United States Patent 7,820,380 (GENETIC POLYMORPHISMS ASSOCIATED WITH LIVER FIBROSIS) - sequence listing, part 2

SEQ ID NO: 5027 - DNA, 100000 bp, Homo sapiens
  misc_feature 19767, 19768, 19769, 19770, 19771, 19772, 19773, 19774, 19775,19776, 19777, 19778, 19779, 19780, 19781, 19782, 19783,19784, 19785, 19786, 19787, 19788, 19789, 19790, 19791,19792, 19793, 19794, 19795, 19796, 19797, 19798, 19799: n = A,T,C or G
  misc_feature 19800, 19801, 19802, 19803, 19804, 19805, 19806, 19807, 19808,19809, 19810, 19811, 19812, 19813, 19814, 19815, 19816,19817, 19818, 19819, 19820, 19821, 19822, 19823, 19824,19825, 19826, 19827, 19828, 19829, 19830, 19831, 19832: n = A,T,C or G
  misc_feature 19833, 19834, 19835, 19836, 19837, 19838, 19839, 19840, 19841,19842, 19843, 19844, 19845, 19846, 19847, 19848, 19849,19850, 19851, 19852, 19853, 19854, 19855, 19856, 19857,19858, 19859, 19860, 19861, 19862, 19863, 19864, 19865: n = A,T,C or G
  misc_feature 19866, 19867, 19868, 19869, 19870, 19871, 19872, 19873, 19874,19875, 19876, 19877, 19878, 19879, 19880, 19881, 19882,19883, 19884, 19885, 19886, 19887, 19888, 19889, 19890,19891, 19892, 19893, 19894, 19895, 19896, 19897, 19898: n = A,T,C or G
  misc_feature 19899, 19900, 19901, 19902, 19903, 19904, 19905, 19906, 19907,19908, 19909, 19910, 19911, 19912, 19913, 19914, 19915,19916, 19917, 19918, 19919, 19920, 19921, 19922, 19923,19924, 19925, 19926, 19927, 19928, 19929, 19930, 19931: n = A,T,C or G
  misc_feature 19932, 19933, 19934, 19935, 19936, 19937, 19938, 19939, 19940,19941, 19942, 19943, 19944, 19945, 19946, 19947, 19948,19949, 19950, 19951, 19952, 19953, 19954, 19955, 19956,19957, 19958, 19959, 19960, 19961, 19962, 19963, 19964: n = A,T,C or G
ctgaggcaggagaattgcttgaacccaggaggctgaggttgtagtgagccgagatcatgcactgcactccacgcctaggcaacagagtgagactccgtctcaaaaaaaaaaaaaaaaaccactttttaaaaaaataagagctcatggtacctatttgcatccagtacatcattgaagttgtagaaagctgcttagttaaagtgaggttgggtcacttcgaagcagtcctccagtttctaagcaagtaagttttggaggtagaaagaaaatgttctcctttatcctagaggctcgatgtggtatggtgggcccgggtcattgatttgctttgtccttaattggttgctcctacctacagaagtgaaatgggtgttctgatggggggtggtgggtggtgacttgagaaggtccggagcctgaagtgggatgaatgaagagcacagaggctcgttgggaggcgaggataaggggggcagaggccagatcccacaggccaggagaggctggaactaagggcttgggcttgacaccgttacagcaggggcctaacacattctattaggttgatgcaaaagtaattgcggtttttgcattaatgtgttaattgccattaaatgttaatttgcaccaaatacctgtctggaccctcgtgtcctccttgtaaatggtgtggtctgggtgcctccatgttgaaacattcgataaaaaggatgatgtccccatctcaagtgctgggctgtgtgtacatcttccctctgcctctcccccaggcctccaccgctatgtctggctggtttacgagcaggacaggccgctaaagtgtgacagcccatcctcagcaaccgatctggagaccaccgtggcaaattcaaggtggcgtccttcgtaaaaagtatgagctcagggccccggtggctggcacgtgttaccaggccgagtgggatactatgtgcccaaactgtacgagcagctgtctgggaagtagggggttagcttggggaccgaactgtcctggaggccccaagccatgttccccagttcagtgttgcatgtataatagattctcctcttcctgccccccttggcatgggtgagacctgaccagtcagatggtagttgaggtgacttttcctgctgcctggcctttataattttactcactcactctgatttatgttttatcaaatttgaacttcattttggggggtattttggtactgtgatggggtcatcaaattataatctgaaaatagcaacccagaatgtaaaaaagaaaaaactggggggaaaaagaccagtctacagtgatagagcaaagcatcaaagaatctttaaggaaggtttaaaaaaaaaaaaaaaaaaaagattggttgcctctgcctttgtgatcctgagtccagaatggtacacaatgtgttttatggtgatgtcactcacctagacaaccagaggctggcattgaggctaacctccaaacagtgcatctcagatgcctcagtaggcatcagtatgtcactctggtccctttaaagagaatcctggaagaagcaggagggagggtggctttgctgttgttgggacatggcaatctagccggcagcagcgctcgctgacagcttgggaggaaacctgagatctgtgttttttaaattatcgttcttcatgggggtaagaaaagctggtctggagttgctgaatgttgcattaattggctgtttgcttgtagttgaataaaaatagaaacctgaatgaaggaactgagtccccggagttttgttctattgggtataggtttcataagtgtgagaagtcaagtctcagggtgagtctctccgtgaccagcaagtaacagctgggacttgttctaggggccatatggagggtctgtcctctacatgtgccattaacccacagcaggagcaaacagttcagatttgaggtttctaaaaaaaaatcataaaatgtgaggccgagtcttattgcccaaaaagcacctttgcttcaagggtccttttgacccaagaaggatgttctaaagaagatggctgaaaaccttcccccttgggaagtctggcgcggacactgtaacaatgcctaagaagtagcctgcacttcccgttctgagtgttatccacagaggctcagtaccaaagaggtgcgcagggtaggagggtgagaaggtccggtctcatgccatctgatgtaccgaaagaaaggaaaggaggtgtttgaaggtgcaaatactgtgatttggtctctgcgatgcaaaggggggggtcctgaatcaggcctgacaggtgcaatgactagcccttccccatctttcactgcagtacttttttctctgaaaaaacttggaatgttgccttgctggaagcacataaggtagatgtaagttttctttttttctttttttaattttttgagatggagtctcaccctgtcacccaggctggaacgcagtggaataatctcggccaccgcaacctccacctcctgggtgggttcaagtgattctcttgcctcagcctcctgagagctgggattacaggcatgcaccactatgcccagctaattttgtatttttagtagaaaagggttttgccatgttggccaggcggctctcaaactcctgacctcctgaccactttggcccccaaagtgctgggattacaggcatgagccaccatgccaagcctggaagtttttttttttttttttttttttttactttagagttctaaaattcgtttttttacgtaataagattttgtgaacacaagttacaaagaaaacaactgtcagctgggcgccgtggctcacgcctgtaatccagcactttgagaggccgaggtgggtggatgaactgaggtcaggagttcaagaccagctggccaacatggtaaaacaccatccctactaaaaatacaaaaattagctggacatggtgcgggcgcttgtaatcccagctactagggaggctaaggcaggagaatcgcttgagcctggaggcgaggttgcagtgagctgtgatcgcgccattgcacttaagcctgggtgacaagagcaaactctgtctcgaaaaaaaaaaaaactgtcctgttgaccttggaaataaatgtaaagttgggcatggagactcacacctgtaatcccagcactttgtgaggccaaggtggggcagataccagcctgggcaacatggcaaaacccctctctctctaaaaaaatgcaaaaattagcccatgtgtggactcgttcctgtagtcccagctactagggaggctgaggtgggaggatcactgaggtcaggaggtcaaggctgcagtaattccagctacttgggaggtggaggcagaagaatgcttaaacctgggaggtggaggatgcagtgagccaacatcacgccactgcactccaactgggtgacagagcgacactccatctaaaaaaaaaatagaaaaagaaaaacatattaatataacacggaactaaagagaaaaaaaaatacatatatatgagaaggcagtagtcatctaaaaagaagggtgatgccttcaactggtatgtgatgtgaacttccccaagggcggctaggagggggtgacccccattctgaactcaactctggcctcaaggtccagctgataaccaccggcccactgggtcacaaattccagcttcctcatttgaaaaaacatcagggttgcagggggtgtcagcctgccttatttacctcacagcgttgttggaggacaaaatcatcttttttgggataagagttaatgtatgtaaatgactaaacttggcctgattgtcatataagaacaaagtaaaaagtccagtttcctcaggtctgtttcctcactgcagcctccgcctcctgggttcaaggattctcccgcctcagccttcctagtccccctgccttccttactgcctcctcaggcaggactaggaggagtaggacaactctgtccatagcaggtgtttgttaggagcagggacccactccctgcttccgggtaactgccctgggacacatccttgacaaacttgcgcagtgggactttttttgagaccgagtctcattctgttgctcaggctggagtgcagtggtgccatcttggtcactgcagtctccgcctcccgggttcaagcgattctcctgcctcagcctcccgagtagtgggattataggcgcccaccaccacgcccggctgatttttgtatttttagtagagacgggtttcaccatgttggccaggctgatctcaaactcctgacctcagatgatccacccacctgatctcccaaagtgctgggattacagctgtgagccaccgagaccttttctaaagatagccctacaatctcagacatagggccctttcccaaactagctagacatttctcaccacagtggaaatggatgaaagaggctacaggaagcttttctaccctactgaaggtggaatactccttgggtatagatcagacaggtctcgattcagaccccaccctgccactggagtgagcttattcttcatttgtgaaagcctagtgttccatcatgtggcaagcgtaagcacgccatcgacgtatctgtttctctaaccctttccagtattattttcagatgtacctaatatagaaactccatgaacagaggtacttaggaaacacaattatcactgagtgtgatgttacagaaggtttttagttgggattaacccatgttgataattatttatgagtatacctttctgctttagcctacagagtgaacatgactggtcacatttgtctccgatacatgaacatcctgtaggaaacaaagtgatctttaggtcatcatattcttttcttttgaaacagagtttcactgttgttgcccggctggagtgcagtggtgccatcttggctcactgcaacctccgcctcccacgttcaagcattctcctgcctcagcctcccgagtaggtgggattacaggtgcccgccaccacacccagtaatttttgtatttttagtagagatggggtttcaccatgttggccaggctggtcttgaatcctgacctcaggtgatccacccacctcagccttccaaagtgctgggcccaccccacgtatcatactctaaagagcaatttccaggagtgtccaagggagagaacacaagtcatgggtcttagtttctgtttctggttgggccagtaaagccccttcctcgtcccccttttccattttcactagacacagaaaccaaaaaccatagcttcaggctgccaaaagcctagaacaaaacaaacagagtaacaacaaaataaggtgggttggacaagcctgattgatagaggcttaagctttgggatcttactgagattgtcctgactcccaaatcatatccctgaaattttatatttttactatctcattgttttacatgtaaaattattctaataaaagcagaatatgaggggaggggatctaatattacagtggggtcatttcaaatatttggttatagtgccttctccacagctgcttttctttaagggtgcccaatttctctcttcagcaatgcatgcttctatgcacgatggcacgtggggggttttgtgtgtgtgtgtgtgtgtgtgtgtgcgcgcgtgcgcgcgcaatgccttctattctttaggacagaaaggtgcagttgaccacgtgcccacatcgaatggtcaacactatcttcagccccatagaagaacttggaagacagagctttacctgaaaggcttaatggctcttcttggagcgaccgaggctatggagaacagtttcaggagggtggctgtcctctgagttgtgaactggtgaacctagaagggaaacttcctgctacaataacacagcaagcgatgtgatgaacacttttatttacaaatataattaaaagctctgacagttatcatgctttccttggaacctgaaaaatgttttgttttgtttttaaagtgcatgcaaaagaagtaaacctttttttttttcatcattttttattgtaagaaaatacacagtttgaaagtgtgaatatgcaatatttatgaccaagaaatgggacttaggaaggggaagggagataaagaaaaagacaagatgatctgattgagagacagtgttgaactccaaatactgaactggaaaaggagggggtggggaggaacaggaggaggaagtaaaaaaatttgatcagagaaacagttaaaatacatatgaaaataagtaatacctctccttaaattccttctatacacaaaatacacgatttgcaaagcccaatttgtgctactgggattctgtgagctccttaagtgtattcacatcctctcaacagcagaaaatgattatgatacaatcagaatatgctgaagacaagttaaactcttgcagcaggttcttaaaaatcacaagatctcttcaccccacccaccccccgtccccaaaaagtaataatatgtcaccactgatatgtacatcacaattagtttctgtaaaatgtatcaaatttcaatctttaataaaactttgttttttttattcctgatgaataaataccaaaaaaataaataaaataaaataatgcagcagctagttaaggtgtaaggctgcggatattgtgtctcctcccccttggcatttattattattattttttgctttactttcacagattggtggtaatagtgattgcttaaagcaatatacatccactttttttgttgttggtttattggttttgttaaactgtctccaaagttttcactgaaacattttgaatcacatcaatactgtgacgtgtatgtgaatagaagagacggccaggttttggccagcactgaaagttgacacggggggaggagggggcccctgatggagtaagaataaacaggcactagtccgacacgatgtcagtaagagaagagagagagagagtgagagcaacgcccgttaaaatggggaatgtggttttgcagggttgaatttttttctgttttcttttttttttttttttttgtaaatggcaaaaaatttaatccatctgtagtcctccttaggaaaatctaatgtaaccaaattcccaaatcccattctgagctctccatgtcaaaagtttcaatctctcgctcttgcctttccaataggttctttattcttcgctgcgttccttctgaagggcagccagctcctcttcaatctgaaagaagcacgatgcgttcttaatggaaagcatctcctaacaggcacccacgtgcacgcgatacacccataggccacatatgacatgcacacacacataggcacacacatgaagtgcgcgcgcgcgcacacaccacacacacacacacacacacaggaactacgggaggaccgaggaaggctggctgagtccgtgatcaatgcatctaaatcattatatttaaaacttgctcacaagaatatcaatgtttgggtccacctggggctggcaatgccgttctagcaagcccagcggctgggcggatctaggtagtgtcctgtgttaggggatggctcatgagaagctaaaagacactcaagcacaattggatgtgctgctttcccacagagagccaaatgcctcctgggtcattagtaatttagttctagacaggagctgggaaaatagtctgttacgttggtctcagggaactactggaagaaagtgcaataactggttaagcaaataaatgcttaacagctttgagatgccttatgaaatgttttcacttcatattcctcagaatttctaaagcaatgaatatttcagttgggataacatttatgatggcaatatcagcctatcatcattttaatttttttttaaacagccctgctggtgattttctcggtttaaaaatagctgaaaagtcaaatctattgtacatttggcttcctcgtgccattggcagccctgctgtcagctcacagtacctttcaggtgtcacatcaaccaccccagcacccacatcattcctctggctgggaacgttgagggtttcctagcagagcagaagaaagactaggatgtggggtcagacatgcgtgccttggtgtttcggcctgtagaagggggacaatgctacctcacaagggtaccagtagcataaagcagataagtgaaaagtgcccagtttaatcctaactaaggaaggctgcatatatggcagttccctcagccacgcccccttccacccagtgcaccggacccctggtaatgctcccttaccttctgctcaaggtgtgctctgcgcagagaactctctgctctagcttctggagctcacgttcatgttgtgcctctgtttgcatcttgatttgctctggtaggcgttgagcagctccatttcctgctggagctgtagcctcaaggcctgcattctgcttcttgagcctcatctagccgtaactgcggacacagaagacacacacggtctgcacccttgcctacagcccttggtggcctacagcccttggtgactactggaagaggttcctcatttggattgaaattggttgccccctcaaaaacacagatgctctgggtacattcaagttgggaatcaaaaacagtcaagtctgcccaatgggctacaataccaaacacattctttcagtatgatctgaaaccacagcagcaggcgtcaggaaggctacacctgtgggctttggggtaggctcctgggcttgaattacagctacaccatccactttgtgtgtgtcacaccttgcacattacctacctctctagatctcatgtgtttcatcctcaagaaaataacaagaatagtcctattgcctgagattggtgggaggattaaatgaaagaattaatataaaatcctaggccagttctcaatgcattacaagttttcaataaatagtagtggttatcattatttcggtttaactgatcatgtccttatttcaagttctttaaccctaaaatcatttagatatgcttagcctaaaaaattgattccaatttccataaaacttggggaatataccacagtactgttatgcccaagtagtaatgttggcacctattgttggctataaaagttacattgctagccagccaaccaaaactccaaatggttcaaaatctcttccctggctggtggctcacctctgttatctcgcgctttgggaggccagggtgtgaggattgcttgaggcctggcattcaatactagcttggaaatattgtgagacccccatctatacaaagattttttaaaaaattagccaggcatggtgcatgtgcctgtagtcccagctactttgggaggctgaggcagaagaatctcttgaacccggagttcgaggctgcagtgggctatgatcacaccaatgcactccagcttggcagacagaactttgtctcataaaaaaaaaatctcttcctctcagagggtaggtaggcttgacaatttaagaggcataactgctttgaagcagtgcctgaactttgtcttatacaagatacccagatctgcgtggagaatgaaccaagtagaagcgccaacttctcaaagcagagtagaaggtttcgaccatcagcaggacagtgtttaggaatgatgaccctgggttgcaggcttggtttggtcaattttggcaggcccacagtttggctgagaactatgagattagaacccttgaatcagtcatttaccctgagcttatctgtgtttccttattgaccacttttccaagatacttattctcaccttatgtacaatttgtgacaatatacatatcttgattgaaaaattactttttgaaatttatattaaaatagttttagttatttgcatgtatcttcttttagtacttctggagaaactactatagagattaaaggaacaaaataaattacataatcatatttccaaggtaccttctaaaattaatcctaaccaggtttcattaaaacccttaaagaggacagacagttctcatttcccagtaaggaatgaagggataagagacactagacacaatacatagtctttggcaggaaagactcacaggtaaatgccaaaggatttactggctcccaatgagggttgttactgattcctcttgatatgggaggttccttatcagtaaaggcagtgaaagtcctgttcttttctactgtctgcattagttgctgtaagccccagctaagtgggtgagaggttcattctatggtcaattagaccatctaaacatctaaatatctttaaacatttagaacatctccatttccttttgttctggcacgctattattattagcagtaactggtaccattgttctgtaccagctctgacgatggcccagtgctagaaatcagaggatattccagcatttagtttttatcacccaaggtacacacatcaaatccattaaaaagttgttttttcgtggtttttgagacagtctcactcattgcccaggctgagtgcagtgatgtgatctcagctcactgcaacctccttctcccaggtcaagtgattctcctgcctcatcctcccgagtagctgagattacaggtaagtgccaccagcccagctaattttttgtatttttaatagagatggcatttcaccatgttggccaggctggctcaaactcctgaactcaggtgatccgcctgccttggcctcccaaaatactgggattatggtgtgagccaccgtgcccagctccattaaaaagttttataagagtataggtaaatatgctgatctttacagtggcttacactgaagatacgataagaggcaacataatgtagaagcaccaagcatacaggcgcacaggattccccccaagatgggttcaaatcctagctctaccacaattagctatgtgaccttcccccttatccccccaagccagtggttggcacactacagccatgggccaaatctagcctggtgcctggttttgtaaatatatatatatatatttttttgaatggagtctcactctgtcaccaggctagagtgctgtggtgtgatctcagctcactgcaactccgactccctggttgaagcgattctcctgcctcagcctcctgagtagctgggattacggcacgtgccaccatgcctagctaatttttgtatttttagcagagatgaggtttcaccagttggccaggctggtctcgaactcctgacttccggtgatccacccgcctcagcctcccaattgctgggattacaggcatgagccgcttcgcccagccataaataaagttttattggacttgataatactcattaatttatgttttgtctatggctgcatttgtgctacaatggcaaactgagtagctgtgacagagaccctgtggtccacaaagctaattactatctgtccctttaagacaaagtttgccaactcctgtcctaagaaagtagctttacttcagtgaacttcagttcctcacaggtaaattagggtcaaaacagtaactacttcaaaggggtttcacaaaaatgaatgaggtaacacttatgagatgtttaacattgattgtacttgccacatggtaagtagtcgtaaaggatgctgtaatgatcacacacttatcttctccctgtctcagaagaaagggcattctctccttttattcaagggtaatcattgacctgtatttctgatcctgttctctctcatttatttattttttttaagagtcccagtcttgttctgttgctcaggctggagtgcagtgggtgatcatagctcactgcagccttgaactcctgggcttgagtgatcctcctgcttcagctcccaagttactgggactacaggcatgtgccaccatgcctggctaatttttgtatttttgtaaagacagggtcttgctatgttgcctaggctggccaagaattcttggcctcaagtgaccttcccacaaagtgctgggattacaggcgtgagccaccgcgcctggtctctcccatttatataacaaacattcattgaacgcttgttgtatgccacacattgttgcagaggctgagctataaagattaacaagacaaaaaccctatcaacctccatgtgtctatcaacttcttcctctctttgcctttcatctccctctgcaaacctttcctcgcactcattctgatcctaacccctacttctaccgctcacattaaggtgacccatgatagcctggaagtggcctgttacctgccttccagcagcatttggtattgctgactgccccttccttcttgaaatctttgtcttctagataccacaacttcttggtttttgtcttccctctctgactattccctttccagtagtcttacctacctggtccttaaatgtgggtgttcttaagggctttgtcctgggccctcttctcctctaaccgctcttcctaagaatctcatctatttcaaaagcctcaattaccatctacaatgtacaaatgactcccacactaaacctctatttcagactttccttctgaggtccagacagctcctgtagtctaccagagacatcctcctctggatgtttcccaggctctcaggctcccgcagccaatacatcaccttttccttcccacaccccaatctgttccacttccttttttacatataggtaaatacaggtagaccatcatctactgctttatttttgttttttttttagaggagtctcactctgtcacccaggctggagtgcagtggcgtgatctcggctcactgcaactctgctgcctcctgggtccaagcgattctcccgcctcagtctcccaagtagctgggattcacaagtgtgtgccaccaagcccaactgatttttgtatttttagtagagacagggttttccacactggccaggctggtctcgaactcctgacctcaggtgatctgcctgcctcggcctccaaagtgctaggattacaggcatgagccaccatgcctggcccatcatctactgttttgtcaaaccagagactggaagtcatcctgaacactggactctccacatccaacctgtcattagtactctcaattctacctcccaccaaatttagtaacttcccccttcatcccgactgcccttttctagtctggctaccactccctcataccccaggtaaaagtcacttcacaaatcattcctaatatccattcttcccatctcccaggccattctccatgtcaccagagtgatggttaaaaacacaaatctgatgtcacaccctgcttaataccctccagtggcttttcattgtttggataaagacaaaaattcttaacaaagcctgaaagcccctacgtgacccagcctgtttaccctccagtcttgttctcatgttagtcctctcctagttccctacatcccaaacataataatttctgtgaattcttccaaagtgccactgccttcccaatgttcacacgttcctcatgttaggttcctcagcctacatagccattgtgccagggaggcctctcctgactctccagaccggtgagctctcctgctttgcagtctgttggcaccttgctcttgctctgacattacacgggtagacttttccaatgtctgtttcctccatgcttccataaactccataaagacgtgattatgactgtcttatccaccactgtatctccagatgcctggtacatcacgtaggcactcaagaatacttgctggatggatgaatagatgaatgcactagctcccatcctcggcctaagaaatgcatgcttaagcatctcccaactaacagaagtctttcttcaactctctctccttttgtaaagctcttgttctcttttccttcattgatgaggatctgggaaaagcagtctcacttacatctggatttcactttataatccctcattcaatgctctataatgtctcccagtcccacactccactgattgtccgagacaagcaatggacgaatccagtgctaggtccaatgaacactcaaagtttattcttctaattgatctctgcaacatgtgacgctgtcagttagaaactccgctctggctcctgtgacatgctctcttcgggttcccttcctgtgtctctgattattcactttgttctacttctacctcagccctcaaatgttgatgtctaccagactctgtccttagtctttcctctctaagaatacctcccgtccccagcagatctcatccattcctaccagccacagtgcacacatataacaatgaagtctagctttctgcctttaatcttgacatccctcctaactgcaggtttccattatctgtacctctctacctggtcacccacaaaacgcagacaccagtctacaacttagtcaattatccttgcaggcatccaaactcactcttttattgttctagttggtaagataatgacctattctactctgttgtcaaacctctcaaattggtcactaagtatttctattcttgcctcctaaatatttcttaaaaccttccccactcctctccatctccatagcatgttctctcatcacctttttcctgaactattataatggcttcctaacaggtctcttacctatatttgccacatttctgctaatatctttctgtaacacaaatctgatccagtttgctttccttcttaaaacacggttcaacagctctccattgcttacaaaataacattcaactcctggcttctgaggctctgaccctgactatcctcccgctttccctcaacaagcatccatactcttgccatagcaattactcattgtttctcaaatgtgccatcctctttcacgtcttaagtctttgcatatactgtatcctctgtcaggaacaactttttcttttatgcctatttgtaaactattactctttaagactcatctccttgggaaagcttcaccgaattaccaggcagctcccatcccaagctccctttatgacctctccattctgggttcctgcaatcttcctcctgaactttgggctcacaccaaagttctttctgtctccatatattttcctctgtttgaactttgcctatgtaggtcccagtttcaaggaatcggtttatgtcaatgaattccttaaagttcttggctccctctaggaagatttccctagacgagcttagttagtcctacttgttctccctaacccccagtacctcccatttcaaatcactcactttttttttttttttgagacagagcttgctctgtcacccaggctggagtgcagtgatgtgatctcagctcactgcaacctccactcccgggttcaagtgattctcctgcctcagcctcctgagtagctgggactacaggtgctgcccagctaatttttgtacttttggtagagatggggtttcaccatgttggtcagcctgtttcgaactcctgaccttgtgatccacctgcctcggcctcccaaaatgctgggattacagcgtgagccaccgcgcccggccccacttaccatgttttactattactgcttaattatctaccacctggcttgactgacaaattgtctgtctagctcatcctccacctctgagtccagcgagtgctgaacactgatgcttaataaaagtttattgcatgagtgtgtctgtgtatctgtttcctcacttgactgtgggctccctaagggcagggactcttattcatttgtgcctgatatagttgcggggagggcagtcagtaaaatctttgataaatgaacacatggtatcatatgtgtatctatcacatttgccctcaaagtccctatgtgccacaggtctgatgtggcatgtcatccttgagttccatcttataagacactccagcaagtatccacattggcttggctttattaacgtcgtcctttcctcagtcctttgggcagaaaaacatcaatatcctaaatttgtgcagaatcatcttgggaacaacaggctggatcttggattttcttgattcccaaagctctcgagccgtggcaccaaacctaaccacttaccgcttgagaggccatcatttcatttatactctttcatactgctctgccaaaatggcaagttttcttgtctgctcatctttcagtgtctttagattgttttgtgctcattctttggagtaacttccaactggtgattcttgagtgctttatctgtttggtctgtactttgcaagtgtcctgaaactgttttttaatttgcatttccatggctgggtagaaaaagtgacaaaggaaaaataaaggcacatcagtaaatacagaaagcctttaccataatgatataatacaagtgctgagagcgtctgttttttggtgcagtgactcacatgctaatcaataaaaatcaagcagtatgtatgacacagacaaaagttaactctacctgtcttttggttttatattgaatgactataagtaattttgaatttacaaatggggtcaaagaaatatggactgttacaaggggatgacaactctaagcagattgagcgatactatgaagctagcttgttgaaagagtggcaactcttttcatgctttcctagtcagacacttcagtgtctccattgttcattgtttttcccccctttttttttgtttctgtgtttcaccctgttttcaatgagacaggggatagcattatataagccagctctcactgctctggtttatagcaatttctatcaactccataaaggagagtatatggatggtaccttatatcctaacgcatttctactgatttcagcgtaaactgagagagaaaagtgatttagaatttttttccccattaagaggtgtgcttgcatgtagcaatataaaatatgcatttgggcaaagagaaggtagagtatattatttgagcccagaaggcattccatcaggttgccccacagtcatgtgtgcacttcacgaacctctgaggacttatggtgatagaaatcattgcttagcttaggatttgactgaagagacgatagccagtgtgatccaggttggcctcatatctgtggcaacactgacaacgtcctcccgatatatagcaatggcttagtacacagagcttgttaattagcagtcagctaaaattagctgaggcagtgagggctacaggagttcctccacatctctgcatctctagtgcagaagtggtaatgcctggcacttatagattcattcctgatgaccatgacagacatcactaataaatgaactctttcctcctaagcttggatgtggctttagagtctttctcaatacagcagtgctcaagtacctaacaccaatagaacttccttatttcctgggattaaaaccataaactgctattgtccagttttgaagatggcaggtcatgaagtgctcagagaaattccataatggatatgagacaaattgatagataatgtagtataataatagtttccaaaccagcttgcccaacatctcttttcaggagcttaaatatagactctgtgctttgcaactggagattctgatacaatagtgtggggtgcagaaatttgtgattctgaaaagttgctcaggtgactctgacacttcaggagagaaaccactgatctggtccaacactgtccagcagcacaaatcttacctttaagtttttggctgttgccgaagttccatgacatgctttctgtgcagttctctttctcgcctcttatgtactccagctggttttccagttccgtctggtgctgtaaacggatcagatccatgcgtgcttctgtaacgtgtgcagctgcctgtactctagctctcgggtggactcgtcgtgccggttagcatggcatgctccatctccttctgggtcctctttttatttagttcctgcgtccagaacaaaagataaacggagagaggtgaatggagatgaactggaaggaatgcacaactaaggagggagggcaaggaatggcactgctaaccatctcttaattaaacccattagtgtttggagcaggacttaatgagattaaattaacaatctcttcaggtttaggttctgttcctgggtcaccacttacaaaatgggcaacttcacagcaatcactactgtactctctgtaaaatgggttaattctacctgactctctcttacctcacagagctgctgtgaaccttagttaggtgattgctatgcataggtctacataaatgtttcttcagtgaagctagtggtcctacaccctgaggcccataaaaatcatgtgaggaaacttttcaaacataagatgcttgaatctcacaggggaaattcttataactgtctggggtgggagcctgatgtcagtattgggaagagttctccagtggtgccaataagcaatcaagattgagaattaaactgataatatctgcaatgttcttactttctgggaaatactctgtttttgcatgaatcagaggtaggccaattgtctattttttaaatctcagagttcaaggcatgttggggaaaaaaaaacagatgagatctctcccctttctcttctgcattacagtctgtttgatcatttatagatctaatcactctgttcttttccgtctactcatgtctttctttcttccttttctttctttctttctttggtattgaaggaggaaggaaagcaaactagaaaaaaggggaagttgggtgaaatcttttcattcctcaattgaagatatttcctaaatagcactatatatgaagatcagaacaatgtgctctcagtacataaaatatttattaaaccatgacttctgtcctcaactcactgacactccaacagggaagtgcacagacatttattgaagtatatgctctgctcaaagctcactgaatcagatttagatacgtgcccaacctgggtcaatttattttctctactcggaatttggaattgatattcagaaccagtaatctctatgtgtggctggaattaaggcatataaaaaccacatatgtggtagtcatctctgctatgagggctgaggattagagaaagctgggcttcagatcaagaagaaaggaaaagaagaagtgcagggaatatactgatgcctaagttacttactgcttctgagccctccagtagtctagctgtattactgctattcgattttataagacattcctgtatttctatagtaattccctggttttggcttaagctagctgaaataaatttcagttaacatgcaaacaaaaaaatttaattaatacagggacatactttttttttggggggggtgggggaactccacgcgtccatcatccactggaggccatactttatgactatggccaccattttgagtttttgtaacattagatatttggaaatttcatgaactctaccttctagaagattttcccacagaacagcattaagagtccccactcagtcctcaagcatacgtcaatttttggctcaccatactcagacttagtgccaaagcccacaggcctacacttctgtctttgaacatgctcatgaaaaaaaaaaaaagccagaagccaatttgagataaccccactagaccattctatgcaaaagctaatattatttttctgaagtaaagcttagttcagactatttaaagtggcatatatatttagatattttatacttacagatattgtccttggaatgacaaaaaaattttttcattatcaccacttttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgccccgcccaccccaccccgtgtccctccctcacgaactaacacaacaccgacccgttgcgcttgacacggccggcgcaacacgcttatctacttttctcgccgccacactcggtttgtggccccaacacctccccccgcgcttgatcatatactcgtctccccctcgcgttcctccttgtcggtgaggtcccccctcgatttaggcgtaaccaagggatcacaccaccctccccgattggtgtgctttccccgctccgcccacataccacacctacacctttgtagtgggtattcgctcgggcggggacactcgccctgcttcttcgtgcctcttccgcccccgcatcacgttgcctcctccgcgggggcaaccatccagcaccaccagccccctatggatcccctactactaccatctccatactgcgtggatctggtgggcccataacatgggatgcagtatcgacacacgctccaatgtagatgatccttgagacattgcgccaagtgaaagaagccagtcacaacatatattgcctgcttcctctcccacgcatgtctgaaataggcaaacccttcgagacagaaagtagattcatgataaaaagaggttgctgcaatcccagcactttgggaggccgaggcgggtggatcacgaggtcaggagatcgagacatcctggctaacatggtgaaaccccgtctccacttaaaaatacaaaaaaaaaattagcgggcctggtggcgggcacctgtagtcccagctactcggaaggctgaggcaggagaatgggtgaacccgggaggcgtagcttgcagggagccaagatcgcgccactgcactccagcctggggacagagcgagactccgtctcaaaaaaaacagaaaaacaacaacgaaacaaacaaacacccaaagaacgtcaaggaaaggagaaagcttttgagctgtactttatttatacttattattaaatttttgagacggagtttctactttgttgcccaggctggagtgcaatggtgcgacttggcttgctgcaacctccgcctccagggttcaagcaattctcccgcctcagcctcccagtagctgggattacaggtgcccaccaccacgcctggctaatttttgtatttttagtatgatggggtttcaccatgttggccaggctgttctcaaactcctgaccgcaggtgatccaccgcctcggcctttcaaagtgctgggactacaggcgtgagccaccatgccccagcctcagtgtactttaaattagaacaatagagggcctctcttctctgatggcatccactataggagaaatgcaaattatttattttaatagatatcatcgataacatttttatactggcgtggttgaaatatcttgcacacttgggctccctattgattgaagagaaatccttttaatagcacacatctagtactagagtacagtcactaatcattcacttattcattcaacaagtagttattagcacctactatgtgctgggcactgttgtaggaactagggatagaacagtgaacatgtaaccccctcagcgaccttataaggagaaaaaacccaaagtataaatacaatttaaatttgtttaaggaataaaaaataagcccttagagttatctctctcatctcctcccgtgttttccttgttttatttttcttctttacctagaccatcaaatttcttttttacaaagcagtaactgcccgtaggtggcaccaaaggatggagagcccttcccacagacgaaagctctcccaggcaaggaaagccctttaaatgaggactttaattgaggtccaggagtcccaacaccaggcattattcatcccacactttcctaaattgagaaatgcaaactgagcctgagttgctaagagcctgaaactcatgggctcttgacacaaagcaaaacacacaaagcaagcaaacaccttcagagaaatcaagtgcttctcttcctgcttaatgaaatgcttcaagatactgtccacagaatcctacatccgaattacctgtgttataagggactagtctctataacaagctacgcagctattctgatatatatgaaagtttgagaatcaatggaaaagtgctaagggtgtgagtcagttcagctcctctataagtcttatgtatggcttggggcaagtctcttaatctgtatttcagggtaaaatgaggatagcagtacacattgtgaactatcgtagttgtaaagataaaatgaaaaccataagaaagtgcttcagaatacataaatgtcattatttttctctattcagaagggatacatggcatataatatcttaaatctagtttttataaactattagaagagtaagaaaaaatgatactgaaatggcttttctgttacaagttgttcccttcacctttaatttgtacatcgagttgctgaggtgtaagatggtaagctacctttaatatttgagacatgggggaaaaatattcaccttattatgaggccagtgctgtgcctacataataatgtttaatgtgctttccattttaaaagttattccatacatctcattcaatccaaattgccaccctatgaggtgataaactgtaaggatttcccccttttatatgtgttagtaggcatttgggagttgaaggactaaataaagttacacaacttctataaagagaactgaggctaaaactcaggtatttagcttctagcattttccattagaaatgttccaataaatgaggccagacgcggtggctcatgcctatatcccagcactttgggaggctgagacaggtggatcagctgaggtcaggagttcgagatcgcctggccaacgtggttaaaccctgtctctaccaaaaatacaaaattagccaggtgtggggcacatgcctgtaatcccagctacttgggaggctgaggcaggagaatcacttgaactcggaggcggaggttgcagtgagctgagactgcgccattgcattccagcctgggcaacaaggcgaaactccgtctcaaaaaaaaaaaaaaaaagttctaataaatggcatactttcctgtttatactttttcagtctgtgataaaatattttgaagaattctgctctagctagacatgaacaatggttactttatttgtacaaatgacacaatatacacactagagccacatcatgtgacctttagcttatacaaatttaacaaaatgagctgagcaaaaactaaaaaatcagttttatggtacagatcattctgcccacccatgtactcaatgtatgtgtgtgtgtgtgtatataatatatacacacacacacacacatacacacacacacacacacacacacacacacgtatagccctggagggagtgtgggataagatacatgcagcttcctttccctcggtcaatgtccatgtgtttcaagcactctaacttctaatggaagtagtattgacttctttaaaagcagcggtttcactcatgccaaatttttatgctcaggctcactgaggttgagtaaaaacgagaatttaacttttaaatagagatgctgtcagcctatgacatttaatgccttcttagtttcagttttagtttcaacactggtcagaaaatgctgagtgtctgtgtgtgttggtgatagagaaagggctcaacccagtttcagtgatcttcttgttttcactaattaaaaggattgctaatactaatcctttaggcaaagacacaggaaaccaggcattcttgtgctttgttggtgggagtataactcctttagagagcaatttagtgatatttattttaaaaatttagatgtatgcattcttgacccaggaattccacttccgaaaatgtatcccccaaaatacttgtttacatgtaaaatatctatgtacaacaatgttcttatattattaataatactgtaaaacttcaacaaaatgccaccgagaagtgtctcattaaataaatgatattgaggccatacaacaaaatactattaatgaaaaagaatgaagcagagctgtacgtgctggaaggtaaatggaaaaaagagttacaaacagtggagtggacatctgttactttttgtaaggctcagcttccatttttcctgcttcctttataggctcttttttttttttttcctttttttgcaaaatgactcccccttatctggatcagagagagtgttgaataaggcataagcacatgacccaatcaagttctatctctcctggaattttaatctcgaacagaaacgatacaaagacaaaaagtggttggaggaggtacacgaaatggcagtgcctggagaactgcacatgagcccttgctctctgtgtcatggaagttgtttaccagcgtggctcttcatgttttcccgctcagttcttcagctctttacctacctcaatccttccaataaattccttttcagccttaagtcagccagagtttatttctattgcttgaaatcaaataatcctactgatacaaaagtaatctcatttttgtaaagtcatatataataagctgtacatatgtatatagaaaaaaacctagaaatatacatgccaaattaatggagacgtttgagggtagagattgggtggaatgggattgtcgaaaaggtgaagatgggctgatgcggtcaaatggtagaaagttccagttatgcaagacgaataattactggagctctaatgcatcactgcatggtgatgatagttaacaatgttgtattacatgcttgtaatttgctaagagacaagtcctaaattaaatctccctactcaaccccatgcacacatgcacacaaatgtaacatgcggaggtaatggatatgttagttagctttcatgtggtgattatttcacaatgtataatatatcaaaacatcaagttgtataccgtaaatacatacaatttttatatgttgatatccaataaaactgttaaaaagaactttcactacttagctttatgtgtttctgttttcgtctttttcaatgttcttgagttacttttgtaaataaaaaagctttgaacattttcatgaagggggctctggaataagactaaacaaaagaaaatctagacttttaagaaaaatactcttacgagttattttttgctcaactggctagaacctaatactaatgaagtcaccaatatagttttatcatttttagggagtaattatcttctgtaacttttattgacatgaattgtccccttacctcagacttcctccaaatatctattattagaataacaataaatgttacatgaaaagaccccaaatgacttatttccaactggccattagcctttttcattttgattttttgacttctacaaactcaaaatgtgcagtactgaatcagcttgcttgctttccttccttccttccttcttccttccttctctttctttctttctttctatttttttgagacagagtttcactcttgtgcccaggctggagtggaatggcgcgatctcggctcactgcaacctctgcctcccaggttaagtgattctccctcctcagcctcccaagtagctgggattacaggcacccaccaccacattggctaatttttgtatttttagtagagacagggtttcaccatgttggccaggctggtccgaactcctgacctcaggtgacccacctgccttggcctcccaaagtgctgggattacagcgtgagccaccacgcccacccccacccccccccctttttttttaaagacagtctcactcgtcatccaggttggaacgcaatggcatgatctcagcttactgcaagctctgcctcctggttcaagccatcctcccacctcagcctcccgagtagctgggattacaggcgcccaccacccgcctggctaatttttgtagtacagatggggtttcaccatgttggccaggctggtctcgactcctgacctcaagtgatccgcctgcctgagcctcccaaagtgctgggattataggtagagccagcatgcccggcctgagtcagcttcttaccaaaacctctctttaatctcttctcgtttctaccacatcttcatttcccctagtgttaagccctagaaataattttgattccatatcttttctctcatatctttttttttgagacggagtctccctctgtcacccagtctggatgcagtggcgcaatctctgctcactgcaagctccgcctcccgggttcacgccattctccgcctcagcctcccgagtagctgggactacagatgcctgccactgcgcccagccaattttttgaatttttagtagagacggggtttcaccatgttagccaggatggtctccatctcccgcctcgtgatccgcccgcctcggcttcccaaagtgctgggattacaggagtgagccactggcccggcctctctcgtatcttagtatatgtcaagtcctgtttactttaaacttcaaatgtgttttgaatctactgctctgacagccactaccaccagccttgtccatatcctatttccgctactagtctcttctctctaatcctgtgtttctcaagcagtttttttttttcatcattcccctataaggaggctttctaggctttttctcccttaattatccccatcactgaaatataataccacaggtaaactgtgtatctgtttatgcactgtggtcctttgaagctgtaataaacctaggtcaccgcaccccaacaggaacccactttcacccactgggggcgttatcaccccattgagaatctatgttcaaatcattctgtgtattactgtcaatctgggctaatctcttaaagtacaattttagccatatcactgcccttctcaaaaatgtttagcaggctggatgtgtggctcatgcctgtaatctccacactttgggaggctgaggcaggcaggtcacttgagctaagagtttgagaccaacctggacaacatggtaaaacccccacctctactaaaaatataaaattaaccgggcgtggtggtgtgtgcccgtaatcccagctacctggggggctgaagtggaggatcgcttgaacctaggaggtggaggttgcagtgagctgaggttgcgccactgtactcagcctgggcaacagagcgagactctgtctccacaaaaaaatgttcagcagctcacagcctccctcttccaataagacagcatgcagaaagagcctgagcctggcctacatgtgttcatacattttagtttgcttcaccctttttccttctcatttcaatgcagctctctaacaaggtctatcaattcacttttgtattaactgtgctggaagtgcttgtttccctcatgtaggctacactgggcttttctcagactttgatactgttaccactgtgctagatcatttataaagtttctctgcttactccaggtcacaatgattttctgttgaacacagtattctgtattcctctctcagtgaatgccagcatatccatccaacctcccaaattagaaacttggaagtcactttgacttcctcttctgaaattcccatatctatttggtaaggattaactatcagttctgagaagaaatgtcactcagatctaattgcctctatccccacagcctcttccaggctagaactgagaaagagcatcctggctgacctcattgcactttgcttttcatgacttctatctctcttcatactgaagcactaattcttttgtttgtttgtttgtttgtttgagataagtctcacttatcacccaggctggagtgcagtggcacgatcctggctcactgtaacctctgcctcctagctcaagtgattctcctgcctcagtctcctgagtagctgggattataggcgtgcaccacatgcccaggtaatttttgtatttttagtagagacggggtttcaccatgttggccaggttgtctcaaactcctgacctcaagtgatccttctgccttggcctcccaaagtgctgggattcaggcatgagccaccatgcctggctgatgcactaattcttcaaaataaagaaatgtctctcatgtcattaccctgcttaaaaatctctcatggccactgccttcaggctaaaagtcaatgccttgccttaaacaagggtctctacattctgcttccaactaatattgttctgcccgcactctatatacacagaactctggtcacactcatcttttcatcaatagcagagtcatctagccctctcatgattgtatgccaatgatactttatttctatgtctaatatgtcacctaactattgtattgtaattagtctgttacatgtttttttctgctcttagactcatagccatttaaggcagggagtacagcttcttggtatccctggtgtctagcactcactctgagagtactgatgatggaataaatgcacttagttatagagcatcataatgttacttaaatgttttatgggagtcacaaaaatacaagtccttgacaagtaggctgaaaacaaaaattctcgattctattcttttgattcttcattgtgtgatatggcttataacgggagttcaataaaattctattcatgtatttagatggagttgattccttgttctgtgagtgggcttcctcttatcaatagtagttcattccctgactttttttgtatacctactctgtgttagccactgtgctaaaaggcagaaaggctagggatataggaatggaccaggcagacatggtcacaagcctcacatagcaattgtctcctatgtcaatgacaatagttacgagcgtaataaatacctcccgaatgttctctgctccacctcgtgccgcttgatcattattttccgcttgaagaaacgacaatttttgtgtagtacagtctctgttgagtgagaaggtgggcttcctcttcagcctgtgtgtgctgcagttctctttatgtttggagatccgctcttgcttctctttcttgggtgtgctatggtcctattcatttcctaaaaagaacagacaaaaaccaagccagccttactaaatgaaagggacttaacagcttattgcaactgaagattaagttatttggaaagccaatgcagatgtaagcacgaaaagcttagtgttgcacatccttcccccaattttttttatttgctcattaattgagtttaagtgagagggacacttgtgagtttctgtatctttggtttctcactaacagaaattattgttcactcattcactcaacacaaacttaacaagctcctatcatgtgacaggcagtgtcaagatacaggacacaaaggtgagtaaaaggccatgataactgccaccgtgtgtctttatatagaatcaaaaattaaagaaccgcagaaatgaactaaaaattactgtgatcactgcttgaagaggacgtacttggccctagaagaatttaatagaaaatatttaatcttggtagtactaagaaaaattattcagagttaaccagcggaaaaggaaagggaagaatactctcagtaagaaaacagcatgtgcaaaaccctaggggttggagaggaaacatggtgccatcaagggcgaaagaaggtcagaggggctggtgtaacgtaatatgagataagtctggccaggtaggcagaccattgaggctttacaggccaatataaggacactgatctttagtataggagaaatggtttcatgcatgtgagagtgtcataatgagatgcatttgaaaatgattactctggctgcctggggagaacagaatgaaggaggcaagaacatatgaagatagctgggaggctactggaaggtccaggcaagagagatggtagtagcttggacaaaggaagtagtgacaagactgagagagcagacagattccaaagagaagaggtgactatgcaaatgtcactagtttgaattttagaaaaaacattcttcacttgggattatagagtaaacaaaccatctatattttccaaggacaaattcacaatttttccagaacatctgagcaaaggaaacaaagcagtgaatcaggactgtaagatgttaaactgtggtgaaaagaagaagactacttgttaagaaagtacagtatactttctttcttcatttggttagctactcactcagctaaaatctcctttagttgctaacaccattttacttaatgttttgtgatgccgatatcatagactattttatctcttagccaagaatctctgtaaatcaactttcaactatcctgttccagtgaagctgtaagtgaaatcttagatcaacaagagaaagtgttgttttcagagtaagctggagtaagctgggatcacaagaggagcctgggtcattcatctcttcatgccgtgatgtcactacttggttggccattaaccactgactgcagaccccgattcaaatataatcacaaaaatttactccaaaatcaagaataaatatttctggaccatctatcattctgtattagatactcctgttatctatcaaaagtggtgaaatgaaaaaatttttttgtcattccaaggacaatatctgtaagtatataaatatctaaaatatatgccactttaaatagtctgaactaagctttacttcagaaaaagtaatattagctttgcatagaatggtctagtggggttatctcaaattggcttctggcttttttttttttttatgagcatgttcaaagacagaagtgtaggcctgtgggctttggcactcaagtctgagtaggtgagccaaaaattgacgtatgcttgaggactgagtggggactcttaaatgctgttcttgggaaaatcttctagaaggtagagttcatgaaatttccaaatatctcaatgttacaaaactcaaaatggtggccatagtcataaagtatggcctccagtggatgagtggacgcgtgggttagaaataaggaaggtatctatttattttattttacgatttttttttgagacagagtttactctgttgcccaggctggagtgcagtggtgtgatctcggcttactgcaacctctgctcctgtattcaagcaatttgtcctgcctcaacctcctgagtagctgggattacaggcaccgccatcaagctcagctaattttgtatttttatagagatgtcgttttaccatgttggccggctggtcttgaactcctgacctcagttgatccacccaccttggcctcccaaagtgctggattacaggcatgagccaccgtgcccagccaaggaaggtatttagagtggagaaaaacccaaaatttcttaggctatctctgatccagcaacatcatattatgatataaaaattaagccaagccaataactcagagaaaatggaaagaatgtgaaccttctgagttgggctattctcctacacccgggttttctagaccttatggtgtcagagattctacccattcagccagtgtaatcaaatacaattttctgttaggtctaacaattaccagtggcttacctgggcaggacaaaaatccctaggcccaccccaacccccttggtttcacttcctaactaaaaaagaattggagagaaccttgctgagtcctctattgctaacctacaaatcagaatatgagctcaggccagcgtggtggctcacgcctgtaatctcagcactttgggaggctgaggtgaaggattacctgggtcaggagttcaagaccagcctggctaacatggtgaaaccctgtttctactaaaaataaaaaaattagctgggcatggtggtgcacgcctgtaatctcggctacttgggaggctgaacaggagagttgcttgaacccgggaggtggaggttgcagtgagccgagactatgacattgactccagcttgggcaacaagagcgaaactccatctcaaaagaaaaaaaaataaagaatagagctcaaacacatgattttatatatactaaaacaatgcgccatattgaattttattaaccttaatacacttagtaagtctacaaataagaaatactaaggtttatgagaagaaaagtcatggagctgcagacgattcacctgtaagtactggtaaaaggagaactgaagaaatttggctttcagatcaaagtgcagttctttgggaagaactcctaagtccactagtggtcttcaccaaatattccagaatcaatcattcatttaccaaatattcatgtgtacagggcacagggtacagttgtgagcaaacaaaaacatggtctgtgctcttatgatgcttaccagttagtaggtaagtagctcaaataatcattaaacaaatgtataattaaaggctctagttaggaaaccgagacatctgtcttggctgaggcagttagaaaaggcttccttaggaaagtgacatttaattaagatcctaataaccaatcccgcattgcacaaggaggagaagtaggaattaaccgagaaaattgtggtcagggagggcttgggggtagggagaacatcttggtggaagaaacagtagtggaaagaccttggggaagggtggagcttgataaatttgaggaactgaaaggtgaccaggtggctggtgcagcgaagagtgggttgagggtaggggcagcattagtgtgagatgtcatgaacgagtaggctaggaggggactgtgtagggacttctaggattttgacttgtcctaaagcaatgggaagacaatggatttcaaaactatgcagtagaatgaccagatttatggtttaaaagatcactttgactgatgtggaaaatacataggaagaagacaagaatggtttagagtatatcaatggttcttgaaatgtggtccctgaagcagtagcagcagcgtcatctgggagttgttagaaacacaaattttcaaactctaccccagaaaatctagggatagatttttaaatctgaaaatcagtcagataaaaaaataaataaataaataaaataaaatctgaaaatctggggtgggttagcaatctgttttaatagcattttaggtaatttttttttttttgagacaggttttgctcttgtcgcccagactggagtgcagtggtgcgatctcagctcactgcaaccttgcctcttgggttcaggtgattctcctgcctcagcctcctgagtagctgggattacaagacgtgccaccacgcccagctaatttttgtatttttagtagagacgaggtttcaccatgtggccaggctggtctccaactcctgacctcaggtgatctgcctgccttggcctcccaaaggctgggattacaggtgtgagtcactgtgcccggaaagcattttagggtattctaatgtaagtttgagactcactggactagaatattgatcacaatgcaagatgagtgaatgttaagtccaaccattctaatggcaacttggtgagaacaaacattggtatccttacctcttttatttttccttacaaatcttatactgcttcttctgactttctaagaaagttgtcaaatctttctctgctgggccaagatctgttgctggaacttcttctcatctgctgcagctacctttgccgataaaataacaaatacaatgtaggatgaatctattctttacacagaattcagtgatcttattctccagtgcagtaagacagtccatgagtgctaataatgagacatttttgaacaaaattaaaaaataattgtttttctgattttcttgtatcttaaagaaacacaaaaaaaaaaaaccagaaattttcaccattaataaattctgggctgggtgcagtggctcatacctgtaatccagcactttgggagttcgaggcaggcagatcacctgaggtcgggagtttgagaccagctgaccaacatggtgaaacccagtctcgactaaaagtacaaaattagctgggcgtggtcggcatgcctgtaatcccagctactctggaggctgaggcaggagaatcgcttgaacccaggggcagaggttgcagtgagctgagatcacaccactgcactccagcctgggcaacaagagcgaactctgtctcaaaaaaagaaaaaaaagaaaaagaaaaagaaaaatacattctgaatttgggaaaaatatgaaggtgaaccataaacatgctttactgaacacaaaaacattcatggatgaaaggagacctaagaataacatttttttttgagatgaggtctcgctctgtcgctcagctggagtgcagtggctcgagcatagctcactgcagcctaaaaatcccgggatccagcgtcctcctgcctcagcctcctgagctgctgggaccacaggcgtgcagcaccagtcctggcaagtatttttaaaaaatgatcgtagagactgggtcccactttgttgcctagggtcatctaaatgcttggcctcaagctatcctctctcctcagcttcccaaagtgctgagactacagggtgagccaccatgcccggtcagaactaaggatttagttctgatataaatctaataaaggttttacatcatattgttgatagcccaaaggttaagttgtaaaaatgtataaataaccatcctggccagttttattccaagaatcaaactctaactgattaactattccaactatcagatttccagtggtatcaactcaagtgtaattggaacgctaacggcattttgttttctttttttttctgagacagtctccctttgccacacaggctcgagtgcggtggcatgatctcggctactgcaacctccacctcctgcgttcaagtgattctcatgcctcagcctccccagtagctggattacaggcacaagccaccacatccacctaatttttgtatttttagtagagacagggttcaccatgttggccaggctggtgttgaattcttgaactcaaatgatccacctgcctcgcctcccaaagtactgggattacaggcatgagccattttattctcttaggcacctgctgcatccacaacagtcacacatcatgacattttttggggtcctaaatgaataaaacacatacatataaaaggtcatccaataaatactggctcctgaaagtgaccaaatctgtttctggtaccactgggtgaaggatatacgtaagacgagcgacttgggagatagagggggaattatgctcatggctcatggctctttttacgtatctttttcacctgcaacttccatgaaggacaatcttccattatgaacaattctcacaacatatttaccaagtcaaatcccaagaaagaatctactgatttatttaatcaacatcatccttgtctgggcagaggttttcatgccagactgcccacagattgatggctgttgggggaaatctttcttctacaacctgattgttccttccatgggagacagagagagacagagagaccaagagagacagagagcaagctcaattatggaaacccctggaactgtgtccccagtcactgcatgcccagggagcacatgtccaccacatttttaacactatggaagtctcatgggggtggcaggaaaggtgactcagttttagcactgcttggcaggcagatctgcttaattttgttttcctgcagacataaatcacctcttgtacctaactgtatcagtaatagatgatattatggggagggaggagggatagcattaggagatataccaatgtaaatgacgagttaatgggtgcagcacaccaacatggcagatgtatacatatgtacaaacctgcacgttgtgcacatgtaccctagaacttaaagcataatgataataaaaaaaatgatattatgactatctgccttacccttctgttttttttttttttttttcagtcggagcttgttcttgttgcccaggctggaatgcaatggcgtgacctcggctcactgcaatctcccctcccgggttcaagtgattctcttgtctcagcctcccgagtagctgggattacaggcactgccaccatgcccagctaattttttgtatttttagtagagatagggtttcaccatgttgccaggctggtctcaaactcttgacctcaagtgatccacccacctcagcctcccaaagtctgggattacaggcatgagccaccatgcctggctggtttttttttttttttttggagataagtctcgctcttgtcacccaggctggagtgcaatggcacaatctcaactcactgcaactctgcctcccaggttcaagcgattctcctgcctcagccttctgagtagctgggattatagcatctgccaccacgcccagctaatttttgtatttttagtagagacggggtttcaccatttggccaggctggtctcgaattcctgacctcaggcgatccacccacctcggcctcccaagtgctgggattacaggcgtgagccactgtgcctggcctttttttttttgagacagggtccgctctgtcacccaggctagagtgcagtgacacaatctcggctcactgcaacctctgcctctgggctcaagcaatcttcctgcctcagcctcccaattagttgggactataggcatgtccaccacacccagctaacttttgtattttttgtggagacggggttttgccacattgtccggctggtcttgaactcgtgggctcaagagatccacccaccttggcctcccaaagtgctggattataggtgtaagccaccacatctggccttgtctgcttttaaaattagtttagaacgggatggggacgagagatgttccctagaaaatccaaataattgccggactcattatttgcccttttgctcaggggctcatcagctgtaggcagggattatcactactataagagactattgtaaagcagttttcttttgaagaggactgtgggtatggcagatacagtaacagactttgttgtgcacgttctcagaagatggaagcatcttgtttccctttacttgtacccaggccacatcaagggactgatactcagaatatacataagtataatttttttttttttttgagaaggacttcctctgttgcccaggctggagtgtaatggcatgatcttggctcactgcaacctcgccttccaggttcaagcgattctcctgcctcagcctcctgagtagctgggattacaggctgtgccaccatgcccggctaatttttgtatttttagaagagatggagtttcaccatgttgccaggctggtctcgaactcctgacctcaggtgatctgcctgcctcggcctcccaaagtctgggattacaggcgtgagccaccacgcctggcctcagaatatatttgaatggacaagatgtaacatatattttcagttgctattttagctctgaacgacaattttacatagccctataaatctagaaacccaattttgccaccccggaaacaacaattttcctccatcccccactctgcctcttgctaacatcctgccactgaccccaacaggctgggcttggttgtggcatgaagcgtgtgtgcacatactgacctccttttctatgatagccacttgcttcttggccagctttccagctcgatggacgagttgttggcatgcgtctccacctccttctgtagcttgaggcgtgctcgtccatctcagccttcagcttgttctccagggcgatcagctgcttctggtgctgcgccgcatccgcttataacctgacatctgttcccgcaactcgttctcctgctcatgctctggatctgtcgtgtaacctgaattgggttaggaaacagaactcaggtaaccaggttcatggagacaagctttcatgcaaagtagaacggccctgtggcataattttatccatcaccttaccatcaatttacctactgtttagtgaatgctcacccgtagggggcactgtgctagataatactctttatgtattttatccctagtcctcaaaaccatctcattcactcattcatttcttcatgaggtaggtgataacatcttagttttatagttgaagaaattgattcttgaaagaactctttattcaggccgggcacgatggcttacgcctgtaatcccagtactttgggaggcgaggcaggcagaccacttgaggtcaggagttggagaccagcctggccaacatggtaaaacccgtctctactaaaaatacaaaaattagccaggcatggtggtgggcacctgtaatcctgttacttgggaggttgaggcaggagaattgctggaacccgagaggcggaggctgcagtggctaagatcactccactgcactccagcctgggtgacagagactctgtctcaaaaaaaaaaacaacaacaaaaagaaattatttattcagtcaaaatatgtttacatatttttgatatacatcacatatattacatgttcacattaacacagctaataaggactggattgggaatcagcccatctctgtataactccagagccatgttatttctactgcaccaagatttctcaccaaactactgacaacgagcccgataattatctgttgtgggggccgtcctgtgcattgcaggagtttagcagcatccctggcctctacccactagatggcagtagcacctcccaccacatgaaatgaaaagtatctccagatattgccaaatgttcccttgggaacaaaattcctctagttagaactactacactggtttgttttgtatatgtgtgtgtgtgtgtgtgtgtgtatatataatatatatatatatattttttttttttttttaaggatcatgtctctaacagtcatagacttttaaattagtctgaacatgatttatttcctattcctaatatgaagaggtgagtatgaatcaagagatctcttaaatcatgtctcccccatccccttctctacaaaagaaatgttacaaattataatacattcactcactctcctaaagaggacaaagcattgctatgatttttggaggctacttttcttagtaacttttccttaactcattttcaagtgaacatccaacaaattaagcttgtaaatgtacatttcagcacctcttgctcatttctattaaatcttttgtgattttccagtccttccttcaatttatcttctctctttattttcctgatcacttcctccctattttcctattttagaaaaaaaatcttaattccaggattgtaactttagtcttgttcttcataagtgatttggtcactcctatctactgtaaggcccatctccccagcctaacacccaacaagctttacaggaaattttcaagctgctattaattttctgtactattttcagtttatggttaaaatacattttatacaaagaagagtttgtttctctgctctttttagaaggtggcccgcatactaaattgagtccttactaacaagagagtgctgttctgtaactagatagtattacaaagtacaccattaaacattagccaaactttgaaacctttccagttgaaactaacactggtttcatattcatttctcttttctgaaggataatactctttcaagtattaagaataaggcagaggatattttaagaccaaaaaaggatagcatcacccaaaaggcacctaaccctctaagaaaataaatgatctattttattatcagaaaatgtgtttttttaatggacataattcagatgaaaggaggaaaagaagtagtttgaaatatatgtatcaattttacttcttcacgctatatgtttctgaagtacaactttaaggaagaaacaattctaatcaatggaaaggatacatttagtcctttctgaattcaactatttttcagaaaaatatggcagtaaagtatcagggtagggtaatgaattttagatatgttttagctagaaactttttcttattttagcattcctctttaatcagattcccaaagctgaggcatggcacactctaagctatcatgacacatttaaacttggcataagcattggcttacagccaataaaatattctcaggatggtcatttccctaaccaggatgcctaaagataaaagggaaatgagttgtgtcaagaaaattttctatttcattggtgggtgggtgtctgtaaagagggtggctttctacttgtaccagatcacatacaagtgatctggtacaaggatgtggcaaagaaaatttacagagctcaatctgctatcattgtaaccactgaattccaggagagacattttgcttttgaatgcttcccataatgtggataattccttcttaaactcctaatatcacctttcatttgtcacaactaaactttccaagtttcaattgtctttttgggtatatatatagagatactaagctttataattccatgctcaagctggtagatgaatttaaataaaagtataaccagatatttcaattgaaaagtctaacatgaaattacaaaaaatatgatatttacagttatatgtgcctgtgtgtcttaagtgtacactatgattttaagaatacaccttttggtcaataaaataaaaaataatagctgataactttttcatcatatggtttaaaaagtgctttcacatataatttacctctttaatttttagaaggccttgattcctatggttcttgaattgcctgaggaaattcatatcaccaaggcagaaaaagagtactattttctgttataaagtaatagagggaatcaacacccaaaaaagtcaaagctagaggggtggtaagtctaaattacaaattgagtaagtctgaaatgggagaaagttataaagattagtaactgtagtttttacaatggcagtctcaaaaatgtgatcaactaaaagtgggcagaccaccttgctctacccagtggattgtgtggagaaaaacctcatctatctcttactataaattgaccttgggcaaattacttaacctcttaaagtctctcagtttcttaatgtgtaaaagagaggaactaccactgtcttcctcagggtcggaggactttctcatgtgaaagtgcctgcagggtgtctgactcctaggaaatgctcaacacatgctggtttccttccttctgatgcaggctctgcgaagcatgtccctttgccctccacttagtatttctggtgatggagacacaagcacaagtggatccagaagaaggggcacatttaaggaaaaaaaaaaaaactagctgtaccaggttgtggattataaaattatgtataatttctgaatctgaattattacttatttcagtatctagaatatgaaaaataaacaaataataaataatgtgccatgaaaaggaagaccaaactttttttctaaaggttcctatagctgttcaatgctactttatttaattccagcaaattcggccctaaaacaaaccacttcatctgaagtgcagagtgtccctactgtgtacaaaaactgcactagaagggtaataagcaacttcctgaacataaaacaagagcatggtggctgagatgttaccctcttaagagatcaaagccaacttacaagattaataatatgtaggaatcaaatgatgcatatgataaaagtggccacctcagcacttagaacaaatgaaatttatagcagttcttaaaaagaatacagtgagtcacattttggcattagaaacttaacattctattcttagaatacctaaggaaaaactgttttttaaatttttgctaaaagtaatgactgataacagcaattctgcatttataaaagaatatgttacatgaggaattctgaaatgcaaacttataatccaaattctcatgtgatagcaaggctggaggtgacctcattcattcgttcattcattattcaatacacatttattgacagactttgaccatatgggttgggcatgtagattggacacataagtgagaaatggtatcagcaatgaccttagtgagttaagaagccaagaataagtaagagatatgcaatattttgataagcatcctctggtatactgtccaggaagagaacacatttcaagcatttagaaacaggatgaaacagtagcatttactgctgaggctctcatattttatttttaggtatcaaattcattcacgtatccaatttcacaattagctgaattattaggggcattttaaaaactccaaatgaagactctctatgagcttttctatcgaatctggcaaaggaagtaaaagactctatatttgcatgaatagaacaataatacttttctcctacatgcctcttgggaattcccctatcacacccttctccctgacatgtgttctaacataaattcgccttgtaatgcagtcacaggtgaatttgtgttagaacacacattaggaagaggggcagtgagattccttcacaaaaccaaaagctgaactctgatagatacactgctctttatattaatattctatcacagaaacggccaagagccccagacactacaaagttttcagaagaaatgacatagatgtagcaacagctaaaaacaccctcatgaatcactaatataattaaaatatgaggcctccataaaaactcaaggaaggcacatctcaaaggcccaagaagtcagattagtgattcgcagaactatataaacaacttttttccagataacacatgagcccaatatgaacttccttcagaagaaggaaaagaaaggttaaaataaagatgccatgaaatacccttccttttcctattcttcaaaataagggcaataatctctgcccttagaaaattataaaaattatacaattgaataaaaagttacaatgctaaagttttctcaggatttcatctggtatcaaagtttatagccttccttatcctttgttacaaatccaactgtgcagcagtgcataatacaaaaatctcattataaggtgccaaaataataaagacatgtagcaatacagacccaatgcccatgggcttttcatatacttgtcagtaacctcattcaaaagcacaatgttgaaagtgatactaaggggaaaagcacaaagccaggcctcttttaggcttatgttgaagaagtaggctcataaacaaatttaggaagactaatatctttgtcagtttgcaagtaaatttaaaatatgcatttcatcattatttatctagttattgaaaaactaatttctaaattccttttccctgttcacctttggcctctttgtgacttgttagcgcctctactagaagatgttaaagaacgagtaaaaccaaataaatgaataaataaatatagtattgccaccaactatgagaaggcaaggtttcaacaatacttgattttttattatactggactttcactttcccatgatcttgctcttacttttatgcattttagtcattttcatttgagctggggtccataaaacacaacagaattcataatatatttttaaaattaaatattttatgatattccagtgtcctgatttatacactactgttggcttaggctttaaaataatatagtgggtagaattgtagtacttggtaatatacattaaaaatccatacccatagttagattgttcaaaatgggacatggaaccatacaacaccatacctttcccttccattttttttcccctccctaaaagccactagatacaaataccattgaactctgtaaactaccatcaatcccaatcatgactcccaaagcactacatttagagagggcacccacaaaaacaacttattttgtggctaaagcaacagcatatcagctactctgtttgtaactaatataggagcaggggccttttagcaaatcaaaacttcattagagagactggttgcagcgttctctggatgggcactaggaagcctgtacgattcagagggttcctgaggacactgccatagccctgaggtggcatagtagggaagcagcttttatcatccacagagaagaagactggatggctgatatacacacagagtagccctgggtgagttcacagatgcgagcatgagattttctggcatggctgtagtaatctcttgctgggaggtaggagaggtcatgaatatatgattgggaatgagggtgtggcaagagagaaaaaagaacctgtcccagagggggaaagccactggtataatgtctgcttcacatgtaaaaccactgatggtactcggttgctcagagcttgtatcatttccccactcatttcaacatgaacgggtctggataaaggtccaagtctcacaaggtcgatggtaagtagtcatagttctctaaagcaccgtatttcttcttttgtcagatatctggcatgaagacaatgactatttggtaatcttatgatgctttatctagactcaaaagcaatttttaggtgcctaacaatcattagcaaatacatagtggacattttaagatctccattcatagtgtagcattcctttaaaatgaaaaattgctcatcaaagagatcacaagaaactttacataaaggaactttaaagtgggcttatttataagcagtttaaattaaattgcttgctttagacagcagcaggcacagcaatatgtacgtgctttaacttccatttttccttgcattgggtttttaaaggttataatccattataattttcaaagataatcgaagcctttaaaagattgagaaatagaagtagaaatcaggtttaaaaaataggacaagaaaaatgatcatttctggtcggccttggatgatgtcatcataggttctaaatgtaatagccaagcagtgtacactactcttcctgcccatgtgacctctaacattaatttgggcaaaacaactaatatttcaatattttttggctgagaagtgagattcagaagcaaaagattaaagagagtttagagtgccaggatgaaacgatgtgagtgtgtgtgtgtgtgtgtgtgtgagtgtgagcgcgcacgcgcagcgtgggggccgaggggaggaggcatgaaaactaactcttccagcacacaccccttttgtactacaagggcatccagcaatcacatttgcaatagtaaaaatgctgaagaatcctacatctcttttcttccacaatcagccctatcctctcctacaaagcccttcttgctttattgggccaggaaattcttcaggggttaaatggggaagtgcagccactaccattgttgcaataataaatgaatgaaccagaaggaaccagcaatccgtccctgggaaacaagtatcttatttttacaattatatacattatccagcaaccatatattctttaaaattatattttatcttttgtgtgtgtgtatacattatagacacatatgcatctatacaaaaagcagcacagtgccgtgatacatatacatcaataccttaaaaaaatttagcattatttatttcaatgaaaagacaatagcttttaaaaaattggacaggctagcaacttcatctcaaaggccttatattttgcactacagcatatacaaacacacacagacacagacacacacacacacacacacacacacacaacacacacacacaaaggttttttttttttttccatgccatacacaatgctaaaatatctaaatcaggttgctatgccaacagatttttttcctaaaatgaataaaattattaggagaggaaaacattcttgactcctttcctcccatccatgaagccgagacaggctcagggagggcagaggctgccagatggggaggaggggaaggaagggaaggtgggtagaggggtgtttgctaccaaagatgctgatttgatcgtggcaaagcgctctctgttccggtagtggagggcctgctctgaactgactgggtaggccgcggctcaggcctgggatcgccgtggcccgcctcatccttatgaatacatgatcctgcagaaatggataaaaacaaggagaaagtccagctgtgcttttcctcgccggctgcctctctctcacccctctttctgcacaagcactgctgtttgaaagcatagtttagctctctgctagtccccgcagctcccacggtacaaaatgaataagcaaccattgcagccttcagttaggaatgtcagctgatcgctagtgggatgccttctgaatcccggcaggctttttctttacctccagaattacatatatgcaaaagaaaaaaagaatagaaaaataatgcaatgtacagactccttagaacagtttgcttaaaacgctgtaaccagataatcctttaaaaatgtcatgtccatgtctagcaaggaggatgctggtggcttttaacataaagcgagcctccgcctcattcccttgaaagatctgctttctcaatttaattttatttgagactgttcggtaggatcatcgttctgcctagaaccaatgtaggcttgtgctgaactgcctcctatcttgtgctgggaagattcggcagtcactgagggatcctgctttccagtcatgatctacacagttctagcaccttctctctacagcttctgaaaggatttttttttagatttaaacgacaggcgtacaattttaaccaaatgatacgttcacaaattcttcttcaactcagcatggtatggtcaccagagtgagtaaagctggaatttaatgtccttgactgatttaatcaagccatgcttcttgataggcaaagataattaatcttgttctaacgtccagtgaaaaaatagattccctggaaggataataatggatgtttcttaaatgcaactgaaatgacttttaaagggaaaatgctttcaaaggatgatgttcctctctataaagatgaagtagtggtcagtcattagtggctataaccctttagaaaaaaggacgctatagtaatttgtacctcaaaaacatgtcaaccatgggggattttaaaatagtacatgttcagggtggaaaaggagaaattaattcctatttccctagggttttaggaaaaccatttgtgagaagtcagtattgcattttatccataccacttgaaattttttataatggcttttttcttcatcaggaaacaaaaattaaagaagttagaaaatacaaaattttattatagtccaaaatttggggagaaattaaattttacatcagatttttatgtaaaagccaagacccaagattaaattgggctgattttctttttcctttatacatttaaaatgctttgatgtattgggaaggtatctaccattacacctatatggagattgttttaaatttatgtattatagctcaaataatgaagggatctttaataaacttgccatgagggcatatatatcaaattcacgtatattctgcagctgcgctgtccagcaagatagtaccagccacatatgactattttaattaaaaattaaattcaattaaaattaattaaaacaaattaagtgcaaaattgagttcctgagtcataatggctatgtttcaagcacttagtagcatagttagtggtgccatattggtggcttataaaacttgtaagtttttaaaacttataagaaatatttgaaaggtcagttaaaattattctacatgatttctcgcgaaatttgaactccattttacagggaagagcgagaacgtgtgtaattgggattcattcactaggcttaaggtttaaagaggaaggcactgggacctgctaccatttacattactgcatatttgctaataaattatgtacaaaattcaacttaatattacagtgccagaaaagcaagcagctcttaaatgccgtaatcaaaagagatatgctaggtagaggcctgtgattttataggaggccttaacaagtgtagttttggtgaatattaattggctaacttaccaagtacattgatagagggggagacccaaatacatgggcaacagttcagtttcacattgtaataacttgatttataaggataaccatgacactagaatccacattctccacagggcagaccaaaacaaaatttattcatgtacaatatgtgcaattttatttagtctgttttatctctgataaaaattaactccttagaaacaggtttagggctctgcttctccaattaaaagccacaatgtattttctaagtttactaaactgaggaagttgaagtacaccggaaaaattaaaacttgaaatgacattgattttagttgaacatatgtaattaagtaactcaagtatatttttaaaataatgctatttttatagtccaagaataggttcaaaattttaacccactttaaatataataatgctaatagtataattctttcttccccctacatttttttccttttataaaattattcttagttttccagatcattttcaaacagagatcactatcactaaaggtcttcaaatattatacaagagaccacaaaatggaaaaaattttagtctaacagtggatattcatttcaagtgcattgggaaatgaattttaatatcagttccactgcataaaacaggttcaaaactccaaagacagcttatgaagctatttaaaatgggagaatgtaacttgagaagtaagctcaaagaaattaaagtatcaactttactggaatattttctgttggttatactgcccctttaagtaacagtgcctctgtaagagaccacttacctggctcccagagtttctgaactgcacacatcttaagattaacaatggaaagggttatttctatttttatgcagttatgcactagatacagattatttacaaatgataaggctgaatcttcaaagaaggattttagaagattaagaagaataaatctattctactttgccaaggaaaatatatggcatggttataatttatctttaaaacattatcatccaggaaaaaacaaaataactccttgaaataccagttttaagtaaacctacgttaacctggtaaacttaccacgtgttgttttttttttttttttttttttttgagacagtctcgttctgttgcccaggctgggtgtagtggcactatctcggctcactgctacctctccacctcctgggttcatttttgtgctcagcctcctgagtagctgggactacaggtgcgtaccaccatacctggctaattttttgtattttagtagggatgggttttcaccatgttgcccaggctggtctcaaactcctgagccaggcaatctgcctgccttggcctctcaaagtgctaggattacaggcacgagccaccgccccagcccacgacattgtttcatcataaaaaataaatttcttcagattaaaaaggaagcgtcataatgtttcttcaagatctttggtaaaaagaattgaatttctatacaagagtgaacatgtgaagcatgaggcacacaaactttactattataccttagacaaggggctttcctttatttggaagtctttcctttaagtgtctgaccattacacttctgaaatgaaggttcgtgttaggcacttgcctagagtttctttttctaaatatattttcttccctaatagagctgggtctcactatgttgcccaggctggtcttgaactcctgggctcaagcgatccacccaccccgccttccaaagtgctggaattacaggcgtgagccaccgtgcctggctacttgcctacagttctaaatgaacttgactttaacccaggaatcactcctctggactcagttgtgctttggtttacttttatcacagtactcatcacacttacttgtctgcctctgcataaggctgtgggtttttgaaggcagagtaaatgtcgtttgaaaaatcttagtctccctagcacctggcatatgcttgatacttagtaggcattcagtaaatgtttgctgaataaacaaacacaagaatatggtctgaggagattttgagaaaatgacattttcttttggattatttaacagaattcaaattgtatttcataaaaacctgccactctgtactctaaggaagtcgtaaaatagtgacacaacataagcacacctttacacagcggggtgcggggggatgtatctaaaaatggctcttatcggtgatgagaaacctttgtatagactcccacactttctacgctgtggagaagggatcacagacccaccactctcctttgttttgttcatttcaaaattattaaattattgtcgaagcggggtagctatcaaaagctggggctggaggaaggggaggagaagatgaaaaagcatatctaacttggaaggatagttggagagaaaagatgactagcaaaaggctgaggagaaagacgtactacagagaagtgttgtatgactgctctgtttaagaaacattaccttcatatgttaattacttttactttgccaaatgtgagttgaagaggcaaaggacccacccctctattcagcaaaataataggaaaggccactgaagcaagtgaaaattaaactagaacatcctattccctaaggacatttcttttttttttttttttttttttatcccgcaaaggtggtgaaagctgtttttttttaaagaggggatgggaaaagaactaacattgactaacaggaagggtcaaataagctttaggagtcagggtagaatggctttttttccccctccaccagacggagtctttgcttgtcacccaggttgaagtgcactggcaccatcttggctcactgcaacctctgtcctcccaggtttaagcaattctcctgccttagcctccagagtagctgagattacaggcgcgtgccccacgcccagctaatttttgtatttttagtagagacagattttcaccatattggccaggtcgtctcgaactcctgaactcttgatccacccgccttggcctcccaaagtgctgagattaaggtgtgagccaccgtgcctggccagtagaatgacttttttaaacaatagtttctggacacttattctgttttatagaatgaagtgttgtcccattaaaaaaaagaaaaaaatgttcctaaataatccctagaaagggacccttatgactggcgttcaataagcatacctaaaatacactgattcaagaacaatgcttttaatatattaaagtcttatgatctatactaatagaagcagcaacaggcaaagggaattaattttatactttagtaaaataaaaatacaccttttgttaacaaatttaaaagacagactttgctgcttaggatattattaaaatctatttgctatgctctatacacaatgattttaaggagtaggatgaaggctcagaagcaggctagatgacaggaaacaatctggattaaaaatttgtaccggagtcacttgtgaataatcaagaattgagtgtggaattgtgtccttggccatcttcaatttagttcacagaacatttgttgagcgcttctatgtaacagacactgtgctacgtggtaggtgaaaaaaaaggttcctgaagaactaccgtctagagatgtggtgatgttcttgttattgaaaaaagtagtgtggcaacactagccaggggaaaaataagtacctaaagtttattttgtcagaatatgcctttagccttatcaaatcttcttgctcaaaaagaagactggattgggccagtcgcagtgcctcatgcctgtaatcccgcactttgggaggccaaagagggtggatcacgaggtcaggagatcgagaccatcccggcaacacggtgaaaccctgtctctactaaaaatacaaaaaattagccaggcgtggtggcagcgcctgtagtcccagctactcaggaggctgatgcaggagaatggcgtgaacgcaggaggggagcttgcagtgaactgagatcgcgccactgcactccagcctgggcgacagcacgagatccatctcaaaataaataaataaataaataaataaataaataaataaataaataaaaggagtttggattaggatcccctcagggcctgggaaagaccagagtagaggcaaggactggaagtaagtaacctggaattctgatgtcaaaggaaaattttcagtgtcccactttgcatttgggggcttgatctgtggtagaactgtcctgctaaaatcagggcatctttattctggaagagagcagttaagtgcaagtcatgctctcactagctactcatggatttcattttatttattttttaaggtccttctttgaaaaagcaaatttatttcctatctaaaatggtaatctgttcagatctgttttgactaccagtcaaattaatttgactaatttaagatatgtctgcttgtagccgagattgcaccactgcactccagcctgggcaacacagtgagactctgtctccaaaattaaaaaaagaaaagaaaagatatatctgcttgattataacaatcaagggacaaaagctccttctcccatattcatatattttggtatttattaagcacgttcttattgtgttgggtctcatttaactttcatttaactattatttaactttctcaaactgtaaagatagctaagatatttaatccttttgatccattatgttcaatgaaccagtagagtatgatatttaatattggtaattaatttattccctgccttctttttggttttgttggtctattcattcattccacgttatttactgagcatctatgctgcgccaggcactattctaggtattggatttgttattgtccaaagtaaaataaaactaacagaggcagatagaactataaattagtttcctcattctaagtttaatatacaaaattttctgttgagagttaaaaatcctatttatgttcccaagtaaaaagtgttaggaatttgagtaaaccatccaatacaaacttcatgaataatttttattctattgtttttaaagataacatattttaaagctcaggtacaagaactaaatggatttcagaaaagataccatatcttaagttttcatatatattctattttttgagctcacttacatttaaaggtaactcatccaaagttttatttgcaaatgtgttttgattttcttccatcatattcctctatatatttcatgataaaataggaatatataacttaaattcttcctgacctataattttttgtggatcaaatgcaattatcttctacttcagaatataaattttatctgttctcttaagtcatcacacatcagggagagaaaagtattgaaacactcatattatcacaaggtggtctatgacagcatgcaaaaataaaattaaaaatcccattagttctagaccagggtttctttcttgttgattatgccagtagtgtctttcttctaattctggttgcctatctgagaatcctggagcaaaaagatccaactgaattcctctcttttgccccctctactcatagagcccaggggtaatagaaaggaaagtgccagacctgtcagcactcatgatcactccctccaaaagacagcccagcaaaaccttcttttttttttttttttttttttttgagacggagtctcatgtgttgcccaagctggagtgcagtggcgcaatcctggctcactgcaagctccgcctccaggttcacgccattctcctgcctcagcctcccgagtagctgggactacaggtgcctaccccacacccggctaattttttgtatttttagtagagacggggtttcaccatgttagccggatggtctcgatctcctgacctcgtgatccgcccacctcggccattgcgcctggcctcaaaccttcttttttactcttcaaatacatgatcacttgcccatgttgaaaggacaccagctgcaatgctgatctcttggtagatttctgcatctgtctgacatctttgctttcctcaaatgcttccatgtcttcctgataatctgggtcctttgctgtctctctggtcctgaggcactgccacatagcacaccagccatagcttctatggccttccccttttccttgaacatacaaagtctctctgtctcagtgctcttgtacttgttgctttctgactcatccccatctcttacccagctggctagcttctatttgtttttgaaatttctgcttaaatgtcacctcatcaggtagcttttcttactccctgctagagtaagtcctccttttacccgaggcaagtttctttctttttcttcttttttttttttttttttttttttgagtctcactctgttgcccaggctggagtcaatggcgcgatctcggctcactacaacctctgcctcctgggttcaagcaattctcctgctcagcctctcgagtagctgggattacaggcatatgtcaccaggcccggctattttttgatttttagtaaagacggggtttcgccatgttggccaggctggtctcaaactcctgacctaagtgatccacccgcctaggcctcccaaagggctgggattacagatgtgagccaccacgccagccaagaaacatacttttgaaagagcatacttctaaaagggcacaaccaacaggtaactcaggaagacttgaaggtctacagtattaagattattggtttagagaaggacttatcaattcttcaacttatttattgatgatgatggacatcagagtaatgagagagggagatgagaaataggcacagatgtagcctgtgtagtcctttgttactttttgactgtaagaaaacttcacatgccaggtttagtaccacactgcagttgcaaaaaggtaactgaaacatctggaactaagtgacttgaactggattcgctatgattgacaaagctcacctctgtggagggtaccagaaacctactttcttatgcacgacggaggagctggaattgattgtgctttcgtcatcggcatcatgacaagttcggaactgctctcgtccatgacttcctgcatgctgttcacactgtgctctggctgcctgtgctcacggacatgcttggaatggaatggttgctgcccaggctgccatttccctgttcaggctggttccatgttcactgtcctgtaaaaatggggcactgaggtagaaaaaaagactgaagataaagagtcaatccattgacaaaagtgtcaagcacactcattttgcagtgtcaagttgcttttctgccaatctgcaaagacaaactttttatgtactggtccactactcctccaccattttcatacatctcatatttgcttcctatgccttccccagggccattctggacgtgggtcataaggctccaaatgctgccatcccagggctttcccctgtatacacactatcatattatcgtgttgctattcagtaagcaaaatcaagccaggtttgtagggaccttctggaacatcaaggagctagaggaagactgctggccactaaacaggtgagcctaggatatcttcaaatacagcagtggtcacttgaaaaagtagagtggaaagagttttcgatatttgacaagcaatatgctccctctgcaagtcattattgagtaacttcatatctaacagaaatattaattctactttcctggacaggtaattaaagtctgcctccctcaagcgatctatcatgcttatctctgtaatcttattatatatatctgttaaataatactggtattcacattactggcccaaagactactatttgaaaagtggtaaaataatcagaacatataattttccatcacagtgggatatcttttgatataagattgaataataaaattaaatccatttagtacaaataaaccttgttctcaaaaaaccatatggtacacatataactttaataaactgtacttagccatggcaatataaaaaattactgggtaatataaaatggaagataatacattatttttaacagacttattttcccaattaaaggggatcatttctatatatgcaatcaagaattttatagttcaatgcaactttccgagcttcatttttaaaattattgataaaatactttatgtttattttattttctgttaaaaagctaaaatactcctgttcttgttatgtctacgtctgaaatcctgcctctttaactatatccctttcttctatcttcggtgcctctgactctgcctggctccatctctactgcatttaaagatgaagaagcctgccttatatttatggatcttctacatgctgcccactcttacttttccttcttaacccaatttctgaatcttaacataatattttttcctgtctccctcttatcaactcccatgaattatacaactccagtaatctacattcattctacctagtcctgtaaaactgcttttactaaggtcatcaaggattctctaacgaaaacttctatctgtatactggcaagagtttataatgccaggaccttaaactcaaaagcacgaaactgaaatcatcctaaatctactctttctccctggttctttttctctgttcttgtattgacatactcctagccacccaggctccaatgctcagagtcaccttaaactcctcctatctgtcactgtcaatgagaagccatggattatgaaatctacctctacgatgtttctcaaagtgctcccttttccccatttgcatcgacactgaccttattacctcttgcatggactttagccaggatgttgcccattcaaatccatgttacactctgttgctaggataatcttccaaagcacaacacctttctgagtctagaacaccctatgcccatttgtcagaaactacccaatcatgtcctccaggaaaccttcactaatcccaccagcagacttattttctccccatgaggacccctgcaatggggttacacctctgtagcacttttcatattttgccttatataagtttattttatgaatgtctcttgtacaacccttcatgtttcttaaggcggacagcatcaataatttttatcttcaaaagtttttcatagtgcccagtctagaactttttcacatagtgggattctataagtgcctgctaaaataaattgaacctacttcctcatcctcctgtgactcatcaagggtccattccgtgtctcttggaaaagtatttttttcatttttcggtactgtaggtatctagctcacgaactgcatcttttgtcctctgtatgaggtcaatgaggacacgtagtgccggtctcgtcgaacaaagtcatgctgattgagggaggaggaaaaaataaactgataataagaaatgtccttaggtgcaaggtacagatataaaaggaaatagagaatcataaaatagtctatggatattacagaaataacaaaatatgattttcatgtcatgtgtccttccatatttgtaaatctcataaagagatagctatgcttttttcttcttccttaagccccattttgcgatgtgagaattctttttaaaaattgtacatatttaaagtatatggcaacatgttttgatcacatatatatagtgaaatgatttctacagttaagcaaattaacatatctattatctcaatagttacttcttggtggcaaagtaccgaaaatctttagtcttagcaaatttcccagattaatacaatattatcaactatagtcctcatgctgtacactggatctctacacttatttacccacataactaaaactttgtaccatttgactttcatctttccattccccatccctttcaccacctttcattttgtgttttattctttgtttactttccacatgtaagtgacatcgtagctatttttttgtgtgtctggtttatctcacttagcataatgtcttctgggttcacatgattgctgcaaatggcaggcccactttcttaagactatatataaaataaatattataaataacaaatatataataaatatatataataaaatattcagtcatatatattattgagtcttaatatctatatcacatataccataatttcttttatcctttcatccactgatgaacacatggatgtttccttattttggctatagagaaaaatgctgtgatgaacatgggggcacaggttttttatgaggtgctgacttcattttcttcaggtatataaccagcagggggattattggacaaattaacattttgttttttgggttttggaggaacctccatactgttttccataatgcaaccccaatctacattcccaccaacagtatataaggattcccttttctctatacccttccacttattatcgcttatcttttttgataatagccattctaacaggtgtgaggtgatactcattgtggttttcatttccatttccaataattagtgaatgttgagtatcttttcatatagaattcttgaggtttactttatcatataagtaataaaaaaatcactagaactttaagagtaggaggtaggcttgtaccttttaaatctgaaactacataataagcagaagcaatgcaagtatagtctattcttttttttttttttttttttttttgagatggagtctcgctctctccccaagctggagtgcagtggtgcgatcttggctcactgcaacctccacctcctgggttcggtaattctcctgactcagcctcccgagtagctggaattacaggcatgcaccaccatgctggctaatttttgtatttttagtagagacgaggtttcaccatgttgccttggctggtctaaactcctgagctcaagtgatccacccgcctcagcctcccaaagtgttgggattacagggtgagccaccgcaccgcaccttgttctattcttattataacttgcctcaatcctcaccccatacacactatcccttgaaaaacagacttgtgaatattttgttctctatttctgtggcgtatagtgtatgcttgaaaatatgccagttgttcaatttatccagaggtcaaaattctgcaacttcatttccccaattaaaaaaaagggtctctgaggagtgaaaacaactgccctaagtccataaattaatcttgatataaacatccctcactttcaatattattaatgattgttaataatctggtttcctagtttctcagcccatagcaggttagacagagaataagaatggagagtaagcctggcgcggtggctcacgcctataatccaacactttgggaggctgaggcgggggattactggagatcaggagttcaagaccagcctggccaacatggtgaaaccctttctcactaaaaatacaaaattaactgggcatggtgacgtgcatctgtaatcccagctactcggatgctgaggcagcagaattgcttgaacctgggaggcagaagttacggtaagctgagatccaccattgcactccagcctgggcaaaaagagtgaaactccatctcaaaaaaaaaaaaaaaagagtgaggagtaaaggattgaggactgggaaaggtagggttaccacctgttgtaaaagaagtagcttttgtaagttctctgacagcttgagagtagagaaacagagagaaatttcagactaacagacctatcaaccaaacaaataataataaaacaggtttgtgggctattttgcaaagggcaaatgccccttatatagccccttttatgcctcaagagttcacgaaacactgttctgagccctcaagaagtgacattaggctgggcgtggtggctcacatctgtaatcccagactttggaaggccgaggcaggctgatcacttgaggtcaggagtttgagactagcctggcaacatggtgaaaccccgtctctactaaaaacacaaaaaattagctgggcattgtgatgctgcctgtaatcccagcaagccaggaggctgaggcaggagaatggcttgaatctgggaggagaggttgcagtgagccgagattgcaccacagcactctagcctgggtgacagaatggaaaaaaaaaaaaaaagacattattttttaaaggcaaaagttcagttatgtggaaaatttactatgtaaaattgtaatttgaagacattgggaaaatgagatataatgtagtgggccttagtgatgaaatgaatttaatttctttataatttaaacagataaaaaataatagggcccttggagaaaacaatctatatgtcttgtggttctgcattctgactctcttagaggaattgtggttttgctgttgcttttataaaatacctcttcctaggtagagtcctttttgaataaaaaaatcattcccagaagcaagtgtagcctgcacatttcaaggatgagaaagaaaggaagaaatattatcattttcctcctctagtgcttacaattataaagagctaatcggtttttagtaacttaaagctatgacttaacatcatagaattttagaacgggaatgcctcttagaaaacttctgtttcaaggctgggcatggtggctcattcctgtaatcccggaactttgggaggccaagcgggcagatcacctgagactaagagttcaagagctgcctggccaacatggcaaaccccatctctactaaaaacaccaaaattagggaccgggcatggtggctcacaactgtaatcccgcacttggggaggccgaggcagggggatcacatgaggtcaggagtatcaaagaccagctggccaacatgatgaaactccgtctctactaaaaatacaaaaattagcagggcatgttggacgtgcctgtagtcccagctactcgggaggctgaggcaggagaattgcttgaacttggggaaggaggctgaagtgagccgagatcatgccactgcactccagcctaggtgatagagtggactctgtttaaaaaaaataaaaataataaataagaagtaaaaataaaaaataccaaaatagccaggcgtggtagtgcccgcctatagtcccaggtactcgggaggctgaggcacgagatcaattgagtctgggagacagatcttgcaatgagccgagatcaggccactgcactccacctgggtgacatagaaagactctgtctcaaaaaaaaaaaaagaaagaaaatttttcttttcaaagtgagaaaatttgggccctgagaagttaggtgatttccatagctaattagtagagagctacggctgcaactcaggctttaaaaatttttttctgccaggggtgtgggtggtggggttattttctggtgtcctactaccataattatctttctaaaatacaggtatgatcattattgcaacagatactacatgtcattcccccattccaacttctttttttttgagacaaagcttactctatcacccaggctagagtgcagtggtgcaatctcagctcgctgcaaactctgctcccaggttcaagtgattcttgtgcctcagcctccccagtagctgggattacaggcgtcaccattacgcccaactactttttgtatttttagtagagatggggtttcactatgttggcaggctggtctcaaactcctgaccttaggtgatccacccacctcagcctcccaaagtgcgggattacaggcatgagccacagctttcagacccaatctctctctctctctttttttttttttgccttacttgaagcactaggaagtaaaggaactgaacccaagccttctttgtggtacagatcactaagtgactaagttctggccagtgagaggtaggcagaagttctcaaggaagttttattttctagaataaaaaggcaagacacatgaggacaaggtgttttaccctttgtctctctccttcttcctgcctggaatgaaaacttgagtcatggcaatgtagcagccatttatgacaaagacaataaaagctacatgctaaggatggtgaagtagaaagagagaaagagctgggtcgatgacgacattgttgagctgcttagagctttggactgcttacgccacttcctttccaatgtcctggacttcctattacatgagataaactcttacctgtttaaaccttttaaaacagatacactctacatcttaatatctcactgtctcttagataaagtgtagccttttcagccaggttcctgcttgtatttctaggtttaaatctagtcattgctactcctccttccacacaattctaggtacattctaggtaattctaaacccgtgcatacctttcacacctctagcctttgccttcacatctctatgttctctctgcctgcaatcccatctcctcattgttttttttatttttattttttgggacagagtcttgctgtgtcgccaggctggagtgcagtggcccatctcagctcaccgcaacctccacctcccgggttcaagcaattcccctgtttcagcccccaagtagctgggattacaggcatgcaccaccatttccagctaattttttgtattttatagagatggggtttcaccatgttggccaagatggtctcaatctcctgacctcgtgatctcccacctcagcctccaaaagtgctgggattacaggcgtgagccactgcacccggcctcccattgtttttaaaagcccactgttctccaaacccctacaactggaatgccctcggactctttaaaaggacaattttattgttctcaaaaatatgtttactttcaacactcaaataacaagaaaaatgtataaaaaaagaaaatcggccaggcacggtgggtcatgcctgtaatcccacaccttgggaggccgaggagggtggatcatctgaggtcaggagttcgagaccagcctgacaacatggagaaaccctgtctctactaaaaatagaaaattagccgggcgtggtggcacagcctgtaatcccagctactagggagggcgaggcaggagaatcgcttgaaccagggaggcgaggttgccatgagccgagatcgtgccattgcactccagcatgggcaacaagagcgaaatccgtctcaggaaaaaaaaaaaaaaaagaaagaaaatcacccgaaattctaccatctcgaataaatacataaatattaagttacagaatatcattttagacatgtccctttctttctccagaacaatgaataactagaaatcattttacatgggaatctgattatacaagctaatttatgtataatcgatttaattaaggtatatttgaatttaacaggattagaagagactgaataaaacgattgcataggctgtatgcagtggctcatgcctgtaatcccagcactttgggagctgaggcgggtggattacttgaggtcaggagtttgagaccagcctggccaacagggtgaaccctgtgtccactaaaaatagaaaaactagccagacatggtggcgtgtgcctgtaatccagctgctcaggaggctggggcaggagaattgctagggagaatctcaggaggcgaaggtgcagtgagacgagatcgcgccactgcactccagcctgggcaacggcgcgagactctgtccacacacacacacacacacacacacacacacacacacacacacacatgcacaaattaaaaataaaacaattgcttaactttagttgtaatttcttcaccaaaagagttatctgttcctacagatcctctaaagttaaaaaaaaaattattaaaggctttacgagattgaagttacttagttcttttgtcctatatattttaagaaatgttattgtccatctacttggaaagataagaaattagtatgcatacgtttttcctgcccttagatttttctaattacattatttttacatgcaaatgtttctaacatttacatctgtcctttaaccatttcaataattttacctcagtgtttatttaaatggattaagtgtgaaagtgatgttttaatgtcagggcaaaaatgcatgaaaagatgtattattgaaaaatatctgggagtaagtagatagcttagctgggggaaaaaggtagatttttacctcactccttgtaacaaatttttgcataactctccccacctcctttcacaaaacatcagcataaagaatgtcaaaagagaaataggaaaaaaaaatccaagatctctataaattaaaaaggaaatacaaatggcttttcaacttacgagagagatgttcaacattcccataatgtgaaatagcaattaaaactatagtgagaaaagttttcactgatctgacaagttcaaaaagtatcagtcttcatactttcacggtgggactataaattggtgcaactgcttgaaggacaaatgggcaatatctatctaaatttaaaatccacattgatgagcaatccccttctaggaatttctttattttatttttatttatttatttttttgagatggagtcttgcctgttgcccaggctggagtgcagtggcacgatctcggctcactgcaaacttcgccttccggttcaagtgattctcctgcctcagcttcccgagtagctgggattatcgacgcatgccacatgcccagctaatttttgtatttttaggagagatggggtttcactattttggccaggcggtcttgaactcctgaccttgtgatctgcccaccttggccccacaaagtgctgggattaaggcatgagccaccgtgcccggccagaatttattctttagatattcttatacagggacaaatgccatatacacaaagatattcattacggcacagtttgtaatagcaaaagattggaacatcctaaatgcgttggttaaacaaattatggtccatctaagaatattatggagccattaaaagaatgaggtagctttgcatgtagtaatacaaaacaatatcctaagcacactgtaagcaaaaagaaaaatcagggtggaacggtttttatggtttgctgtcatttgtgcaaaaataaaacaacatttacttttatatgcataaaatatcactagaaggagaggtacaaaatagggcagtggttgctagtgagggggcctgaaatgggagggagatttctttttcatgttctacttctcttattattttttgagacagagtcttgctgttgcccaggctggagtgcaggggcaaatctcggctcactgcaacctcctagttgatcaagcgattctcctgcctcagccactcgttagctgggactacaggtgtgaaccaccatgcctggctaatacttatatttttagtagaatggggtttctacgtgttggccaggctggtcttgaacttctggcctcaggtgatctgccgctttggcctcctaaagtgctgggattataggtgtgagccattgcacccggctcttcttttcttcttcttcttttttttttttttgagacagggttttactcccatcacccaggctgagtgcaatggcaggatctcggctcactgcaacctctgcctcccaggctcaagtgattctctccttgagcctccgaagcagctgggactaaaggcgcatgccactgcacctggctaattttgtagagatggggttttgtcatgtccaggctggtcttgaacacctaggttcaagtgatcgcctgcctcagcattccaaagtgctgggattacaggtgtaaggcactgtgcccagccccggttgtaccttctactgtatttttccttttggaaatttgtgagacctatttaaaatgaaaacatacagcttctttagccatgcaaaataaataaataagtatttggggaggggcctcttaaattcaatatttaccatcagcccttttaccagtttctccagtccctcattcattcttctgcttgccttcctccctctttttcttctttttgcttcatctctatattggctagattcgttattgagcaatttttaaaaggaaagcgccgaaaggttgcattgcctaaatgtgtgggctcgaagatgtcagctgcctttataatttaagaacatcttggctggctcacaattcctgcttatattttatttcccttagaactctgcaaacactgttctattgttttctggctttgatgttcctgaagaggtaggtctggagccagttggtttttccaccccaaaataaactttttagtctgcttgtatgaatctttctttattcctagagttcagggacttcaccaggatatgattactgatcaatgaagatcagtttcatggtccccctcttcatgcatgtatctgcttaaagttacctcctcgaacggccttctccttacctaaaatagcagcacctgtcaatcttgatgttgtctaatttatttttctgcacaacacttaacatcaactggcactataacatatattttttcttttcttttttcttttttttttttttttgagacctagtgtcgctctgttgccccgctggagagcagtggtgctatcttggctcactgtaacctccgccttccggcttcaagtgatctcctgccttagcctcctgagtagctgggaatataggtgcctgccaccatgcccagctatttttgtatttttagtagagacggggtttcgccatgttggccaggctggtctcgaactgtgacctcctgatcctcccaccttggcctcccaaagtgctgggattacgggcatgagccccacgcccggcctacttttttatttcttactccttcttgtaagtttcacaagggcaggcctatgtttttattgtgtactactgtattctctgcgcttagaatagtacttgacacccagagacaatcagtaaatatttgttgaataaatagttggcccatttgatttggtccatcaaacaagatggaatcaaatcaaaggaagatccaaacatttccagaaaagttttcttcaaggaatctttaaaaatcttctcctccatgtgttttgttttctttttcaggaataatcggttggatatattagatctcctgtgtcttccaaatgtatcattttctttatattcatctttagaattttattttttgcacttaattctattttatttccttaagcctattcaccattggaaacacctaaatgggttggtttactacatgttcgttgcttataatatgattttttaaactgttagttttttctcttccatttttttctttacctctacccatttgctttttatatccttttgtgtctgtaacccttaacttttaacatcgcccaaatttattcatattttccttttttttttttttaaagagatggtattttcactctattgcccaggctggagtgcagtggcacaatcatcctcactataacctcaaaatcctgggctcacgtgatcctcctgcctcagcctcctgagagctgggattataggcgtgagccaccatacccagctccacattttttccccttttatggtgtaatttttatgtcttggttttttgtttgtttgtttttaagatctttgtgtacttcaagtaataaagatattattgtgtgtttctggtgttttgttctggttgctattttcccctaaaaaacatggaattgttgctaagtagttcatgtttaaaacatgtaagggctccacaacaaagagaacaagatcaagctctttgtcctgttgcttctcttaccatactcctgtggcctaccctcacaagaagtaaaaacttgtcacctagccaaggtgttcttaaattataaaggcaaactttttaagctttacaaattgaggcaatacaactcttctgagttcttcttaaaaacgaacaacagaactgctatacaataaaagccagccattctagagacggaagaaacagaaagggtgaaaaacaaacatgcaaaagaaggattaaagaaatttggactattgtgcgccaaataaagaaaacacttctactgtaaaagatttccacatactacactgatattgatgcaacacactcctatgtataaagtctacagtaaaatattacatgaaaagagatgcttggtgataattaatcaaataaatgtggttaacacgatactcttatcactaacatgtcataatactatgtaaagtctactctatatagttatcatacaccttcactgcctgaggatttggcaacaacctaacgaaaatcccagagttggtgtttgaaccaccggccagctctgtcttgagaccactggattatgtttatgcagatgttaggcccaggaacatcacaatgatgactagagcaaggaggagaatattatttgttataaggcaaaaaaggaacagggagggaggggaaaaaatagaaaagatgggaaaaacctatccacagggaatacatagcacataacgttgcaataatcttgctattttatgcctagctacttatctcaggataaatgacaaggcagcacgtcctaaaccactttgtatgatgagctgccacaggaatgatttattatattccattataacatgactttaaatcccctcctcaaatataaatttgaaaaattacccttaatagttctgctgatgttggcctttccgaggtattttctgcaagcagtaatcaacaaatctcctaaaggagtctgtcctgtgtgtgaaatacacaaaagaaaataaactcagggtctgtagagcacactgattacttaaaacaatttcattcaagggaaaattttgcatttaaggagattttaaaaaaatgttttggaatatcagataactggagcattttcaagttacgatatctaaaattcttttggataatgagtgaggaaagtttcaagttagtcaacatattaatacatcttaatatataaggaaggtcaaatcatatatacatcagaaaacaaaaatactatgtttaaataaaagttttatatacatttttctctcaaagacaacaattctcatagtctcaactctatattcttaattaccaattgttaattccctaccacccacaatctataacaaagtagtaaaatttgaagcatgagggatggagaacccggagtaggcttcctgaacaaaaattcttcctatcttaaaagttccattttatccgttctctttaatattgccccttttaaaataactcttgtggcccaaatagttataaaaatgtcatcttttcagcaaggaacactgtatctgaatagataatgtatgctctgtctcaacacatttagtgtacatatagtttaaaaaaaaaaaagacaactggagaaataatgacatcatagaggccccttatctctgctgagaagtgatatcagctgagatgatcaatacaagaccatcatgactgggacaatagacttgttaggagggtagcagggcatgttccctgcaggattttggttatagacacattaagaacacagtgcaagccatggtgaaggcaaaaataagaaaatctatgctgtgtgcatgtgtagacagttgatgcttgtgaggcatcagtgtcacttgtaacaacataagtgaaggaaagaaatgctttctaggtcagatatttaaaatgtaatgtaataaaaatgtaaatacatacggtgattttcttagagatttaaaatgatagcagagtcttaccattcattgactgtaacgttggggagtcattctgggcaatgtgatataaggcactcattgcattcatttgaaaaggggcggcttccgttccgctggaagaggaaagaaacacaataaagtagttctgaaggaaaccaggcagacagagaaataagaaactatgagcaaagctttgcggctaaatcatagctcattactgtcatcatgccacataatccacttattttaatctctaaggttggccaagatagccattcagaagaagctgccggacattaaatgtacattggcaaagctcctaacgaactcatttcaaaagagtgaaagaaaagtttttttctttttttcacatagcttcaaaaattggcttttgcatattttcccacaataggtatgaagatctttgcatgtgcgttttagccaaaaatatatattctctccttgaagtctgggtatttggtgaaaaagaaaaagaaaaaattcatattcacttaaaaaagtcagaaagcaaagaaacatagaataaggaaaaaagattatataaaatgcaacttttttttttttttttgtgacggagtcttgctctgttgctcaggctgagtacagtggcacgatctgcaacctctgcctcctgggttcaagtgattctcctgcctcgcctcctgagtagctgggactacaggtgcctgacatcgtgcatggctaatttctttcttcttttttttttttttgagatggagtttcgctcttgttgcccaggctggagtgcaatggacgatcccagctcactacaacctccgcctcccaggttcaagcaattctcctgcctcagcccctgagtagctgagattacaggcatgagccaccatgcccggctaattttgtatttttagagagatggggtttctccacgttggtcaggctggtcttgaactcccagcctcaggtgatcacccacctcagcctcccaaagtgctgggattacaggcatgcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggctgaggcaggagaatggcgtgaacccaggaggcggacctgcagtgagccgagatcgtgccactgcactccagcctgggcgtcagagtgagactcctctcaaaaaaaaaaaaaaaaaagaaaaagaaaaggaagagaagaagaagataaatcacttctctttctactgtgcttaccctaatggattttttatatagtctcactttctaattcatatctgatctctagtttcatcagagcaccttagtttttaagtaaaggctcttcttctattaccacttctaaaatgacaaatcgggcttattctatgcagttcaaaaaacagaacaaggcaagaggtgaagttatagaaaagacattttcactcacagaaggaaaaatttggacacagcagagtagttaaaacacaaaacaagaaaccagaatggacaaggttgaaaagtagtaaacttaagtcatttagtagcacttaagcagatgacaactatacctattcatttgttatattttgaggggcatcttatagtcttgattaagtgatttctgtacctctgaaatacagtagtctagccaggcatggtggctcatgcctacaatcccagaactttgggagactaagcgggcagatacctgaggtcaggagttcaagaccagcctggccaacatggtaaaaccctgtctctactaaaatacaaaagttagctaggcctggtggcatgcgcctgtaatcccagctacttgggaggtgagaggaaaatcacttgaacccgggaggcggaggttgcaatgagctgagatcatgccatgcactccagcctgagtgatggagtgagactccatctcaaaaataaaaaataaattaaaaaaatgaaatatagtagtctctctctatatatagacagttaattttatgtatatatatgattttatgtatatatgtatatgtatgtatgtatgtgtgtgtgtgtgtgtgtgtatatattatatatatatatatatatatatatatatatatatacacttttttttttttttgagacgagtctcgctctgtcaccagggtggagtgcagtggcgtgatctaggctcactgcaacctcgcctccaggttcaagtgattcttctgcctcagcctcccgagtagctgggactacaggcgatgccaccacgcctcgctaatttttttgtatttttagtagagacggggtttcaccatatagccaggatggtctcgatttcctgaccttgtgatccgtccgccttggcctcccaagtatttttattgacctctcaataggatactttatacttaccaaacagatactggtattacagtatatgaactgttaacaagtggaaatttggaagttgctgtgtggtcgaatggatttatattgtttcaaatgcaaaagattaaaaaaatctggtttgggtttatttttcagggggcagatttagaaagtttgcagagcttgctttctggcaacttcaagtacagtcatccctaggtatcgtgggggactggttcccgttcccccctgcatataccaaaatccatggatctcaagtttctatataaaatggcatagtatttgcatgtaacctgcacacatccttctgtctgtatacttaaatcatctctagattacttatgatatctagtgtaatgtaaatgttatgtaaatagttaaccgcattgtttagaaaataatgagaagaaaaaaagtctatacatgttcagacttgtatgacattttcttgtcattatttcctaaacaatttcctataaagactcaaccctccttttttttcctgaatatttctgatctgtggctgattgaattcatggatgtggaacccacagattggaggaccaaccgtatttaaaaccacgtggaagcctggccaacatggtgaaaccccgtcctactaaaaatacaaaattagccaggccgtggtggcttgtgcctgtaatcccagctactgggaggctgaggcaggagaatcacttgaactgggaggtggaggttgcagtgagccgagacacaccactgcactccagcctgggtgacagagtgagaccttgtctcataaataaataacaaataaataaaaccacgtggaactaggaactcatcacgtaaccatcaatggcttcccatattcttaggccaaagtccaaatccttaaacatagtctcttggacttcattatcatgggatggctacttccagagcccgattctgagaagtaacctatttttccctctctcatgctttagtgtgcttcactcaaagaaccaagctcggtgtttttcacaaatgctgttttcttggtctgacacccctctcccttttgctccctaaactttatctgggtacatctttttgtgtatgtggtgtgtgtcggggtcttgctctgttgcccaggctggagtgcagtggcgtgatcagctcatgcaacctcaaactcatgggctcaagtgatcctcctcccttagcctcccaaagtgctagattacaggctaattctcgacaatcctttcaggtttcatctcaaatataatttcatttctcatgaatttaataagtatgtattcaggattcattatgtgtttataatcacttcctcaggaaaccttccctgacctctcagactaggtctcctattagattttgtcattgcaaattatatttttgctttcttccacatatcacagccctagttatttgtgtaatttttttgagacaggtcttactctgtcacccaggctggagggagtgcatctcagctcactgcagccttgacctctgggctcaggtgatgttcccatttctgtctcctgagtagctgggattataggcatgtgcattaagtccagctacttttttggctttttttttttttttttttttttttttagagatgggttttgctatgttgcctaggctggtctcaaactcctgggctcaagcgatctgcccgcccaacctcccaaagtgctgggattataggcatgagcgaccatgcctggcttatttgcataatattttcttccttccttctttcctccctctctccaaccctccccccttccttcctttccccctctctctttctcattcaagccatccttctacctcaccctccctagtagccgcagctcaggcacacgtcaccatgcttggctaatttttttaaggttttcgtagacataaagtctcttatattgcccaagcttgtctcaaactcccaggctcaggcgatcctcccaccttagcctccaaagtgctgggattagaggcatgagccactgtgcctagcctagttctttatttaatggtgtcttctttgctaaacttcatgagggcaggaacaacatctatcatgttcatctctgcttctcagtgctgagaacagtacctggtacacagcaggtggcccctaatacttttaaataataaatgaaggtgagggaaattaaagcacagaataaactctgtcaacaaacaaagaatcttgttcagtaagtaattacaaaattacaaaaatgactgagaagacactaagtctcggggtcatgacagatactatttgatggcttcattcactattagaaggaccagaaccctcccactactggcaaaaggttaaaaaaaaacaatcccagcttctcagaacactgaattgcatagggaaacagtgaaacagaagggaaaggagactgaagcaagagaaaaacaaatttgaaaagaaaggatgaaagaacaaaaacacaaagaaaactcagttcaataaaaggcagtggcttggattgaagcagcaaagagaaggcctgtaagtagcaagcactctgcctaggaacaagcagaaagatggctgaccatgtaatggtagaagaaataattttaatagagaagcacatgactaaagtactctaaccatagaacagctctatagtctgggaagcattctctgagtattagcttcagtgatctcatctatgttcaagtctttgctagatgtaataaataaatcctctgagcaatgtgacaaggctcactgctgagccagaatactacagagcaagggctggcaaactatggccctgggccaaattcagctatcagcctgcttttgtaagtttattggaacacagccatgcctgacattaatgtattgtctatgactgctttcatcctccagcggcaaagttgagtagttatgtagacattagatagcttccaaagcctaaaatgcttattatctggtccctcacagaaagttgtcaatacttattgtagaatatagcagttttcttttcttttttttttctttttttgagcagagtctcgctctgtagcaaaggctggagtgaagaggcatgatctgggctcactgtaactccgcctcccaggctcaagagattctcctgcctcagcctcctgagtagctgggattacggcatgtgccactgtgcccagctaatttttgtatttttagtagagatagggtttctccagttggccaggtggctggtctcaaactcctgacctcaggtgaaccacctgcctcggcctccaaagtgcaaagtgctgggattataggcatgagccaccgtgcccagcaaaatatagtagttgaataaagcttcttctacatatgcagcagaataggaattgggaacgcttctgaagaatcaccttgtgatacggaatacatataacctttttttttttttttttttgagacagagtctgctctgtcatccaggctggagtgcagtggcgcgatctcagctcactgcaagctctgcccacaggttcacgccattctcttgcctcagtctcccgagtagctgggactacaggtgcccccaccacgcccggctaattttttgtatttttagtagagatggggtttcactgtgttagcaggatgttcttgatctcctgacctcatgatctgcccgcctcggcctcctaaagtgctggattacaggcgtgagccactgcgcctggcagaatacatatattcttaaatgaaaggaaaaggtagaagcatacaaacgttgagctagctacattaaaagaaaaaacagtagtttcccttaacttagagacaaagatcaagtttctgtgtatgatcaatctctgtcatgtaagatcaagttcaggaaggtcagtttgatcaagtttctggatactgctctgcttggtaaagagtaaacaaattagagtgcctacatgtatgtttatcacagcccaatttacaaacggaaagatatggatgaacctaagtgcccactgaccaaggagtaaataaagaaaatgtggtggccaggcgtgtgactcacgcctataatcccagcactttgggaggccaaggtcggaggatcacgaggtcagagatcgagatgatccttgctaacagggtgaaaccccgtctctactaaaaatacaaaaatagctgggtgtggtggcacgtgcctgtagtcccagctacttgggaggctgaggcaggagattgcttgaacccgggaggcggtggttgcagtgagctaagatcatgccactgtactccacctggcgatggagtgagactccctctcgaaaaaaaaaaaagaaagaaagaaaatgtggttatatacaccatggagtactactcagacagaaaaagtaatgaaataatgtctttctcagaacttgaatggagctggaggcaattattctaagagaagtaactcaggattggaaaaccaacagcattatattctcacttacaagtgggtgctaagctatgaatacacaaaggcatacaagggatctaatggactttggagactcagaagaggaagggtaggagggggtgtgggataaagactacgtattgggtacaatgtacagtactcaggtgacaagtgcactaaaatctcagattcgccactatataattcatccatgtaaacaaaaaaacacctgcactacaaaagctattaaataaaaaaatgtaaaaaacaaaataaaataaatcagagtgtctactgggcttaatttactaaggaaaatgaaagagtacgcctatctttagataaacactacctgaaaaggtataaggttcttttctttctttctttctttttttttttttttttttttgagacgcagtctcgcatgtcgcctaggctggagtgcagcggcgtgatctcggctcactgcaagctctgcctcccagttcacgccattctcctgcctcagcctctccgagtagctgggactacaggtgcccgccacacgcccggctaatttttttgtatttttagtagagacggggtttcactgtggtctcgattcctaacctcgtgatccgcccgcctcggcctcccaaagtgctgggattacaagcgtgagcaccacgcctggccatttttgaggcagagtctcgctctgtcgcccaggctggagtacaaggcgtgatcttggctcgctgcaatctctgcctcccgggttcacgccattctcctgcctcgcctcctgaatagctgggactacaggcgcccggcaccacgtctggctaattttttgtattttagtagagacggggtttcaccatgttagccaggatggtctcgatctcctgacctcgtactcacccacctcggcctcccaaagtgttgggattacaggtgtgagccaccgcacccggatttttttttttttttttgagacagagtctctctttgtctcccaggctggagtgcagtgtacaatcttggctcactgcaacctctgcctcctgggttcaagcaattcccatgcatcagctcccaagtagctgggactacaggtgtgtgccactacacctaatttttgcatttttaatgagacagggttttgccatgttggccaggctgctctagaactcctgacctcaagtgatctcccactttggcctcccatagtgctggaattacaggcatgagtggccaagcccagcccataggtttcttatgaacaaatatggttgaaaaccataataactaatgataacaaaataatcctaccatttactgaattcctactatatgccaggcactcactgccttaggcatgttacattgttattcataattctcaaaatagcttgtcaagataggtattatttttccagtttcccactgaagaaactgaggttcagctaagtaacaaaaccaaatcacatagtgtttacgctgaatttcaacccaatcctatgagactccaaggcctgtgttctttttactaggccatggtatccttcaataactctgtacattttaaggtagatagcactagaatttcaaaatgaaaagaaaactttagaagactaaatataaccccttctccccaacaacgatcatggtattcatttattacagataaactataaggggctaatgtataagaagaaaattccaggcagagaatctataaatttatgtttgtgttttgttctttcctggagaacttatttctggacacaatccattcccgacagtgccgacagactatttgccagtttctaccataacctttgttggtgaactaaatgctgtagtttaaacagaagagaaccaagattaacttctcctgaatgtaatcctgaaaaataaatatctggtgactggacaatttcaacctccaagagttttaactagtcctttcaacagagatcaatttacccaaagataatttataaaacaggattaaacacttaggagctgtaaagttgatctttaggaaagaaggacagtgtcagtaacactatcatcatcctgctttttgatgcatcccagcaattcaacttctagattagggtgtttttaaaaaaatatatactattatagagagacagacaccataaagaaaggggataacaagctattatggaagagagagatatcagacaaaagggaacaggactatccacaactttccatgtaatttcgatgttaaaagtacaactgggctgggcaaggtggctcatgcctgtaatcccagcactttgggaggctgaggtgggtgatcacctgagatcagaaggttgagaccagcctgggtaacatggtgaaattctgtctctctaaaaatataaaaattagccgggagtggtggtgggtgcctgtaatcccagctactcggaggctgaggcaggagaatcacttgagtccagggggtggaggttgcagtgagccaagatccgccattgcactctagcctgggtgacaagtgcgagactgtctcaaaaaaaaaaaaaaaaaaaaaagatacaacttaaaaatatactattggtattaacagttagaatttcattatgcccaaacatacagaaaatagcaaaatcattgcttagggaatatttgaaacagtttaaccttgtcttgcatgtaaaaaaaaaaaaaaatacccttcttttacatgtccattagcaaaattatgctagggagatgaaaatgtatgataaagctgtcaaagagatacttgtatgacttattaattactgatataataattttcaagtaattgctgagaaattaaatgttcttggtaataatttattttgtgaatatttactgaccatctacaatcacatttctttgagtctgagatgtcatgactgtaaggtgtactaccgttaaatattcaccacgattttataatatgtataacagaaaaatgctgccaactataagaggctgttgcctataaaatacctcctactttaaaaaagtatttccttgtttttgacaaaattgtatatatttaaggtgtacaatgtgatgttttgatgtcatatacattgattaatcacaatctgtccatcgcctcatatagttactatttttttttttgtaggaacatttaacatcatttactctctcagcaatttcaactttcaatgcattttacatgttgcttcctagtgttaaagagatgttaaaatgggccggcatgatggcttgcgccttaatcccaacactttgggaggccgaggtgggtggatcatttgagatcaggagtttgagatagcctggccaacaaggtaaaactccgtctctactaaaaatacaaaaattaggccgggtcggtggctcacgcctgtaatcccagcactttgggaggccgaggcgggcagatcacaaggcaggagatcgagaccatcctggctaacatggtgaaaccccgtctctactgaaaatacaaaaaattagccaggcgtggtggcgggcacctgtagtcccagctactcaggaggctgaggcgcagaatggtgtgaacccgggaggcggagcttgcagtgagctgagattgcgccactgcatccagcctgggcgacagagcgagactccgtctcaaaaaaaaattagccgggcgtggtggaggcgcctgtagtaccagctattcgggaggctgaggcaggagaatcgcttgaacccgggactagacgttgcagtgagccgagatcgtgccactgcactccagcctggtgacagagcgaactccgtctaaaaaaaaaaaaaaaaaaaatttacagacttgagataatttgaccaaagtagacaactacaaaatggcagaataagaactgaagtttatctgactgcagagtctatgcttttagcacaatttgacactatcacttatcaatttgcagaaatagctgtcatagaggattgacaatttgggagaaggctactttgtcctttagttcagtaaatcattttataaaatgcatcaaaggctgatacagagagcatgtagttatacatatttcaattcatttttataagaagtaaaatcagaaagcacatataaggggctgtcttaagagaggaagcactaaggtatctctggggtctgtacttgtgtccaatgtcaactgctgttgacattttagtcatttacatgtaccggtacaaaatctgatgtgatgatgatcttgaatcatcataaaagggtatatgtagttttacaattgaagaagattggaaagggaagaatccatgtcaaatttcggcaagattttggtagaaaaaaacttgttaagaaaaaacttggtaagaaaaaactagttaaaaaatgggtaggactaacagtaaaattcaacacaagtggcacattcttttaaaagatcgtaactgaggtgtgctatgatggtctcagtgttataaggaaaattttggtttatttttataaaatattactttatattttaatataatataaaattatgttataattttataatataaatttatatataaatataaatatataaaatataaaatatctgtgttataagtaaaatataaaataagtaatatttataagaataaaccacaattttacttataacactgagaccattgtagcaactcctcagtatgaccctaaaggtactatgacctctaaaagtagcataattttatatggcctaaaacaaaattacaaaaaacaaaaaacaatcctatatatgaatacaattaactgttactgagcactgctatatgccaggcactatgctaaatactttacctaagttatcttattgaagcctgtaatatctatgatatatccattgttatttttacttagatgagaaactgaggattagggaagtaacaaaatgatccatgatcacacagtcagaatcaatatgttacacagtcccaggagggtcatctgcatcccagactatgtgaatgcctgatggcattatgttacagccacacatggtgtcctgccagctaagtgctggtaaagccaagattcacatctagggtgtctaattctaaacttactccatactgctaactctatgctatgcacagagtagttttgttcccccaaaggaaatatatttacttctaatttttgaaaagttcaattattcaatatttaaaatgtgtaaaatttgtagaatattataacagacacctatcacttagatttattataatcttgtcatatttgttcaggtcctttttcttctaaaaaaataagaaagtagatacagctctatttgccttccttctccagtgtttactgttctagaattatatctttacaactgtattcttatgttttattatatatatactcttttttttttttttttgagatggagttttgctcttgtcgtccagctgggtgcaatggtacggtcttggctcactgcaacctccgccttctgggttcaagcaattctctgtctcagcttcccaagtagctgggattacaggcatgcaccaccatgcccagctaattttgtatttttagtagagatggggtttcggcatgttggtcaggctggtctcaaactcctgactcaggtgatccatctgccttggcctcccaaagtgctgggattacaagcgtgagccactcgcctggccagtatatatatagttttaacaatatataaaagaacttataaaattttcatactggcatcaaaccatccttgtacttttgcaattttatttgttcaccaaatattcaatgtatgattttgagatttatccatgatgatacatgtagatccagttcattcttaactatgaacagtattccataatttatacattctcctttggataagaatttaggctagttctacctttctggctactataaaaacagttgcacccttgtacacattttccagtgtgtatgcatacgagttcttccttccttggcagcttctccaaatttattattcgaggacttgaaattcttgcagtctcataaatgtgaaattgtttcaaattgcatttctctgattactaatgaggcttaggtcttctgatgtttgttttccatttaggtttcctcttcaatgaattgcttaatcatattctttttatttttatttgagatagggtcttactcccatcacccagactacagtgcagtgggtgatcatggctcactgcggccttgacttcctgggttcaggtgattctcctacctcagctcacttaatcatattccttacccatttctctactggttgtttggctttttcttttttttctttttttttttggggggacagagtttcgatcttgttgcccaggctggagtgcagtggccaatctcggctcactgcaacctccgcctcccaggttcagatgattctcttgcctcagccccctagtagctgggattataggcgtgcatcaccacacacaggtaattttgtaattttagagaggtggggtttcaccacgttggccaggctggtctcaaactcttgacctcaggtgatcgcccaccttggccgcccaaagtgctgggattacaggcatgagccaccgcatctggccagtttttctttttcagaaagaaattgtaggagttatttataaattttggaccaatactttgtggttaaatgtatttcaactaccttctcctagtccatagcttgtcttttaatgtttgtgtttacatggttttatattttaaagtagtaaaagttatgatatttatcattatgttttaaaaacattgattagaaaaggtcttcattatacttgtaaaagtattttagagtaataataaaacactaggccgggcctggtggctcacgcctgtaatcccagcactttggaaggctgagggggtggatcacaaggtcaggagattgagaccatcctggctaacacgatgaaaccccgtcctactaaaaatacaaaaaattagccaggcgtggcggcatgcacctgtagtcccagctacagggagcctgaggcaggagaatcacttgaacctgggaggtggaggttgcagtgagctaaagcacaccactgcactctagcctgggagacagagcgagactctgtcttaaaaaaaaatataataacacttacatagtgcttattacatgccaggccatgttctaagcatataatagatttaattaatcttcataacaaccccacaaagtgggtactatcattatttctattttacagtgaggaaactgaggcattggggggcttcttctaaatgtttaaagttttacttttgggcattaaccaatctaaaatttatttttgtgtatgacatagctaggaatccagttttagtttttcatataattaacacatttctcagtattatttaccaaatgagccatcatttccccattgtctgtaacggcttttgtgtcttataccaaaatctgactcatactagagtttcctagtctttctaccggatactagtctttccctgcaacaataccatatggatttaattaatatggtaggattctggggcagtgattcttctgttcaaattctatttctccaaagttgttttagctattttggtcctatgacttctgggattaccctgtgaagtgtttttttttttttttttttttttttttgagacagagtcttgctctgtcacccaggctggagtgcagtggtgcgatctctcctgcaagctccgcctcccaggttcacaccgttctcctgcctcagcctcccgagtagctggactacaggcacccaccaccacacctggctaatttttttgtatttttagtagagacgggtttcaccttgttagccaggatggtctcgatctcctgacctcgtgatccgcccgcctcggctcccaaagtgccgagattataggcgtgagccaccacgcccagcctaccttgtgaactttacgtagtattgtgggaagttcgttataagccctttttaaaacatgcaaatatttctgcgagtggcccccaaaatcagtatgaataactttgatcaatttcctttggagtgaaataaaagtagtaccatattataacctaaaaaagaaattcatcaactcaatatccatcaatacaaaccagttaaataaactatggtatatcatgtaatggaataacatgatgccattaaaatgagaaaaacatgtctaagttagtcatagaaaacagatctccaagatattattaagtgaaaaccaaagtacagaaccacatatatacgttaccttgggtgtgaaaacgaatataggaagtgatattcatgtttgtttgtatatttaccaagaagatctggaaggacacaccaattaataagtggttccctgcgtgtgttggcaggggtggtgtaggaactgtgtagatagggcaggggtgaagaagatctttcactgtatgtctttttatgttttctgatttacaaaccttgtgattcgctacctaattgaaaaaaataatattcaaattttcctccaggaattcttttttttttttattaatacttctttaatgtaaaaaaaaaatccagataaattgtgcatctttatcatatgtgttttgtcggaaggggtcaatgaaacattggcaatgtaatataaagtatcccaagttgcctaacattttaggaaaagagaagaccatagtctgtgaatcaaactagaactcagaaatcttataggatcaatttggaaaccttaatagaattacatgaaattaatatcttaaaaaatagacaaagaatttttttaggccaggcacagtggctcatgcctgtaatcccagcactttggaggccgaggcgggtggatcatctgaagtcaggagttcaagaccagcctgaccaacatgcaaaaccccatctctattaaaaacacaaaattagccaggcgtggtggtgcatgcctgtatcccagctacttgggtggctgaggcaggagaatcgcttgaacccagaagagagaggctgagtgagccaagattgcactgctgcaatgcagcctgggtaacagagcaagattgtgtctcaaaaaaaaaagaaaaaaagaaaaaaaagaattttttaaaaactgattttttaaaaagttaacatttttgatttaaaatttatgaaaatatgtagataaaggcagcattatgctgtagcagcacatactggctttggaaggcccattgtgcacatctttccccattttcacatttagtaatagcattggctatagtaagagtatttacatcatggaaattggcaaagctacaaatcaggccttttcccctctccacaagagattgatttgttaaatttaccagtataccactggatgaagtaagcttaagatatattaaagttcaaaatatacaaccaaaggagagattctgtggactttagacaatgttagataactgtaacaatatttggggaataacttaatggctgaagttatcttataacacaaagttttcttcacagttgtgctctacatgggtcaaatacagttttgagtcagatccctgataagctttctattactttttcagatttccctaatacaagttggatataaattaaggtaatgggaactcccataaaggtaggacatatattatcattcatagtaggagaatggatatttttcatatattactatgtgctattttgtatttcatttgttaactgcatatctgcttcaactccttcaattaaattaataacatgagactgggtgtggtgtctcaatctataatcccagtgctttgggacctcgaggcaggcagatcacttgaggttaggagttaagaccagcctggccaacacagcaaaaccctgtctctactaaaatacaaaaattagccaccttggtggcaggtgcctataatcccaggcactcaggaggctaaaggaggagaattgctgaacttaggaggtggaggttgcaatgagccgagattgtgccactgcactccagcctgggaacagagtaagactctgtctcaaaaaaaataaataaataaatcatgctgctataaagaccatgcacacgcatgtttattgtggcactattcacaatagcaaagacttggaaccaacccaatgtccaacaaagatagactggattaagaaaatgtggcacatatacaccatggaatacatgcagccataaaaaatgatgagttcatgtcctttgcagggacatggatgaaactggaaccatcattctcagcaaactatcgcaaggacaaaaaaccaaacaccgcatgttctcactctaggtgggaattgaacaatgagaacacatggacacaggaaggggaacatcacaatccgggcctgttgtggggtggggggaggggggagggatagcattaggagatatacctaatgttaatgacgagttaatggatgcagcacaccaacatggcacatgtgtacatatgtaacaaaccgcacattgtgtacatgtaccctaaaacttaaagtgtaataataattaaaaaattaaaataataaataaatacataaataaataaataaaaataagaacatgaaaatgtagcagagagaagcaatctgtgttatgagtataaaaaaatctaataaattcgcattgcctagcacacataaccagtaactcattaagtaatagccagatgaataactcctaatcattatgattcttaaaatacaatgaaaattcatctgcaaaatagaattttaaaaaatacaatgaaaacaaataacctttactcacccaattcaatacaagtgatgccaagtgaccaaatatcaactttcccatctactgtccttcatccatagctaagatcacctctggagccatcctaccaaacataaggtaaaaactcaagttggagattaaaaacaaaatttctccaggaaagtgattcaatgaaatagtgttcttaagggtattctgaaattttatctgatatagatattatttccttacacaaatattttgaaaaacactattcaaaatataatctacttggtgatttacatgacacagtatattttttcaataaagactggctccaccccttactatcagtttgatcttagggaagttacttacctatctgtacatcagtttcttcatctgtaaaatggagataattctcatagcaactttaagagatttgtaaaggatgaatatacataaagtacttaaataattactttggaacatctgttatattgctttatatagttccataaagtatttttcatattgtttaaagtaattaaataagcaggaaatttttttttttttttttttttgagacggagtctggctctgtcgcccaggcggactgcagtggtgcaatctcagctcactgcaagctccgcctcccaggttcatgccatttcctgtctcagactcccgagtagctgggactacaagtagctgggactacaggcgcctgcaccatgcctgactaattttttgtatttttagtagagacgcggtttcaccatgttagccagatggtctcgatctcctgacctcgtgatccacccgcctcggacttccaaagtgctgggatactggcgtgagccaccgcgcctggagtctttttttgttgttgttgttgagagtcttacttgtagcccaggttggggtgcagtggcgccatcttggcttactgcagcctctgcctcctggttcaagcgattctcatgcctcagcctcccgagtagctgggattacaggcataggccacacacctggccatattcttttaaaataattaaacaacatgaaaaatactttatggagcctataaagcaatataatcagctgttccaaagatactaaaacctacaaaaaccctaggttgagtaatggatgttactttacttgtttgtccataatgcatcttcattaggagggcaggggcctatctgtttaatatgctttgaacagaactgtactctattatgatgtgtaagcagttgttagtaaatgttatttggtgatagaaaaaaattcaaagactagctgattttttttagtaacaagtaattttgcagagatctaagtcattctgtaaggcataatgaaattccaacgtgttaggaaaggaaggaaaataatctggaaaagaatagggtgaaaaactctgagccagactgcaagctaggtaacctatcagaactcaacaaagacaagaacttggatttctttcactgaaggtaccatctctgcttgttggctagtcagggaaggtgaaagaagctgccctgtccttactggaggctttgcctcaagagaaaagttcaaaagaaactgcaaatgaaatcgaaaacctgacttggtcagtgaattgataatcctgctcagtttacacacagtgacaccaaccttaactcacaatttaaagtcattgtaaattttatacaaagccagagtgtttctttttatgccagtggctttctatccttctcaaatgaaacctcgttttgaggcatattggtaagacactgtcaaaaaccaagccaaaccagcaccatagttgagttcatgtatgcagattttaaaactatgtatatagcctaattctacataccagtaaggtgtgcccacgaaggagttggcaggagaagcattgaagcagatccaaaatcagctagttttacctgacctggctctgttagaagaatattcctgctttaatatccctataggaaaaaaaaaaaagggttagaaaattacttttcaatttgattatggaataggtcagagcatgcaattaataagacaaaaagtttatttaaacgaacaacaaacaaacaaaacaaaccttgctcagatagccagaaggagatttagtaattactgcagttgtaagggggcccagattcctgggtgtacttgcaggtaggtcatactagttacttaaggtagagctttcttcagagggagggaatacaaatgagaaaaaaggcagacatggcgaacagaaaacctattcagctgctacacttacaaaggcatattcttaaaggctaaatccagtttcaatagtattccctgtgctgagaaaattggtgccaattttaactgctttttctgctttccaaattatgtgacatttttggagcctaaacaaacctgcaatgattccgtattgaccactaccaataaacctcaactacacacataccttttctttcttgcctgtgaccctttctctcgtctttaattgtaactgcaactctaaggcatttgaggtacatgttatatagaaggtgatttttaaaaataactctgtacagtaaaaagaagaccctgaaagatcaaaacaaacaaggataggggttaggaaattacatttctattgtattactacaaagaattgcacgtggttactataaagctaatagaggtattatatagcaaaaagttttaaaaatataattcaaaaaattcattttcattatggtaatttagaatgagaaggtgtggatgtactccttattctttttaaaaaggcatgaggtgtaatgagcactagaaaccatgaattggaagttgatggtcagtgaaaaataaaacagagaagatgaggaaatttatgtcaagctgaaaatgataaggttcaaatgctcaaaataacttttataaaaacttcccttgaaaattcagtttccttcctcatggtgacataggcattggcagacagaactaaaaaaaaatgcattatttatttttcttcacaacagaaaatatattttctctacttatctttagttaggagattgaattgcctttaaaatcaaaacaaaaaaatctgagacacagtatttacttttaaattaaaaaaacattatttataagtattttactcttcaacaaattattttacatactaaagaagataaagcataatacagactaaaacataagttaatgtgcagattaaggtaataatggcacaaaaaactgaactgtagctttaaatagagcaggcaaaataatcacaagcaagttggcagtagtattaacaccttggtaccaaagcatatatttacaaaaagttgtcagatccatagacattatgataattttatttaatcagttttattaacatgattaggttcactctttgtccttaattcccagcaggatttcggtctgctatctttaggaagttctgcttttgtggtaccagtaagtggtcatggctacactggggtgttaaaacagaagcaaaagaggaaccataacccaatagtttcacttcttcctagtaaatgcagttgttttctttcatttgtgagccatctcagattcttcatacctaatatttcactcccctcccctcattcattaatgtaactgtactaaaagttcattactgagagaagaaaagatggtaacatgtttctctagaagttaatggagggagggaggttgcagggaggagagtgtggtgtggtagagaaaatacaaggcagagaaaagtcctagaataggagtcaagaaacttgagttcaatccttaacatattacttaaattctgtgaaactctgggcaagttaagtctttctggccctggtctcttcatatgccaaaatacagtaaagataatatcttcctaagtatctatagaactatagaaatgagaaatattttaaagttataaaatagcatatatttatataagactgcttgttatttgtaataggaaagggacaataactctgctaacagataaatatatgcaagaaggttaattttcttttcttttcttcatgacacagtatctaaagattggtgggcccttttcaaatttccctgcaacatttagcctggagaacagttacctactgaacaaagatgatatattgtggatacgtaggagagaataagagatagaagctaaattctggcaactttatccttatatccagaagcagcaatctatttgcttcccatgaatgcttaggcaacctaaaaattgggcatgcactaattttcaaggttcctggaatagacagtcctgcaactgaaaagaaacatactggtctctaatcttacctatgaatcaatgcatgagaatgtaggtaggctagtccatgcaggctccatgagtaatggcagcgatctccacttcctgaagtggttttttatgaactgagaaggaaaaaaaaaaaagtcagtagatgatcagtttcattcctcattttattattttataagctataccagactgggttacatactttctcacatgacaatttgggaacacattcacctgatcttctatagaagataataagtgatcagacaacaggaaacccaagtatataaacacaatgacccttcaaaacaaaaataaaacaaagaaagcctgatattccttaaatgatgcattttaatttacttatcagttgcaagccaagccacactgattccaattaaccaggcccaaataaccagtcccttccaacatttcaatgtctggagtgttctaggttacattttcctcctctccacaaagccatctttaattaccccttcaaactacaggttttcattatttgtgaaagaactaataagcaatttctattcagagatcaacagtgatttaattttttttttttttttgagcaggggtctcactctgttacccaggctggagtgcagtgtttcaatcaaagctcactgcaccttgaattcctgggctcaagtgatcctcctgtctcagactcctaagtagctggtattaaggtgttagcctctgtgcctggctcaagatattttttttaaagtaaatttttaacacagctctggttatagcagcatctgcagagaggaatggggtcagtcaagatttctgaaagggttaacatcaatataacgtgagactatctacctctctttcacatatacccatgaatatgattttttggctacatgtaccatatcacattagccaaacattttggtagtacctgccctggagggccatgaactaaaacagcaggaagactgctaacatcactcagacactttcagtggcatgaagagaggaagtgtgcatggcttatccacaccaccctaaagctcaagccatcattcattagactgcccaaactacactttagtatggcggtagataacattctgatcaaagtaaaaagaaaggagagtttaattccttctttcttaccttctaataaatcagaggctgagcctaacaatattccatcaccaactataagagattaaaataatattcagaataatgaaagttaattaaaaactgctgaaaccaactaaacaaccaatcaaggaactaagaatactaggtgaataatattctgatctacccgaacttggactgaatttttgtcatctggcactaattgattttttaattttcatcatctcagtttttattatttcttgtttgaaattggcctaaagattattggggactagatatagaaatattcactataaatggtgaagccaagattgccaatttatttataactccttcactactttatttcaaaaaggattcaggtgactatgttgtactataaattgtaactcagaaagtggcaaacaaatacacgagccagtaaaatctattttggggttatacagttaaataaaataaaccagtaagtagtaaattcctttttttcacactttaaaaagtttaaacaagaaacagatattgttttgaactgaatctgaagatgtagcctgctatgtatcatacattaccttgaatccctgagatatatgtgttatttacatttagatcttaaaatatttcagaataatattattataatactattgataggctaggtgcagcggctcacgcctgtaatccagcactttgggaggctgaggcaggtggatcacctgaggccaggagttcaagaccagccagtcaacatggtgaaaccccatctctactaaaaatacaaaaaattagcttggcatggtgcttgcacctgtggtcccagctacttgggaggctaaggacggagaatcgctggaactcgaaggtggaggctatcgatagttattgggtttgcaatctgcggaggctttctaaaagcaaagtgagaaacctctttctttactctttttttttttttttttttgagacggagttcactctgttgcccaggctggagtgcaatggcacgatcttggctcactgcaacctctacctcctggttcaagcacttctcctgcctcagcctcccgagtagctgggattacaggcatgcgccacccacgcggctaattttgtatttttagtagagacggggtttctccatgttggtcaggctggctcaaactcctgacctcaggtgatctgcccgcctcagcctcccaaagtgttgggattacggtgtgagccaccgtgcccggcctctttctgtactcttatcctcgatttcttttttttcttgtatttttagtagggacggggtttcaccatgttggccagcctggtcttgatctcctgcctcgtgatccacccacctaggcctcccaaagtcctgggattacaggcataagccactgacctggcccttcttatcctagatttttaggtgcccaagactactgatttgtagtcaaggcaaaactatcagggttcagcaaccaatctccacacacacatgcaagcattcacactcctcaaattattgttatttaaaagaatagtagatgctcattatgaaatataaatttcctatataaactagacataaccaatatcaacatattagttcctttcattaaaaaaattaatgtgaaatatatttatattatgtaccttgcattactgagataatttagaatatgtgatgtctagagtttaaaatttagaaactattatacttttatagttatatattataaatatcaatatattgaacatattataaatataagtatactgtgtctatattatatagaatgcaattaaattaatataacatacttataatactatttatatattacatatgattatgtcttatattttatattttacagttatatatttatatagtatgtaccttgcatttctggaataatttagaacaagagaggtttagaagtttaaaatttagaaaccatactatagttttctgcttgacattaaaacaaacagattcagaaacattaatcttatttcttattataaaatggaagattctacatggtaaatgttataatgaacactagcctttatgtgccctactttttctttaatcaattttgtgaaagcatttctaaattttattacataattttctaatttttaaaagtaactgaatatgatacataacctccttaaaccaagcatatgaaatgtgaatatagaactttaaaactgaatgaatgaatatgtttctagctgcattaaatgttttaaattacatgtttaaaaactcagcattttgtcacaaatattttttcccctattattctataacacaaaggcacctgagatggtttttgctcctgacactaaacagctctggctgctctgcctttaaatgattagctctgcctttagctcccctgactttttccgtatggttaaattattcttgtgcctgtttgtatgcatgttctaacagctcagttccttagagctctttctgattggtctatcaaaccagttgtagacaaaaccaggtagccatgcttattagcagtctatataatctaagaataaacaggtggccggtgcagtggctcatgcctgtaattccagcactttgggaggcagaggtgggcggatcacctaggtcgggagttcgagaccagcctgaccaacatggagaaaccccgtctctactaaataccaaaattagccgggtgtggtactccggtggctgagacaggagaatcacttgaacccgggggtggaggttgcagtcagccgagatcgcgccattgcactccagcctgggcaacaagagcaaactctgtctcaaaaaaaaaaaaaaagagaaaaacgagcttcaagtaacagtgtgaagattttctgaagacttgaaatacatgagattttagcacttggattttgtaacatttattcgcctgcttgaaatccctttcttgactccttcaagacagctgagattgccagagaactgattctagacaatgagatatgtctttgattaatttcttattttcagaatggaagcaatagcctacataaaagttccttgaacagaaatatgtatgtttagtatactgtttgatagtctattaagaacaaaattccattccctaattagagatcacatacaggaaaggagttggtacatgtaaacaataaatgctagttaaattggagtttaagtaggaatgtgcaatttgaaaaagtaaaagcataacattttcacatcctaaatgtgcctaatgtgccaacctaaaaccagaaataaatcatataaaaatatactaagggccgagcacaatggctcatgcctgtaatcccagcacttgggaggctgaggcaggtggatcacctgaggtcaggagttggagaccagcgtggccaaatggtgaaccctatctctactaaaaatacaaaaaattagctgggtgtggtggcatgtgctgtagtcccagctactcaggaggctgaggttcaagaatcacttgaacccaggaggcagagttgtagtcagctgagatcgcaccactgcactccagcctgggcaacaagagtgaatctgctccaaacaaacaaacaaacaaacaaaatatatatatatatatgagtgtgtgtgtgtcttgtgtgtgtgcatgtgtatatatatttatatatatatatcacaataagatgacagagtgaacaaaagtctcttattttaatcatatggtggcccctgtttggtaaaaatcacatagcattaaaacatcaagaacaattccaaatatggggggaactggagtggaggatgagaaatgaaaagataaaaattctaggatgagaatataaggctgtgccttttacttttacaaacaaatattataaaatgatgtcaacttttcaccatctctttctgagtgtttatagaatggaattttaataggctagatatcatttaatcttacagaatatataccaagtgacacaccaaagtataacaaatgttaaatactgataacaaaagttaaatggaacagaaatgaaattagtaatttacagatcaaatagataaaagaaaaaaaagaaaaagaaaaaaatgtaatagtaaaagatatagaggtccttcgacttacccaagcagtgtgttctttcaagtaacagcctttgtactcatagtattaggatgcttcaattgtcgtaaaaatttaacttccttaagaatatcttgccattctattgaagtcagaaaaggaacattttaatttaatttttgataggaaaatagtatttctatcaagtatacgtatatatcatttatattattgtaaatggacataaagtaaat

SEQ ID NO: 5028 - DNA, 13227 bp, Homo sapiens
gaaaccccagaagggttattgttttgtattatttatatatactatacttcttaaattaatgtaacacataactaaattcaggattgatcccaaccttctagagccagctcctctggcgcagggaggaaacagttgtcacatcaccatgcaggttacattcatcttccactggaatgatagagccctcaggcagtggcctgactgcagacgagcagaggactggctcctggggacagcaggctctgttgcttctcctcattggtcatggcttagcatggttcctccccacaagtcctagtaaacaaagcaactcgcaaaaacccaagtcactacttttaaactctgttggataagggagcttttccacagcttggactgagaacctgtgctctagaagtgctattctgactagatgtatgaagggagtgggtgcaggagacaaaatggctaaaatgaaaatgggagtcactggccccatctgcagctacaactcaagatgtctacagatggggtcagtgtgacatgtgcagggggaggggcagagggacaagacaggcagggagggtgctcctggggacagtatcctccctctggccttcacttcttggccttgccctgggcagccacagcttccatggctttgcgtacctctcttcatcccccagaaactgcatgggcttgataggcttcaagttcttgtcccattcaagacaatgggaataccagtcggcaggttcagctccatgatagcctcttcagagagacccccagatgcttggcaatgccccggaggctgttgccatgggctgcaatcagtacacgtttccctccttgatctggggaactatttcttcattccagaaggtcagagctctggcaatagtgccttcagactctcacaggagggtagcagatcttctgtgaggtctgcatacctgcgatcctactgatgttgctatagaaaggatggttgggctccattggaggtggtgggacatcatagagtgcctccagatcttcacctgggcctcaccatgctttgcagcaacctccgcctccctgttcaagcgattctcctgcctcagcctcctgagtagctgggattacagatgtgcgtcacccgcccggctaattttttttttgtatttttagtagcaacggggtttcatcatgttggtcagctgatcttgacctcctgacctcgtgatctgcctgcctcggcctcccaaagtgctgggatacaggcgtgagccaccgcacccagccgtgaggtgccagatttttatctttgccaaactctaagtgggaaacagtctcttggtgaaattttaattcacatttgcttttcagtgagctcacatcttgtcatatgtttaagacctatttgtcttcttttatttgtgaacttttttttttgagacagggtcttgctttgtcatccaggctggaatacagtggtgcgatcacagctcactcagcctcgacctctgggatagctgggactacaggccaccatgcccagctaactttttgttttttggtacagacagggtctcaccgtattgtccaggctgatctcgaactcctgggcttagcgatccacccactttggcctcccaaagtgctgggatttacttttattttattcttaggacagcatcttgctctattgcccaggctggagggaagtggcacaatcatagctcactgcgcctccaactgctgggctcaagccaccctcccatctcagcctctggagtagctgggatgcaggcatgcaccaccacacctggctaattttctaatttttttatagatggggtctcatttgttgcccaggctagtctcaaactcctagcctcaatcaatcctcctgtctaggcctcccaagtgttaggattataggaatgagcgaccacacccagaacatgattttttatatatgtaatggagaaaaatactcctttaagatgttaattgtaaatgttttcttcagtccatcatttgacataactgtatggatttttaatgtagtaaaaaatgcaattttatgacttttgggtttgtgtcatagttaaaaagactgtttccacactgagatgatacaaaaagtttctcctttagtcctggctgtattttttttttttttttttttgagatggagttttgctcttgttgcccagctggagtgcaatggtgcgatctccactcaccgcaacctccgcctccatctcccgggttcagcaattcttgtgcctcagtctcccaagtagctgggattgctggtgtgtgccaccatgccagctgatttttgtatatttagtagagatagggtttcacgatgttggccaggctggtctgaacacctgacctcaagtgatccacccacctcagcctcccaaagtgctaggattacaggatgagccaccgtgcccagccagcttctggctgtattttcgttttcatttttgtacgtttaatattgaaggttaacatttaatttttatttttatttatttattttttttgagacgttgctcactctgtcgccgaggctggagtgcagtggcgcaatcttggctcactgcaagctctgctcctgggttcacgccattctcctgcctcagcctcccaagtggctgggactacaggcgccgccaccacgcccggctaattcgttttgtatttttagtagagatggggtttcaccgtgtagccaggatggtcttgatctcctgacctcgtgatccacctgcctcagcctcccaaagtgtgggattacaggcatgaaccaccgcgcctggcctattttttattgattttttagagatgagtcttgctttgttgcccaggctagagtgcagcggtgctcactgaggccttgaacccctggctcaagagagcctcccacctcaggctccgaaaatgctgggattacaggtggtgtgagtaccacaccagacctagagtttttattttttaatttttaaaaaaatttttatttattttttgagacggagtctcactcttttgctcaggctggagtgaagtggtgcaatctcggctcatgcaacctccgccccctgggttcaaacaattctcctgcctcagcctcccgagtagctggattacaaacgcctgccacccaccatgcccagctttttttttttttttttttgtatttttgtagagacgaggtttcaccatattggccgggctggtcgtgaactcctgacctcaggtgaccatctaccttggcctcccaaagtgctaggattacaggtgttagccaccacacccagccttttaaatgtttttttcattaggaacaacatattccaaacctataaattgagttcatcttaattttttctaagatacaaattatgaatccaacttactttttttccagattgctccctttcttcctaatgtcttttattaactcatcttttctcaacagattagaaatggtactttttcatctactacattcctgcctgtatttgaatctgtttctaaatttctctgtcttctattatctctatgtgtcagtaaccctctttaattattaccttttaatgatagatttgttgtgtttaatatctggtaggattagtctatactcattatgtcttttattttcagaagtttcctattgtttaatttgccatatgacctttaaatcagcttttctagtccctccttatctcccacagaagactcttaaaatttttcattgtgatacacttagagattaatttaaggagaattgaatctatatgaagcatcttcatatgaagaccaaggtgtcagcccccttgcctctgcttttggtggctagtgactcccaaatttgtacctctattttgagcacaaggtctgttcctcaccctaggaatctcctcttggatagggggatcccaaagataccccataccctgatcccatacgtccctccagcttagtgcattcccccttctctttaatctactcaggtgctcaagccagaccagggtctgaagttgtctttggtctctcctggtgtccaagagccatatctaaccagtgctaagttctatttttttttttttttttgagacggagttttgctcttgtcgcccaggctgagtgcaatggtgtgatcttggctcactgcaacctccatctcctgggttcaagtgattctctacctcagcctccctagtagtggggactacaggagcccaccaccacgtccagctaattttgtattttttagtagagacagggtttcgccatattggccaggctcgtctctcgaactctgaccttatgtgatccgcccacctcagcctcctaaagtgctgggattacaggggtgagcactgcgctcagcctgtggtatatttgtaatcactgatgaaccaatattgacacaatattttaattcaagtccatagtttacattaaggttcactcttagtgttgtacattctgcaggttggataaatgcatgtcatgcatccgtcattacagtatcatacagaatagtttcgctgtgtaaaaatgccctgtgctccatccctctcctacccctctgaatccctggcaactgctgattttttaccattgctagttttgccttttctagaacgtcatatagagttattggaatcataagtatgcagctttttaataccagcctcttttacttagcaatatgcgtttaaggttatgcatgtctttttgtagcttgatggctgatttctttgtatcgctaaattttaaagaaattgcaaactgtcttccaaagtggtggtgatcattttaccctctcttggtgtatgacagctccattcttctatatccttgacaacataacaacacttggtatggttgatcttaacttttagccttctagtaggtgttcttttagaagcagtccttctagtggctttaatttgcatttccctagagtaatgcactcagtgttttttaatgtgcctatttgccatccagagatctttttggataagtgtctgttcaaatgttttgtccattttttgacaggcgcggtggctcaccctgtaatccagcaccttgggaggcagaggcgtgcagatcacttgaggtcaggagtttgagaccagctggctaacatggtgaaaccctgtctctactaaaaatacaaaaattagcctggtgtggtgcgggcgcctgtaatcccagctactggggaggctgaggcaggagaattgcttgaacccagaggtggaggttgcagtgagccaggatcgcgccactgcattccaacctgggtgatggagcggactccatctcaaaaacaaaaacaaacaccagaaaacaaacaaatgttttgtccattttattggatttttattcaattgtaaaagttctttatacaagtcctacatcagatagaattttacaaatattcgtcctagtctatggcttatcttttcatttttaatagtttcgtgcatttgagaaacaaaagcgttttattttgatgaagttcaatttattgatttcttctatcatttcactttttgtgtcatatttaagaaatctggccaggtgccaaagctcacacctgtaatccagcactttgggaggctcaggcaggaggactgcttgagcccaggagttcatgaccagcctagtaacacagcaggaccccatttctacaaaaaatttaaaaattagctgtgtgtcgtggccgtgcctgtagtctcagctactcaggaggctgaggtgagaggatctcttgagcccaggatttaaagttacagtgagctgtgatcagggcactgcactcctgcctggtcaatgaaagcagaccctgcctttagaaaagaaaaaagaaatcttttcaaacccaatattgttaagattgttccatttttaaaaaaaaaagttttatggtttggccatttatatttaggtgtgtaatccatttgagttaaattttgatggtgtatcctaaatagttatcaaatccatctacttctgcctccacctctctagtttaaaccacccttctctgtccctggacacctgcgcagaaagcctagagctggttccacccatcactcaccaggttaggtatttcaggcaagtcacaccctctcagcctcagttttcctcttttgttaactgagggtgaaagtggggttagattagatcagcggccttaacttttgaggggtcgtgggccctagagtcctgggaacgctatgcagtttcctcagaaaatgcttgcatccacaacatgcaagactgcagcagctgctgggctggggctgcgagacagcgaaaagccctgacttgggggggtctcgggagtctctgcagtctccccacccacaccccggcctccgcgccgaatcctggccccccaacttcttgcagcccgtgaagcaggatctagggtcctgggggtggggagagggggctgccgtcctgctcgcagcctctgccgccctctctgggtaaggtgacacatgggcgcttccaggtgggtgggctgagagcctgggggagagacagggatgtccacctctctaagtttccaggttcaagaaaccccagaacgttagagaaagtgggctcccacaattgcccaaccccatcccataggatgcacgcatgcggaaagtcgggcgaacggggcagggacttacccaaggtcacgcagcgagcccggtccccctgcgttccccgggagcgctgagccgggacgcggcggtggggtggggaaggggagtggcgcggccctgcgggtgaggctgccgtttgctgagtgtccggcaggggtctgctcgctgccagcccggcccctctcagagcagctgccgcagcccgaggtaatctcggccccgcgccggggctggctgggaaggcgggagcagctgcggtcgcgcggagcgaggggagctggggaccgggcgggcccggggtgcgggaggcggcgccgccgcacaatcgccccggaatgcccgccagggcgcgcgtgggggcggccgtccggccctgcaactcgagctgctgcccctggttaaaaataccccttgcccgccctccccctcgtttccccgcgtgcccttccgccgcgccccagcccccgcatgtcccccgcgctggcccctccccggggactgctctgccttttactaatttgtcctctcgcggaattgcccccggctgcggagggaggggcggggagacaccgtgagtaagagatagtcagagacctgccggagagataagggagagccgagaggaagcggggtaggagccccaggaggaggaggggagaaggagagagggagggcggagggcggaggggcggcgggaggagggcggggaggaggctcttcctggttgggccctgccctgagctgccaccgggaagccagcctcagggactgcgcgacccccaaacacccctcccccaggtaagaagctgggtagccgagccgggattccttaccctggccactgctcctgggctgaggggctgccccagcacggtcccttctcgggggccctgcgttcctggagcaggggtgggggctggcggagcggcacagcccaggcgcctgtcccgcctggctcaccgctgtccccaggggctgggctagggcccaccagctctgatatcgagctgctgcgggggcctgaggagggggaccccgaccgtctggggttttcagcccacggcaagggccggtgcaccaggagcttggttagtttggggagggggttgcaggcctgtgaacaggacaaagaggccttccctgctgtgtcccacctgcccagttccttgtgctgtctggaggctcgccctgccccacctgacctgctggctcactacagagctgcaagcccctgacaatgggatcgggaaaggagaggtggccggcacgcctgggaactgggaaatccctttcctggattcacgggagcaccgggaggtggctgagaaccctacttctgtgaggggagcagtgaggcagggaaccctaggtttggggatggataagcaggggcaggagagcagagcttgcaggcaggagccaggttctagtcttgggaaggcctgggttctgagcaggcccatctgtccggcaggatgtcgaggagatcatcacgccggtgtactgcactggggtgtcagcccaagtgcagaagcagcggccagggagctgggcctgggccgccatgagaatgccatcaagtacctgggccaggattagagcagctgcgggtgcgatgcctgcagagtgggaccctcttccgtgatgaggccttcccccggtaccccagagcctgggttacaaggacctgggtcccaattcctccaagacctatggatcaagtggaagcgtcccacggtgagaggggccatcctgggtgggactcggctaagccaatcctggatgaggagtagggatgggactccatgtccctggtggggaatggggtctggggggcctggtgccaatttctgggaggggctggccgaggaacaggactctgggtctctcgtagaactgctgtcaaacccccagttcattgtggatggagctacccgcacagacatctgccaggagcactgggtaggcccccagggcgtcgggtcccgggtattttttccacagtagttcccattcccgctccttcaggctctgccccaacccctccctcttgcaagcccaggcaggatcggctatcagcgctggggctggtttgcccagattcctgggtcttttctgcaagctgagggagttaagtggcaccctggccaaggaaccccagattctccctagcacccgcttcccccccggggcaggttggtagagcaggctaatgtgcatccctcctgccccaggggactgctggctttggcggccatcgcctccctcactctcaacgacaccctcctgcaccgagtggttccgcaggccagagcttccagaatggctatgccggcatcttccatttccaggtgagggctcccctgggaggaggggcagcaggcactgggggagatgcggaaggatgacccacaatacctgcagtagggccacaccctgtggggccagccctccctctagcaggtatttgacctctcagtgcctctcgggtctgtcatgtgtgaagtgactgggctgggcaggtatttcggctggcagttttctaggtggttgtatgtatcaggtggaaagtgcttgaaagaacagaaagacttttgtgtttatcctgtgggacaaattccactcctcccggaggtcggtctcagttgccccatctgagaaggagtgttcgctggggaaaacagatcagcacgtgtggccttctccacgtgtcaagcctctatcccccaactcctcctgcgctttggcaaggtctgactgagcccagcagaaaagaaaactcgggattaagtctacgtaaaccagcttttcctgacggtgtgcccagggcccattttcaagtcacaccaatcaattctcaatgagctgcctttgggagggacatgcccagcaacccggatgagactctccagccttggaggccccagccctgcccgaaggactcttgggtgttcctccttctgcctggttagagagccccttaccctactctgtccttgcccgccttgcgcgggggaggtggccctcggaacccagggtgcggaacccacagtgcggatccactttggcccaggccacacccacctgctccagtctgcaggggcgcagtctcgcccccttccctcgctcctcaatccgctcctccctggcctccgattggccagttcagtacccgccacccacactctccgaacctgggctcctagggccgcctccaccccgccccgccccccgttgtcctggccccgaccctcagatggtacctcgagtccttggtcgcttctgaccccagacgccttcggccccgacctgccctgggaaacgtggcctttgtggcatctcagaaacaaagcccgtgattgtgagaacagtcctgcccatcttgtggttgtaggatctggatgccacattttcactgctcatccaagacacaggtgcccctaacccccttgaatagggagggaagagccagggggccatggcctaaagggggctagttccggaaagcccaggccccagagcttttccacctctccgtgcctgagaggaaccctgtttgttcagtgactccctaaaggctttgcctgtgctcttgtttaagtctccgtgaagaaggcaccgctgctcctttttatggatagggaaactgaggctcagaggcgaaacttttccaggatcatgtagctagtatgtctcgagcatacatgtacatatcaagtataacatgtctatatgtggtatgcatgtattagtatacagcaaatatgcaggtatctagtatcattgtacaggcaaaggaaagcatccccttagccctctgaaggttcactgaaaaatcaatcacaaaaggaggttagtaggagaaatggcatacaaattgattagcctgcagcgtggggcgggaaccacagagtgttcaccccagccccacaatgggtacagaagcctatataccatctgaggttacaggaagaatgggggctcgaacatggccaaaaccagtttctggtggtaaataggttatagtggcaagacagactatggaagggggagaaaagggggcctgggtagcaaagcagtcttgttatgtagatgaaacctcacaggtagcagccctcagagggaatagatggtattgtttcgttcagacctttaaagggtgtcaggctctcagtctgacaagggaaggccttaagaaagcctggctacatcaatgcagattttctctacagatgcaaatctcccccacaaaaacagtattacagggctacttctgtttgcagaccctctgaacagctatctcaaaatatgtgaagaagtatatttcagggtgaaatactttgatttccttcaatacctagatacatgtattagtatatctgtagcatacatgtatctagaggtacacatgcatctagtatgtatctagttatgtgatttagtatacatgcatctactatgtatctggtatacctgacctagtatacattagtatgtatctaatttacatgatttagtctatgtgtatctagtatgtatctgggatgtgaatcctgcatctaggaaggtaggggtaaggatggagctcaggtccgggggattccaaacaggtactcaccgtgcccctcccccacagctgtggcaatttggggagtgggtggacgtgtcgtggatgacctgctgcccatcaaggacgggaagctagtgttcgtgcactctgccgaagcaacgagttctggagcgccctgcttgagaaggcctatgccaagtgagtagcggctgaggggcaactccagcttccagctccccctaggggtgggggctcatgactgtcttctcagaggtcctgcttgatgccagagtgctgacctggagctgcccacagggtaaatggcagctacgggccctgtcagggggcagcacctcagagggctttgaggacttcacaggcggggttaccggtggtacgagttgcgcaaggctcccagtgacctctaccagatcatcctcaaggcgctgggcggggctccctgctgggctgctccatagacgtgagtgtgcccggccccgatgctttggaccctggaaccctggtatcctgacctgtcacattttctaaaatccccacccaggctccgtccagaccctgtcctgcacttaagcttcatctctggatgcataccctgcctcatccatccttccaccccccatgcctggtgtcgctcctgtcctcacctacccactcctcccccaaaattcacacctcagctctttcctgtgcttgttttcccgtctaccatgctgtttccctcattctgtcatctcaatccatgccatcctctgtccagttcaccagcctcagatttcatctcctgtctcagttcccacccatccctagcctcaatcccacactcactccattcccacccttcctgctcctctgttcccacactcaactccgctccccagtcctcaacgccagacttgaccccgtatcactgccatccgcagctctaaccccagctcccattcccatttctaactgactctttgtcctcacgtccttctccgtgaggcccactgagggctgtgtggctctggtgggctgtgacggctgtgtgtgtgcacatgcatgttcgcacaggttctggtcagccctggccagtagcgtgtcagcggagtgcctgggctcccctgtcccagtggcagcattggtggggtacccaggtacccctctccaaaagagcagcatctatatgtgggggtgtctataggtgggatcggggtcctgcttgcttctcctagcaactgttgtatgtgcaagtgggaacgtccaagaccctgaggctgggggctcatctgatagggcggggggacctagccactgaccacagtgtgtgcctcttctgcagatctccagcgttctagacatggaggccatcactttcaagaagttggtgaaggccatgcctactctgtgaccggggccaagcaggtactgccctgggtggggccttccctgagggcggttcctgccccctggcctgtccttgcctctctggcacctgaccagggctgtggaggtgctggctcctcctttcccctcctgcagcaccttatctctcttctggggacacccattgagatgcctatcatgtcctgccctgactgactgtagttcatgtgtgcagctgcctgccgggctgtgaattccaagaggacaggcttcatctgggtgctgagcagggcttggagaggagagggtatgggaggcggagtgttaaagtgcgtgcatgggccaggtgcactggctcacactgtaatcccaacactttgggaggctgaggtgggcagatcacctgaggtcaggagttcgaaccagcctggccaacatggtgaaactctgtctctactaaaaatacaaaaactacctggggtggtggcaggtgcctgtaattccagctatttgggaggctgaggcaagagaattgaattcttgaacccaggaggcggaggttgcagtgagctgagatcgcaccactgcactccagcctggtgacagagc

SEQ ID NO: 5029 - DNA, 15118 bp, Homo sapiens
ggcttccaccattgaaagctcatatattttctgcctccaagagcctcctgtgagttatcaaccccctagagttgatggaatatttatggactcaattagtttctctaaagccttgatgcattcaatttttagatcaatccagggaagaatgtactacttgtgtccccattttacagaaaggaaactgagtcccagagactgtacatcgcttcactagccctacagctagtgaaaacggatggctgggaaataaagcagaaactctgatgccagaggccctgagctaaccatcagctccactgcctcccagtgcatcttcagacaaattttattcccatagcctgtgtcaggcagggtctacttattggctggcataagcactggattcagtgccaagtcctcatcccagctctaccattcctcactgtgtagccctgggcaagtcaccttccccctctgagccttcactcctcatctctgaaatggaaataaaaataataatacctattcttaagtggctgggttgggggaacaaggaggcaagccaggtaaagccccagacatttgggaggtgcagcaaatagttatctaatagtagttctcttcttgttccaggttgacagatacactcatggcccaaccacttagacaagtattttcgctcaacccaatggaatcttcctcctcctcctttttcttttaaacctcactctgacgctaaatcaaagctgagtgctggtccctgacaggtcttgccttcagccagcgctgccagcagacgtccaaaatgctttatgggtcccctacctttgcaattagcaccacgcctctgcaggatgcacaggcctgaaggacaggcaatgtcctcctctctcggtggcaccactcctagaactcagagagccattccatgcccttcctggagccgaaggaaatctgggttgttctttggacagctggttaccccattctcagctttggaggagaacactggtctgggggttgaatgggggtgggtggggacagatcatatccttggttttcaacctgaattattattatgttgtcaacgccattgttgttgtcattgttattattttagcagaaggttgctttttaacgaaatcttccagagattctgtcaagatgtagtgggtgccctgaccatgcctgcttgtcctcacccttcccatgcccactcactttactactgcctttgcccaggggctttctctggtcactgagtacactgggcatgtgcaagggattaggccagagatgtaggggagttggaggataatatcccaactccctcacccctgggagagacaactcccaggtgtgctctgtgcagcctccagagttccccagcaggactgtgctccaagtgccggcagcagtcacctgctcattcaccactctgtattggtctcttcttttcctgtctccctggttactcctctactggggcatccgagttcacctcccaaaggaaccacctgccctgaagtctgtatctcaagctctgctactggggagcccaaagacagatgcctaaaaatgaccgtaactactcacatttattttgcagttctctgttagtaggcactatattcagtgcttttcatggattgggtcatttgaagattacacagttctatctagaggaaggtattttttttcagtccctttttacaggcaaggagatgcggatcagagaggtggagtaccttgcccagggtcacacagccaggaagtgtcagagcttcttgttggaggcagaagtgggtacttggactccaatggctgaaccctatcttgaccttccggttgctccagtgctcagctctggaactctgtaaacatttgtcctgacaccaactcactgatacagccagggaagcctcagataccatcagaaataggaatagtgatgtctttgtttacgggggctgctgagagggctaaatgggacacagctggtaatgtgcctgtgtgtgctgcttccacagcctggtagccctgtgctctccctctagggacacactccacagttgccctcgtttatctattcatgtggctgataaagcagcctagaggagggatggagccaggcagcctactcctgggtttgaagcctcattcagccattgatgagcccgtgtgaccttgggcaagtcttatcttcagtttccccatttgcaaaacagagatcgtagtaatagtttagcaatagtatctatcacagagttgatgaggccatttaaggaggcagcccttgcaaggcactcagaacagtgtcctctatcagcaacccaggtcacagctgtaaccaacgtttaaccttgtggagtcctgagctttcagcaataaaacggggacaatggcattcccacattgagtgatgtgatgacaatgagtcatgtgaaggacatgcctggagcatagtagctactcagtaaatgatgagttttaatattgtgctgattaatattaattaactatatgaataatcattaataatatagtaattgatataacaaattagtattagcacttaatatctagtattcctggtgtggcactaacagaaatgtgactgggctctgatcactttccctggggtgaagcacgccgtgaaggatgtgtacacacatttcactttattgttacaacatcgagggttgccagatcaaatataggatgccccattaatttgaatttcagaggaacaaagaaaaatttctgggataactgtgtcccaaatattgcaaagctatacttacactaacaaatgtaattcattgtttatctggcattgacatctaactggcatcctgtgtttctatttgctaaatctggcaacctttacaacaactcatgaaacagccatgaagaaacagatacgaggagaggcaaaggcttacccaaggctcaaagagccagacgcagccaggtctcttaggtctgcgccccctgggttcattcaatttcccgtgttggctgttgtagtaggaagatgtgttctcttggatgacattgctattttggtcaactgcactatctcataggtcatgatgggagtgcagtctgctggtgttttgggggacctgctcccattttcttattcccccatcaagatcccagggagtctgcagcacccgctgctgtctatgtacccaacacatctcactggcccccaggcaggccacctgttctatgcacaatctgggttgggctccctggtccagctgtgcagagaacaggaccaaattcaaggctggctagtgtcaggcaaccctgcggaaacaaacaaatgcaaatggaaaaggaaaaaaaaatccaccaattacttaatgctttctgatgtccaaatatttcgcctcatgtgaaccgagctctgagacctggctgggaaaacggatggggcaggggccagacgttttctacgcaaatccggagggataaaattgcactttcaatccagagaggtggactgggtatctctcgtctgaaaacatcttgaggtgaacaaccaagtcaaggatgggaactgggcccacctggaaatgaaaggcctctcgggctgctcttcccagcccagcctcagcttccatttcctgctgctgctgctccagcctgacttccctcctgttccctacctgtatgggtccagctctcctttcttggcctggaatgttttccctttcacctgtggagcttcttttccctgtgaaggtgtccctgagcatgcccagagacacagacacacactaggcatctggatgcagccccactttacagatgcagagattgaggcccagagagccgaacaggtttctccaagcttcaagccaggtctctgggccccacatccagggccctcttcactgcaaatgttgtctttattggacaacataaatggcaccgaccctgggctctgcttctttcttctggggaacctcaggaaagttgcctaacttctctgagcctcatccagataatgttgtaaaagcatattggtgggaaagaatgagacccaagtttttatgccaaaattcattttctttcttctttctttctttctttctttctttctttctttctttctttctttctttctttctctcctctctctctctctttctttctttctttctttctgtctctctctctctctcctccctcctccctccctccctccctccttccttccttccttcctcattcattcaaagatgcctttgacatctctctatgctgtcattaccctatggcctaaggacatggagtgaatggtgcccacacaagtctccaaggaccttctggtctagggggagaagcaaacatccaaatagacacagacacctcaagacagacttattagtggtagggggagtccaggggtctctaggaacacaaagagccctccccccaccccacccaggcagggaaggccttcctggaacgtcatctgggcttgaacctgaaagatgaataggaatctggtaaaaagggatctgggtaaaaagggatgagtaggatctgggcaaaaagtgagtggaagggaattttaggaataaggaacaacttttacaaaggcaagacagccagggtcattctgggacttgcacagagttcaagatgatttgagaatggggacaaggtgaggaaggaatcgaacaggggagtggggctggtcctgaggggtcttgagtgccaccaagcttcttgggctccacccagaggacccaacaccagcccctccatgtggcttcatgagtttctgctttcctgatctggttgggaccagatgagagtcgccagcctgcaggccccagtccaagatctctggactggaccagctctaaaaactctgcttgttctaatgctctgaggaaaaaggggtggagggaccccactcacactacgtgcaggttgaagattaaacaggataagtgcagagcctgccttgtaaaccacagagctgtgtggaaagaacatcgtaaaggtatggttgggaggaggaatcctctatctccttccaagccacgagagactgtgactcaataatgaaaactgcatctgattttccttgacttgttctgggcagaatcttgccttctctcccctctgactcatgtgcaggctcacaccatccttcttgaatgacaacagccaacacttactagcacccacgctgcccatgtgatgctcccaacgacagccttggaagtatttctaagctgcatttataggtgaggaaatggaggctcagagaagtgaaacaatctccctgggatcacaaagatacaacgagctcagtgaaaattaaaaggcaggtttgtattattccaagatcacctgagcacagtagttcttggttaataaactttgaagatgcacttaaccttggcaattggaggtttaggatggggagggaggtgtttaaaaatgtcgcattcactgcccagatgaaagttaaacataattatctccttcttgaggaggaaagactgctagctccctaagaccccccggattcaaataagcaccttcaaccctccagagcccacttggtctgttcacagctgcctagtgctcttggtataacagcaagatgccagagaccttgctagggatccgggcaaaaagtgagcaaggtagctggttccccagtggtgtgatgcttggctgataggaaactcaaaagaaaccttgtaacacacacacacacacacatacagacacacacacacacacacatacagacacacacacaacacacacatatagacacacacacacacacagacacacacacacacatacagacacacaacacacacatacagacacacacacacacacacatacagacacacacacacacacataatgtagcacattctagagtttataaagccactgcatcactgttcacagtgatgaaggtcatcaagatggttttatcagctgggtgcggtggctcacgcctgtaatcccagcactttgggagccaaggtgggcagatcatgaggtcaggagatcgagaccatcctgggcaacatggtgaaccccatctctactaaaaatacaaaaattagctggatgtggtggtgtgtaactgtagtccagctacttgggaggctgaggcaagagaatggcttgaaccctggaggtggagactgtagtagccgagatcttgccactgcaccactccagcctggcgatagagtgagactctgttaaaaaaaaaaaaaaaaaaaagaagaagaagaagattttcccaacattgtccccatttcccagaaagaaaactgaggcccatccagaagttaaggattccagtggtagaaccagcaccaggtgcacgatccagctctgtcacatcatgagtccctagagagcagaaattttgtgctgacttcggatctcccatgaacagctcctcacctgaattccagaaatcagtggggtgaaccgcacaaggtaggaaccaggtctgtctccttcacctcttaattccagagcctaacatagcacttgcacaaagtagtagcacttgtaaatactcgggggtctgaatagaactgaaagcttagtaataaataaattaaaatacttaataaatagacacatggttaagtgaataaattcattaattacataaaggcattagggtgttcggattaaatgaaaagtatatcaatggataatggatgatgcaggatgggtgaatggatgatggataagtggatagatgggtggatggaaggataggtgataaatgggtgaatgaatggatgatggataagtggatagatgagtggataagtggatggtggatggatggatggatgcatggatggatggatagatagatggatgacaaatggatggggatgaatgggtgaatggatggatgatggatatgtggatagatgggtagatggatgggtggtggatggatagatggatgcatgaaagaatgggtggatgaatggaaagatgggtggatgtgggtgaatggatcagtgatggataaatgtatagatgggtggatagatggagagtggaggatggatgaatagctgagtgcatggatggataaatggattaattcataagtaaaaaattaggatagataatgaatgtataaatagataagcaaataataaatagggaattaattaacattgacttggtggaaagatggataaatgaataagtgagtataattcaagtgtgggtgtggggtaagtgatcagaccggggttgctcagtgatcagactggggctgctcagagagaagaggctgcctcagtcttcagcctcccagtacccgcctcccatctccattaaaatcctggaaatcctggctattttcgtcccttttgcaaaggggagctatttttttttttttttttttttagacacagcttattaaaggagaaagcacacagagcccttcctcccacaggtgcctcttttctgcataaacccaccctctgtcaggcagccaggaataaaactaagcagaaagccacagaagtgtaagaaatcaaatacagaaagacagaaaaagaagttgggcaaattttactgctcctctagagagagccataggagggagatttattaggctgagcctaaaatgagtgatctcctttacccatgcctgagttattagtgagctccatatgccaggctgtggggacacatggataaccacgcagacacagtcactgcccttatggaacttaatgcctagtgggagagacggagaaaaaaatcagcaaacaaaaatatagtatggcatcagaaaaaagaaatagtgagtgtatggtaatctatggctgcataataaatttcccaaaatgtagtggcacaatttctgggggccagaatccatctgcatggctctggcttaggagctcttgtgaagttgcagtccagatggtgccaggactgcagtctcatctgaaggcttaactggggctgaaggctccacttcccaggtgctctcaaacatgcttgccaagttagtgctggctgttggcaggaggcctcagtttctctcatacatacatctccaaaaagttgcttgagcaccctcatgacatggcatctggcttcctcactgtgaatcatccaagaaattgctgggggaggccgaaatttcacttatgacctaatctagaggtcacacaccatccctctccaccacattctattctccaagagcaagtcaaaaagtcagcccacactcaaggagaggggaatgaatcattgccttttgaagggaggagtgtcaaaaatgtaatgacatattttaaaaccaccacaaagagtgccagaaggccagaatgatgtgaaagtagatgttgtcaaagtctttggaaagagcctcccagggagaagatctgcaaggacaaggcctagaggtgggagtgagcttgtcatgtttggaaacaagaaggtgtggatgaggctgagtgtgtaaagaaagcagggatcaaagaagacctggttggagtaaggcaggaggggggtgtggtgaccaaggtatgcagtgtggattctagcccactgcagattttatggagtgcttcctgtgccaatttttcgactccctccagaacttcgtgtgagaggtgctattgttattccactgtaaaaaggagtatgctgaggcccagagaagttaagaaaggtcacacacctacctggaatccggagctcaggtgtgcattcaagcaggccagcctcaaaggcaacagtgctgatgattccagagggaatgctgcaaggaacatacagagacattggggtgaaaatgcttctgaaggaaaataggtggagaaagagagagaaacagaagacgtggaactgagatgccaagagatcaatgacagagaaagacagcaagggagacagaggaggattaagcatcagaaatctttagcaggcagacacaaggaggtggagagaaaaataaagtaagagacagagacctggagacagggaggcatgggatggaggatgtgagccagcatgtgcatggcgtgcgtgagtgcagtgccttgcgctgggtggtgccgggaccccgctaactcagaccatccatcgctcctgtctctcacagcaggagggccgggggagggagagaaagctgacaggagacagtgtgattccagtaatccagatgaaatcacagccagaaggcttgccaggaagtggggtggggtggtcagggagaggagggaacgtccagagaaagtttagcaaatagctttacaattccctcctccataccctcaaatgccgtagatatggggtggggaggatggccctgagtttcgggctgggatcaaggcaccaggaggggagcttgtgcccactgacaaggaggacgtctgcctccatcagtctatgtgggatccaaggaggatcacatattttcgtggttggttttcataccgctttcctgtcctttctctagaacagcccctcaccttttttccttcctttttaatgacattgacgtttttgaaagtctggaccaactgtgttttgaatgtctcacgatctgggtttgtccagtgatgtcctcacatctgattgagggtaagccttttgggcagtcacatcacaaaggtatgtgttgtccattcatctcttcaggggacatatgatgtcacttggtcccattactgaatatgctaagtatttgtcagttggttaaggtgggatccactagatgtttctactgttaaagaacccctttcccttgtaaataatataatctgtgggatagtatttcgggagtatgtaaacacccctttctctctaaactttcaaccagtagttttggaatccattaatgatccttgccagaatcaaatattgagggatgactgcaacacggagttctgaaatttatgtattttttcacactgttaacattcttggtaaagaagggtttcccgctgctctcctcttattttaaatactatgcatgagcaattttaatgctccaattgtcccaggtttagctgggtggacccctgcaagctggcccctgcaccttgtacatgtgcctccttcattctttgagaacttcctaactttctgacacaataaaagttccagactcatcttctattttccttgttcaaatccttaaaccatccatttctccaagtgacctgatccctttcaatggaaaatggtatttaaaagccgtgatatcaaggcaggagatcacttgagcccaggagttccagaccagcctgggcaaaatgacaaaaccccatctccacaagaaaaatacaaaaattagccaggcatggtggcgcatgcttatagtcacagctactcagaggttgaagtgggaggatcacttgagcccaggaggtcaaggctgcagtgggccaagatatgccattgcactccagcctgagtgacagagtgagatactatctcaaaaatgaataaaaaaaataaaagccaaaatacatgttctaggtgtgcttgttactacaaaggtattgctattctagtttctttcagtaaatagaagacacacttgagttcattctgatgcctccaaattaatccaacatcacaaagttctttctcacaattccctcattccatatcatatctctctgattcacggtgagaaccccatttcccccaatatcaacatatttgctcaatggtttcagaattaactgatcctactatcaacaactatctattcattcaagttcaaggtttctttgaagttctgttgtccttagagtgtatttaattgagagcacagttagagaacagtgttcaaaggttattgagctgattcccttcctacatggttacatttgtattattattgattgttgcttaacaactaccccagaacttagtggcttaaagcaacaacatttcttgtctcacagtttctctggaccaggtgtggcttacctggttcctctatttccggagctctcacaggtttcggtcaaggttccgcagggctgggtccttctgggggcttgaccggggaagatctacttccatgctcactacatggctgttgtgggatttgattccttggagactgctggactgtgggcctcagttcctactcagtacattgccagatgtccttcagttccttgccaggtcaccttctctatcaagctagcacatgagaagcaccagggagacagaataccaacaagatagaagtcacacccctttgaacctaattgtcaggagtaacatctcattactttttccatatttcattcattagaagtggtcaccaggtccagccaacgttcaagggaaaaggattaaacaaaatgccggagtatccgaagtgagcatcaatgggggccactttagaagcctgcctagcagagttatcaacgtgatggtagttaggcttgtttgtttctatttgccttcaattttagggtttggtgtctttttcaaatctttgattaaatttcatctttgaatctgtaaaatatttatatgattcaagagtataattatagacaaagaagtcccaagagcagtctcattcttatctccatgctgtcaccccattccaattaccttcttttttaaatttttaaattttaattttaatttatttatttacttattttttgagacggagtctcgctctgtcacccaggctggagtgcagtggcgtgatctcggctactgcaagttccgcctccccagttcatgccatccttctcctgcctcagcctcctgagtactgggactacaggcgcccgccaccatgcccggctaattttttgtatttttagtagatatgagtttcattgtgttagccaggatggtcttgatctcctgaccttgtgatccacccgtctggcctcccaaagtgctggcattacaggcgtgagccaccacaccctgcccccaattactcctatagtcacttttacccataagtgaatcctgccagtttttacttctatgactctatatcatgtatttttagctttccatattttttagataaaagagaacataccataggtactcgctgcactttgctttttcatttaaagcaaaaaaagatttagaaatcattttcattcgtaacgttatcctcaatttttttgtagctgcttagtacttcattatccagaagattcacagtttttcaactggtctcctatgagtaggcatttaggttgtttctaatattttgctactacaaagatataatgaataaccacatgcatttgttgttctgggcttgcagaagtatatttttaggaaattccaaaatgtaggattgaagggctaaaaggtaaacacatatgtgatattgttagaattttcaaataccccatttgcatttccaccagcaatgtatgagataatctgtttccctaattgtcgccatgttccaacagagtatgtggtcaagctttcaccttttgtcagtctaagagtaagaaatactatgtttgggtagctttaatttgcatttctcttgtgcatggagttgaaaccttttcacattttgaggtccatttatacatctctttctgtgaaccatctaatcacgtttttccttatttttaaaaactgagtttttggtctttattcttgatttttaagaactcttatgtattaaggacatcaactacttatctgtgacatagattaaaaatgttttcttccagctctcttttgacttcactttcgatgtttgttacaaaatggttatgcattcagatttatcatcttttttattacattatgttttgaatcataagtagaaaggtttttcccatactttagtatacaggaatctattcatgctttcttctaatgtttatatggttttgttgttatttttactttttacatttagatctttggataatttagatttaaatctggtataagaagaccattctattttataatggagaaaacctctgaggctcagaggattcatgtgacttttttaagttcaatggacagtaacaaaagtatttgtttaatatctactatacaccagacaccaaagtatgcttttaaatttattatctcattaaatacaccttgtatttattatcaataatcttttaatcttaccaaaactctttgaagtaggttgtgctcctggtttacgtataaagtaactgaggcagaagacctgaggtaacatgtccaagtccacagggcagcaaaatgaagaaaggcagagagaaagtagtatgtgctagttgtcatttaaaaaagatttgtagaagctacaataaaacaactacatccaataggacgcaatgtagtcacatagacatagctagctgcaaaggagtctgggaatgtagtccttattctgggtgttcatgcatcccactaaattcatggaggctgttaccatggaagaagggagaacagatttcacatttcagcaggggtagggtaattgaggcctggggtgttttgcagttcccaaaatgatatctttggtcagcaacaaataatgggacctagaaaataagtgtttattgaatttagggctcagatgccaatggctttgaacttaactccacacatggttctgtttatagactgcatggatctaagatgtatatgctcagaacctgcttccaggtttctctcaggttgcccatccctgcctcatccctggagttaaccctctgcctctttctgattgtattttgtaggctcttgttcaaggtaaggaagaatacaaatctgtccatgtctcaagtcaaaagtcaaagaatggcctctcccctaaagaagagagataaacctaatgacctactgaattaagtcaagctgttttttttttttttttttttttttttgacccaactgtagtgaaataattctggctactgatttctaagtacctgctatatgctagtccctgtgatgggcatttacatgcattacttcttatctgcaactcagttttaccagtgaagacaatgggactcagaaatttgagtaaggtgcccatgatttcaaaactacaaagtgctagaggacaaatttgaaccagttctgcctggctactcagaaccctatttccgattctagctagttaggaaactaccctcatgcagttgatgtttaacaggctgaatttttgctatattcatttattttaaaaatattgtaaaaagcacctaccatgtgcctggaaatctgctgaacactggggatacagagaagataagatagagttccatccctaacagggctcatagtctcatgggaggactcaggcaatgacaagtagtcaataaacctacaaattgatttcagattgtagtaagtacaaaacaaatcaaaactgggatagcttgtagctgggggtgggaggcaggtaggtagttattgataatgaagtctgagacctgaagaatgagaagaaagcatccatcagtgggtgtaagagtattccaggcaagggaatggcctgtgcaaagtccttgaggttgaaaagagcttgatatattctaggaactacctaaggttagtaggagtgttgtggaaagcaggtccctggcttgcaattaagcttgaggaaaggaatgaaatagatcaaacagtgccattagagggaaattgaatttaccttttcattgcctgggatagtcgggtgaaattaagagtgcccttttttttactctcagaactattccacttgaatgttaaattatatgatgtgtcagttagctactgctgtgtaacaaagcacccccaattgtagtggtgtaaaatggtaagcatttagctagctcatgaatctgtggctcagctaggtttgtgccaatctgggctgggttccctaatgtgtctgtggccagctgcagggcagcgggctgctctatatctgggattggctggctgttggctgggatgctgggagggactgggtacctgtctctcatcctccagcaggccagcgtgggtttgttcttatggcagcagcaggctctacaagacagagaagtgtgcatggctacttgagtcacaggtttagaactgacacaatgtgtttctgccacat

SEQ ID NO: 5030 - DNA, 52747 bp, Homo sapiens
ctttacagctgatgccggaatgagttaagattttggggatatttggatgtaataaatgttttagcatgtcagaagaacatgaattttggagggctggggtagaatgctgtgaattgaagtttgtgtctgatatggtttggctgcgccccaccgaaatctcaacttgaattatatctccaggattcccacatgttgtgggagggacccggggggaggtaattgaatcatgggggccgtctttcccatcctattctcatgatagtgaataagtctcaagagatctgatgggtttatcggcagtttctgcttttgcttcttcctcatttttctcttgctgacaccatataagaagtgctttcgcctcctaccatgattctgaagcctccccagccatgtggaactgtaagtccagtaaacctctttttcttcccagtcgtgggtgtgtctttattagaagcatgaaaatggactatacagtgtccctccaaaattattatggtgaaaccctaattgcccatgtgatggtagttgagacagggcctttcagaggtgattagatgagagtggaatcctcatgaagggattagtgccttacaagacacatgagacagtgcgacctctctctctctctctctcaattcctctcagcctccaccatatgaggacacagcaagaaacaggctacttaaaaaccagaaagagggacctactaagaactcaacaaggttggcaccctcgtctcggacttccagcctctagaactgtaaaataaatatttaagccactcattgtatgatatttttgttattagcccgaagtaagacaagaagaaatattgctccaacaagatttatgagtatattttacagatctgcattggacaagtagctttccctgcaacgaccatttactgaatctttactatgtgccagaatctgagagtctattagcatctgcaggtaaatcagccaaggttcaaagagatgactaaggccaggcacgaggcccatgcctgtaatcccagcactttgggagacccaggcaggaggatcgcctgagcagggaattcgagactagcctgggcaacgtggtgaagcccttcctctacattaaaaaaaaaaaaaaaaaaattagccaggtgtggtggcataagcctgtagtcccagctactcaggaggcaagatgggaggatcacttgagcccaggaggtcaaggttgcagtgaaccatcattgtgccatgaacaccagcctgggtgacagagcaataccctatctcaaaaaaagaaaagagagagaggatgaccagatttgcccagggacaccgagtgagttagtattcacactgggatttaacccagatctgtatgactccaaagctggggctacctctattccactgggttgcgtctgcatattaaaaattagctgcattttaaatatttgtctaaaataaaccttaacctatcgcagggcggctgccccagcctgagactggctgcttcatctacagttgtttctctacttgtccttgcgagggaagttttatcaccacaaggaccgtttctcctctgtttaatctaacacctgctagttgagattctctaaatgtcccacaataaatatgaaaaacagtctcaggcatatttttccctcttaaataatggagtctaaatgccaagtggccaaaagcaggcctttcagccattggcgctgaacactgtctgaacatgaaatccgtctcttcaaactatgtcaaaattgcttaataaaactcaggggaccccacattaatgaaaggatgcatctgctttgggtttcacattattggagtgatggttcagagccagccacctatgcttgactttcactctttaaaactctgcagttatcacagccctcattatacaaaggttacatggatataaagtttgaaagattcggttcaaactgcgagcggtggccaggaaaaaaaaaaaaaaggagaagacacaaagacaatgatcaagaacaatgaataacattcaagactaagtcggtgcaaaattttcagaatgagaaatgaaaggaaaacttagaggataagtaccaagcacaagttttaggtattctggagacaggaaactagaatattttagcaaccgattatgtctatgagggggatgaataatttattatctgataagaatcttccctgagcctgtgacaagaaaggtcaaataggcaactgaagtagaacagtaatacacgatatactactcgaaaaggaagtctggaacggaaggcgaaggaaagagcttcctggcccatgttcatcaactccctcagattacaagaagcgcagcggatgtactttttaggtccctcatattaggaacccagaagtattcatacaaataaatgcaaataatgtatgagtacatacttgtctaagtccttgaaaaaggccaatcttccggcatcacccacacaccagctgcaatcttggatccaccccgttatctcccagctgtgtgagcctgggaaagtctatgcctctccagcctctaaactgcctcatctgcacaatgggtttcacacataatataaatactttacgttaaatgctaagcacagtacctagtacaaagacaaataggaatatccaaccccccaccgcaggtgacaataataggacattttgcaaacgccccaaagaagaacttcagaactttacttcctttgtgagcatgcgcttattgacttgagcaagtggcttatatagttcttgctggttgcagacttgtttatatcatactttatttattgaaaatccaatactatacagaaaaacatttgtaaagcaaagaaatgaggaacaaatctaatggctgatttaggatgcgctcttcccgtaatctacaactattaataatattaatagcttttatctttttgtttagctacagatcgtcagaacaatggagataagccctgtgacttgtgatgcgttgacgaatgatcatcttttcaagccaagtcaccagcttagacaggcatgaggctcgtattttacccgccccacataccaatgcctccccccaacacatatatcataaaagaaggccaaggccttccatccacaaaggcaatcatgggacttaagcttttagtgtcaaaggagattgcatggaattcccacaaacagtaagctataccagctcataaagtcactgaattttaaggagcctaaaagtaggtggagtttgcagaagtctttaaaagtgcgagcaatttactcctcagcatcctacccatcgttccttatatcatgccatgaaaacacaggatgcggcagtttcccggcagggaaaacaacaacaacacaaaatgaaaacacaggtgtcagtatctatgaaaagcacagcaaaatgttgagcccatggcctaatataatggttggtactgagtgctccctatctgaaaataatgttaaagtcattattccgatgcttatcaatgaggctgcaatcacataatgctgtcagtactatccctatccctcactcccacaaaataaatagacccgatatcaactctattgaaaacctgaatcattacacacttcagcagcaaaccgtgtggttgcaatcaactgagcatgcgctctctccctaaaactgcacattccattacctctggctaataaatcttttatttttacccctcatctctctgcttctcaataatcattttgatataaaccattgcttgctgttcctgatgactaatcccttaacatctttccaaaatatatgcagagtgtatttctttgtaaatacaaaagaaaaagcaatccataaatagttaagatggcttttcaaatgacagttgagtgctaatatgagctacactggaaatactaatcaacaaactaaatacacatccattaaaatgtaggagtccagacatatgagacagaaaaagaattcattgcaactccactgaaatcaggctgataaacatctgccctaggctcctctttcagccagttggagaggttaagaaaagtaagcatcactttgcactttcatcgtgaagaaaatattattattgttgttattaatagcagcagctaacatttaattgagcattaatttattccacaatgggttaagactttatatacacagagttgatgtgtttaatagaccacctgtatctctgaatagagatattatgatgtgcattttacagatgaagaaactgagtttaaagaagttaagaaacttgcccaaggtcataagatgtatctgattctaatctttgcactataatacagcatgttttatagccgtggttatgaactggggacgatttgcacccccagagacatctggcaatgcctggagacattttggttgccacaaacatacttgggtcacccccccatatgagaggggaatagactcaagacacattctgggaagtcaggggtgagtcaaatgtaactctaagggagagccacctgcccctcttcccataccagccctctctgaccaaccttggccatctcaatgtccagcagatgctgatgtttcacaacacttattgggcccctcgcttactaatggccagtccccaacagaagctcttctgcactctctgttaaacagatctagtggggcctggcaggcatgaggaacattggttactcataacaatccctctcctctctctcaaccaccgcccctgcctcccagcctcagcctcatcccttttcctcctgcaaacaacgtaggagatggatgacatcaggtccatctgctcccactctaccctacctccttcttccacaggacagagttttagatcccaagttccggggatctaaaatttagaaactaaaatttagaaatcaatagaaacagaagaaggaggaactcagagccccactggggtctttcaagagctctacatggaatgtcgaggtcttgctgtagctgttcatgaagtatgttttgatacctaataagctttgttctttacatgcaatgcccctcagaggtcctgagatctcaagacagggagtgggattgccagaccccgagaaataaagcaacagaagcccaactccaatagatactgggtaaaggaagaataaaccatggtaatgcaggactcagacacacctatcgttgtcccagacttagagactcacatggattcctaacacatagacactgctgctaaataaaagagagtccactgcatttgaaaacaggaaaacatcttattccaccagccacactggcctcttggaatacacaggaaacgataggtgcttgtcttaagaggtgagggcaccagtgtataattcacataaggatgtaatgaggtagatcacatctgtgtgctgttccacaacataggaacaagccccactgccccttttctttatttaaatatgaatgggggctgatgtgcctccatctcctccctctttttttattatgccaaatggattggccttttaagacagtggtttacttctgtactgtccatgttacctgttttaattgttttcattttttctcttctaactttggagcatctaaaacatctcagaggagggcattttcccatgaaataattagtagtcatagtaattacatataggttcttaaatacttctatatggaatgtgttttcacttaagttgtattttattaaatagctccttcttccaaaagtaatttgagagctctataaaggatatcttgaatataaagagacgacagggtaatcagagtggcttcctctaagaaataggatggatcctgaaattaatcactcaaaccgcactagagagtttgaaagcaaaatctgcaaagtatgaacattgatactaaacatggtaaaagatgggccatggggtggagcagacagacttggagtttggaagccagatggaccaagcaagagcctgactctgagctcaccagctgtgcaattcgggtgagttccttcacccttctgagcatcccttggctcgtctggaaaatgcaaaaaaaaaaaaaagaaaaacaccaggtttttgatcctcctggatgagggatataaagtgcctgacacagcatatgacagggatttgataaagggggctgttagctgtcccattgtggatgtgagaatagcattctgctggctaaaaggcaacatgaatgttctagaacatggcgatcccggaatgtgcagtgaaggcaggaagaggaagatgggcagggaagaacaagttgggatggaggaatgaactcttatctccagaagcagagcaagaatgcccacggagccttggcacatgacagcctccgctgagccaaatggcccaaagattctgaatgagcttttgctgcaacaaaaaactttggatcattttgagagcctcccgtgagtgccaatatgttgcagtaccttcccggccccgacactgatgtgattcatcgtaggtaaatatgaatacgctcaagctggccagcagcttgaaaaattggagtctatcaaattgacctgagaaacacaggaaggtaatatttagtgacataccagatgaaatccttgcgcagagatggaggtgaggaaggacctgaagtgaagtagaccagcaaatatcaagggtcaaggagttggggatgatatagagacgaagcctaacagatgtcaccagagcaagaaggccttacgacttccatcctctctgcagggtatgaatggtgcaatggaatgaaatggtaactacagcttctgggcaaaatttgagtttccataatcatcatcttgggaaaatgaggaacacaatataatggctacacagagaacaagtgaaaagatgagagatgatgaacaggttgagtttcttcagcctaaacctatcaaatctaattttaaacatctggagccacgtgtattagttttgtttctgttcattttcctttttctgtgtccccgacggtgaatgattctgaataattcttagtctgggatactggtctatctcaaggtactacatgttagagtaaaactataaaacagcaaattctatctctgaaattgactcacagggacccaattaaggctcaaaatataagaaagaaagactgaaagtgggtctttgacatcatccatccaacctttttccttaaagatgaggaaacaggctccaatagatccagaggcttacccaaggtctcatcgctaattggggcaggtccaggaatttcgctctaagcatcaaacaataattaaaataggataaatgcagatgaatgtgttctcatattattgtgttctcagaaaagaagaggataaatttaatgatgcaaaaacagttgtgctacacattatcttccaagactggtttaaacatgaatgtcactgtacaatcaggttaccatagttcactagcgtccctggaattttacctttctagtttcaaatattacatcaaataggcagattttacaattttgacacgccctcctgctagtcccaagaacactgcaagccctcagcagtgtctgtctacactgtcagtgggaatggaaattggagcaacaagataagaaatgactcggaggtcgggcacggtggctcatgcctgtaatcccagcactttgggaggcctaggtgtgtaatcatgagatcaggaggtcgagactatcccagccaacatggtgaaactccgtctgtattaaaatacaaaaattagctgggcatggtgacgcgtgcctgtagtcccggctactcgggagctgaggcagaagaattgcttgaacgcaggaggtgaaagttgcagtgagtcgagattgtgcactgcactccagcctggtgacagagtgaaactcagtctcaaaaaaaaaataaaaaagaaaagaaaaaaaagaaaaaagaaaatgactcgggaactgttaccaaaattttaaatgcattgccctttgaatcaaggagtccagtgctaagattctgccccaggcatttactcacaaatcgtaaataaagaatgctcacagcagcatagtttaggcccaatatcagatgatatcgtaaaaagactgatgcaagaaagagagaactgtgaaacaccattgcttggaataacaaatagcaaacaatgcaaacaacctaaatggccaccaaagggaagactggttatagcataagcacagatggaatattatacagcagttaaaacaatgaagtagatctatatgcactaataacagactcctgcagtactaagtttaaaaaaaaaaaaagtacagaacagaatgtgagtgtgtttgtggtatatagataacctttttctggaagaatacataatgtttatcttccaagagaaggacaagaacgactttcacatttcatttttcaccttcccattctgcgtgtagattcaaataaatgcacgtattcccatttgtactcttctcaatacatccctaaaaatcccacctactagagttactactttttaacattagtcagaaagacaataaaatgatcagaaaaagtaagactcgttttcttttttatttaacccaaaataataagctcagtgagctcaagataagggctcattcaaatatactgaatttcaaatatttcatcataaatacactgaaaaagcagaaataaatttccttttctttattttcactacttttcagtccagagtaccaaaaattttcttaagtacctgtagtctatttcttcaaatggcaagaaatctttcacagcattcaaaaatgaagacggctccacagggtgtacccagcccccttcaggctctgctcccaaacacgctgctctatctctcctccccctcctcccagggcctctgcacctgccattcccctaccccatctgacccttcccaccctcttcaggtctttcttcagatcttagttcaatcacttcttccttggggaccccaaggtctcccaactccctggcatcattactgattcctaggaccactcactgctttttcagtttacattaagatctgtgttttttgactaaatttgtcttccacaataggctgaaagcttacaaagacagtggcaacgtctgttgtccttaacagtagaccccagcacccatcacagagtgcacttcatgaatatgtgaatgaatgaaaagtgaatgaatgcagtctggacttcatttgaaatccagcgatgtttcaaaaatcaaacagctcgcatcactctctagctcaaacccttaatgtcttcctcaccgctatctcagagtctaccagatacccatcccccaacagcaccttcctacccactccattcatctccagccacactagcttccctgatgatccttgaaatctcaggcttgtgcctacctctgagccttagcatatgctcttctcactgctaagagaatactttcttgacatctgcatggcttacccctacttcattcaggtctcagatcaaatgtcacaacttggaaggctccctgctgatgactccatcacactcacgctatcattccccccaccttccctgctttacagtcctttatttactgacattatggcaaatattaaacttgattatggtcttttttcctacctagaaggtaagcctatgagggcagggattctgtttcgtttaatactattccttggtcccaagactaatgcaagcccttagtaaatatttatgtagacacgtatcaactcaacttctacatagacagagaaaagtaagaaatcagagatagggttaaagcttccttcttctaatcttaacaaccataagcataacagtctcctagttgcaatcatgggcgttcacccgttttatttttcttaataaatgagttaaaggaagaaacattctcaaacccctgactaaaaagcagatgacactgacaatgaactacaaacaaatgcgtgaataataatggacttgctatgctttcattcataagacaaacaaagtgaagatgactttaaaaataaagacatgattcaagagcaataaactttacacactccactgaaatctccatatggttagcccggcatgtgttttgacaattaaaaaaaacaacaacagtcaagcgcttacccattcttctaaaatgcgtgcactgcttcactcgcccttgccatgttcctgcaggccaagatcacatgtgcaccatggaggcaaaagacttggcggtttcgaaccctatggtttaaaggaaagtcaatgttagaaaactaacatcaacacagtgagtcatgttgaatggcctttaccggagcaccacttaaattacccaagttctcaaccaggggtgattttgatccccaggggacagaagcaaatgtctggagacttttcagtggccacggttgtggggtagagtcctactggcatctagtgggtaaacaccagcattacaaaacatcttaccatgaacagggcagcccctgacaacatagaaccatctggccggactgtcaacactgtgatggtgagaaaacttgtcctagggatgcagtgatttcaaagagaagactgggacatagaagagttcacggcatgtccagccatttaaccatcaataatgacagatcctgtgcccacgataaggactttatgctctactctatggtaagtgtcgccagcactctgcttctaccagtgttacctaggtttcttagccccatttcctactgagaacaattagaaagatggacaaaataacacacgtgcatacacacccatatctgtttgaaggcatcagaaggcactatgactaagaattttgggggccaagatctgcaaaaactgcaaggccagcatttgcagcttttttccttcaaggcatatttcatttccaaacatagtggttggaagcctgagagatgggctgagcttttggcaattttataacaaggaaaaagacataaatttgagctcaggcccaccaggaaagggccacggtaaacacaccaaacctttggtcgggatcctaaagagtttaccctcgctgtaataacaagagacagtccagccttcacaagagtggaaactcagcttcggccatttcaattcctagtttgattaaagtgatcagtccctatctatccaatttccagagcaagagaaaatgttctctggaggaagataccattatctagagtctcaaattaccactagattatttcaaatactcatataaactctcagacattcaaacaaaatagctaagcatacaaaagaaaaaacttcaccaaaagccagaggggaacaaatggaaataaatgcacaggagattgtctaatcaagttattcagaaacagtgattaaaataagtctgactgacaaattcaaggacaaaaaggcaagatggagaattttgccagggaattagaaacaataaaaaaattcaaatgatattctgaaacttaaacaaaataagagtaataagagtaaagaagaattcagcatatatttaacagaatacaagacacagctgacgacaagattgaggaaactacaaaataagttaaaaaaaaatccaaagtgaagcataaaaagaaaaaaataacacaataaaacaaagcacaaagagacatatgaaacacattctcccaggctcttacacatacatgtaatctgagttccaaacaagtgaaatagactaagaaaagcaatatttaaagacagaatggctgataatgttacaaatcaatgacgcatacacggccaaaaaaagaagtatcctgagccataagcagaaatatgttgtgtatgtgttgacatgtatatgtataaatgtgtgtgtctacatgtatgtgtgtgtgttatatatatatgtgcaagctacaagcagaaatgtacgtttgtatatatatatatatattatgtctgtgtgagccgcaaacagaaatatatatgtgagtgtgtatctgtatgtgtgtattgtgtgtagatacacatatatacacatacatgtcaaagcaaggcacatcagagtaaaacgctaaaaactgcagatagttttagaagtagttagagaccagtagctacaagactgatagtatacctctcaggaaaatgatggaagccacagctgaaaaaaaataaaactttcatcttaaattctatacctagtgaaaatatttttgaaaaataaaggcagagaacaaaaattttaagaaacgaaagctgctttttgtttgtcacctacactacacctagtgtcacgtatagacccaactagaggaaacactaaaggatgctcttcaggcaggaggaaaatgaccttagctataaaccagagatgcagaaagtaacaaagagcaacataaagggtaacgacatgttaagatccaatggtaagagtgaaatctgtgagttttaaaatatatagcaaaaattactatatcaataatataacaatgcttaacctaggaggtgagtaatggaagcaaagtatcctaaggttcttgtctctccaggaagtgatataatactgatttatattagattttaataagtcaaagatgcaagtgtaaatctctacaaatttaaaaagctaatggagaagaaaagcagaatgataaaaaggcagaaaggagagaagatgactaggtacagtggcctgtaattctagcaccgtgggcggccaagcatgaggatcacttgtgaccagcttgggcaacatagcaaaactctgtctctacaaaattaaaattaaaaaagaaatagccaggtgtggtggcaggtaccggtagtcccagctactcgaaggctgatgtcgagggattgcctgagtccaagagttcaagggcacagtgagctatgatatgccactgcactccagccagagtgacagagcaaggccctgtctcaatttaaatggaaaaagaaaggaaagagaaagaaagagagagagagagagaaaggaaaaaggaaaagaaaaagagaaagaaaggatagaaataagggaaagaggaatatagaataacttaacaggaagccataataaggtggtatatttaaacccaaactcaaatatatctgtcattacattaaatataatggcctaaagatggcaattaaaagaaaaagtttgtcagactgaagaaaacataaatataatatactgtccttaaaaaagaatgtacattatgttttataccttatttaaacataagcaaaaaaaagtaaaagaatagaaaaggtatactgtataacacgggccaaaagaaatctgattagctgtactaatttcagaaaaaaaagactctaaagcaagaagcattacaagagaaagtctgaatatttcacaatggtaaatttcaatccaccaagaatacatgacaattctaaattttatgtacttaataatagagcctctcatatatgtcaaaaattgacagaattaggacaataatagacaaattcacaattataatggaagattttaacatatccctcttagtaacagataaataagcagacaaacacaaagtatatagaagacttgaacaacttaattgataaactgaaataattgaatatgataaacactgaaagcaacagcaaaatatactcaagtacttcaagaatcttaccaaaactgatgatttgcaggggcaaaagcaagtctcaatgaatttcaaaagattaaattagaaagtatgctctttgaccgcaatggaattaaattacaaatcaataacaagatccagaaaattctcatttctggaaatatatgtataaataaataagacattatggctcaaaaattacaatgaaagttagaaatattttaaactcggtaattacaaacacatatacaaactaaggagtatagctaaagccatggttaaaagaaaatctatagccttaactacatatattaaaagaagaccaggcacagtggctcatggctgtaatcccaggaatcggggtggccgaggcggtggatcgcttgagcccaagagttcgagaccagcctgggcaacatggcaaaattccattctacaaaaaattagttgggcgtggtggtgcacacctgtggtcccagctactcaggaggtgatcatgccacttcactccagcctgggtgacagagtgagatcttgctccaaaaaaaaaaaagaaagaaaaaatgatgatctaagcatccaagatgatctaagcatccattacattagaaaataacccagcaaattaagcctaaagaaagcagaacgatggaaataaaaggagaaagagaaacttataaatctaaaacaaacataaaatacagagaaaaaaagaagctaaaagtcttcaattgaaaaaactaataaaattgataaagggctagcaagaatgacagagagagagacgagacagaaagagagggcttgaacaaccaatatcagggatgaataaaaggacaacattagccacataaaagcataagcaacaaaagcaaaactagacaagtgaggttacgtaaaactaaaagcttctgcacgttaaagaaaacaatcaagacactgaaagggcaagctacaaaatagaaaaaatacttgcaaacctcataactgatagtgttcatatccaaaatatataaggaactctaaaacccaatagcaaaaaaaaaaaaaaaaaaaaaaccacagattttaaaaacaagcaaggaaccaaatagacaattctccaaagaaaacatacaaatagccaagtgtatgaaaagggctcactgtcactaattctcaggaaaatgcaaattgaaaccacagtgagatgtcacctccacctcttaaggtggttctcatcataaaatgaaagataacaagtgtggttcagggtgtgaaacaagagcccccttatgcgtgagaaacttacattccttagtggaatgtaaattggtgaaccattatgaaaaacagtatggaggttcctcaaaaaacgaaacaagaattaaaaattgtggattatgatccagcaatcctacttctggatacatatccaaaggaactcaaatcaggacacaacaatatgtctgccctctcatgttcactgcagcattattcatactagccaagacaggaagcagcctaaatttctactgatgaatgaatggataaaggaaatgtggaagacacaccacaaacacacacacacacaaacacacacaatggaatattattcagccttaggaatgaagaaattctgctatttgcaacaacatggatgaacctgaaggacattatgctaagtgaaatagccagacacagaaggacaaatactacatgatacaatttatatgaggaatctaagacaccaaactcatagaggcaaaaaatagaatggtgtaggcaaagggctgaggggagagagaaaaaggaggtattagccaaagggtatgaagtttcaggtacgccagatggaaaagccctagaatctaccatatagtactgtgctcatattgtatcatgtacttataaaatataatggtttccaggtatatacttatctccaaacttatcaagttctatacatcaaatacgtgaggcttttgtacgtcaatcatacctcaataaagttgtttttaaaaatgaaaaataaagaaaaggactcagatcctatgaaccctaagaagatcttaagatatggtgaacaactttataccaatgaattacaatacaggtaaaaaagacaaattcctagaaaaacactacaaaaaaagttgccacagaagaaatggaaaactgaaaaagttctgtatatttaaaaaatatgaatctatattttaagtcatctcaaaaaaggggaaaggagaggaggggaggggagggagggaggaaaaagaagagcagtctaatccagagcttgaacaccaacccattgctctaaactaaaaaataccatatttgtaatctgtggtggaagaccctatagagtacagtacaataacaaagtagtcaattctatagagaaggcagctatgcaattcagccaaacccatgtcaaatggccataaattattgttacaagataatgttaatatgcacgcaaaatcagcataccgttatcttcctgacatcaccagtgaaagagcctagtaaagttcattcattcatatcactcccacaggcctaatcttcataaaaacagtctatttatacagaatacttctcaaggaaaatcagcatagcacagaggaaaatcaagttggacacacttgtgttgctgccagttctaagcacgtacaagctgtgggatctaggtcacgccttgaacccatgtgaaactcagttatcgtttctgtaaaatggggaataagtgtaaacatatattgagagcctaacataatcatagtaggtggaaaacaaatgttagttgctgctttttgcaaaatccttggtgtcctatgcctcttccccaattcgtacgacctaccaatccagcacagtcactatgactaaaaaattaaaacttgctcctagatgtgctaccaatggaacccgagggctgaatgactttaataccaaccagaattcaaagaaatcaacctcgggctcaccattccgtttgtctgaatatggactctggagcacaatttaacctcattgctgagacacctgaaattatttcttgagattttgccaaatcccatattccaaaatacttacttattactaaagatgacctctgatacttaaatcagatgctgaaataatgcacaaaggatttcaaactgaagtatttaacacctaaatccatttgactccccttgggtgtgtgggtagtaaaaggttttgaagctgtatctccaacctttaaagcaagacgacaataatctcaaatttactcattttacctgtgataccaatgtcaccccttatcaccagtgagcaaaagacacctagatcattggggaaaatgagagaagtaaaatgccaggttttgtagcccagctggctgggggcaggcccgaacaaagtcttgctgactgatctgccccatcaatcaggctaatgagatgccaacagcatatgcaagcaacacagtgaccaaacacaactgcatttgtgagcccgggacttcacaccccagaagatcttggacggaatggtggactgtgggtccctttgaaatttccaggtcaaacaatgatcaggaatatctttcttcacagtttcatcacagggtattaaaagaaaaaaaaagatgtaagagagtggaaatgagagtaaacaattcttagtcattcaatagcagctacgttttaacagattgagaaagcatcgatataacacaaggccaggcaggttccagaacttgattattgactgattgactgactgagacagagtctcactctgtcacccgggctggagtgcagcgtgcaatctgcaacctctgctcactagaacctccaccgcagggattcaagcgattctcggtctcagtctccccagcaactgggattacaggcgcgtgccaccacacccagctaattttgtatttttagtagagacgggatttcaccatgttggccaggctgctctcgaactcctaactcaaatgacccacccacctcgacctcccaaagtgctgggattacaggcgtgagccaccaacccagtacagagctttatttatccagtttctcaggtaagctccttgagccttacacccccaatctccgtatttcgccagactagcacccagtaggattcaataaatatctgctgaagaacaaatggttcttgcagactgctaataggctgcagctctggactattttaaaacaatcaggctgtttcaaactgcaacacgatggccctcttccttcctttataataatgaataaatttaaaatcctgcaaagatactgctcactgtagttttgaatgatgctaccaagaaatctggggggaaaagcatgccgtttttctatcaaattttattttcccaaacaaacctgttaagtctgctatctcacttgacaaaataacccacggcaaaggactttttattaccagaaagggccatctgacaagacagcagcaacaggctacaggctcaagcttccaccctctctcctttaggaattcctgactgtagttacgggtaagccatctgtctctgtgtcttgtgaaattacacttggttcttacatcttcctttatctaagcaatgcattacccgttgctagtctacttttaaagctgcaatagacaactccattttcttaccctttacaattgcctttggaacagaaacaagcgtggctatttcaaaagatgatagtttaacaggaaggacaataacacttttatagtaaccatatctctagagtgtggagttttatataaaaaaagcttaataatgctacctactgttaagtcctggataaaacccaagagaataacatccctcactcttgtaatactgcagctgacgccagtttaattagctaaatgtagtagtgctaagcctattctgcacagtgccaaagttttgcaaaataatgaaggcaatggtttactaaatttaataacctgattcatcttataaaaattaactttatgacaatgtttaaattgaactagcttaactgcatggagatggcaagagtggttcggaagaatatgtaaacctaataataccaagaaaataaagaaagacgttttaaagcatgaacagcatcagtttttctagcacttgttacatcagatgcaatcagaaaaatgacgtgccatggaggcttaatagctcactgtcttgggttttaagctttgaacacaaacattcaattctatgaaatggaaaaggtgcaaagtaatttaaatacctacttatctgatactatcttcatagttttcactctttagaacagaggtcacaaactgatgatcagaggacaagtcaagccacagacctgttttgtgtggcccatactttcttcccttcccttccttccttccctttccttccttccttttctttccttccttcctccctcccttcctccttctctcctttcttttctctttgctccttctttctctctctcccttccaacctctcttccttccttccttcctaattgaattagttgccagcattaaaacattggggagatcacaggtccaaaagctagatgtgtacttctctgaaaaagcttacaccactgggggcccaatcccacgtggtgacaggttagctggaagccactgtcagctagaggtggggtttgggctttctagttggtcatgttgaccatgacatcacccgtgctgctggcattacccgccaggccactgcaggcacttgatgctcagtgccattattcaggaaacatccttgctacagacatgactcaagccttaccacaaaacaccctagtccatatgttcacaactcaatcaccgaatctcaaagaacatctcccactgatctggtgagattttatttaaaccatgtcaaaccctactatgtcaagtgtgagactattaggatgcagctatgccttggaaaaccccgcagtagcacttggctttgcgtggacagagaagcacaaggtagcaggctcagggatctgcaggagcttgaacccatggtgcaagctcccttgcatttacaaatgtcactgagtggcagcagaacctctgggccaagaactttactggaaggagagaaaagacgaaacagacaagcaaaaaggcagggtgcttggcaaaaaaaaaaaaaaaaaaaagatcaaggattggggagcaactccgtgtaaataaatcacatgaatacaacagagatgaactccatgaagcaagcgaaaactgtgggactcctctgtaggcagcgggagcctgtggattaggcagggagtaaacactatgagttattattcatattattattttatccatttacagtactccagtggtcacaatggactcgctcaagatactgtggccttgtgaccagccagaaatgacgaggtgccctcttatcccgagcagctcaaggtataaattagaaaatcatgtaggaagaaaaaaaatctacaaagccagggactgcctaagtctaggtgtccaaggtgccctgtgggcactggtgagcttggcaagttgtttacccagacagggaacacaaagggagaaatggcttggcatggtggtggagagcatcggagcaggcagccgcacaccatgagactcactggtaggtggacaggtggggacagtcgcccacagaatcctcaggcacaaaaaacatgaaggtgggaccctgtcccctcaaatactgacaaagctcccacagaggtaggagctaagaaaaaggcagttctttccccgatgccaggaaggttccttctggtttaagttttttaattttctccatatgtggatgtacttgggcagtgtccccatttactgtaaattatggttttaattatcattttattaagacgcccaaaggagttggggcttacaatacccgtaatttctaatgggtggttatattaatttataattgtgaaacactggggacaaatgttacttgtaactgggcacaattaaaggccacagagatggtgatttccagccccctccagccccgccccacaaacatagcactaaacgatctttaggaaccaatcaacaagttgtagaatcttccagcacacatcctctccctcctggagatctgccattatgcataaagcaagaagataggcctaatgtctttcagcttggttagatttggggacaatgcaaatgtggggactgtttttgtattaacagactactatcttaaggatgagtttctcctatatcctcctaaaagtaggaagaccatactttccaaactaattgattaatgtaaatgaaattacagtgacatgacattgacgatgatcttgaaatccaactccccacaggcatttccagatgaagttctaagatgtacaccacgcttatatgctcaatgcacatctgcaatgactagctaatccatacctctgtttctgtagttactttgattacctgatgatcacacttgcctcccaggccatttcaattacatagttctgagttccaaagagttaggatcgtgcttactaaacacgatccacagctgccaaatcttaagaacttacaaaactacaaggtctctctagagaaaaataagtcatagccagccctgctttttaaaagtatgtgttattacagcaagcaacaaatccctacagagcttcctaaatagccctaataacataaatacattcaaatatattaatcaaaaaaaacataccaactcaagaagtgggaaacgggtcagttcagtggaatatctttaaaatacaccaggcggcatctgcatgctttgggcagtacaaggctgggccgtaatgttttgtaaagctgtacaataaatcccagttgactgcatgagatctctcggaggcaagactgaccccaggctggctactagtgctgccactgtgctgggtgaataagtttcatttaacctgccagtgacagtcctggttaggaatgagtgagaaaaatgcccaaagatacaattaacatggtcctagacaggcacatgcagacagattctacaagggtaactacattagcggcagtcctgtcggtaaagatgtggggcaaccaggcaacttcatagattaatgaggatgggggataggaaatggcttaacatatttgggggcagttgggacatagctatcaaattgaagtggacatgctctttgacccagccacaaccagaaatttatcctacaaatagacttgaaatatgtgggaggaatattcagtacggcattatctacgacagactgcaatcaaccaaatgttttatcaattaggttatataaattatattgcatgaataggacaaaatactgtgttaacctaaaaagaatgaggagaaatgatacggagatgcaaggaaacatttccatgttataatttttttttttttctcttgagacggagtctcgctctgtcgcccaggctggagtgcagtgcgcgatctcggctcacttcaagctccgcctcccgggttcacgccactctcctgcctcagctcccgagtagctgggactacaggcgcccgccaccacacccggctaattttttgtattttagtagagacggggtttcaccgtgttagccaggacggtctccatctcctgacctcgtgactgcccgcctcggcctcccaaagtgctgggattacaggcgtgagccaccgcgcctggccccatgttataatattaagaaaaaaagtcaaagtaccgaacagcgtgcacgtaagacacaaagtggttaaacaggtgccaacattgattactgcaggagagagttaccggttgggggcagaaaacttcttgtgcatttcataatgtcgacgctacttccatttttaacacatgcatactgcctgctataggaagaaactaaaaataacaaaccaaatgctatctaattgataattcagagcctttatgaattttaatacagagcaatcaaggcaagtgagaaaaaaagggaggagctattcctattccaaacaaggtatttcctgagcatcctgatttatacaaaggatgctgtatgtccaggtaaggaggagcacttcagagtgttactcttggctgggtaccacgccatgtgtttatgaaacacattaactaattctaaggtgttctctacagaaaccctataaagtgtcatgtcatttcatgtaagagaaaaaccactgatccccaatgttaaggaactcacaagatcaagggcaaaaaagggggaggaccccaatgggcatggtagcctgacttcaagcaggtgtacccaccatcaggccccccacactaccacaatcaccatgtgactgtggatttgtgatattggatataataagaaatacatactgggtcttcatccaggttcctggcacagagctcctaaatccttgaaattggccaggcatggggtctcatgcctgtaatcctagcacattgggaagctaggcaagaggatcacttaaacccaagggtttgagaccagcctggacaacacagtgagatccatctctaaaaaaaaaaaaaaaattgtggagcacagtgccatgcacctgcagtcccagtactcaagaggctgaggtgggaggatcacttgagcccagaagttggaggctgcagtgagtatgactgcaccactacactccagcctgggtgggtgacagagcgagaccctgtctaaaaaacaaaaacctttgaaattttctgagcaatgtgggtgaggggagagtcttttattattccaattagagagttgtgaataattgataacccccacattccccgccttgggggaagaggagggctggagattgacttaatcaccaatggccaatgatttaagtaatcatgcctagggtacaaaacctctctaagaatcctaaatggagaggcacagtggctcacacctgtaatctcagactttgggaggccgaggcaggaggattgcttgagctgaggagttcaagaccagcctggggacatattgagacctcgtctctaataaacaaaacaaaaaaacttagccaggcatggtgggtgcaactgtagtcccagctactcaggaagctgaggcaggaggatggctttagcctgggggtcctggctgtaatgagccatgattgcataattgcaccactgcactgcagcctgggcacagagcgagaccctatctcaaaacaacaacaacaaaaacctaaacgatagggtttggaggcttccagattgctgagcatgtggtgcctggagaggggcatgccgggagggggtatggagctccacatcccctccgcatgcctggccctatgtaccgcttcatctgtactctttgtaaatcctttatcataaacaggtaaacataagtaaatatttccctgagttttatgagccatttagcaaattatcaagcctgaggagatggtcgtgggaaccccaatttgtagccagtgagtagaagtgcacttgacaatcttgaacttgctactggcatttgaagtaggggatgatcctgaggactgagccctcaaccatggggtctgtgctgactctgggtcgttagtgtcaaaactgattgtaggacaccaagctggggtccagaaaattggagaattacgtaaaaggagggaacatccacacatttgtcatgggaagggctctgtatgagagaagaggaagacacagtgtttcctcctttagggttaagagcacacactagaagcagctccttgaggcaggagaaaccagcctgaatgcccccaccaggctcacaccccacagggtcttgactgtcagtcaaatacaaatcagggatttgccatctattctctgtggatattacgagatataggcttctcatatgtgtacagcttggcatgtgtataatttaagctaaacctactaagcagctgtccggaaagagggagagtggtccaaataccacctgtttcatcaacagcctaccagtgctcccttcggtgtaatccatcaaggcacagaattgaggtctcttcagctactgtattacataaacctacctgctgtaggaatccattcccagacagtgatgcattggcaaatgttcttctcttttacttgatatttatcttggggctcagaattaacactgtcctttgcttttacaaacatttatctgtaagggcgtgagatgggatcaccagtccacaggaataagtttctctctatgttcttccaacatcaaagtttacaattatagacttaatttaaccccacttctatacttccaaccagtaaaaaatgtctttacaccatgaccgttacaagttatactcaattttttttctttaatttccaaaagtttcactgtcaaactttaaagaaccaactgtattaacgtccaacacaaaggccagccaggacagtggctcaaagtataatcccagcactttaggaggccaaggcaggaggatcacttgacttaggaattcgaggttacagtgagctacgatcctgccactgccctccagcctgagtgaggagcagattctgtctcaaaaaaataaaacataaagaccctctaccaataaaaagaaagaacaccgcatgaaattttttgtaatcaaaatatacatggcactttttttttttttttttttttttttttgagacggagtcttgctctgtcgcccaggctggagtgcagtggcgcaatccggctcactgcaagctccgcctcccaggttcacgccattctcctgcctcagcctcccgatagctgggactacaggcgcccgccaccatgcccagctaattttgtgttatttttagtaggacggggtttcaccgtgttagccaggatggtctcgatctcctgacctcgtgatctacccccctggtctcccaaagtgctgggattacaggcgtgagccactctgcccagccaacatggacttttataaacttgtctgagaaccttaggaagaaaaataaaacagcacaaaataaaactaaaaaatttaggcctcctgttaaaaaaaaaaatgtaatggagctttttagaggcagagcctctgtgtcttttaaaggttctcaagaagacacagctcttttgctccctttcttcttatacaagaaagtaacaattgctccataattccaccccctacacgtgctgtctggcccaagtcatgttcttcagagggcaatccttttgttaactaaccaatgacacacacaggcatgcgacacacgtgcacacacacacccatggtctcacttcgtataattctgtactcacactccttctactaagacaaccaaagtgtttctggttgtttagaagtagaaagatttatcctgaagttggccttttttattttgatgaattaatttatagccacttcaagagaagaagggaacccactctgaatttgtaagcacactatattctattactgaacgtgtctcattgttttcacagtggtacaggatttcctttcaccattgaggcctccgttactctttctcgtctgctcgagaagggttctttatgatttagagcaagcaggccagccaccaggattctacacgcacacactatccaaagagaccccgttccttgactttcttaatgaccaaaagggctgtgatccctcttgcaacatagtttccacccctgtcaattaagaaatgcttaggagggaattgtttaaaaaaaaaaattaagaaaaaaaaaaagaccttcattccattgccagctctcagaaatgaaaaagcagccccatcctgcactgtccatgtggacaatgtgctacctttctaattcaagcaccttttttttttaaaaaaaaaaaaaaaaaaaaaaaggaagaaagaaaaagaaaaattcagattaccttggctctcaccattaaaaaagcgaaaagtggtatattactttgcctcttgaaaagctaaagtctttatgctaccaaagtcacgtggaagtgctcaaaacacaatgttgggaaaatcagcagttttttgaggctcacttttaaagtgtccaaattgacttttcattctccatcgtagtaactttttaagacgcaacttttcaaaaatatgacttaaattcaggcttcgaagctcatcaacggccagagttccattaactctgtgctctgtgggctcaccatcaccttgcctaaatcaatgactcctccaactccaaaccggacatttattgtgattggttaggaagtggtatcaaacatacaaaaaagaggcaaaatgtaaaaaactttaaagcaaattgagtttaatagaaaacactaaattaaaggataatccttaccttgtagttgcttttttaaaagtatctctgtaatcaaaaaaaaaagtatctctgataatctatgtaaccagatcactatcttagatatcttaagataattactttttaaagttttgtaaaatctaacagtggcttgtgtgtgtttgttctattgttgttttggtctttaaaaaaataatgctgacaccatctcaattcacactgatacatttaaagcaagccctaagtttctgcttctgtgagttttcttgcagtggtcaaatatcacaacagtcccgcgtggaaggcacgggcaatgctagctttaaaacaaggaagtaaattaactctttacctcacttctttcacatgccaggatgcacggaacaaaacacaccgaatcatgcgagtttgacctttttggttataacatattcagtgattacagcacccaggttcccacaggcatacaattggtaaaagaaattctccatcactttttacgctatctgagaagccatctagcttgaataaaatcagacactcagaagggagagctgggaaggagttcttcatttgatacattttgtttggggataccatgatgagggacgggtgaaatacaccaattttgaaatctaacctctcaggaaacgtgtaatctaaccatcagctgtgatcaggcacctgcttgtgtgaagtgagggatgcacggaggagcttccagctgaggctgattttacatgacttctggagactgacagctataaatttttgtttcattcccctcaccccgctgctgcttctgggccaaaaaggggtcttggtaggatccccaacataggtaatgtgaacattgtgactaggatcaatttaattcaaaaaagagaaacagagagagaaagagctctgagttggtgaaggctttggaaccctacagaggattccaacctgcacggcttgccaggcagagggtcttgtcagcagcgggagccaagcacttgggaggcaagtactccccaaaagatcccaacagagattctccttcctagagaaacagcttatggaagcatgcgcaactagaattgttatctggctcaaagctgcccctaacacacaccattttagcaaacaccattttaaagtccttatcagggcaagggggacttgatttcttcagtgctttgagacagatagggaaaaggagataaaatcaacatgaaaccaaacatttcttggaagagaaacagatcaggaatcttacgattctcacgagctgaactgctccccgccatcccaaactcatacactgaagccctaacccccaacatgactgcatttggagatgggcctttatggtcataattaaggataaatgaggtcataatgggggagccctaatccaatagactggtgtccttatgaaaaggggaaatctggacacagcacacggtgaggagactatgtaacacgaagaagcctactgagatggttaatattgagtgtcaatgtgattggattgaaggtgcaaggtgctgttcctgggtgtgtctgtgcgggtgtttccaaaggaggttaacatttagtcagcggatgaagagagacagacccaccctcaatttgggttggtaccatctaatcagcgccagcgagccaagagaaaagcaggcaggagaagatggaacaacacacttgctgagtctccggcctttatctttctcccatgctggatccttcctgccctggaacatcggactccaagtcttcagcttttggactcttggacttacaccagtggtttgccaggggctcttggggccttgaccacagcctgaaggctacactatcggcttctctatttttgaggtttgaggactcaactggcttccttgtccctcagcttgtgattgtgggagtcaatactccttaataaactcccttcataaatattaatgcacctatcctattctgcccctctagagaaccctaatacactcactacaagccaaggagagaggcctgtaacaggtatctcctcccagtcctcagaaggaaccaccctgccaacaccttgacttcaaccttctggcctacagaactatgagacaataaatttgttgtttaagctacccaatttgtggtgctttgttacagcagctctagcaaactaatagattaacttctgtgaacctcaatttcctcatctgtgaaaggggaataataagatgtactctaagagctgttaggaaaattgaataaaataactgcagagctcttggcaagcagcaaattctattaaaagaattatttcaaattttaattattaaaagaattatctttgccattaaaagtacggcaggccaggcacggtggctcacgcctgtaatcccagcactttggtaggccaaggtggcggatttcttgaggtcaggagtttgagactggcctggccaatacagcaaaaccccactctactaaaaatacaaaaatcagccgggcatggtagcgtgcacctgtaatcccagctatgggaggctgaggcaggagaattgcttgaacctgggaggcagaggttgcagtgagctcagtcgcgccactgtactccagcctgggcgacagagtaaaactccatctccaaaaaaaaaaaaaatatatatatatatatatatatatgtgtgtgtgtgtgtatatatatatatatatatggtgtatatatatatatgtgtatatatatatatatatagtaatggcaaaaaccacgtttgaccaccctaataaaacatcaggctatcaggctatccagcttattaattattgctacattgctaaaaggctctccatgtgagctgtatctcagattctcccatggaaacctaaaaattttactgaagactaaatagaataaatgaatcttaacttctccagctgtgctattcaactataatcattagtgccccagccactaccgaaaactatttaaaacagcttgtaatagacaattcatacaacccagggttttaaaataacgcaataatcagtagtaagactgacaaattgcctagccaaggggcaggtggaaaatttcttacagatgtgaatattctattatcttgactgggtggtggtttatgtgtgtgtacacacttgtcaagaccttcatgtgtatgatttaaatgtagggttttacaacatgtaaattatgcttcaaaaagttgatttttttttaaagtgaaaatgatccccgtgttaagaaaaagaaagctgatccgaaacgtgaagtgagctggttacttaaaattttaatgtttaaagttctgagcttcctggcaaccaaggtaaggaaacgaaatataatctttataatgtcctcctcattaaacaaccaccaccaaaaaaaaaaaaaaaaaaacatacaattcttttagaggaatgagctttgttttcttaataattctgaaaacttattagaggaaccttatataggaaacatgttaacagaataaaccaggggttgccaaactttttctgtaaaggcaagagaataaacataaatacagtaaataaatgcagtaaatatcttgggctttgctgccatagggtctcacagctactcaattctgctgttatgatgtgaaagcagccatgggcgaatgtaaacgatgagcacccgtgttccaataaaacctgatttacaaaagtgggcctcgggggctggatttggtccacgtgccacaatctgacccttcgaatagacaatatccttttaacttcggttctaaactgacctgaagcaaaacaagaactaaagacgtgaagatgaccttgactgtagattttcactgcaagaaaatgtgaataattataacagcaagttcagaacccatgtgatgacaaccacagaaaatttaattttagacaatttacaagtttctatgaaagcagataaaagagaatctcattaaaacaaatataaaacaaattttctaagtattcaatatgcatcaaatcttattacacagtttgtttcacccagaatttcattcagtgtgctatagctacattgcttttcattgcaaagctggatgtttaactataaactacatcctgcctctccttttgtgttaaaactgacaaatgtgttgtttttggattctagaattctggagaaagccaacttaaataattaagatgactaatatgttgattctgtttccagtccaacaaaatgtgaatgtaagacccatgtcatatgatgctatgtgttttagttcaaatttaacatcgaatattgaataaggcgtttctaagtaaattactaagctaaaaatattccttcaacatagcaaaaactctatctttttaaataagtggaaatttgaacatctttgctcagatcagcctaaataagaaattagaaaactgtaaacctccattacagtcaagagcattgattccatctttctgtggaaagtagcaaatattgtatatcaaggaaaacgatttatttatttaaagttattcacccacaatcatgattcacacaaagttcttcctaaatacaacacttgcacaagacgatgcttttctggcatactgaggaatcacatccaaggtgaatgaccactaagataccacaaatataactgtgagaatacaagtgtttttgaacacccagctactagggagtatctagcatttctagttcttttgcacttgataatgtttttacaaatgttttcattgcattaacttaacatttggctgaggagttctgtggctataacacactgctacacagttttgttttaagtaaaccaacattagtttttcttacataataggtgggtaatttctatttccacagaggcagtaactattttgctttttaaaagctgttgaaagtgttgcaaagcctcaactcaattccataaatattgaccatgttgctccataaataagactcttagatgttcacctaattctaataacaaatatttctagttttctaaactaattatatttattgactaccaaaggaagcattttaataattaccttcattgtgaaatcaaatctgttatgagataataaaatgaaggaaatcagttagggagcaccatctttaaaaaaaaaaaaaagaaatttaaaattttataaggaagaatttagaaatccagggtctagaatggaaactacatagaatatatgtattttgcccctagctcttagattcaactatgacagctgtcagtaactgaattttttttccattacctgccagttatttaggaaatttccattgttagcaccgtataattctgaaatcaatactactttattaattacacactgataaatttcatccaaaaaaaaccattacaatgaaaaagtaacaaatatttctatgcatatttttattctaatcctattcaatgaatttttatgaataaacacactctctaaagcaagtatgtgtattaatggaagtatgtctacgtaactgctactaatgattacaattcccataaagtgtagggattcttaattcagtgtctatgaacaatcctttcctcccctacaaaattgtacacaaatgctggctaggaatacatttatttttcccttgtagaatgggccagaggttccactatattctaaaggagtacaggatgcaaaaaaaaaaaaaaaaaaaagaagggggatggtggggttgactccagtggtctagaatctttttatttaagcagagacctgtgaaaacactatttgttcccttaaagataaacagaagtgttgtatacttgacaaaacagacagaggcccagaacctgtcatttgtacaatcataccatctccgcagtggaaatggactttaaccatcacaaacccaaaccctgctcggcatttaaattgcctctgcaacatcctcactaagcagccaccaagctatgttaaacacctttgcaattcgaactcacttgctcaaggcagcttgctctgtgatccaaaacaggcaatccccccttggttcctaatgtctgatgataacgaggcaaaagaacaattactctgaaaatcatgctccataagaaagtaagctgcacgtaggcaggagcactttgttcactctgtaatcaccaggtcctagagcagagctgagttacatactagaccctcaggaaataccatttctttcgaatgacttgttgaatgattgctatgcatctggatagcatcaatgataaaagcaacatctcttttatagcacagttgctattggtctaattgtgtccccccaaaaagattgttgaagtcctaagcccagtacctcagaatgtcaccttacttggaaacagggcctttgagaggtcatcgagttaaactgagggcattaaggtgggctctcacccagtaaaactgtcaccttagaagaagaggagatcagaaaacagagacaaacagtaatagagggaagatgatgtaaaagatacagggagaatggcttgtgcagatggaggcagagactggaattaccctgccaaggccaatgaacatctagggctaccagaagctgaaagaggcaaggaagggtccttccctcacattttaaagggagtatggccctaccaacaccttgatttcagacttctagcctctagacttggaaacaataaatttctgttgtcccaagccacccagtttatggtactttgctacacagccccagaaaactaataccacagcagaaaaggctaaagccccagaattcatcaaactggactcatttatagtcccatcagagagccttttaactttaaggatacactgtggtagatctgcttactcttaagagacctgagcatggtgcagggggtggactgtatcgggcacctctatgcaccccttcaaattctcacagctccattttactcaaaccatttttacgctcaccatcagttttcaaccaacttgacacaaatgcaaccagatggcctcacctggggctacaatatgatccccccatttccatcctagagattctctgactctgcagcatgggatgcctacaagacctgcttggcacttgcacatgtgcaaacccaaaattctgggacatcaaaacttatgggagcccttgtccaacggggtcagaagccggtggataaatgccctttattccgcaggcagacgctatgagatgcatttcctaaagtgcctggagttgagcactagttgcctctagtaatgataactaaaaaacacatttttatattgcctctccttccttcctgaattccccatccctcttttgtaatcacatcccaaattatgcataaatatgtctttttctctggttctgtttttggggaacctaaggtaagacaaagaactcttaaaacattttcaatacagaaaacttactctcacttttatttatttatgtatttagagacagagtctcactctatcgcctgggctggagtgagtggcgcaatctcagctcgctgcaacctccgcctcctgggttcaagcaattctcctgctcagcctcccgagtagctgggattataggcgcctgccagtacgcccaactaattttttgatttttagtagagaaggggtttcaccatgttggccaggctggtcttgaacccttgacctatgattcacctgccttggcctcccaaagtactgggattacaggcatgagccaacagtgcagacctactgtctgctttttatacaatgtgaatcattagaaaagcaacaccctctcgccaccccacccccgacaattctaatcagttaaatgctgcctccttgcagattctgtccattgtcctggttctgtcccttgaagaaagctaggattatctctctcctagatagctactgaggaactaatttacataaatcttttcttctaccaactaaccagccattcactcttcctttagggttgctcctaggacatgacccaatgactttgccatcctttagcctgtctatgcgccaccctaaatgaacgtaatattctagatacggtctgattggtgggactgtgtacctttcttacaacaaaccatgaaggtttcaaccacccagaggtataaacgggttgtctgcatcagagcctcgttgcaaatgttaggagttgcaagaaacagttgcatggggggaacatctttgagcgctgtaggtaatagagatgccaaatgatgattgcaattcagaagccccattttgagcactgctccccactcacatccgtggagtggcgcattaagcacttcgctgggactctcccgcacgtgctgcacgtggttcttgaaagcttgattacggtctacagcagttgggtgattgctatgaaggcaggcagatgcctggtgacttctcagggtgggctgtccccagtgtgttttatgccatgcaggaaggaaaaataaggaatttaaaaaatcttctttcaaaagatatggattctatcggactttcattccttagtaaagttgcattaaacccagagacatttattctttaatttccctattctctcatatggaaggtaggaagaatttgcactcaggccccactgaaagatagtgccagattcactcctgtcctcctttcccttttggttttcacatccttattctgagctaccacatcacgagcacatctttactgctcaactgagttctcctgaagcattataaaaaaaaatcagttacatgttttaaatatccgttggcaagcatcatagcatggctcttaatctggaaataattttaattaaactaaaaagaggtaagtcattgaacacacaataattaaacagagactgtgctgtcagcaaaactgggctggctcttgcaggattatcagagggactggcgtgtcatgtgatgttttgtgactcttctacagtcctaccatcagctctcgtgaagaggatgagcgagccatttagacagttggccaagaacagtctgctagacaactttcctcattgcatcattatagaagctgatcagaagaattctcattttccttgagcgaggttctgtttcctttaacaatggtttgctcacccactctgttcctttcacttcctcttgtgctgtttgtgatatcacacactatggataagatttaggtctaaacggataaggaaaaagacctgctttcatattcaattctattaagagtatggatactgctcaagtacagcacatagagccatagctttgcaaaaacttttattatctgttgacaattttgcacactacctaagagctgtcaaataaaacggccaatttttatcaaactcccaaagtggaacagagaccacaacaactttagaatccctagcagactgtttcaggaatctaaaacccaagcaaaccctttttccctgtttcatatgacgtgcatcttaacccagctcctttttacctacaaagaaaaacggtaattccctctgtggcgcatatatatgaagtcatccataagaagaaaataagaacttggtcctagacacaaaacatacgtaaggaaattcctcatggactaacacaagcggtcagacaccacactagttgctttattccaccttgtcgaattctcacaactctgtgatgctgacgtcatggttcccattttacgatgaggaaactgagactccggggtgaaagatactgtgccaggccccagaattggcaagtggaaagcatagacgtcaaaacagcacgtctagttatcggagggtgaggattcacaatcaaaagaaaactagggggtggacacacatttacgttgcagtcttatttcccaaggcgtcaaattttcatcactctcttattggttgcaggaggaaaaaggcatcttctccatttcagattgtctttctgggtgaagggatctccatttgcgttaacatccctgaccccctctgccactacttattcctgctcaagggagctgatccaacttatgttgtgaatggtatgtgaatggtattccaggattgagaaccgggcacacgcagctctgcctctcctctcctcttacagagagccacaccctgctctcctgcactgtcttgaacatgctgcatgaatggggtctgccctctgcaaggtctggcctgacctagcactgacccattaccctgtctaattgtggtggtcaggattgaaagcccaccagctcacacagctatacatattctccagtatcagcttcatgaatgactaggtgatgttttggtcttccatttgcctaatgggtggtcttactgctcagttaggtagtacttgggaaagggaaactgtgttatttgatagacctcttaaaacccaaacatctctttaaggttaacgaaccaacctgtgcttagatttctctagtgagagtaaaaagctctacgttctcaagtctctgtaatttaagaataacacggctacacatttcatttcagtttgaaactcaaaacagatgtgatatgacagcactttattaggttttgtcctctagatttgaaagagctccaggccccatgatgaagactagatccagtaaggtctaaagagagagacatgactcaatgacaccaaagcagacacccaggaaacagcatcctttgctcaccctgtcctgggaatcaaaaagcctgttatgaatctgaatgtatattacaagcaaatactatttttccagctacacgtcttccttgtttcactgtatcacaataattttttaaaagcataggcatatcatgaaatccttgctttgtagaagattccattataagagtaatcattattgaaccttttagcccagatgaatttcttacatgttacaacaagtttggcacgcattgtgaatttcagccaaggttgataagttcaataacttggctaaccaaccatgtgtactactcattatagaagtaataaatagatcatcaaaatggacatgaaaaagccataagaaaatcggatgccatttccagcctgcctctaaaagcacctcttggactttaatataattttatatatagttatcacaactgcccatcatcaacaccaggcatctataaaacaatcacccacccacatttgcatgctgaataaattccgctacaaaggtgaattctctattctagacgtctcaaaagtcacatagaggtacatgtgctatatgttcaactcccaaaaggactgacaagtaaaaaaggaatcacagatcgacatgtcttttccctgctattatctttttgagtcagttttagtggaaggtgttttttttgttgtttttgttgttgttttgtttttttttcagtaatactgtcagtctaattattctcatagcctatggtaattgaaaaatttagtagaaagaaaagaaagcctgatttagataaatgtcatggaagaaaaaagaaatctaagttcacagaatggaagaatctcctatgattaaatgtgcagaatcagtaaagctggcttctataataatatctaaacaacattaacaaaattgaatttagaaatttgaattgaagataacttcagcaactgtatagttaaaaatccagattctgcctactgacgtcttttatgcttctaaaaggaaactcagactctattagacattcaaggaaactaaacttcccctccttctcagaaagaaatagtccctcacacttggtaaaccacagtagagctcagtgtcaagctctaaactaaacatgaaaaggcacgtggtacatttcaaacactgtcatggaacactttgctaggtaaataacgactcttgagttgttgcacgtgggtgagttttctctcatcccaagacgggaagcctgagggtggaatctgcatcctctatttctcagcaaggcccatcttcatttacaggaatggtgggagtcaggtttgtctgtattgcagggactgcattgtatggcactgggatttttcaatgcgcaggtgacaccctttctatctgtgcattgcttctgcctctcccgttctcactgtgccatcagcaccatttgtcaccagaaatgtccccaggcttagtgaaatgctttcttctggattttctctcttgcgtatctatccacagtgggatcaccaatgacaatattaccaatatcctcacactctcctggttcttttcacatctaacatggagaaaacatagatcaagctttctaaaaccaacgttatactcttaacaacaaggaaaatatctctgccattaattgcaaacaacacctaaatgatcccaagtttggccaaatattgtgagttttcacttgccataagcagctcataacaacagtggagtgctttattttctcaacaagttacaaatgcctgatgtttccaagagcttaaatactataatggcagatattgatgtacagaattaaagtaaaatatgaaactaaacagagaatgaagagataagccagaggtgtgctctgataaaagaagtaatgaaaaggaaaaatttcataccaattgtcataataaaaacaaaggctaaggcaactaagagaagaggggctcaacggttcccaaaaagacttacagaataggtaaattcagcaggcattgcgaagtattcactgcaccccaaaaaaaaaatagtctttgcaaagttgtactattgttgactgcaatgcccaccattaaaaatatggttaaatttctaaagaaagcttctgacagccatccagaaatgctatcaataatagcagatagctttctatcacatggtttaaaataaagccatcctgctagcatgttgactctaaaatccaatgctaatatttgagcactagtaaagtcaacattaacaatgtttgccatttcttattcgtcacaagggttagttccctaaccaacatgagaaacacagacacatagagccgtaccatacaaaagcaattctttaggaaacagtctaggtacattgaagaaaacacatcttagggataatacctgtgcaagaggacaaaatctcttaagaagatggaaggcatctacagtccattgactgtaaatttggaatccttatttctaaatgtgacaactctctaatatttttcttcccttgcaagctcagctcagcttgcaggtatctcccttgcttttgtgagctagcttccccaggattctacttctacgcatacatgcagtctggaggttctagcagtctgatttttctattcattgaaagtcatgagcattgttcctcaggggttaatttgaaattatttcaggccaggcatggtggctcatgtctgtgttccactactttgggaggccgaggcgggtggatcacctgaggtcaggagttccagaccacctggccaacatggtgaaaccccatctctactaaaaatacaaaaatcagctaggcatggggcgtgagcctgtaatcccagcactttgggaggccaaggcgggcagatcacttgaggttggagttcaagaccagcctggccaacatggtgaaaccccgtctctaataaaaatacaaaattagctggacgtggtggcacacacctgttgtcccagctagttgggaagctgaagcaggaaatctcctttacccaggaggtggaccttgcactgagccgagattgagccactgcactcagcctgggtgacagtgcaagactccatctttcaaaaaaagtaaaaataaataaaattttcctttcaggtacttctcagtttaaacataacacgcggataaggttttttaaaaagcatccttgaaaagttaaatatgattaaattcttcaatccaaacaagactagctttataaccagtatacacggcatgtagaagtcactccctcaaggttgatggtgagatcttaatttggctaaccttccattttacataataagaagtaaaaagtttgcttggaatttgtagatccaaatacatccagaaacatgaccgctttccctgcagccttgacagaatgtaaaatcataagctgaatgacgattctctacttcatgttcaaatactgtgctttgcagctgccaccccatttgagagctgggaaatggaatggagcaaataagaattatggcaattataaaacctccctggtataattgtcagattaataaccagcattagcagagctcagctacaccatcagcacgtgagaatgaagagcccagagctacagggctaagtcgtaacaggagcaaagcaaagaagccaactaaagaaacccagccagaactgtaaaagaaatctgcccacaaaataaaatgggtaaggctgcactcagactagctactcatttttagcacataccatctcaagagtacataaactgctcagttataagcatggactggacatcaagatactggatgaccttttaaaaaatcatcacatggcgcatacgtattaacaaaaggcaagcaatggaagcgtgattaatataaattacagaagagcaattaaacttgaccacagatacacacatttgttcaagctgatggtgactctgcactcctccatacctactgtagattttgcttttctttatagttactcagaagatgcataattggaataaaggttaagaaaaatcaaggccgggcgtggtggctcacgcctgtaatcccagcacttgggaggctgaggtgggcagatcacgaggtcaggagatcaagaccatccttgctaacaggtgaaaccccgtctctactaaaaaatacaaaaaaattagccgggcgtggtggcgggcactgtagtcccagctactcgggaggctgaggcaggagaatggcgtgaacccgggaggtgggcttgcagtgagccaagatagcaccactgcactccagcctgggcgacagagtgagactcgtctcaaaaaaaaaaaaaaagaaaaagaaaaagaaaaaagaaaaatcagagactagtagaagacttaatgagagtgtcattcaaaatagcaaaagttctttttaacttataagaacattttgctgttagatgtttcctcaagtatgaaaaaaaaaaaatccttgccaggcgcggtggtcacgcctgtaatcccagcactttgggaggccgacgtaggaggatcacgaggtcaggagtcaacaccgtcctggccaacatggtgaaaccccatctctactaaaaatacaaaaaaaatgctgggcgtggtggcacacacacctgtaatcccagctactcaggaggctgaggcaggagatcgcttgaacctgggacgtggaggttgcagtgagccaagatcgggccattgcactccacctgggcgacagagtgagactccatctcaaaaaagaaaaaaaaaacattttagtatccttacttttaaatacaaatagaaatacagaaataattagaaactacccagagtttcgccagtgtggtggctcacacctgtaatcccagtactttgggaggctgaggcaagtggactgcttagcccacgagttcaagaccagcatgggcaacatagcaagacctcatctctattaaaaatcaaaagaaattagccaggaatggtggtgcatgcctgtagtccaagctactcaggaggctaggtgagaggatcacttggcccaggagggagaggctacagtgagctatgatcacgctgagcactgaagcctgggtaacagagcaagaccctgtctcacaaaagcgaatcaatttaaatttctctagaagcacaaagatcaagctgctggtacagtcacacactgcataacaacacatggtcaacaatggagtgcagatacaacggcggtcccataagattacaacactgtatttttctgtaccacttctgtgtttagatacacaaatacttaccattgtgttatgactgcctatatattcagttcggtaccatgctatacaagtttgcagcctggaagcaacaggctatcccatcagcctctgtgtataatgggttataccacgtaggatttgtaagtacatcctatgagggtgcacaacgatgacactgcctgacacacttctcagatcatatctctgtcattcagtgaagtgactgcattttggtgtgttttgtatcctccacaagggcagggaccctgcctgtttctaactgaagtcttagcacctggtactcagtagtcaataaatgtttgttaattgcacaaaagctgaataagggcgtggcagtggctatgagccagtgagtccaatatcatcacacagttttattgcagactctaaaccaagctcaagcctctacaggaagcaggcaggtaaactgaccatgaaaatagcctgtgcctgcctacagggggtcagcctataggaacagctctgttcaacctagtgcaactatgttccttgatagacataagccatagtcagctgaagctgcagcaacaaatatcatggaccgagtggcttaaatagcagacatttctttaacacagttctggaggcttaagtccaaggtcaaggtggcagcatggtcacgttcttggggagggccctcctactagttaagatggctgccttcccactgtgttctcacattcacatagcttaaggaaagttagctaccttctatcctcttctcatcagggcacaaatcttacttatgagggctccaccctcatgatcaatcacctcccagaggcccctgtattagtctgttttcatgctgctataaggacatatcgagactgggaaatttataaaggaaagaggtttaattgactcacagttccacgtggctgggagacctcaggaaacttacaatcatggcaggagaggaagcaaacacgtccttcttcacatacagcagtaagagaagtgccaagcaaaagggaagaaagccccttataaaaccatcagattcatgagaactcactcattatcgtgagaacagcatgattcaattatctcccaccgggtcctcccacaagacatggggatcatgggaactatagttcaagatgagatttcagtggggaccaaccatgtccaaataccatgaccttaagattagggtttcaacataggaatttttggggagacataaacatttagtctacaatactcattctgatttttcaaaactgtcataaatctaatttaagtaaaatatcctgattttagtatgctggcaagtagtctgacaaaaaaaaaaagaaaaaaatcccactatagaccatttttgtgtggtccatacaaaaaacatctggaggccaatccaggctccaggccaccaaccagttcttacctctgtcctaaaggctgattgggaagcttacccttgagcttatggaaataagcaaacacaaaaatgtccacctcccttaatcactacacatgacaatggactgcacacacaacggcagtcccataagattacaacactgtattttactgaaccatttctatgtttagatacacaaatacttaacactgtgttatgactgcctatatcttaggtttgcagcatagaagcaccgagtttgtggtggtccattatagtagcaacagacattaatacaccttcccaataattaagtaaacatgtaaggaacatacaagtgagatgcaacatgtgtacactcgggtaagtcaatcactaacagcgtcgcgatgatgacacaccaacagactagctttcccaaatccctcccggatcaggccagcaggaaataaaaaagaaacactggcaagtggcgacgctaaccctgggaggaaaaaggtcctcgtgcacacaggctgacagccccaagtcagcttttcaggctgaaaggatggtatcccttgccaaaaatctgactccacacctgactgagatgttccccatatggatctactacagagctctctaccttgtcaaacactaatctagtaactgtacgtgaacttagaattgaaacttcctttgctaatagataaagctgaacagcatttttaatgccatttggaatgtactgatgatctctcagctgatagaagcttccaaacctagctgctgaatttagaagccacagctgccttgctgtatcacacagccacacataaaatcaaaggcagttggaagacattatattgcaagatacaaaaagttttgagagttctccttatagccaatggtggctgacacagcggagtctctccatttgaaagagattgattatttcattcttttgctttgtgtgatcaccaggaaaaagagtttctataatcaagatgtggcagcaattctgttgatgttatataagcaaggagcatcccgtttgtgtctgaatccccaacagtatctaaattcgtgctgcactgtgagcagaagtaaggacctgggcaggtgaaacttaggcaagcaggaagaaatcgcatcacccaagaactcgcaacatttccacctgtgtaatccaacacaactgcaacccacagaagtttctgcctctgcaggttcccttcttattgaatcagtttctgctcctgaatatctggctagagtcagagcctgtcaactttaaatgagatcgcacattaaaattttagtcatcaccacccagtcaattgcatgacatgcaaccctgttaccggcatccggttcacttcgtaaaccctgaagaagatatttgcagaaacctctccccatatccaacaacaacaaaaaaaaaaagtcaagagctcttattttattctttccattaaggaattaattactctcttcctccatcttcttccaaccctaatcttccctttaggagtctttcttcttaactatgatttttccccaaacgccagcaaccttatattcatacactattggacttcttattacagcatttcacacattgttttacttgatctgtacaaaacagtatgtgacagagaattattattctcttgaatttacaaacgaggaaattaaggctcagatggttaagtgacttgcttaagtcacccaagttaaggacaatctgtgtcaaattacagctctcttcctaccatgtcagtagacgccaataaaactgtcctacctttttaagtggcaataaaactatattcaaacctgacactttttggatatgatcaaaaaaataggacagcaaagttgagcatttctacttatacaccaggcagtcctataaactatcacaaacttgggtgaacaagtgtgctaatgcagactctcagtaaaaaagatgttaccatgatgcatggtataacggttttaaagaataatagtttccttctctttttcccccaagtttaatatatccctttttgttccttgactgtaacaaaataacctcgtctcggtggtttttttttttttccgttgattattcttttctggatgaaagtactgacctccagccaaaaaaattctaaaatgttttccttcataccaaagacaagccaggtctaaagcagttatttatacaggtcattttaggacaaattcacagagattatggcagctcttgaggatctgggaaccaggaagctaggaaaataccaaactaatttcactggtaactgatcctcttgcctcccattccagaaatggctacacgttattaaacgcctgcaatgatgatagacaattccctgggcactctggagttcccatctttaacaactttgcaaagtaggagtctgtccatattgcacagaggtggaacaggagttctgagaaggaaagtaacttgctcgggcatacagataggaagtggttatcccaggtttcaaaactaggtcacgtctgcttccagagcagtgttcctctcctacatctttccagatagaaacttgctaccaatgaagcttgccctactgtcagcgaagctattttcagcaatggtacaatttctccacctgaaagcaggctcatcaatgagagaatgcatagaaaagctctgaagcgctgttactgtcattaatagaagatctagggaaatttgcataaccaaagtaatcaaatcttgcctactgtgtcatcttgggactccacaccattgcaaagccagacaagtttaagttttttggggtattccctccttaaatgcgggaccaaagcaacagtgcctttgatttgagttgcagctggcataatagacaagatgtgtgctaaaagattttagtgaagcaaactgaggagttaggccaatttctttctctgtgaatttctcttgatcacaggattgaacaggtacttaaagtaatagacactttataaattaacttctagggacattttgaaaattaaattatagcacatgaggcaagcaatcaattagtaatcgatcatatccaatagtcatgcatataagatgaaagggcaattcgttaaaaaacaaatggcccacataagaaaagcctatcaatcttgctaatcatcagagataggcaaatttaagtgatatttttaaaaattctaattctcaagtttggcaaggatgctgggcaaaggagcattcaaattgtacaatcttccagggcagtttgacaaaacaaatcaagatattaaggttggggagcaaacacttcattcagcaattccacttccacaaaataaaactatagaagagtcacggatgggtcaaacatttaattacaaaatgtgcttctccattccacagctattaaaaagctggaaacccccgaatgtaccacactgggagaagagctggaaccacataatggaatactatgcagccattaagatgtggagtatttaacaacacagaaagataatcacaatttaaatagaaaaatcagaaagaagggaaaacatgcttacaatcatacatgctaaatattaatagtatacttctaatggtaagaattggggtttttttaaatcttttattcttatttttatttttcttcgctttcaaattttccataaggaatacatgttaatcacaataacctttaaaataattacttatattaatgagaaggcacatcaagctaatctagcctaacacctggcatatacaggcgcttgatgatgctacttcccattcccccagacttattccttaatgtttgttttacaatcataataccaagtggttttggtaaagaaagcttcagcttttaaaaaaaatttgatttggtagagatgggtcttgctatgttgcccaggctgctctcgaacccctgagctcaagcaatcctcctgcctagcctcccaaagggctgggtttacaggcgtgaaccaccatgcccactcctaagcttcagttctgaatccaggatccaatgcagtctggaaatgacatctgccttggccctccccgcagtgccactcccagcacttgaccgggcacagagcgaggcttcacgggtttaaataaattggtgattccaaactcaggattaacaaaatgaatgagctgcttagaaagagctcattcaggatgtgctgttattcctcccaacaggatggtggcatgtacagtggaaggggccccaggcacgactcaattaccctttgatctatcctgcaggcacccgccgcccaagacctgtatgatctaagcacgttacctcacctcccttctctttcctttcgacattatcacaagacagctgtaacacggtgctgagaattaaatatgacaagtacggaatcttcataaattttaaacggctataatgtaatacaacatgataatcaataaatacgaatctgtaacaattaagtacattgtagggtaagggtaaaaatgaaaaacattgtattagctttaacttcagtttctgtgcaactacgaagaaatttgattctgattttgttcctctttatatgaaataaacttcatacaaaaggctagctccgttcatctggctagttatcctccacctaggtagaaatagtagagacactgaataggtttcctccccgcccccatctctctgtctcagatctcctcttagagtctagtgaagaaccttgtcttgctttcagagagcaccatatgactatggcttctaacatgaaggctccaaaatcacaaaaagtaaaaccatcaagcacagcctggtgagcaaataactcaaagacttaaacaattagatttaaaccttgtcacacaatgcaacccttcctatgtaccccattcagttggcttgtgtagactgagaccagctcttcatgaaatgtaccgttatttatgaagccaaaggagatcacaaatttaggcaagaaactaaaagcgagctattggaacctgctttttgatcctctactggtgccttaatttaagacatctttccaagaaggcctcctagtgaccccaacctattttggagaaggctgaggattcatatctactcatgtataggctacaaaagtccaagaagtctgtgtcataccaaacaggcaacggtcaagggggtttcaactgtcagcatcttatttttatgaagtctataataattcccagaatcgccatctagttttaacaatttattagataacaacgaacacactcgtatatgaacaaccaaaatatctttactctggtgaaatagctttgaatgttacaagtatattcacaatgtttttcaggctcttgcattttcaaaagagaaaaagtgctgaaaaaaaaattatataaataaaagtatataatatagcatattcgtttttgtcccatttaaaaatttgaaaataagcagttttgtaaagccaaagtgtattcctttctgggccaatttctatttgacagctgaaatatgcgattaatgggctgcctcaaaccataattacacaccaaaacaaaaattaccctccctaagattgtacatggagaacactggctatctgcttcaattaagtagctggtttaatatgatccctcttacttaagaaacatatactgtactgagccaaaaggacacgttttcttctacagcaagaatgtatcattaataaacaatttaattacaaaaattatgtaacactgggtaaggcttgtagcagggggcaagggacactatattcttagaaaaaacatagggttgcgggtgcagtagctcacgcctgtaatcgcagcattttgggaggcgaaacgggtggatcatgaggtcaggagttcaagaccagcctggccaagatggtgaaacccatctctactaaaaatacaaaaattagccagacgtgttggcaggtgcctggactcccagtactcgagaggctgaggcagaagaattgcttcaacctgggaggcgaaggttgcagtgagcaagaatgcgccactgcactccagcctgggcaacagaggaagacttcatctcaaaaaaaaaaaaaaaaaaacaaaaaaaaaaaaaacaaaacaaaaaacaaagaaaaaaacatagggtaccaaggcgttcaaaatgaaccttaaacagaggtattaatacttaaatattacaatttcacttaggaaaaaaaaatcatattattgctaggccagcacactcaaaagcaataatgtcagaaaacacatgcccttgtgtgatttggcagaacaggctgctccctgaacacaatgggccttttattaagtggatcccttcatccctggcattttatacaaacaaaacaaaagagagagaaaagaaacaaacacgacactagtaacagtcttcagtttgaacttcatcacagagaattgaagacctaaaagatatgttagaaaagtaaaagacattatttaaccaaaatgaaagcaaatggactgagaggaacagaactatattgcaatgctgcctcttttgtttaattatatcaagggcaacagagccctctagtggaaaaaaataaaaatatataaagatggttctgcttttaattaaaggaaatatgtacaacacccccgggcatggtggctagtgtctgtaatcctagcatttgggaggccaaggtgggcggatcacttgagttcaggagttcaagaccagcttggccacatggtgaatccctgtctctacgaaaaatacaaaaattagccggacatagtggctcacgctgtaatcccagctattcaggaggctgaggcaggagaatcacttcaacccgggaggcggggttgcagtgagctgagatcacgccactgcactacagcctgggtgacagagcaaggcacgtctcaaaaaaaaaaaaagaaaaaaaatgtaaaataacatcttccattacaatttttatgtgccactctatgatgtaaaagcaaaagatcaaattattttaattgggttttaagtaaacaatttccaagttttcaagctttacgtaatgctacaaaacctcaagtagaacaaaaatcattattaatttttttaattatgggtttgacccactttgtcattaaacaatagtttgtatactctcatttgttatgctgacaccataaaaaagtaattaaaatctaaacctacatgcagcatgaaattcaactgatggcctcatgtgacaaaaaagtttcagttgagatctaatcaggtcacactgacagtagcccccccttatcctcgggagatgcgttccaagacccacagtgatcctgaaaactggatagtaccaaaccctatgtattctatgctttcacctatacatacatactaggataaattttaatttataaattaggcacagtaagagatcaacaataataataaaaagaactataacaatgtactgtataaaagttatgtaaatgtggtctctcacactctctcttctcaaaattagtattttcagatgcctgttgacctcaggtaactgaaacctcaaaaagtaaacacgggccaggcacagcggttcacacctgtaatcccagcatttggggaggttgaggaagcagattgcctaatgtcaggagttcaagacctgtatggacaacatggcaaaaccttgctctactaaaaacataaaattagtagggagtggtggtgtgcacctgtaatcccagctaccaggaggctgagacatgagaatcaccaggccctgggagacaaaggttgcagtgagctgaatcacgccactgtactccagcctgggcaacagagtaatactctgactcaaaaaaaaaaaactgaaacaccacggataaggggggactactgtatacatgattacaaatttattttaaaatatatataacatacacacacccctattataagcattttacatgagattaccaaattatagatgatgctcattagaatgttttaaattggtctcttcctttagatatttacttctcaatactttgatcacgtgatttccatgtacactcaatgtccaataatatctcagtgtaaaatgttaagtcataaggtactaattctcaatttttatataatgtcatttaaggactttgtctacactgtcaagaatctccatagtttcttagaacaaagtaacttcaaaataattttacttcaatacctgggtataatttagcataagataatagtaggcacaaatgtttttaatttaaatggagttccaatgcccaaaaggttatttcgattatttcagaatattttcctttccttaagagcaccaggtttttaaaaagataaatgccaagatcccactagtttaagtctggtcaacatcagaaaggaaactaatcaggcatttcaagatcccaagtgcaatgatctcatatgagttgttttacccatgaaaatgactaaatgtaagttagctatggccccagatttatgggacctttggaataactagaaaaaaaaaaaccatcaatgacatgctttaggctcaaaggcaaaat

SEQ ID NO: 5031 - DNA, 75779 bp, Homo sapiens
tcagcgaatttgtcacacaaggcagctggagtaacaatgtttttaattaatggaaaattttttttaagtacttggaaaccagaaatttgcagcggtgtcaatgagaatataaaccatcagaagtcctcaggctaagcacagtggctcacgcctctaatcccagcactttgggaggctgggtcctgccctcgagtggactacttaaggtcaggagttcgaaaccagcctggccaacaggtgaaaccctgtctgtataaaaaatatgaaaattatctggcatgttggcatgcgcctaaatcccagctacttgggagactgaggcaggagaatctcttgaacccaggaggctgaggtgcagcaagccaagatcccatcgctgtactctagcctaggagacagagtgagactctgtcaaaaaaaaaaaaaaaaagaagtcctcagtatggcaagaagctcctcccctcagcagccttgaccacagacttactccttatctacctctaggttgctgggaaaataaaataattgataaaatcctagtggctagcccacaatgaatgcagaataaatgttgctattgtttataatagatcagtgaggtaattacagattctccttgaccattaattctcaaaggcctttcattgacttttacttgctattttgtttctgtatatgtgtaaaggtaataagacagttatgctataattgcaccattaatacattccaactaaacttccctcaaattaatactaattattgatgttacatataatttcaaagggattagagtgatgtttgctttgcaataccattgggagggaaaatcagtgtttaagtataaatggaggaagataatataaagtgaagatcaaataatgacttaagcatttactaaatcatgttgtgtgctgcttcttaacaataaaaatatcgcttacactgcaaacagaaggaagatccctctagcctggtgcaccaagtaagggtggaaaagtcagtcttatactctcagcggagcatcatgctcataaaaatttttgtaataatattaaattttttattaatattttttgagatgggattttactctgtggcccaggttggagtgtggtggtgtatcatagtttgttgcagcctcaacctcagaggctcaagcaaccctcccacctcagcctccaaatatctggaactacaggtgcacaccaccacatctggctgaatttttaaattttttttcagatagggtctcacatttttctgcaggctggtcctgaactcctagcctcaagtgatcccctgtctcagcctcccaaagcactgagattataggcgggaaccaccatgctcagccttaatactaaagtgtccaataatgtgagtttgccctgaaacataggacacatcaatcatctttattttaaatggtttaagcaagatagctcacagaagttgggggtgcttgactgcttcaaattggcaacatgatttattattttcaaaaattataggtgttattatcctttctagtggaaaatgacccacaaatctccagttgtacagaaatcagtatttcccaaactttccaagcagagagtcacctgcttaaagatacacattcctagaccactccagggaatcaggatttctaaagcagctctagtaatcggacaagtttgggtaactctttccagcactggttcttagcactaccacttgctagaatctgctgggaagcatgaaaaacagcagcaacaacaatgataacagtgtccaggccccatctccaaccaatttaatcagtatgcatctcctaagttggcctggcctggatgtgttttctaaagccactcagatcatgctaatatgcagccaggcctgagaaacacaactgctttgcctcggtactcagtgtcattggaactagcaggactggcctcttctggggctggttagaagtgcaggatctcaggcctggccccaggccctgagatgacgatctgcttttttttttttctgagatggagtctcactctttcacccaggctggagtgcagtggcgctactgggctcactgtaacctctgcctcccaggttcaagcaattctctgcctcagcctcccggtagctgggattacaggtgcctgccaccacgcccggctaatttttttgtatttttagtaagagaggttttcaccatcttggctaggctggtcttgaactcctgacctcatgatccaccgcctcagcctcccaaagttctgggattacaggcgtgagccacctgtacccggccgaacaattctttaagagatctgtgtgcacactaaagattcaagtatgcatatcaagggaacaaaacctttccaccaagaggatggatttttgctcccctctcccctctacctttgccagcactccatcaaaagcagcttaaaaccttgactgaggtctttttctttatacacttagccattgaagccaactgaagagtgatagggtgaggcccacctatctgttccaaaatcatttaggaagcatgttaaacagcatacactgctcttacccaatcaaatgtctccgcaaaatttaattgcagtttgtttcatgtccagcaatcaaagacattaaggaccactaatatttacatccatgattcatttagacagttttctttaattgatgatgaagacactacaattctaagtaccagaagaatcaggaaaaaaaaaattgaaaataagcataacactataaagaaaacttggaaaaggaaacacttctaaataaaaaatatatacctggcctggcacccattacatatatacataaacatgttataaacatatatacagtaaatgttttggtagcaatacagaccatgcattggttttgtgtacacagatgaagtagcaccggggcagcaccaccatcttaagatgataaaccaactgcacatacattaaatgaaaatacatatatgtttaatttggcccaccctgtagccaaaggtgtaaggaaagtactttgcaagaaaaaattgttttgggaactacattcttaagccatggtgaagttctaaaaagaaaaagaaaaaaaaaaccctacaaatgtctatgcaaatatgacaagttttcctgtttactgaatttgtcctatcctatggcatactcgttaacagcataacaaagagagatttaaatgccaagtgaatggcagaagtctaaaacaccagatcttttggttatacgtcacaaatggcaagtcatacacaaactagaaaagaaagctaactctccacctagtcatgtgttttctagtcatgttagctaattataagctctttattcataattaattcctgagtagggttaagcacctccaatatcattccacctcctccctgcccctaatgtgatgcttgtttacaagtagtgggagacacacaacaggctacatattctctacccatacttaggagcagacttacagaactacggaaggaccacaaagatcttctgtggcgctgcctcagaaaggcccatggccccagtgtttatcctcggtgttctactcactatgaagctgtttttgttctcataactgagctcacagtctagaggtcttttagtcttggcaaggtcatatttcctcacatcctagaagagcatgcttcttcctctcaagtttctcacaagcctatacatctatatatattatatatatatatacacacacacacatatgtgtatctatatatgtgtgtatatatatcttatatgtgtatatatatctatatatgtgtgtatatatctatatatttgtatatattcattatatatacacacacacatcccacacacacgtcacatatatatacacacacacaaagaccacacatgtcacatatatatacacacacacatatatatacacacacacaaacacacacaacacacacacacacatatacagcattacctccaactaacattcatcattcatggcatccaggaacattaactcccctgtcaagtcattgcaaagaagaaatttcatattggcttccaccattcttcttcccattcctaccaaaagggtcacatctctccccgccaaggtcttaattccagtgtctggattcagggcctccttgtgtgatggactaacctacagagtgctctgcaaagcagcatgagaccaaatatggggtcattgtcaccagcagttggaagactgcacatggatctatttgtcatggctctcgttgtcagtggatggtgaaaccctttcccccctttttttaacacctgcagtaaataaatataaagtttccgactttgtggtatattgtattcaagatgcagattgaataaaacagggcttcagtattgtaaaatactgtttcttaccatacagaaaaatgtttcttaatacttcaaatgtctcaaatttaaatgatagctagaagacaaaagccagggaagaaaggttaaaaatctctacttctggctagatgacttttagtagatccatttttgcatcactggattagtcaagagtccttgacctttgaaagtcagcaagaaatagccacaaatgaacatcagtactgatttctcattattgactcaggtggttgatcattaatggattctcttacttctagctggttctagggccattcttttgcccagaatgaagatatcatcaaagtcataaacatatttgttcttttcgcaaaagaggattttaaaactctgcttaagtctctaaggaaaacgctgtgagaggttggtgtcatcaagaaaaacccactaacttctaggttaaccagagccactagaagcctcaataatgaaagcccttggctggcctacaaatgctttgaaatggaaaaagccaactctcctcaatgggaactgaacacaaggactcagcagctgacgttgctcaaggaaacccttcgtgtcgccagagtatgaacttttggtttgagtaccagcaacttccagtttaaatcggtagtttgatgccaccatcaaaaccagctcaggcaccactagaagcagctaaataagaatttctacctttatgcttttcgactcaaaaagtcagagaaatagaaaccaaagatagatttttccagtctgttcatttctgctctcattcaaaacatgttgataattccaatgtagaggtatctcggtaacacatattcaaagtgtaggttccttgagaaataataaccgctttacaggaaaatggttgggagtgactttgttcattgatttctctttaactatttcatcctcaaaggaaaagagcagggcagcttgctctcttcttccactagcaagagtatgaatagaatgcttgaaaatatgaaaagttagtttgactaagaaagtctttttttacaagagtaaaaacaactttcatatcagattttcaaaatgggtagtgctctctactaataggaaatgagtaattctgcaagttccttgaaaacaatggattcttatgactctagaccctatttatctagaaattgatgagcatgcaaatgattaaaatctgcaataacggacactgcacaacagtcgtgaggtacatgccacctggctgaatgaacagtaacacgggcctcagcagtgtgaggggtccatttatctccgctcccttttgagtagagctggggtccccaaacagttcatcaggagcagcagccactacaatgccctccaaccctggcccctaccttgtagtccccactcccaccagggagcttaggcgttcagagaaataaaatgttgctcctcccaatagtagggatgcgaatcctgatagagagatagaggctcccacagactcagagggagcctgatatttgcattaatcatttaacctttaggaagtttcctggtaaaaagatttaaaaatctgtcggcaatatcttaaatgcattcattgccatttgtttttcacgtggaaaaaattccaagacgtgtatactttcaaacaagaaaagaattaacattttcactgctggctaggtgtttcagtagcaggtcattagcttttctgtgctctctgtacgctgtgttttgttaactaatcactaataggccagcaccaccaaggcaaatgggccaattacattcagttaaataatgtaacactggaagttctcaaaaatatgagataaggtaagagtcttagggaaggtgacacatagccctggtcataatgaaaacacttactggaattttaatttctggttagcaacagctcacttgccttaccatctttccaagacaatgcaggaaatgaaatatatcataatgtgtgcacagaaaaaaatggtgggaaagagcaggaaacttacagaagtggtggggggaggggacagaagaaaagatcaacagtattagtttattatgaatagaaagacatttccagaatttacaaacgcccacattgttcattcaaagagagcttttgaattgaaggaatcacccatctccttctgtttacaatacatgcaatgaagactttaatttcctcttcttataattttgcttccattcaattaccaattttaagctacatttgaaaacacccagccaaatatatccttcttcagtttaattaacatggcctattgcttacaggaaaaaatacaaaattaagattaattcttataaggaactcagctcaacatcagtttatatgacaagagatagtatcagcaaatataactatacaattgagaaccatctatgcactatgattcttatattatgttttctgaattacaatcttaaaacaaggatcataccctttctactcttttaagccttgttttaagcatttgctccactctttacaacagaacattgttacctccatcccacatccaaaaaaaagatgtgctgtaagaaaagttacattttcatttaaaaattacacatataaatcaaaacctatgttaaatatttaatactctctccacccaacggaacagttttgtatgaaataatttacaatgatgctttgtcgtacacagtttcagcagcaatgaaatgtatcttgaaaatgcattgagagtaaacccattctctcatgacacggtggtggcacatcagctcactgtggccagctaagtccttaaggttgaagatgaagtttatgcagatcattattctggtgtcacagtgcatttttttttttcgcttggcacaatatagaacgtgcgttcagtcaatgaaatcctgaggattggataaagtaaacaaactgaaatggatgcatcgaccatctactgatgaggaagatatgaggtcctagttgtgaatcatgaaatatttagagttgggtacccatgagttagaagaggatttgctgaggtcatttaggtcttcattctgaaaaaaaaaggaaagaattcagcaccacaggtatctcaaactgcacaatcactactttagaactttcttttacaaggggcagcgtcacataaactgaagttacaggcacaaatagtactgtcacctaaatatgatcaacaaactgtatttagctttttatttatttcaaaatgcaagagtcaaagaaatcactaaccaaaagtcatcaatgtggaatctgtaaacaaatcaacatgatctgatgtttcagaggtttagcaaaggaaaaatagaaaattctttggtgttgtgattgaagcaaaacatacatcattagttgctatgtaaaatgaccatccgacatgagcgggttgtagtcgtctgtgttgtatctccttctggttgaaagtcagctgcagattttagaatttgaagttgagagcttcacatgacaaaatcggaaatcaatttttcatgtgcacaaacattgtttgacagagaattttagatgcaaagggagacccaagcaaaacggacctactgaatcattaaataaaaaacaaaaagattcagatttacgtctaatagaaataagttatttaggcagaagcacagatttcttctttgcaagtcaagaaggtaaattttaaagggtcactatccgtgattcccctcagagtgaagactcttttttttttactttttttattattatactttaagttttagggtaacatgcacattgtgcaggttagttacatacgtatacatgtgccatgctggtgtgctgcaccactaactcgtcatctagcattaggtatatctcccagtgttatccctcccccctcccccaccccacaacagtccccagagtgtgatgttccccttcctgcatccatgtgatctcattttcaattcccacctatgagtgagaatatgcgctgtttggttttttgttcttgtgatagttactgagaatgatgatttccaatttcatccatgtccctacaaaggacatgaactcatcatttttatggctgcatagtattccatggtgtatatgtgccacattttcttaatccagtcttcattgttggacatttgggttggttccttttcaacctcataaagcatcttttactcaagattacactacctagtcttttacaggtccttgtttttcatgcattcaaaacttatctataatatcagtatctacagagtgcatcaaagggtatttagcagagagtagatcagaaatactgttgaatgagtacgtggttgcactaaatactaggaagtgtagaaagctggattctgttgaagccctgccttctagtaattctagaaaggaaggcaagttctgttcataaatacatggctgtgaagtagacatcagtacatgccaagatacatgcatgggggcaatagctctagacactggaggatggaaagaatcctcccagctaggggtgtaaggggagcatctcactgacacactggcttggttttggaagaaaaagaataatgtggggatgtggaaactgggattgtgtctagttgctttggtgttgcagtcccagaagataacacaaggcttgccacgtggtagtacttataaataggagttaaataaatgaaaaggaaaaggacacttcccattgagaacatatgacaggtcctacagggtgagatggtagccgtgagcaggctcaagtagaggatgtggcttcactgaccccaagatatctaaggagggatagaaggaattaagtctacaaatgtagcttgaggtgatggtgaagaaccttgaatgacaagctaagaggactttatctaattatagagacaacaggacatgctacattgacataaggtcaagatgtagcagtaataatgcatatcacctacaagatagtgacagcttccaaaatacacgcaacgtaagtgtggaccgatatattagggtggacaaaagcaattgcggtttttgccataaaataaattgcaaaaaccacaattacttttggacaacctcatatctttttccctctgtctcctcttgaagggaatgatcatggctggcatcatcatcattcattacgcaatggttttctgataagtcaaagtttaccaaatgatgactctattttaggagatttctatttatttttaaatattaactctgcctctaaaagacaggtaaacaactgtatttttaactcactaataaagacttggcatgacgatcacaatataaaaacaaaaaaaaaggaagcattccaagtttgcccctttaattgccagagaaacaggatttactctggtgtctacaattgtggtgtccacaaatgaaaagaaagcccgtcccttcacaagccattgtatgctaggaaactccccacaacaagctccagatctcttatttactgtcaagattctccgaatgcatataggaatgttcccaccagaatttctagattagcgcttaacagagcttcacgctctgggcctctaattaggcaggaaggccacactttattaaaggacttgtgacaaacaacaaactgccgaacataaaatgggggagaaagcaaagggcatatggtatgtttttcattcatatctggctcttctccagaaggggtgggtaaacagcttagtacaggaacacactgtacctcttttatcatcacacgtaccaacctgcacggatgcataaggacagagacccagggcctgtgaggagagggaaaaacaggtggcttcactgggtgctgaaatctgttgctttgggcacttggaaatgatctctgtcattatccacaagtatgttcaaagagcagggaataaaaggcgtatcaagtgcatcgacaccttccttccaaagtcttacttagcacactacttttcaaaccccttatcttaagtcctgatcaacacttgtctcaaaagggaaagtctgaagttcacactgtttgtctttgtacagggtgtgtgtatctgtgtaggcacataaagtttagctaccaaaaatgacatggacatccttcagtgagaactgtccttcacaacagccaacttgggggctgctacttattccagtcatgcagccattgtttgcagcatttttggaatgcctgctcagccttggcatattcttttgaatagtctctatagcagccagtcttagccctctgaggacacgtttatctttggagacagccaaaaagctttgagagccaaatatggtgaataatgggactgattagctgggtaattgttcccagcgaggtattatctaaagccaaagagttccgaaaccgaagtccaaaatcagagttgtgtacaacacttgctctgatgagtttgttggaaaggaagtctctcactttagagacagacctcaacatatgcttaatgagactaaagttcatctgtctgtattccctagctccacatactcacaatcaagcaaggctgaacttgaataaagcaactcactcaaaaaggcaaacatttgcgtaacttaatatattttttaaaaaagaaaaaagcaatgccctactagggtcttgcagtcagtcattcaatgcaataagcataaatacaatgataaagactgaataagcaggggaaaagcccgcataggcgtacatatgtttaatacactttatatatacccacttcaattgactgaagggagacaattgacagaccagaggtagcaaatattgctacaagttttacaaatgcaaaaattcatttgtaacaggcagaaactggaaacaaaaaggcaaacatttccttaagagaagacactgcaaatatcaagtggtgatattcctacaatgcattcttctggttacatcattggggaataacttctgaaggcagaaatacaatgcacctgtcacgaatttagtagcaggaaattacattttgacaaaatttcatcaccacatcagtatctactattccttctgcgtgtatattcttgtaagataaaacccacctaatcctgttgccagtaatgaaaatgtaatttttaaagcattatcaaataagtcaacacttgagcaatgctacttgacactatggattattgcattattgcatctagtaggaatttacatcttctgggttctacccactaaactatgcctataatagctgaaaaacaaataaagactttgcttccttttacattgtctagcttactgatcgtttttactgggaaagcagctggaaacagcacaagagtataagtgtgtggaaagatctgtacactcagcaatgcattcttggtcagaacaattgacaaatgttttctcctgtatttatatgttttgaaacttcttgccaatatgttaaatcaagggcaatatagtataaaaatctagttggggcattgctagtcgtttctacttttactagggaaataagagtaaatattttaagttgcttggccactgtcacatactaaattgttagaaagtaactcttcctatccaactgtgctttaaaaaaatgaccgtagtgatgaccttttttcaatagaggtcatttttgaaatcttatattgtagatggaactagaaaattaatataaattaatttcctccactaaagaaatgaatcaaaacagcatatttctctttcagttaacataaacagctgtgtgcttttaaaaaaaaaagtatcttgaatataatacagaaaatgtataaaatacaggaagatgtaagaaggaataaacatgacttatattccccatcaccagaaaaaccactactcagctgtggtgtaatttcacaatctacttaaaggatttgaacttttaaaatgctgcatttaatgtccctcaaaaagtctaagtaggaaaggaaaatactgttttaatcatacttagatctttcccatcttaaaaatccatgatgagaaaaatttttgaaatgttacccaactttttaaagcatcctgtattccatccctttgccatcatcccaacgcattgtataatatggggagagtaggaattgaaagtaggaaaatcttctggctccctggctttagtttccaaaagcctcagtatttaaagaagggcacaggcaaaatatttggaagagccaggagaacagaaggattcctctcaggttgaaaagattcccttcatgagagcagaggggtcagtgggtagctctgtactttgcaagatctgacaatgatgcctgtaacctctctctattctgtcttcccacgtctgttgatttcctattcacacaattacattaaactgcatacccctccctcctaccacaattcttcagttacctactgctgatacacttaatttacagtaccactaactggaagcaaatcatgtcttctagaagcttattaataaagcaccttacaacacacacattcagcatacctgaatctggcaaatgacccagtaaacacacacacacacacacacacacacacacacacacacacacacataacaccacacacatattatcatcagtctcaaatacctttatagttctggtaatagatgggtgttttcattaaaattcatacctccataaaatcccactataaaatctcagatgaataaaaatgccactgacctatggatagactgtgaaacgcttattaaaggaagttcccagcttaaagcctggttctagcatttgagttagtagcacagaaggaggaagctgcattctcctggtccagcctattaactatggtcatattgctgatacaaaaagaagagctaaatccagagagcctctaagtctgggacatgggataatctccccgttctttacaagggacagctgggaagtatggggcaagctgaagcttggaaaaggagaaaactaaccagtgaattctcaattctcaactctaagccttcagatcataatcacacacatcaagtgaagattgagctaaagttagaggtaagacaacatgtttgctacttggatgttgaaaggagaaagccattttagctaaagaaaggaaacaacttcttttaaaacaggccaggattgagctggaaagaacttggttttgtggtctcaaaggcaaagggtaagccaaccagccaagccagtgctttaatggagctgcttaaatagcactttgcctggtgcaagtcacatgggagagggctggtgaaaataacaaggttgctggccagacttccagtgcgcagggttgccaaggaagaaaattcagggagagttgccaacatatgagagccatctcgctccagttccccttttgtcccagtgaaagagcttctggcagggctggtgattcaggagaccaccaatgaagaaaggcacacgcattatgaaaaaaaaaaaaaagaagacgaaaggcgaccatcaagcctgtcagctctggcagaggctactgggctgaattctgtcagctcgtgaatttctccttccccagctaccaaaggcagaaggagattccagaaacttttcagatggttaggaatttgtggagaaggcagaccaaaacaacatttagttctcagtaattaaagtattctgtcagtgatatattaaggaaatctgaataaatattaatacatcttttaagcaaagaatatccacttctgttatttcccattctttttattaacaggaagcatgctgataagaaaatgaggtcaagaccataacagctcctcccctcaattgcaaatcaaaatgtttccatctcccttttaccaatactatagtttgtcctatgtacatgacagattcaaggtaaaaggcttaggaaaaaaaaacaaaaaaaaaaagtccctcttcatttcaagtcagaccacacgtatctcaggcaggaagatttaattttttttttttggagacagagtctcactctgtcacccagcaggagtgcagtggtgccatttcagctcactgcaacctgcccctcctgggttcaagcagtctcctgcttcagcctcccaagtagctgggattacaggtgcacaccaccacacttggcaatttttgtatctttagcaaagacggggtttcaccgtgttggccaggctggtctcgaaccccaacctcaggtgatccacccgcctcggcctctcaaagtgctgggattacaggtgtggccatcgtgctcagccaggaagctttaattttaacagagctcaaccaaaataaacctgttcgaaaagacatgaaggtaatatgacagaatattccctactaagtgagaatgtcatacgatgtctttcttctgctttcatgggcactatttctgcagcatcctttccctcacagaaattcatttcagttctgaggtttctattgtaatttcacatcacttttgggtttggggttttgttgtaatggtcagattacaggatacaggttttataggtctggctttgatacaaaccagtaacttgcattaaaatcaaaacttcatttagtgtatggatggtgaaaattgtgtgcaaaacgtttctataattagacaaaagggaatcaggcagagcctattttcactgcctttgcttttttgttaaaaactaatagatttctcattctttgccctctccctggagtcaaattgcttcagaaagcaagcgtctgattttacatttgagtaactgtctgactacccaattgtttctcaacatcatcagtttttccataatagcccaggaatcaggcaccaaacaagcatttgcatagaaaccctggtctgcagcggactgaggtaagaatcattaacaccactgacatcacttttggagctggagaagtgggaaaacctgtgtttaatctatttcctactcaccgcaagttttagcagagtccccgataatatgggttgtggttcactttatggaagaacttggtcatgtaagaaaatctactgaattgaacaagcatcttccaaaacaaccatgaggtacctcagctgtggggcatgatcttcccataggtttttctgatccttaaacaggcctaacagaggacaatgccaccccaatagtttctaataggggcaagctcaacctcagtagaagattttccctacaacataatctaaggcaggggtcctcaattcccaggctgtggaccagtagagatccatggcctgttggaaccgggctccacagcaagaggtgaatggtggatgagcataagcacctgaactcggctcctgtcagatcagcagcggcattagattctcacaggagtgtgaaccctatcatgaacctgtatgcaagggatctatgttgcacatgctctttatgagaaaataatgcctgatgaaacattcatcccctcacccccagccatggaaaaattgtcttccatgaaacctgtcactggtgcaaaaaggttggagacccctgatctaaggaacgtctccaggaagccatcatcttacagagcaaaaaaggtttagcctttgttttcctttctgcattgaggagaatatcagggggaaaagttgagaagaatttgatctgggattctttgaagcgaactgttctttaaaaaaaaaaacaagtggtctaactattgaagaaacactccctctctgaaaccagctgaaactgattataatcaagtatatggcagcatatttcaaatgtatttgacccacagttctcatttgctttacctaagaatatctgttatggaaatgcaagtcataaagatttctgggctatgatagtaattctcaacaaaagtcaatgtaaaaggagcaaggaaaagtataccattcatcttagatttcagaggccatacacaggcaggaaccatattaattagctcatgttaaagagaaagctattaactttgcttacagtaaagtaataatgcaataaatgtgtgtttcccttgagttgcctctttctagtgacaagtgagtaacctgtatgcgattttgaattaaaaaatgtactttagggaattcaccccaaaaaaggttattttcagaatgaagatggaactattacatggctgtcatgcttttaaagactgataattttgtttaagtcaaaacttatttctgaattaaaatttgaaaggaactaagacaagttccattatcccatctctcagtgttcttttctctgtgatttcaggcaagtgctcaccctccaaaatcccaaatgttttcgtctgtaacacaggagagcattgcccattcacagggttctcgttgagattaaatgagataatacatgacattttcttatcattgtgccgacacataataagccctcaatcattagctcttagtgtaactactgttatgaagaactagaacccttggatcccacatcttttcctgatacctgaaaacacaccagccaaaaacactgtgtggaactagcaagcaaggatgaatccaccaaccaaatgccaggcaaggactgaatcagagccaaaatgaggatgcatcttgcgaagagaggacaaagttatttcagaaaggaggaagggaaaatgccagaacaaaaagaaaaagtaaaagtagcagtagtagtaaggctaaagatagatatgtaatacaacgttatacaaggacctgtctacctacacaggaaagagtacaaattaatattgagacagtagcattcacgtacaaaggggaagatctcaaatgaatgctatctacgaaacatcagaaaggccacttttattgcttgaaaaaaatcagaagcttgaagccccccatctttctaagtctgctaatgaaagacttctaatactactgaaagtatttacaaagaaatacatgaatatgcttaaatgggtgttcagtgagattcttatgcattatttctaggttctaagcatgtttatgattgttgggggtgggggcagggaattgggtggcttttgtttccaaatcttttccccaatctctcatctgaaggaactgaacaggagtgtgatctagccagtcaatgtgcttgagtaacttgatgaaaaattgaaattgctgccagatgcacatctaattgttggcgctggaagaggagggagggaaatctcagaaagttaatctaaaataattgataatgcatcactgcttgcagctctaaggtcactgaggcagacaatggtgcaaatttctaactgactgcttgtgtaaagaggcaaaatttttccagttgacaatgaggggtcgacctttcacctactgccccaaagctcctgttcttttgctttcatctttcaagtcttacttccactttgctcctgccctctctattttctccattatctgacatttcagcctctttctttttaatgtggaaaaaccacttgcttaaaagtttcctagcagcattcttttttttttttttttttttttgagacaagtcttgctctgtcacccaggctgggctgcagtggcttgatctcagcttactgcaactttgcctcccaggttggagcgattctcctgcctcagcctcccaagtagctgggactacaggacgcaccaccatgcctggctaatttttgtacttttagtagagacggggtttcaccatgtgggtaggttggtctcgaactcctgacctcaggtgatccacctgcctctgcctcccaaaggctgggattgcaggtgtgagccatcatgcccagccctaacagcattcttaaacgaaactcatatcacattattgcagggttgagctgcttgtctggctgagctaaaagcaccccatggcagttgtgccccattcttaataaacaggtagtgacaacttttagctaaggaaccgccataagaagtatttatagtgactgttatggactgaaacatgtctttccttgcaatttatatgtgagatcctaaccctcaacatgatggtattaggaggtggtgcctttggtaggtaattaatcatgagggtggagccctcatgggtgggataagtgcccttatgatgaaacatgagagctgctttctgctctctaccacaggaggctacaataagaagacggccatcgtaaaccaggaaagggcacaccaaaccagggtctgtggtgccttgttcttggacttacccgcctccagaacgtgagaaataaatgtgtgttgtttaagccaccatcaactcaattttgtaataacagcccaactaagacagagactctgaggggactacagtcccaagggaaataaatggggtcaccttagacccatggaagggccagacagaagccatccatctggcctttggcagaaacacgctcagaggctcaaccaatttctctttgcagacaccctccagtctccaagcatttcactaaatcctagggtaatggttctcaatttgtgtgggtgaaaaaactttgccccacagggaacatctgcaatgtctgcaggtatttctgcttgtcacaaccaggaaaggggttggggaggagagatctactggcttctaatgggtaagggcctggaatactactagacaccttacaacacagtgggagtctactgcaacaaattaacagtttaataaaatggagaaaatacctggtttcacaatatttgcaaagctcagggagataatgagataaggctgcagtgaacaaggagacacattactacgtgacccattcatcacgctcattgccctcaaatctctgagagtccaaaaaaaaaaaaaatcctcaagggccaggcatggtggctcacacctgtaataccagcactttgagaggccaggagggcagatcacatgaggcctcaggagttcaagaccagcttggccaaatgatgaaacccatatctactaaaaatacaaaaatttgtcaggcatggtggtgcacatctgtaatcccgcaactcaggaggctgaggcacaagaatcacttgaacccaggaggtggaggttgcagcagctgagatctagccactgaactccagcctgggaaacagagcgagactctgtctcaaaaaaaaaaaaaaaaaaaaaccaaaccaaaatgttaaatattagattccttctgttccagaatagtagactttaaaaaataaattcactttaaaaaataaatccactaaatttattctctaaaggctattcctaaatcagaacactgtttcatagaggttttccctactttataagataaaatccacacctcggaagataatttatgatcaaaaaacaaacaaacaaaacaaaacccagtgtcaaatgcaagactgagatacaaatcatagttgctgtttctgtgtttaaaatgtcttccaggaagacacttttaggtctgctttcccaaaacttaatattgacaaaaaacagcaaagggggatgctcggggcacatatatcatcatccgtgagtacacagggttccagattctaaaattagacaatgaacagaacaagttgatttccaggtggttaaataccagggttttcagatgaaccctgaggcagtggtaagaagaacagatcctccttaaatatagcaaaaggagctgcgcaggtcccagagtacaccaagaaaacaacagcttctattctttctagaccatagcctggacgctgacaaaatgctttcaaaataaaagggagccacaaaatttcaccttactatcaacatcaacaggctataattaacacttaattaacagcattatggtgaaatctgcttattctctcaaaaactgcctgaagctttttttccccattaaattattacatgtcacaagcgggcctggcctacctgttcatttggtttctccacgctttccttctgtaacaatgtaagcaagagtgtggccaggcaaacgtccttggaaagccttaccctttagagatagttttctttcttccgaattctcttcactcccaaccagcagcaatactcaccagggcccctaaacacagccactacttgccccacatcatttcttctgggattctctttgtgggaatttccagtagaaacaaaaccttcccagggactcttgagcagaggtgggaggattgctaagtccttgctaatttccccctctcaaacgcatagttagaaaaagtcaataggaagttgacttgagaaccatttgccaaagtcagtaagctgggacccttctccatggtggcctcctccgtctgccttcaaccatttgtggttttcttgcactttttccagagatagatccaagaaataaaatgaaaactgaacaaaattcaacttagtccatttttcccacctgagagttctatgaaagtgggaaggaagatggccaatgactatccgaaagatgcacctggatgagttattccagagtttaactgccctatttcatttctacaggtggcatctaccacgtgaccaagtcaccatataaaaagctcatgaataatatggacagagccatcaaaaagtctcaggcctggtattatgagggtttccttgattggtggtattgttgacttagaagcattaaatgagtggccgagagtcgtggctcatgcctgtatctcagcattttgggaggccgaggcgggtggatcacctgaggtcaggagttcaagaccgcctgaccaacatggtgaaatcttgtctctactaaaaatacaaaattagctgggtgtggggtacatgcctgtaatccaagctacttgggaggctgaggcaggagaatcacttgaacccggaggcggaggttgcagtgagccaaggtcacgccattgcattccagcctgggcaacaaggcgaaactctgtctcaaaaaaaaaaaaaaaaaaaaagaatcattaaatgtgttgtctgattcatgcaactggttagtagtagcactagggtgagactaagcgttctcctcactcccaatcagtaaaatcttaatagcataactatttagagaaacagaaagatcctaacaaaagagaaaaacaaggtgatattcaacataagggccaaagaagattcttagctgccaaatcactaattaaaaaatggggacttccacaggtgaggggggtaaacatacagcagtaaaaaagacccaaaatgtcttcagtgactacaaacgtattgtaaaggaagaatacatatcaaatttagttaaaatgttttaatatcatgggtattagattaataagaagttgaggtacataaatacttgtaaaatatttccactatacttggtaatatcctagtcatcaatataggaccttgtctagcttagtgtccactgttaagccatactaaagaaaagcacagagaaaatatccagattataagatatagaataaagtggcacttctctaacttaaatgtgcttaggatctgctggggatttgttaaagtgcggattctgcttcattaggtttggggtggggtctaagattctgcctttctaccagcttacaagtgaccccagtgctgtgggtctaaggaccacactcagtggcaaaggataaagaaccaaaaaggaaggaggaaacctactatttaatttctataaatgaatactaaggggcttagttgagggccaataaggaggctacaccacaagccatgtctgcagggtgaatggctttgactgcagaaatagtttggaattaaaacatgaaggaaattttccaggtgggtaagttctagaagagttaactagagaagaatgagaaacttctgccgccagggctcttgaacatacagatttggatgactgcaaagaggacattgggggaaaactacaatagttagaattcctaaaagactccacacgggtatttttttttttttttttttttttttttgagacagagtctgctttgtcgcccaggctggagtgcagtggcgcaatctcggctcactgcaagctccacctccgggttcccggcattctcctgcctcagcctcccgagtagctgggactacaggcgcctgcacgacgcccagctaattttttgtatttttagtagagacggggtttcaccgtgttagccggatggtctcgatctcctaacctcgtgatctgcccgccttggcctcccaaagtgctggcttacaggcgtgagccaccgcgcccggccgggtattttttttaaaccctgcttagtgttcggctaaggagaaaggagggcccagtgacagaggcagatgcacaggggagggaagagggacgaagctgtgacccagtacatttctatctctttacaaaatgaatgcgggtgactctgaccctgagaggctcagttaggaggaactgaggtagggccacgtacgttagctcaaaagtgaagaaccaaaaagaaacaggcattccccaaactcagtgaaatacatcgccctgccctacaccatgttttaccaaataaaccacaaagcacaaatttgagactagctcccaactccacattttattacttgagaggcctgcagttataaaaagccacaaaactgccaactcagatctcacccaaataaatgagtagaactgatataacaggtaaatgactatcatggtctataacaactcaactttgaaatatcaaaagtattgatattaagacatgcttgctcccattttctgctggtattaatttatcctcagaatcttaaagaacaagaaggattccttgtgcaggtagctcatcccagaaccgtagatgcttccagagaaagatcccgaagcagcacattttctaatatcaggggagcacagaggcataatgactcaaaggtaccaaaatttagaaaagactaaaaaataaaagaaaggatggtctgtgtgtggtgataacttccactgaggccagcagacagtagcaactggtccccaattcctataggaaggcaaacaggccctgaatcaacagcacacacttcagtctacttattaggaagtcagccacagattcgcttttccagtaaataaagttttatggcatcaacaggccttaattattacatggcaatttcattcaccaggcctaactctggtctctaccccaaggtgcagctttaccactggtctgcaagcataggctactaaagattttaggaaagataggaaatgatgaggtggccagagatacttcccaagagctaatttccaaaccactgcggacagtgcaattcacatatcgtgtaattcacagagttgttttcctaaccagttgagacgagtgagaatacattttaccaagggatatgggatacaatgagaatgtagtatgtaaccttaaaacggtatccagtatataatcctgcctgtaaggcactcactgctggacccatgcgacactggacagcaggaaggccccagctccacttactggcgtgggacctcgggcacttgatagcctcactgagctgcggtttcacggtaaaacagtgataaaattacctaactcactgtgtgttgtgaggattcaatgagatggtaactgtaaagcacgtggcacagatcctaacaactacaaattacaggaccatcaattcactctatccagtagcaagaagccaccagaaaacaaatggccccgagggggtggcaaaaagaagaactgaaaagggatggaagggacttgacactgagctctgcctctttgcagttttatctaagtgtttgcagagaagagaacctcaaaaaatctgccattaaaacccagacaattacattaatcatgagatatgacaggccttcaataaggatattgccaaattaccactgttttatcactgggtataaaggtacttcctgttttgctttaacttataattttaatcaccgactcattatttaaaatggattgcccttaactaaaagggcattcaaaagcaccctaaagttttataacctgcattattacacttcattagctgaaaggtaaattatgtctaggcagagtagaatcataccatattctaaatatgccatgaaatgtaatttctgagaccgtgaataaacttacatttgattacaatcctttactaaactgtttaagagtttcttatctctaactttctacctgatccattacagtgttttatatataactggtactcattaataaatgtcaattaaaaactgtgtataccaagaaaggatctataagaaaatcatagtactcataaatatagtctaaggtccatatgacttgattaaggagaagtaatttcagccaatcaaagataatggactctgaagtctttgtgacgagatcctcatagttggcagtgttcaaaggggtttgctaactttttgaaagtgttattttcttttgataatatattgtttaaaatcagcactgattgattgattgattgattgattgattaagacagggtcttgctctgtcaccaggctggaatgcagtggtgtgatcacggctcactgcagcctaaacctcccgggctcaacaatcctcccacctcagcctcctgagtagctgggactacaagcacatgccaccatgcctcctaattatttttattttttgtagagatggggtctcagcacgttggctaggctggtctcaactcctgggctcaagtgatcctcttcccaaagtgccaagattataggcacgagccacccccttggcctcagcctatcttttaatgccacaaattaaatatctctactaagaaaataagcaattttaatattgatgacaatggttctcaaatcacaatagtatcctcctccctcccatatattttagtaaaccattcctggagtgagggtgggtttatttcagtaaaccattcctgagtgagtgtggggtggttagtaaactaacccaacccacaaacacatacacagtaatttaaatctccaaaaacaatatagccatcatttgttacacgttaggcactacgtgaacagcgtaatatgcattatttcatttcattctcgccacgatcctgagactgcattatcattcctgtttaaacacaagaaaaccgaggtttagaaaagatgagtaaataaattcctcaagatctcaactagtaaagggacaattaggattcaaaatccatgctattaaccaaaaatttatagacatgctataaaaagcatgggtggaagtactgtcaaatctttcatctaaatagagtccactgaatatacaaagttatttttataaaaggaaacagggtaagctttgtgtttacaaaggtaagagaaattacatactgaaatgccattctgttaaatctaaactaaatcagctaaaacaactttcacttaataggcacttggatatcagaaataccttcacttctagaaaacagcttgcaaagagattgtcattataaaagcacgtttttatctcttattatatgtcctcctataaaaaactaaaatgaaatctcatttccagaagagtctagacagtggtagacacaacaaactggggtgactaatattttgacaaacacaaacagccaaaaggtaaagcgtgaggcctgacatttttgatcccataaaatagaaacccttttagctctcctgccacactgcatgacctggtaggatggggatatttttattcaacagctttccttcggtccttccatccttttttagaaagccaaataaaaaccagaaaaggcatacttataaagtcataagccatatgctataacaggtaataaaagtcctttgacgttagaagccacgaaagaacagaagattaaaaagtaaatcataacagctgcatctcgcctcccagtgtttacattcttagacatccactttttaaaaatattcctctgtagatcaaaacatgctgtactttgagaaggggaaaacaatgacgttaacgttaaatattgtacagtttacatataaacagagctaagtttatgcacatcattctagttggcagaactcatctgaatggctcaaactgagagctataattaagtgtgttaattatctgtgtaccaaaaatctaaaatatatatgttccttattatagagcatagaatacaactggtttaacaatcaaaataatccaaaaagctttttcaagttaaacttgggtgctctgaagctggatgaactaggttcaattactgggggaagtctgtttcttcatcccatccttcccctccccacaacttgtattcctttccctcagtaccttttctctttcaattagtgccacccacaaatactgccagctcattactgacactcaggctttaaaaactgggtggccccataccaagaaccattttaaaattactgccttcaagcattaaaatgctaatccaacagaaagcaaagcttaagagctggagctcctcctcccaaaaacatacatgtatatgggagagaagcacggatgagccacagtttaaaattctagtttgtaacatattcaagagataagcagttggcagaaagctttcaaacacaatgcccattcacagactttatgcactcactttcagccttataaagggaaatactcattctaagaaggatctaagttttaacataatacaggccaacttccatcagaagcagcaattaatatcagtggtaagaaggctagtaagttcaggcagatacaagatttaggggccctaattatcattaagaaagcatttatcttatacccgcatgtctaaggtacaagccaaggtggtcaccaactcatctgactgaaagttctgttgctaaaatctggtatcgctgacctcactaatcaaaacatatatgctcctttgaaggtggtgaaacatccctagtcagtgaatcaccactctcaaaaatctccaaggattataggtaaacatgagccctgccactacaagtcaaagtttgatatccaaagaactggctctggtgttaatgcatgcccaaggtttaatgaggatgaaaaaagaaaaaaaacaaactaacatattttccctttagaacacaactaggacacatggtttttaaatcagatgacttattgatcaattataatatgcttattgatgcagaacaatagcacgtgacctaaggctcagggattcaatccacaactgggataggttataaggaagaacagattgtctcctttaaaatacaatggctctggctgggcgaggtggctcacgcctgtaagcccgaactctgggaggcccaggtgggtggatcacaaggtcaagatatagagaccatcctggcaacatgatgaaaccccgtctctactaaaaatacaaaaattagctgggcacgatggcgtggcctgtggtcccagctactcgggaggctgagacaggagaatcacgtgaacccaggaggtgaggttgcagtgagctgaaatcacgccactgcactccagcctggtgacagagtgagactcgtctaataaataaataaataaataaataaataaataaataaataaataaaatacaatgctgctttccctaacaggctgtatgtagccaaagagaggcctaactgcttatgtgcttgctccaatgacaaagtgcgtgtgtaagaagcacagatatacttgactgtttataaactactcaattaataatttatgacaacgactgcaagtcatacaacatctgagggtacctataataactaagcaagaagctttcactactagaggatggtacggtttgaactctcctggagccctgttctgggcattcagtaggccagcagttcccaaacatgttctacagaacatgagctccagagaaacagtcttgtgaggctgaggcacagtggctcacaactgtgatcttggcactttggaggctgaggtgggcagatcacctgaggtgaggggttcgagaccagcctgaccaacatgtaaaaaccaatctctactaaaaaatacaaaaattagccaggcatggtggggtgtgcctgagtcccagctactcaggaggctgaggcaagaaaattgcttgaacccgaaagtggaggttcagtgagccaaggaaagaaatagagtcttgtgtccaaagacatttaggaaatatctccccctgacatctctcatctcatattagagcttgatattttgtttaaccatgtgtttcctaccttataatctgaaaatatgtagttttcatttcatatctgtgctaactactctaacatctgtaaaatacattttgagaaatactgcattaaaattttccctcaaaaagccttttcccttaactttgctattcacaaagcattctgataaaatattcaacaaaagatacataggcataacaaaagaaacatattttagaatagaaaagttgatttaaaaattaacaacaaaatgtttttttaagaatatcacatttgtgtttttagccctaaatttctaatatggtttgtagttaatagaaaaatactaacatatcaataatttacaatttgccaaaacatttatgtgtcaaaagattctttgcttctctgattttgaaggaaaagaaaatgagagaggcagagacaaaaaaatgattaaaaagtggagagacagcttcttcccctaattattcacagattccatttgaattcaaaaacgattcttcacatttcaggactcatgtatgaaggttgttttatttttacttcatgaattggtggatgaatgttatataaattattactgcacaaataattttaaataatacttgagaatgagacaaaaataatattttaaatttctagaacagcagctatatcattagtctacaccatgaccactaccatgaccaaacacgtgatgagtaagtctaaaatcataaaaacacctaagtgaaaatcgaatacctttattttctaaaacattaagcagaatgtcatattacctttagcctaaatactttcccaatatacagttgaatatcaggaaaatgtaaaatttgaatgctaaatataaatatttagacttgggtagaaattttcctcttattagagggttaaactttgtataatatagaaataattataatgaatcagacaattactttgatccccttcttggtttcaagaggctgtgatgatacacaatattttctaagatatctctatgtgcctcaagtatctatgctagaaatgtggaaatgaaacataaaaggcatcatgtttacagggagtttaaaaaaaaaggtgtcagtgaagggatgaggttaaatgattggatgctaatggaaaccacctccaaatagccagacaggacacacccaacctacccttcctaaaatatccaaggaagtgaaatttggatgctctacagatagatacaggtactgtctttcaagaccttcttgtaaattcctttagaaagatgctcattgcacattacaaattattttgcccagtaactgtggaataagtggttggtgattatacattcacttctatttgtgtccagagtatgactcatagaggcccaatggggataatgaaaaaatcggctctaatatccaaaactgcctgtgtccggggctggtgcaagggttacacaagcctcaaaacacaaataaaagtcacaaactagcaagtaatattcattaggccccatgtggttttgaaagacaattccaaatgctttcttatataaatgtgagatatggttctagatttttacaatgccatgctggaaaatggaaaaattctctctacaaaggaaaacgttagtctggagaaaatgtttacagaggtttgcagcaaataaacttctaaatatagtaccacacttaataaagggtcaaataagctctgggttcttgagcctgaagttttcaaggattttacacagccccaatgaaccatggcagaaccatggcagctggcaaatgccctgaaccattaccatcaaacagctgctgaagcaagtcacattccacaattctgtagcacttcctatcataagtaacagttggtatgtgcccaaatttattttctcactaaagctgaatgaagatcatgtagcagagaaacacttttatgattaaagcagatatacattttcagatgtattttttaaataatggaaaacaatgaaaactttttcaaaattcatgcaaagacaaataaacaccctttttgatataacttaaaactacatagtttctttatagcagagaaaatacaagagaatcagaagcacaataaaatgcaaatatgccatgaaaaacaaagccatgaaaatgcactgaaatgtttgtctcctagcactctgttggaacttgtacataggcttagctgagaaagaagagttatgcctgggtgctgtggctcacacctgtaatcccaacgttttgggagtgcgaggcaggcagatgcttgagctcaggcgtttgagaccagcctggccaacgtggcaaaaccccacctctattttagaagtacaaaacagccatgtgtggtggcgcatgcctgtagtcccagctacttgggggctggggctggaggatcgcttaagcccaggaggttgagctgcagtgaaccgtgattgtgcactgcactccaggctgggtatcaaagtgagaccctgtctcagaaaaaaaataataataaaatgcatatagaataagtctaccatccaaatgagtcatttatgtgcacaaattaaattttttctttttttgtcttattgcaagattaaaaattaattttaaaactacaattcaataagggctttactaaaatgttccttaaaatattattttgacaaaagccggcatcaagaatctcttcttactcctcagagagagttgaaaatacccaattactttataaaatgtcaatacaagggatctcacagatagcaaatctaatagtgtccagtccacacttccctacaaatacatgcgtcataattttttttaccctcttaatctgctgtggctccattagtaagcccctaaaaatcaacctggcatttacattcttgtccatctggaatgtctctgcatcagaggaaaaccctcaccccacccccctccacaaaagatgaacaagtgcacagctggtataaatctgggcacgttgaaggcaaccacttgcatgcatgcatacacaaggctaaatgtttaatccctcaagcacctcttctacccattttcagatgatgctaggaaggatatgatttgcttttttaaaaaattaattatgtacttttattagacaccaaacaattccttattgaaaagatattgcaagaaaaaagcttgaaaacttgccatcaaagctgtctgaagtccaaagtgctatcttttgctgtcacagaagacttggaaccaaataggcagaaagctaaggtcaatcttgtgaaagtatgattggaaacctaaccctagacctctgtcctcttcagagcagcagattcacatatgtgcatttcgcagagatgcaggaattgctgatgttttccatgctgcttccatgaaaaccaacacttgcgggttcactgccagctcatgatgtgaagctaaacttagaaatcaagctgggttctatatgagctacaccacctaagtagctgtgggcaggaatatgactatatagacaactccaattctaactattggtttttaacgagaagagcagaccaataaaattcagctttctaaaacaacacataattgctttggaatgcattttggtaataaatttggctgctgtaactgaggttttgaaggacaactacagggggcactatttacaccattctgggtgtgaaaacaattccatggaatgtgctgtacacagcccaggtgactgccgggtttattgtcattctataccaacttccaaagctctatcccagggaaaaaaagtatccattgtatctctctgatactttcctactttgcatattcctctgtttctttctggcccccttctccactctggtcaactgtcacttatagtgcagttttgtttcttatcaaactttaaatcgaataaaagctagttgagcttccagagagcttactcttcccacaaagaatcctaagttgtagatgattcagatattaaaatttgagcagactagaattttataggtacctcaataaacctgaaattccccaaatccaaaactctggaaagttccctaacataattagctacaaattttcaatcttgaaacttaaatgactgttccataatgcagtttggaaatcatgacaaagccataagtacagacatggataacagaggttgccggtggcattatgttccatcataaactacagaaaaattaaactgttccattatttttagcaagacctctggttattggattgcatgggtgccctgcattccgcttatccaaaaagcaagcagaaagaactaaaatggcagcatagaggctgagctgttgtcctacaacatagcccttgtcattacagaagcactaggcaccctaaggttcattttgttccaacaaccagcaatcattttttccagaaaaactgagatgtgagtttggtttgatttattaatttagttactcaaaatttgaccttagtgactataaatatgctctatcactattcaggggtggcatcctcacttggatctctggccagaattctttgggaagttatcattgatatcttattgcattgacaattaaagacagacagctcatacctcttgagatattactatctaaaatgccatcagaacataaaatgcaaaaaaaaaaaaaaagagagagagcaaatctttatctaaacataagctttacctacacaggtaacactagtgaagcatctgtataatttactcattgcactaaaagttttagccatgaagcattggcaaattttctaatagggtcagattgcaaatatcttgggctttgtggacatgtatagtctctaccccaacaactcaactctgccattgtagctcaaaagcagccagacatacataaagaaatgggtgttccaataagctttccagaaacaggtggcagctggatttgccctagtttgctggctcctggcctactgtaaagccagaagaactataggttggtgcaaagtaattgcagtttttgccattacttttaaaatgccaagacctgtaataacatttgcaccgccgaatacatatttcattgtaaatcaggaataaaaatccaaaagaggctgatcataagacaaaatcagctcaaagtgacaagcctacaaatataaaacacctttccaatggaaggaacaggtaaaactcttacctaacaagtggtctgccagagcgttaacaggcgtgcatttgttttcttacaaaaaagtataatactcttgcgatcatccagaagagaaaactcatttgggaaatttatatcatcatcttcctttaaatgcttttacaacaaagaatgtacagtaactttctaatagaaagataaagggggaaaaatgatgatacagtacctccaacggcaagaaagggaaactgttggtttcaggaaaaaagaaactgaagaaaatgcattgctgaaggccttgtactgtggaggggcatcttagtttgaattcaccattccctaaacacttcccataccatcctattttggtttctttttattcaaattactacatttttggggtttttctttttataccatgttggctttctacagtcttgaattacacaagattctcacagtcctgcattaaggctgtcttggagactactgtccacatttatgacaaaaatactacaacaaaatccacaaaaactgccattatgcatgccacatctcagatcctggtggttaccccctttgaatgccaacgtgaaaatgaacgagcaatccagggagcttgaatttcaaggctattttttaaaagatgccatctgctttcaaaagcaacacagacacagaaatagttctctccttgactagctacattccaaaatattggtcatggtgagtgcatcccattgccaatggcccaggtatctacgtattctggcctttcctcttggtttctgtgatactagtcaagttttatttcatctagaattattcactatcctccagtaattccaaatcacctttaattgccatttaaaaaaagaccctacataagtcttccatcaaacaaacaaacaataactgacttttgaatcaaatttctttttagcaatacccaagcactcttttcttcattgtggaaacctacaatgaatctcagggtactaatccatcctatgaaatctttgggccaatcacttagtaatcagagcttccaaactcatttgtatgaccgttgttagtaaatgaacttcaaatccaaataaaatgaaaatccctatacacaactctgtagttctgccaaatgatgaaaaatggatcatggataaacttcagcagaacacactccaagaatcattccactcagtctgaaagtaagttttattatttccccccatactagatttcctaaataaatttccttttgctttttctgcactgctatggtgtatgttcctttagaaacatcgaaggacactaatggaatgtggcaagaatcagagctaaaaatacagctttttggccaggaacagtgctcatatctgtaatcccagtagtttgggaggtcgaggtgggagaattgcttgaggtcgaagtttgagaccagcctggacaacatggcaagaccccttctccaaaaaaatataaaaagtagctgaacatgatggtgctcatcgtagtccaagctacatgggaggataaggcaggaggtcactcaagtcgaggagtgcgaggctgcagggagccatgatcactttaccacattccagctgggcaacataacaagaccctgtttcaaaaaaagaaaatctatttacctacagagagattttaaaattgtcatgaaaagtatctcaaagcctgacacatacatcattagtctcaatgagaccagaaaaaggagagagaattaaagagggtgacattagcattcctagaaaagggagtaaagcagatcacagtgagggtgcgccacagcataacctctgtgaatcctcgcgcaattacctcttgggttgccgtcgtcaaggtttgattgctcatctatatgcgagcagatcagaatggaccagctgcctagcttgctgttctacaagatgtaccataagacactaatcaactacccttaaagacaacagtgtacatgtatttttaagcggtggttatagaaatgctgtcgatatgtacttagaagtctatcgcacaaactttgtttcttgttaattttcctcaaaggcaagaaatctacttatacttctatttcactccttttgaattatatatccttagctctcgcaagctacactatagcttcaccaattcctattctttttataaatattactcattcattcattcatcatttgagatggggtcttgctatgttgcccaggttgactcaaactcctgggctcaaccatcctctgatcttagccttacgagtagttggggctataggcatgtgccactatgcccagtcaccaattcatattcttttcttagaaaaaatctgcttagacttacctccctcgggaaaacacagttgagctgaaatggaaattagagacaagataatgcctttaaatttttattgacaacaagtagcaaaaactcttactgaatcactatttattgtcatataagcttctttgaaggtactctgtgcatcctactcctggactggtccacataagggccaggaagactttttatcgggccctgtggggaatcgccaacttatctgggtttcctacaaagttgactaatattgcttctgtgagttctctaaaacaaccccatgagcactaatggactttcctaggctcacaggataaagtatccatggagcttttccacctgcctactcaacagctggcctcacagctttggacaacgagaaaactccagttcctactttgcaaaaattggggaggaacaggaaaggctttccacatttctcctctgccacttccgtaaaagaactatgcaggatgtcttcatcagctgaaataacaggaaccaaacagaagccactttaaaaagtaaatctgttgaaaacatggacctatttttattgtaaatggatttaactgaaattttacactagggaataaagctgaaatatataaaaaactatattaccttatgtttaacaaagcatgttttaattgaatctactagaaaatcttaaatgaacaaagtttgatcaagtgttcatgtttttggattacttttccttcacgttcaacttcgacttcttgtttggtcatcatggaacaaccataaaaagaatcatttctgtagaatattcaaaggttttatgaattttcccaaggccctctcttaatcctatatatatatattatatatatatatatatatatatatatattttttttttttttttttgagacagggtctcctctgttgcccaagctggagtgcagtggcacgatctcggctcactgcaatctctgcctcaaggttcaagcaattcttgtgccttagcctcctgagtagctaggattacaggcgtgtgcaccaacctcagctaatttttgtatctttagtagagacggggttttgccatgttgtccagctggtcttgaactcctggcctcaagtgatccacttgcctttgcctcccaaagtgctgggtgacagcgtgagccaccacgcccagccaatcctatactatttttaccatgcattttagagtactaaagtagtcattatctttgatttgtttcttcaacagttgactcatctgctagattttactggtcattgactgcttgtgaaacccagcaatccaccagcattactttcattgacttatgaaatgctgcatctttcacaaaaggtgtatttccacactgaataaaactggatgaggatcactggtattaagtataaagagataataagcaagggcagagtttagaagtgcttattcattagtgaatatttttgtgtcttctgcttccctactaaaaccttataattgcaggactcaaataatgaagatcactctcttgccaccattccatatggtaggattcggtttcatcacccactagcatgccttcatgaaaccatagagccagctgtcgagagcagctcaaaacaaaatgatcacagaattaacacctaaaagcaaatggtataataaaaaacatcattaaaagttactcagccaacataattttccaggaagttagtaaaatcaagttaaaaaaaaaaaaggcatgaaggtcaaagcaaactcacatttacctgattagtgccaaatgtttctactacaggtttgcatgtcaccagaaaaaaggcctgatatgtaggtgttagagcagaatagtatctagctacaggaagattaaaggattaaaatgaactaatactctacttcctaaaacatacagactctacacagtgccagtcaaatggcagccaagtgttatcagcaaggctaaatttggatcactaacctaaaaaccacttaagataaaaagagtgctgaaataagcgcaagccataataaggccaatgagagaatgggtcacgtcaggtgacatggtttccaaaataaaaaaaggccaactaaaatacaaaagaactgggataaattcttgatagctggaatgtttggtggaggcttaaatgagcaccttacaccccacccccaacaaaagggcccttagccattctttatagaattgaatcctgctttaaagaaaccagagcacacatgtcttgcaaggaatgcattaatgatcatacctgggtggccaagcatccagacaggcctggaactaggactgaactctggtggcaataccaaagggcctggtttgaccaatgggtatctcagaagctagtgcagcctgccgctgtggcagactaaaaaagaaaccttttggagccacccctaaaataagcctcggtgatgctggtaagaatgtatgaaaatctagggtagaggtggctttagttcattatctaagaggtctcagctattggcactatcaaactcaaaggcatgaggagtaacacgtcacacagaagaagtccatgccctctagaataaaacttagtaacatggtgagtggtccaggcacacacactgacattccaggctttcatcatactttgaatgaaattcaagcaacttcccatggcctatgaagccctggagaccctagcttactaccccaatcacaccttctaccccatccctgctgctccagatgcccggaacataggatcgttcccagcataggattctgcatctgctgcttctactgggacaccttcaccagcacacagcctcgccccataagtctctcccttacttcactcagatgtttgccagtcactgcctcctttctggctacccttatcaaaaatggcccaccctacccattcttcctatccctttacactatttcattggttatcatttgtttcttcccttggaataataaaaatccacgaacacagaaacctactatctgtctgattcaccacatagtctctgttttccaaaatgtgtctaggcacatagcaaatctcaacaaggaatgagatttggaataaatgaatggaatatacttgttgcattgatacaaatatattttataaagtaatgaaatattaaaataatagcaaataatcatcaataagactaaaataaaccaaaccaaagccaaagggctaatcaaaatttgaatgtttgtgtgctaaatattgtaccaacagcagcttagtaaaccaccctgaacttcctctgtacctgctgaccttaaaattcatgtgaaactaggttctggctgttactaaacaatctaaatgccatcaaaagttctccaaaatcttgtagtggcgctatctcggctcgctgaacccccacctcctgggctcaagcaattctcctgcctcagcctccggagtagctgggacataggcgccccccaccacgcccggctaatttttgtatttttagtagaaacagggtttcacatgttggtcaggctggtctcgaactcctgacctcacgatctgcctgcctcggcctcccaagtgctgggattacaggcgtgagccaccgcacccagcgaatccttctttaaagtaaccgagctcactgaggcaagacagatggtgccttcagtgacccattctctaacaacaatgtttaacacttgtctgcaaaataggaactcatgttcaatatgttttatgtaactatattcaaatattgcaatattgtttatgcaactgaagagaccatcagaacctagaaactagtaatagattctcccaactcaatactcccactatcaccgaatcactctgtgaccatatattcttaagcacggaatacatgccaaagatgaaaatccactaagcagagtcaaaaaagagttatgaaagatgatgaaactgaagacaactaaggccatcagccttgccctgccaaagatggtcactgcagtgcagtacacatggacactgaactcaggacagtccaggttcaaataatcagtgacggcaaggaaacagaagctgctgcaagactgcccggagtgtcttcagaaagcaattagattatggaagactagaccaaggcaatgcaggcctgcagcaccccaaggaaccacagagccattcgaggctgtccttccagccaaccagacatggatggaagatctagacatgcagatgttttttaggtttccgacgcgtttcatgggaggcttagaaacttaactttcacttgaaaagcacaacttatcaacccatcattataacctcaaagttgtttaacaaagctattgttttagtggaatgaggcagataacagggaaggactactcttgtcgttatctctagaaaactttctattatgactccagaaaaacaggtgcatataaaaattagtcataagccaatggaatggagtttccaacttttctgaatttatcggtccattcactgatcacaagtatacattcatcttagtgagacatatcagccattgatcgccttactgccatataaagtatggccgttcaagtcttcaaaatgtagcctcccagtttcactgctctcctgtctggtaagcagtggaggcactaggaatctactcctctcccagaaaggatataggaggttgaaaaaaaaagagcagtaataaagcctagcagtcatgaatgcattttgaaaactttatgactagggttgactatgtcatagatcaggcaattgattaccagtgttcagaaagtattttcaagcagggctaataatcaaacacccacatatgaaagagaaaacttcatttaacaagctaccttttaaagcctttaattattcaataaattatgattttcccctcaaacatgtgtgaattgctgaatggcatcttgcccaatgaatttttcaaaagaaacttcaaaaacaataaaactaaatatgagtgtggtctacttagttctttgataaatttagtatgatacattgttcataaactcctccaccctgcctaattttcctaagagtacttaccactatctgaattaacttgatctgtttagtgcctatttctcccttagaacataagctcagaagtgtggaaacgaagtcttattcctagccctattcccagcaatagtaaagccaaaatagtgaatggctttacaaatatttgaggatcaaatgaatgaacaagacatctataacatacagtctttggacacatatatatgtgaatatgcaacatatatgtaaacatgttgtatataaagatacaaaacagacaaagcattttacacatgtacaacctgattagtatagcatgggagaaaacattaacctggagatagaatatcagggtttttatttttgttttgtttgctaactctaccatgtaacagctgtatcatcttaaccaagttacttacacttatggtcctgagtctatttgtctgtagaaagaacattctgagctttattatctttagggtacttttaactcgaatatttttctcaataaactggactctttggaaggctgaggtgggagatctcttgagcacaagagtttggggtaagctatgatgatgccacagcactccagcctggcatcagagtgagaccctctctctttaaagttcatgtatatatatataacttttggagctgagaactagctagatcctgtcactgtcagtgacggaagaacgttggtagtgtgggctggttgtttgtgattttaaaggttaccctatttttatgggagggagtggtatatgtaaatagagcacattcttggtcctgactgtgtttatcaaggtcagaaggtgttggggaaggatgaggtgatagggcatggcatggctgctgaggagtttatagctgggtcccctttcctgttccaagcacatggtatcagccggctgtccggtggctcagtaggctcactgtgttccaaaattcttcagagcattcggctccaccactcaaggaaaagcaaaatagaaaatgaggagaggaaaaaggagtaggttggaggaagggtgaaattcataggacagttttacagagagccatgaacacagttagttactgatttataattacccagaggccaggagttagaattttagtagtttgttattttgctttccttacagcatggattatgtaaattgttgtatatatgtctcttgaaatatataatacatatttaaacatacatataatatacttaaacatctatatatatgtttaatacatatataaatccatctctttaagatgctcatgccttctgcctggcacagcacacacactggatctctctgtcaaagagtgctgagactcaagagtagagtcaagaattctacagagaaaacattcagcactccccagtcatacttttattttcaagtttttatatataattaatccacaggaactataaaatgcatgtacctagctccttttaaagtttaataaatatatttagccattaatcctgatttatacttacagcttgtaacataatttagcccacatgtagaacttgctttttctatgccaagctaataaatgcaacccagtttcctagaatttaacagtacacatactcatacttcataaaataaatatctgaacaagagactcaacactgttgtatctttcaggcactcaatcttgatatactcttacagccaagaaatctaggaagctggctgagttcaaaaatatttttaataaggaaggaacaaaaaccaaaagcacccctatgttctaagggtgaaggggcgttggtgggatataactcaaaccatgacaaactctgtgtatgagaggcaattacagcttacaattttactttcatatgttatttcatttgatccacaaaacaacattataaacagactggggcaatattactatctccaattttgtgaaccagaaaatcaggtcaaggaagacagttcccaggaggtggcagaatcgggaataaaattcacatctcctcttttcttgtcatgatggttctatactttcatttgatctttcacttataatagtcaacctagtcttgcacaaaacaaatacagaatcaatactatccacacacaatagatatagctaatgaatgagtgacagtagcgtataatttgtctcttagccaagcaaatactatgagtggcaggaaatgacagaccttatcaagacaggaaaaatgatgctggtaaattctttctcttccccctacatggacgtaaaaaaaaaaaaaaaaaaattctaagtcctcttatagaagatgattacaagaaaataatcttgggatcaggaaagcagaactgaaacctaaagcttatcatgctgataaggatattacacaggaagcagtaagttaccactgcttcctgttttaagtatcttatctgtaagacacaaattttttttcaccacagaacctcacatttaggacacttcccaaaatagcatcttctgtcttcagctgtcagctgaagttgtttcataaatagcccagcatatgtactccagagaacggtcacactctaaatgcaaatatagtccagtaataccaattccttttaggctttggtgaagcatgaaacaagcaaaatcaaacagccacagaacttctaaagagaataccgtagaggttgtagctaatgacctatgtaactctagctggactatttctggaaactttgaaacaaaggcattggcagatatatattcctgttttttagtatcagtttataaaggaacataaggtttgttcaggttagttaatatttaaacaattaaaaacaacttttttgcaaagattcattttgggaataggatgtatatatagaaacagctgggttctctgtttgaaacaactcttctggggccttcacagtcaacaagtacagacagccaaactgattataagggaaggtgtttgaaatatacacatgaaactctaaatatatggagaaaacacatacatacacactggtataaaagaagctcactgtaatctgtatgatctagcatgtcaggaattctactgcaagaattatacaacagctgagacaatttcggtgagagagaaagaaaaatcaatgtctgtgtttttaaaagaaaaaaagaaaagattgtgtagaatgggactgtataacttgttagcttgcaagttaaaaaaaaaaagaatgggactgtagagcatacctgggattttattttcttttgcatctcggtccttaacaaaacatgtgtgcttttgtgaactccttcctacaccatcgcctgcccctttacccagagcccctccccatcacatctcccccaggaaggcgaagaaggggttttgccttggttaacgtaaccactccaggagagtagtcttaaggctgattccatgctgtacctagtaaaggttcaaagtacttgttgagtgttgaaagactgtataaatatgatcctcaagcccttttagctattggatagtagctgccctttttcacataaaggtgatagacagtgaggcatggcagaatgccctccttatgatcccagagataattccctgtagtccaacagagaaagccctgttcctaactacagaccaggcagtccaggcagttccagattcccactggacgtccggaaagcacaaagccaagcctcaatgaacttcattaacttgattccccgagacttgagagtccgttatagaagaaagaataaaaatgttgtaaatgtctatactgaatcaaaatcacaaaatactttttaaaaagactactggtagataggttcaaataaatctgttttttaaaatgcaaataactgtcttcaaggaagagggcttaaaaaggctctgatgatcacagtggttccaaggtggtacatacctataaagttctgtctctgaaaaagtaaaacactaacatggggcaaattaaaatggaagaacatggggaaatcgggaagcaaatgtccaactatgtccagtgtggagttggtttgaacactgtactacagaatgttggacaatttgggggaggaaaatgatgtaaaaaaaacaagaaacaaaaaaaatattcaaggtttgggaaagagccacaaaattaattgaagattttaaaataagaatgatgagtaaaacctaaaaatgtttagtattaaaggaaagctgagacctgactcacaaatgtcttcaaacacatgtagagaaacatttcataacaggttggtggtctaggtaataaactatgtttcatccatacaagagtattaaccagcaataaaaagaaatgagctataagccacaaaagatgtggatgaatcttaactgcatattgctaagtaaacgaagccagccgataagaatacatactataatgattccaattttatgacattctggaaaaggcaaaactgagagacaataaacagatcagagattgccaggggttggggagagagaggaagggttgaatagtgaagcacagagcattttttagggccttgatactatactgcatgatactgtaatggtaatacaagtaattaagcatttgtcaaaacccagagaatttatagcacaaacagtaaacttaatgtatgcaaataaaaaaatacacctaggaagtcactgatcccaggatggaatgcagatgtgacaaaataatctaaatgtgttataaattcatgaaaagacttcagtaaaagaggtggagaataaggtgctgaccgaagtaactctggaaatgaggggaacctataagactaaagcaaaagaaacttgacagaagcattgtactctagttgataaagttgtttcccatggggctgagttaacaatcctgaactgctatgtatatgtatgcagtgaaattgaacaaacaattaatggatcaaggatagtaacagccggacttcacactgttgaggtgggaggtgacagataaaaaggaggcgagaatggtccatgtggaaatggattggagttagagacagcaatgtgaactatgcttggcttagtacagatacagatggttacatatagaaatatttatagatatgtgtaacgtatgggttagtacacacatacatttccatgctctgtcagctgagaaggcaaagaagaatgacatctcagtagcaacaaacactgctagttcccagatcttagtttccaatataatgtccatcaggtatctgtgggggattggtttcaggattcctgtgcctaccaaaatccatgatgctcaagtcctttgtataaaatggtgtagtgtttgcatataacctatgcacatcctcggtatactgtaaatcatctttagattacttatgatacataatacaatgtagttgctatgataagtgttataccgtattgtttagggaataatgacaaggaaaaagtctgtatatgtttgtaaagatgcaactatccttttttttttccttgaatagttttgatttgtgcttggtgaatccatgaatgcagaacccaaggttacagagggcagactgtacattctccaataaaaggagcagctccttagagaaactgatgattttagaactggggcaggaaataaacaaggtgatctgtagtatattggagtgtcaaaaagtaagggaatgctcaaaaaaaatacaaaagcaagacccacaatgatgggagtatgtcaaagggacacaggcgccaactgaaagggctaaagctgaacaatttgagcaacaaaataaagtgttactggattatgacctgaagtataaaataagcgccatgagtccatactaatataaatagaattgactaagtaaataagaagcaaatctccttgcagaagaatcgtgtgtgagtgtggggtggttcgggtgggggtgggtagataactgccaatccttaattgtgggttgtgtattgtgactttctgccaaagagcacaatatggaaagggggaaaaggctaaatttatagcagaaaaacctgacaaacactccttcagccaagttatcaggtcaacatcgaccttgagaaatcctgttgataacaggtacacttgataggtgatgaatggcacctatcaaggtgatgaaatggcactgttacaaagtgtaatccttggttgggtgcgtggctcatgcctgcaatcccagcattttgggaggccaaggtgggcagatcacttgaggcaggagttcatggccagtctggccaacatggtgaaaccccgtctctactaaaaatacaaaattagcctggcatggtggcgcacacccataatcccaactactcaggtgctgaggtagggaatcgctggaatccaggaggcagaggctgcagtgagccaagatcacatcactgcactcagcctgggcaacacagtgagactctttgtggtcttcatccccaaaacacattactcagttaatcatgagaaaaacatcagacaaatcccaaatgagggacattctattcctcaaaacttcaaggtcataaaaaacaagaaaaatctgggaaactgatacagcctaaggagacacatatataatgattaaatgccatgtggtatcctggatgagaccctagaacagaaaaacaaggaattaggggaaaactgaggaactctgaataaagtatggactttagttaacaataatgtgtacattagttcattgtgacaaatgtattatactaatgcaagatgttaataaaggcagaaataggtatggggtacatagtaaatctctgtactgtctttgggataattctgtaaatctgtactgtcctgaaataaaaaagtgtattttaaaaatgctattgagttaaaaatgagtgataaacaagcttaggtgactatataaatattcaggtattttgttttccaaaggattttcaaactatttaaagttccttaccacttatagaaccccaaattgtaaactgtatttgatgaattttgttcttcatagaatagttagatgatggaaaatttcttttagaggaaactcgctgataggcttggctctgtgtccccatccaaatctcatcttgtagctcccataattcccatgtgtatgagagggaccctttgggagatgattgaatcatggggcgggtctttcctgtgctgctccatgatagtgaatgagtctcatgtgatctgatagttttaaaaacgggggtttctctgcaaagctctctttttgcctgcttccatccacataagatgtgacttgctcctctttaccttcgccatgattgtgaggcctccccagccaggtggaactgtaagcccaattaaacctctttctatgtaaattgcccagcctcgggtttgtctttatcagcagtgtgaaaatggactaatccctgaccctattattaagtttcagcaaataaatatatgttgtatttgaaacccagaaaagcatagtcagtttaattagaattgtctcatcaattataaaatattttctatttataaatatttttctaagcatttcttagaaaattcatttcctgtcttatttcctcttttagcaaactattagttgcagtaccaaggttatgatttttccatttattcttctgcatatttaaatatgtcatcgtgttttattttaaatttgtttttagaacttaatagtactttacagtatatttcataatttaaatcttctgataaaaatataatttatagcctcatgatttttaaaaaaggcttttgtcaccactactaaaatcagaatgagggaaattctctcacatgtaaatgaaggattaagttagcgataaaggaatttcctcaccataaaagctgttatccactagaaaaagcaacttaaaattgtgagatttcttcttgtgatgtatggatttaacaggaatatgcctgaagattttacttgtaaaatacacagcaataccaaagtaaaagctttttacataagagcagtttcagatagtctttcctcccaaacattaaatagttttctaacagaatttaaaaaaaaaaaactttggaaaagaaaggttagagtatatacattaccacttttgcataatagtcttaaaaagaaactctttacaatacctagtgaaaattactaccatccaaagctgcaacataagctatgttcatgacatccctgttccctccaacacccaatgcccagtacacataggtggccacactgtggccagccccagtcttctctagggcttcccagatgtaccacatactcctaacatcctctctcaatatgtcacctgttccagatctcgactttcatgtaagacaatctctctcaagccatatacatcaacttcaactcttacttccttctcttttataatttgccctattacatcaaaaaatgtgccctgggaaagttggtcctctatagctttctcactcacatggccctcaagaaggaagttctaagaaagcttgaagttttgtctgttttcttcacagttgtaattcaagacttaggagtatgcctggtactcagtagaaattcactaactccttattgtaccacttaacagaatgctctctcatgacaggtctacaaccatttgagtcttcaacgactccctaccaagtcttcatgattggttatgatttcctttaaatttcaggttcagcaattacaacagcttactctgcaatgaatggaaaaatctaagaaaatattcaatacccaccaagtattagcagtagaatgtagttaacaaaaactttattttcctgaataggatatgattctggtctacagataatgaggtgttggtatatttccatattgtgctttaaaatcctatggtccaacattcattcatatttagatacaacaaacagtatctaccaaatgccagactcattccactgagcattcaatctactcagccacgctggtgaaaagagaaatagcctagctcaataccagacacatatcttaaggacacacatcttcaagttttagaaagcagcaaaaatgtgaatcaaccgtgaagggcaataaaactgaagtcttatttaaaataaaatagaactaatttatattacagatcttgtgagttgtgggtttcatacccaaatgtgacaaatgttctgctgtaagtactataaaagttttggatcctaagttttagctcaatacttcaaatgtccaacaatatttaaaaacaattgcacagtagcggacacaccagtttagaatacacattccattactttggtcattacaccagtcagcctcaatgaagtgtggaaacaaaagtcagggaatgcaggggaaaagtctcaaagcattaggttcagttttccagaccaaggtaacatcttagcagagtacctaccaagggctacatggcaaaatggactcatttaaatttaattccttttcctaaaccttatgcatattttagtgaggggctaattagcaacaaagaggaagaaaaaggaggagcaatgggacacatcaggaggaaatctatgaatcacaaactttctaactgacctctttttaaaaatagaggtagcagccggtgcggtggctcatgcctgtaatcccagcactttgggaggccgaggcgggcgaaacacagatcaggagttcaagaccagcctggccaacatggtgaaaccccatctctactaaaaatcaaaaaattagctgggcatggtggcaggtgcctgtaatcccagctacttgggaggctgagcaggagaatcgcttgaacctgggaagcagaggttgcagtgagctaagatcacaccatttactccagcctgggcaacagcatgatattccatgtcaaataaacaaattaattaaattaattaaattaaattaaaatagaggtagctgtgatataatgcttatttttcaaataatttttcattgcttttgatatctgaaacgtcagtaaaaatgctatgctatgacctagatcagtagctacaattaacatcagaagaactatactagtagaataaaagttgatgagctactgttgaagcacaaaaataaatcttgtcaaaacaaagcaaagttcctgtcaatcttcaaaagaatgtttgggggaagggaggaagtgtccaagatttaagatacataggaagttgcaattaatttatccaagtttttatattcagtcataccagattacagtcttgtaattttgatggacttttaatatatctgatattgttaaatctgaattttttaaatattggacaaatgaaatggtttagatactcaaaaaatatccacattattgttcttgtttgaaacttttctaaagccatccttcccttgatccaagactcttccctgaactgttgataaatatgttttcaatgtgtcaagcttttgtgagcaccaacttggataatggagtcatgaaatgaagagtgagcctactctcaatagctcacaatttttagtaggaaggagtgccataaaaccagtaactgaagcaaggacagtggtgttactgcttccatcatccttcatgaaggggtaaattttctgaactaaaaggagagcagggtggttgatacacttgaacccagctaataaaagatttgggcattttctttggtcatgcatttaaaggcattgattttacattgcaaatgcaattttacttactttcgctggaatccattcagaactcctctcagctaagagagttgttcctaaacaacttctgccattattttaaaaataatatttcccatccacaaaaaaggaaaagaaaagaaaaatgctgaagtttccaaagtggtgagtaacagtaaatcctgagttggggtagggagggagccgtggaatagggcctattcatagagaagagacacattaattaaaaatccacctaaaaggagccagtgaattaatcgaattgggtggtatgggtttttgttgtgtacttgataatgcaaagacgctttccatagcccatctaactaatacagcgtggtgggaagcaggctttgaagacacaataacattccccagcgagcttcaagctggaggctaaagcaccagccattcatttttccatcttgagacaattcttcacccagttcaaaggcccaagaaacaacaagcctgtacactttctgaaggtcgcctctgtagggacttgtgagggactaaaggctcaggctgcaaaatatttttaaagaccagttttaggaatgtaaccttttttattggactgcagtttccactcccttgccctcctcctacccctaaatacacacacacacacacacacacacacacacacacacacacacgtttgggaaaagggagttttaattatactcttggtaacttccagggtactctacaaatggaaataaatatttttagaaattaatttattacctattcttttaaaaatgtaatattaatattccttacctaaccagaaggaatgggattcgctttgaaaggaagttattgtttagctgtggttcaagagtatgctggaattgggaaggggggcagagggagctagtaagggtgggttaggggggggactggagctgccaagatcacaatataaataccaccacgttcaactttcagtctctcctcttggctcccctccatgacatattttatacagtgtcttgttttgttttgttctgtaactcaggaacatttacggtatttgagattctggtaaaagcaaaatgtaaatagtagctgatggagagctgggtgaagagttaactaaagtactgcctttgctttgagtaggatgtggcaaccatttgcatttgctttccaataatcagcaactttgtgttacccaaatctagatttatgtcaggcagcgaaagccctttcaaaccatttcaaagtctctgactccatttaggcccttgtctccacctccccagacaaaatgcccagcgccctgcaccagttctcatgtggctcagttgttgtgtaagtggggacaagcagtaagtcattggtgaagagacagtgggaagatatccctggctctgcgttcccttccagtaccatatttgctttcaagtcctatgtgagccacctgagactgttacaaagtgtaatccttggttgggtgctgtggctcatgcctggaatcccagcatttgggaggccaaggtgggcagatcacttgaggtcaggagttcatggccagcttggccacatggtgaaaccccgtctctactaaaaatacaaaaattagcctggcatggtggcgcacaccataatcccagctactcaggtgctaaggtaggagaatcgctggaatccaggaggtggagctgcagcgagccaagatcacaccactgcatgccagcctgggcaacacagtgagactgttcccaaaacaaaacaaaacaaagtgtaatcctctaacctagttcatagtagacatctagacaaatagtatattttcaccatccaccaatggcactaaaaatagagacaaccgcatctatactagaaacctcaatagtcatttttcaatgttttacttaggggtgagctttcagccttactcaactaataagaggtattcttaaggagatctaactcttaaaaagatgccatcaagactgaatctgcacttggcccacaaagcatgtaatataaaaatatgtgtttctcctttacaacctgaataatagaagtacattatgtattttctgaaatcatttcctgcccctacatttaggtagtgcccattattctacttcataacactctgcccttcctcttcctcatgccacatttgcagtagcatatttctttatttacttgtttatttttgccccctgtaaagtgccacaaagcagggacacacgtatttcagtctccactgcctggctcacagagaaaaactcaatgaatgttatttaagggaatataagtgtttgtgtttttccaaaaaaagtagtatgaaggaaatcctgatatttcacccaaaggtagaagtgttcactataaacatctaagaataattttattcaaatgttcaacatgcagttgataaacatttactaatgacaacaaaataactgcatttagatactatggtatcacagtaagtcaaaaaatacagattttctaatagtatctctattttaccccttgatgctgggtgtggctatgtgacttgctttaggcaatgggatagtagcaaatggatataagcagaggcttgaaaagtatttatgcactcattgcttccctgctcttgctgctggaacctgttcaataccacgtgaggactgggtcagtctgctggggacacgtggaccagtaatagcaagcaccaactgacagccagcatcatccactagatatgtgaggaagagcatccagacaactagcccccagtcaatcctccaactgactgaaccactgcattcaccctgatgaacaagcagaagaactgcccagctgaactcaacctaaattaccaacacacagaattgtgactagtaaatgattgatgttttaaagcactttatttggttgtggtttgttacatattgaagctaaatgatatatacacctgagaaactagatagcttcatatataaaactctttaacagtttttaaaaatttccttcatatggatgaatttcattcctccttactttaatctggaagaaactaacactactgctattactatactcttattggtaagtcaccaaaaaaacgatcaaaactgacgattctaattcaaatgtttttttttaatttttttatttttattttattttttatttttagatagagtttcgctcttgtctttcaggctagagtgcaagggtgtgatcttggccactgcaatctctgcctgtcaggttcaagtgattctcccgcctgagcctcccgagtagcgggattacaggcgcctgccaccacgtgcagctaatttttgtatttttagtagagacgggtttcgccatgatggccaggctggtctcgaactcctgacctcaggtgatccacccacctcgcctcccaaagtgctgggattacaggcatgagccaccatgcccagcctctaattcaaatttatctgttaccacattctcgaaagtttctattttgtagcaagagctaccccattctatcatcctcttcctggaccacaattagcaagaatagcagggtaccagtcataaatgtttttaccactagagaagctcctctttgcttcaaggtagaaattatctcagcaatacacactttcttaggagacagggtagattctccttattccattcctgtccagtgttaataactttggaaaaataagtgacaggacatcactagtgtaaataaatttcattaattagttgtatgtagtttatgtataaaataaattgctcccagaatttgaaatgttgaaagactattccaataaaagcattaattcttttgagcactgaaaaatatgagacattggtatccagaaagtcttcaaaagatccttaaccttaatacttaatcccattataccatattaagaactagttattcactcgtcttgggggaatgaatgcctaagtaccatgaaagtgaacaggaaaagaaaataaagtataaagatttaaattggtggtgtttaaaaacttaagacacttttctggccaggtgtggtgctcacacctgtaatcccagtactttgggaggctgaggcgggtggatcacttgaggtcagagtctgagaccagtttggccaacatggtgaaaccctgtctctactaaaaatacaaaaatagccaggtgtggtggcgcacgcctgtaatcccaactactcaggaggatgaggctggagatggcttgaacctgggaggcgaaggttgcagtgagccaagattgtgtcactgcactccagctgggtgacagagtgagactccgtctcaaaaagcaaacaaaaataaacaaataaataaaaagacacatttcttaatttgaacatttccaacttgaaaaaccagatcattttttaaccttgcttttcccctttcactgttatgctagattaatcactagaaacttttcttttttttattatatactttaagttttagggtacatgtgcacaatgtgcaggttagttacatatgtataatgtgccatgctggtgcgctgcacccattaactcgtcatttagcattaggtatatctccaatgctatccctcccccctccccctaccccacaacagtccccagagtgtgatgttcccctcctgcgtccatgtgatctcattgttcaattcccacctatgagtgagaacatgcggtgttggttttttgtccttgcgatagtttgctgagaatgatgatttccaatctcatccatgtcctacaaaggacatgcactcgtccttttttatggctgcatcgtattccatggtgtatatgaccacattttcttaatccagtctatcgttgttggacatttgggttggttccaagtctttctatcgtgaatagtgccgcagtaaacatacgtgtgcgtgtgtctttatagcagcatgattatagtcctttgggtatatacccagtaatgggacggctgggtcaaatggtatttgatcatagaaactttgtgaacctgaggattgaaaagagacgtggaaagtagtgtgtcctttttttccctttaaaagtaacaacaacaacaacaaaagagaacagtaagtctgtgatacaaggttattatctgctgtgcccctttaagtgctgaaatttgggatctgagcatattcttccataaagacttggagcagttgggcatttaaccaactttttattacaaagcttcaaaatttatagcagtctatctctggaaagataaacaaaacccagcagtgatggtggcctatgagaaactgggacaaaggtgggaggaagccttatttttcactctctaccttaaaaaaaaaaaaacaaaacaacaacaacaaaaaaaaaccaaaaaaaattggaaacttacagcatgtacatgtatccctatacaaaaatacagagaaaaaaatagtgtgaagagacccagcaagctattataaaattggtagtctaaaaaaaaaaaaaaaaacttttaaaacatgtttctgtaagagactaccaaaacttaaaaataaacgtgactgcatatcatcaaaacagagggagaaaaatctcaaaagaattatacttgcagccagaagcaagcaaggaaccacagttcaaagtgttggaccttttctcattaaaaataaaaaccacccacccaaaggaaaaaaaagaaaaaagtccttgaataacaagctaagatagcaagaaaagactttaaaatttattttgtagcccccactttccccccagtttcctaacactgaccaccccataacaagtccacattcaacccctcttcatttaacagtggatgcctcttcttctggttgctttcactgggactaaagatccaaagcaaagatatctttttcctgctttttgtcaatattatgtttgcaagcttaatatccaaaaatgggccattctccaaatgagagttccttcctgattatttagtatgctgatggtattgtcagacaggaagcatggttagaaagattcagaaaaatacaaacctttaagctagatgggcacttttgcccttaggtttatgaaaaatgccaacttttgtgaactacacaatcggaatcttgatttggtttcccggataacttatgtcataagaaatttggtaactcctttggtgatctcctctcagtacatttttccctccatttccatgaatctaccttcatcccctttcaataaaaggtgtactattggaacatgataggtgctcaatagagcttactgagtaaaagaaggggaggggaagaacagaaaaaatggcttagggcctatttgacaaaagcagataatttatgttagggttgagaaagggtggtgggcttgaatagtattaaagacaattaaagatcttctgatcttctgattgtcccacaacccctaaaactcaagggtaaacataattatttttcatatccatagagccctccaataatttttaagtgaatagggacatgatgattggagaagattagataaattatagttgctacttagcaattactcaatattccagtggcctttaactaactgctaaatgtttataaagtcttttattattttgctagctcacttagatcatatccttcctaaaagtaaaaatcatgctttctgtgcaaaacataatttgtttgccacattacatatattcaaaaaaaaaaacgtcctttgatcatttcaacaaacgtgagaaaacttctcaagattaagtgatattgttcagcatatgacctaaatatgtcagggaggatcagagaacatgcattaaagtattctttggtcaaaataaaagtggagtgcaaggatacatatgtaatatgcaatatttataaaacttgggatgtaaaaaggaatacaatgaatgcaatccaactcagcttactcaataaaacattcctggtaagtaataaaaccacaaaatctctactctgctttaagaaaactgcaactagaatcatagttgacccatgtattcaactctactgccattatcaatggaaaatacagaaaaagggtcaaaagccttttcaacataaatacatctttttcaaagctctattattcaaagatcactggctcctgaataagcacaaataacatttatccaaccaaatttatttcaacaaatagattatagcgagcctgctgcaagaatactattaaaatggaaagtgttccttttatcatacatgacagtccttatacttgtccaatccatcttctccctttttgtgaattaagaatgggagaggtactccatttccaaagtataagacaaaaatagaagcaaatagatgatacttactaacctatctcttaaaaagctttacaataaatttttgtaactatgtcatattagtttgaaattagtatgaattattatatcatactaacgttaaaatgtaattttaagttaaaattcaatatgattacctttctgaacatgtttcaataacattttaaagacagctctcaaagtctgctgcatagcttggactaataaggtaacgaaggaataaatcagttacataattataaatgtggtagaggcggatctattattttacatgcaaaaaaatactagtatgaaaaaaagttacaggatctttatgtgaaactggcttcaagcatgattcacaagaagctattttccttgaatacaatttccataactttgtaacatgaggaaataattgaggaaatggctttctttaaaacaaaacaaaacttaaaactgtgaaatgttccaatatactaaattaccaacccatcaaaataaaaggaacctttatatactattcagctaagacacatatctgattatagtgagaggattggaaaagcatagtccgtggagtttcttaagaggcaacagactattttaatgacttgtgaaatccacatgagggacaaaaaaggtcggagcttctgaatatattggcaactcaacagtcaagataacacgggttggaaaagcagtgttggctcaactaactaatcaaaaaccctaaagcacaaaaaattggacaacactaattttgccagcaagagaaatattgagttgtttcatacacctaagagaaaaaataaagctaaagaaaaaattgtggaaggcctcctatagtccccagttggcttctcaatttccttaccattcacttaaatggctgtctcactgaagaacactgatggtacaaatggacacattatccacaaacacaccacccctgaaaaagaggtgatttccaacaggatgcattgttaatttccacagtgtgcactggttaaagcttactctatagtgtggggaggggtgggtgtttctgagagctgaccttaggatgtaggaactagcaggtgccttgcattcccacacaattttatttttaaaaaggcggaaggaagaggagcataattcagtctagagatggttccaaaacttaggctggtcgatcaggagggtttgtcttagggtttgttaaaactcgaaaatgccccttgaagcaagaaaagttaatgtcaggcctgaatcaaacaatgttttccttccaggcccagtctgtccataaagaatgtctgatccaaaggctagaaatggacagaacaggctatttcatgctttatcatgaccctgtcaacagcttcttcggaaagaatcctcattgcaactgaccattaaagagtatcagtcattttctccacaacattcctatgtttagagctgcaaaggagttagaataatttagaacaaaatcctcaagttactgatgaagaaataggtccagagaaataagtgacttgcccaaggtcactctgctagtgaagggcacaggctgtgttggagcccaaatctctggctcccaagaactgctttttccattgcatcatttaagatagcacaaagctatttcctggaattgtgatttaaaaaaaaaaaaaaggtggcatgccctttggatcccaagtccttcctgtagggcaatgctggagatagtatttattgagggggaactcagagaaatgactcaatatatgcaacattttatggatttatttttactataaaaagatacctaaacaattgcaacattaagcaaattattagctgctcaaacttttctggaacaacagagaaactctctccactgctcagtagcagttttgggtcataacatttgcacctgcttggtacgtttccacctggatgtttcacttggcccctcagaaaaagcgctgccctgggatcttatgattcagtgatgaagagggatgttggctggtgagaaatgcttatttgagagggaaggaggaggaggagaaatactcccatagcacttttctttcttattttccttattttagaaaggccaaatctgaacaattttccatcccatgtagtaatatatctcacataattttggttactggagggtacacaaacaaatctagcaagctttcaaaatcgatgtgcccagcctaaattgacgggctgtcactggactgtcaatgatggaaaaatgaatctgtgtctgagaacgccacagcatttcctccaagctttaaggaacacactacccaaacccttgtcacaccgggttctcaggatctgcaagctgagtcccgtctttcatttcgctgtgagctccctcacagcccaggaggatgcgttttcccactcttacctagctctggtgctttgcagtaaagtgtatggagcctagggcactttcaagcaaaggaattccccctccccccatgacccaaaacgatggcatccgcagcactcgcaggtcctctccctcccttggttgaggggggcgggcaggaatcgcgggccaaccccacctggccccaggcccgcagccacgtgcgggactccctcctgctcgcggatctcgagaccggaagacgaggaacgtggcctcgtagtaaaccgtagtaaagagagaagggaaacaaaatggggctcgcacatggttacggcctggatttttctcaattaaaaataagagcaagtgtgtgtttccggccccgtccgtgggctggttggactttttcattcttaggattctgatccaaatgcaagaaacagctgagggcacaacgtcctcagtcggcgggcgcggtgcagagggggcctgcggctcgcctgcgggcacccgcgggaaagaggtgccaggcagggtggcagaaagcggcccagggagcccgcccgccaccaccgccaggggacccgcggagagccccgccccgcgcccgccgcggtcagccgtttcacatgctgattggctgtggtgggggccaatcagcgcccaaccgccccgccgcccgggacccagagccgcgcggctgtgcccgagggcggggcctcgcccgccagcgcgaccacgcggcccgggaaggggccccaccgccctggatgacccgagacgggcgggggcggagacccgagggcggtctggctgcagattcccccaccccgggcgaaagggggctcggaaagggaggagaaggaatgcaggaagcggaggtgacccggaaaagggaaagtgccagggccagagggtttgcgccagccaaaaaggccacagggctggggaaaggggagggaggggaggcaccttggaggtacggaatccttgacatcacaaaaaaggaaactgaatgaaaaagaaatgaaagagtctttttctgttttttttctttttcttttttcttttaaagggggagggcataaaaagaatgacaaaaacaaaaaaactgaacccaaaaggcatggctggggtctgtgtcttttcagctgcagtttcaaaactaaaagataaatttgatgccaggtaaaggtggcagggctgtatgaccgagtctgagaggctctttttgccctgcttcttgggctctcaatttactctctcagagagtgggccacaagtactgcgaaattctgaaaaggagcaaaagaaaaaaaggatatgtcaggaacatgaaataagaggtggaaacaaagggatggcaggggatagtactagaaacgagcaagccagaactaagaggctatgcaagagaaagggcaggcagaaaaggtcactggctacaggtaaagcagacaggcttccaacaagtagagctcctgagctcagtgcttcacaatgttctcctcttaacagacaatgaaaaattttaaacaagccgagatgtttcaacagagccacgcctcatcatacctctattcctttcaccgagtctcaggttttacctgagaaatgagaaaagaagcaaagacagcaattgctgaggaagtgaggaaaataatgtttgcacacacatcggagcagaagctgtttgccactcacaggtctgacttctgtctgtttcagatagctataaataacatctttggactcaacagggcacaggcaagcaagcagaattgaggatgtaaatggccaggtagcatttggtgcctcactttaaacaccaacacaaacatctcaaatacgcatttagaattttcctggcactgtgcaaagcatggtcgattgttactccagaattattagaaaaggattatatgattattccagaatattttattttcccaaagaaggttaaggatagaatttgtagagtttttgtttttttaatgcatccaacacataggagaattttattttaaagcccttttaaaaatgaaaattctagttggtcatcaattctcttcagagcaaacatcatttatttactctataaaaagaaacctaaacaaattaagatgacaagtaagaaaaacttattctcttatctcctttaaaaccaaaattttagttctgctgggctggttttcttcaaattctcattttttaccaatgaggcactttataatacaaatgcttaaagtgttgagggattctgactccaaaaacatcatttgatataacaagatttgtactactgatgttgatatacacaattaaattttcttctagtgaatgatgaaaataaatgttgaagtaaatactgatcaaataaatgcttttgtaacatatcacccaaaatcttcatttgagtgttcatatacctttttcttgttctataaatagagaattatatggatcaaatattggaaacagaattaagaagactatgaacacatataaataaatacctgtcaataggaaaccagggcacagattaatttcttatgaatggacaaaattaagaaaaatcagtgcttttaaaagctcattctgtggagcatagataaaattcacagataatcagtttgtcagagtaaagtgtttccaaatgctggaaacttctgcattgccaatcatcacattatttgcaaactgtactctcttctacccacaattatgaccaccagaaaacggatcaacagaacgaagggcaggctaatttcctattacaaatgtttttcatttttaataggcattagccacagaagacctaaagccaactttcagcatttactgtggtgtctacttttaacttaaaggcacacagcaaataaccctaaaagtggagggtatacagtttagcccttctctcaatgcaaaacaaaacaaattaaggcatgttcctgacttagtatgcattcttctcaaaaataaaagtaattttacagaagatatatagtagcccccaaatgatatctgtaatgtctagtgcaagaagagataactataaggcagacatcctaggatgaactcccataactcttaaaatgggtcccagacacatacagagtttcctgcatatcctgtacaagagaggccaggccctgggatggtgggtcggtgtgtgaataatatttcacaaatcctggtacatgaacaaaagggaacgtcacccataattactttcttgagagatcacaaaatagataggtacttctctctaatacatatttctaaaaagctcttactcctgatctttttagggcaggatgaatagaaatcatgcttcccgctgctgtttatgttgccctagtattatgaaatcacagaacaaaagtacaagaacaacttgataagatcacccttaagggctcccagaaactattaagatagtttaagaaaggaagggtttagcccctgtgttaacaaatattttttgtagaactgtcccttccagggctgacctaaatatatagtgaaaagaaaacttcaacaaacaaatcaagcttcttacggagaactctacaaaacgcagaactggcataggatatatgttttaaaaatactgcagtaactattcacttgggaattctcaaacgaaaaagccctcctgtggctgctcctacatgtttgtttactctctgccagatgtcagtgtggggtgagcatcttgtgtgccctgagaatgtaagtgcttctccctgaggaagcagtgggaaagaacaggaaggggcagaggcgaagaacagaattcaggacaaggttaaaagcagttttgtcttctgactttgtcaccatgaaacgcacctgctggatgtccagttgagctactgacggtcctctggctgcttctggaaactgatgctggcatagcgcttaaatcctcacttgagcggcgggtggagctgctctcaccgctgcccaggggttgtgagggggtgggggtgggggaggctgcggttcaggggtgcactcctgagggcactgtttaagtccttgaccaaatccaggtctatgtagttaagaccattctccaaacccccagcagcccacacagtttggctggctccttgggggctcccccaagctccccaggcctcagccacacttctcaaaggaagcagagctgtggcgtttcacatcctcgctgctgctgctgctaccgccccgccccctactgctgcccccgctccaaagggcactgtgttgcccacccgggtggcactggtgttgaggagaaagtctcggagctatgcctccgccggcacccttgtgggtctgcacgatcactttggcactctggttgcggttaggactgaggttcacccgggtgaaggcgctcatcccccaggtccttgtgggccccccagcagggacgagtgggcagccagctctgctgcccctgaggcccagtcggggaagcagaggctgctgaggatgaggaggcagcagccatggtggcctgggcaggctcacctcctctgcagcaatgcctgttcgcatgtcagcatagcttacagggcagctggcgaggtgtccacgtagctctgacggggacaactcatctgcatggtcatgtatcaccccggctgctgggcactgcccgggtaggcctgcaaatgctagcagccccgggagggcagggcccagtctgcccatctcgaccccagtgctctcctgccaggctgccctccggccggccccaggtccatcttcatgtactcctcagtgccagtctcttcctctctgggagctggtggagctgggatggacacctgacagaaggtgagctgtggaaagccaccgggccagacaatagccagactgatcactcccaaattcaatattgacatattcccccgggctcttgggctcggagggtgcagcaagggctgctgctgctgctgctgctctcgggcccgaggtaaggtgctgccttgggatcccccagggacagcctcgtgggccgggccaggcggctattggtctgagcgctgtgtccacctttcgaggcagatggggctgcagaacctgatggtggggatgtggaagctgggctccagcctagccccgcagtatcccccacccaggctgtcgctgctggtggaagagaagaatcatctgctgttgcagcatagagaaggcgaccagagctagtggaaaggcggagtgctgatgccgggcaccctcctccggctccccggggcgctgggtgtgcttaaaggatctggcaatgagtagtaggagaggactggcttgtgctgggggtcctcagggccgtagtagcatcggaggggctgctggtgttggagtcccccactggtgacatgttcatgtagtcacctgtcaaggtaagagcttaccaccgctgctctccactgggggtttggggtgaggcaagacatggagtggtggccccctaccccgtttgtccacagctttccatagctggtcccggaagggacgcgttgctgctgctgctgctgctgctggggccacctccaatgtcaggagagcagccaccctgggggacatcatcatgtagccattggggtccactctctggggatggcgtctgatgggttgatgatctgctgtggggcagatacgctcttggggctcatgggcatatagtctccactccctttcggccactgggcactggggccacccctggggacatgggcatgtagccatcatcgtgtggagggtggagctgtctgggcggtggtgccccccccgacgctccaaggggtgcattccagaccctcctctgggtaggagcgggtgggcacgaaggcggagtgcctgtgtcccggagtcggcctccactgccacctcctggtgggtaggcaggcatcatctctgtgtactcctcatggaagccactgaggactgggacggggtcttctggtgggtaatggtaggggatgtgccgccgagtgagttctctttcggaaccgattatccagatctgcagcactggctgcttcatcccagccaaggctggactcgtgcccaagcctgttcctggggtgcagcggtggccattgccccccgagacaaaatgtagtgaccgttgggggcggtcagggtggagggccccttgccaccatgcagatatagttgcttagctcctcctcaccgcgggctggtggggtgtggcccagggatccggagtgacactgcggaaggaactccggaaatcgcagggactggagccatactcatcgaggagatgaaaccgccatcgctgggggaaccagacaccgaagcactagatcgccgtggaagagacaatccgaggtggagccatggccactggtgctactggacgacagactgaccggctggtggccgaaggcgagcagcgggaagccggcatggggatggagcggctgtggttgagggggggtgcagccgggcgctgccccgatgccggtgggcgtgggttctgttggtgctgggctcacagggctgccgtccaccgaggctgggcgggacatggtgccttcgccgtcactggagcgcggacacggaaggagcctggcttcccgcccaccatgctggccggggaggtggcggtatgctctcagtgcgtgatcggcgggtcagccccacctggctgggcgggggattgttgagtggtgccggcgcagggggacgctgatggggttagagcagttggacgaggactggctcttctgcgagggcggaactcatcactcatggcccgcatggcctccaggatggtctcgtgcatttctgggccaccacagagtcatccacctgcatccagaactccccgggccccgtcacggcgaacggcccacctcgatgaagaagaagttttccgagtggccacagcgcctgatgttcatagctgcagcaccacggccgctgcctccgagttcagcttcacgaagctgatggtcttgctgtcaggcaaaggcggtagataccaatcaggttctttgtctgacccaggcccttgggcttaggatcacttgccagacctctttgaatgcgggtcctgggggcacgtcaccgtagctcaatcctccccagcctcaccaaggccggagctgccgctgcagctgcccccaccacctcccgcccgagggccgcagctccgtcgtggtggcccttagcacggttgtgcagctgtaggagagctggtaccagctgtcttgctcggcctcgctgtccgccgcgatggcaaagtgctcgtcccggtgtagagagccaccaggtgcttgttcttggagtcagcccgcttgttgatgttgaagcactctcaagggggatcgagcgtttgggggcgctcgacttgtgccgccacttcttctcgtttcgtagtactcgaggcgcgccgggcccccagcctcgctggccgcgcgcagtacgaagaacgtttgtgcatgctcttgggtttgcgcaggtagcccaccttgcgcacgtccgagaagcctcgctctccggagggctcgccatgctgccaccgccaccaccaacgctgagcagagggagctccgaaaaacaaccgggtggggggcggaggctcctcgccgcggcccggcacatgcaaaagggctggaggcagcagaaaccccgactctgaaatccacgccgccccccgcgccggggagggcagctgaaggaggacgcagctgctgagcccaggagagagcccgaccggagttttcggcgcttcacgcccggcggggaggcagtgcgtccggggtgagggcagccccgatcctccggagccaagtctcctctcagccgccgccgccaccaggaaggagcgaagatgcatctctcgcgccccggctggagtccggcacagggaggcgacagtcgggggtccctgcggtgcccctcaggagcgcgcgcgcgcgcgcgccttccctcctgagttcccctctggaagcagcgattccgaggcaaattaaatatccttgggcagggggaggcgggttgccaagtcccaacgttgcacgggttctccctcctccttcgcctcctcccaccccccaaccgtcccagccgccaccagcccccaaataccagctcagtcgcagagaccgcggcgctgcggctgttgctgttgctgctgcgctgctgctgctgctgccgccgcccgcgggcgcgtcctctgcagcccccatccgggccctctcggcgggtggagaaagtggcttttccatgcgaaacgataccgggcagccactgcagtggggaccggccggagggacagactcatccctgcccctcgctccaggcggctggggaggggggaggggacaagggcgagaggggatgggggaggtttgggaagggttcggggaagacgctgttcctcgggaggcgctgccgctgcagttacttctcccctcctccctcctcctcctctcctcggagagttgccgagagccccaaccaaaacaagcggcggcgtctggctctgcgcgcggccccctccgaccgcgccgccgtctcactcggaggagaaaaacacgtgacggagcctcgcgctcggcagccgggcagccgccgccgggaggctcccgcccgggtctctacattccggccgagcccgccccgcgcccgcccctctccgccccccagccgtgctgcagcggcgcccggccgaccccggcgcagcgctaggacagcgcccctgcgcggccgccagctccggcgcagccctccctacacgcgcgccaaccggggcgcccccggcccgcaggaatccccgcggcgggccaggcgggggtgtttgggtggctacccgaaagcacgaggggagtctgggaaaacgggaggggcgagctcgggaagacgcaggagtgagggtggggggccacgggggggcactgcggctcagagccccgagtgggaggccggggggaggcgggggcgccggagctgggctgcctcttactatcaggtaagactgacccacgggagggaggtttctagtcaaggctgtttcccccaggaatttaaaagctagatttcggcttcagggcgataggccatggtgaggggatctgtatttttaaggtttttctaaaggacttctgggccagccttccaccttgggatccccagatttgcgccgtgaggtacctggaaggaacagagggacgcccaagggcagtgactgggggcagttaggtcactacaaaaggagaacagggatccccaggaagtgtctcacgtccggcgctgtggattagttgctgatcaagtagggagaaaatgtaaatatcaccttttctcctgctccccttgccatccgtgtgacggggggactcacacctaaggctgagggcatgggggaggggaaatgaaggtcccttatcatattccgaagtctatccgtgactttaaaaagctgttagggaccttcgagggttcataaggccaaaaccctactgtgcaaatattggctgaaatgtttgtttcacaacagctcccacacccattgaaccaccctataagtttttaaccttgaccacaaggataacgggagaaaacaaggatggtgccagctcaactgtacaggaaaatggttacttcatgagtgaccagatcagcagcctgggtctacttgaagcgcccctttcagggtcaccttgcggtatcgtctccccacaaacaaacgctccccagagtttttttattttttaagccgacctataaacagcagtttgtccctgcttgctcgcctggcactaaggacccacagagatgtcactcggttaatgctgtctcattttgatgcctggcccgtttggggttgccgcccctttactacgccggaccctcctcggcctcaggctcccaggcactgcaggatgctggctgggcactcagcagtcaggcgctgggcatgctcagtggctgggacccggcgggccgcgggggagcgcgcctcggccaatgcggctgaggggcggagcgagtttcccggggaggcctgctgattggtgggatggctgtttttcaagccttgcactgcagagggaaggtgggggtagaagggttgagggtaccaagtaggttgcaaagcgtagtaaaaaaagaaaaagaagatgatgatgatgaaggagaaaaaaaccataggcgccattcaggggtgtgcgatacgtaaattagggggattgggcatctgcaaggggctcctccccacccaagcctgggagcctctcgtttctcctctccccttcctgttccggtcgtcatgcagcctcatctaaacctggttaatctataatttgagtacacatgttgattgaaagccctcccttcttttcctctgacagcttggtgatgtgggcacacgtgcccactcagcaaggctattaatagcagatatttggaaatggaagcgaggcggcactcacagtgacgaaattctgggggtatagagtgccttacagggggtagggcagggaggtgcagaataaagagcctgaagttggtggaaaagtgtaactgtgtgcctggttttaccctagacaagaaaaagagagattataaaagggttgtttactagtaacaatgtaatccagataaggccaaagggctttcacaggtttgatgtttagcgctgggatgggggtagtggagtaattaacattttgtagacaacaaatcaaatccatggacatttacttttcaaatggccctgtccctacctccgtcctccaccccccaccccccaaaaaaagctaaataaaggtactgtacctctatgggggaaaatactcttttctggaaggaggggagggttggaaaatttatttgcacgtacctcacaatttcttcataggaaggattttgatcataaaaagctaattatgataataaaccttttaaaaatatatctctcagtgttaaagcatttctgctttaaaaaacacaatttcagttgctaaatatcgataaaaattatgaaataagcctcactgctgtgacaaattatgttcagaccaatgggttcctatggaagataatcactgatcataggatattagtgccattttttctacttgctgagttttactaccaatttaaaggtggttaatatttgttataattatactacagtaaattcattgttctctacaattgttttattaatgggctaactggaaattcatttacatttggttcagtaatatatagaatagaaagagacgcgtttgtgggaactcactgaagtaatgctgagcagtatgggtattattctgtcacctaagctaaattagtcttttggtgtattgtaatgaaatcactgtatgaaaaatttactccccactgaaaattcacggaacagaagaacaagctattacaaaatctgttgctcaatgctgccatctataggagagttagagccgatttgtgtaatatctaaggttcattttaaaagagggctaaaatagtgatttcatcacaacattgcaacagctcgttgatgtcactaatacagtcctaattcaaggagttaagggtttacatgctatggacgactttggggcaataggtctacaactagctttaaaattgagttattggtttatgtatgatctatcaggaaaataatgcaaaatttatagattattacatatatctgtaaagtgcttgagtgggtggatgtaaaactaaacatttcaaaattataaaacactttttgtatcaaaacatagttttccttaagatgtatgggtcataactggaggagctatttaaatactggcgtctcttgaattaattttggcaatttagaacagtgcttgaaggacaattgaatgtggattttctcatttaagatctgtttttattttaagatggctcaatagtaataagcatttgaatgcttacttgcaaggcaatatgaaatagataaaaagacagcttcttacagctttgatggggtaataaagagtacaaaataacaatagttgatgactaaaatgtgtgtgtgtgtgtgtgtgtgtgtggagagagagagagagatgtcaaataacaagtggtatttactttcatgatggatgaaatactacttaatttttacagaagagaggagccttaagcttgaacttgaaatgggctataactagataaatggcaattattttttcccactcaagttttttggaacacctacttgtgttaggactaggctggacactgaggatttagatatcaaagacatgctgcccacaggaaacttacacgaaaatggcagatgaacacaattgcagagcactatgatctcttttgtggaaaaaatagcacagggcaaatgagatcacataacaaccaactgccttctgacataaacattatcagttcagacagtgcaatttgggaatctgaaaggtgcctcttcccttaaaaactttgttttctctgtaattaaaatctttcatctgttttatttaaaaatatataaaataggccaattaaaaggagctgaaaagtcacacttggcttgtaaatcggctagatcagggcttctcaaacccgagatcttgttataatgcaggttctggttaaatgcagaaggtcaagggcagtctgaggcagtcatttttaacatactctaggtgatgctgattctgctgggtaagtagcatagttctaatgctgatgattaattgaaagacaataatttggtgctgtgacatgcaagcaaggcacttatatttagtattatatacatatacagagagaacaacagcaagaaaaattctacttaactgagcttcattgtatttgggcttctctcttttcaatcacaggcatcaaatctttctggtaagctgaagagttattatcaaacagttgtgttagtgttttccaaggtgtgattgaaaatggagtttcttacctcatcccagtcctgctaaaccaaaatctcttagggaaggatgggccccccgcattcacagtttaagcagcattacaggagattattatttacatcaaaatttaagaatcttggcttaaacacaaagaaaaaaatgtaattttattcttccagaattggcaaatgcacaccttaaccagtcaacaaagatcttcacctgtgggctgtttactacagctgggtggagcagcaatgacccaaacctgcatgagtctcccaatatgaattgattttcctttgaagaatataattactggcaatcagctagtgagaatccagttctgctctcatcttgatttcatccctctctcttctagagaactgagggaaaataaatgcaccaagaactaacatgggattttggaagacagtaatgccctcaacagatgatttcaaaacatttgctgtttgaggagcaaataaagatgaaataaacaggtggatgaggttggaagaaaggagggaggtgaaaactccatgccacgtttaattctttcacttcagaaattctactgattgattggtgatttggggagtggtgaaagaatccataactgatatttgtctaaaaaacttggtcctggtccaggcatagtagcttagcttgtaatctccgcaatttgggaggcagaagcagaaagatccttgagcccaggagttcagtttgcagtgagctatgatcatgccaccgcactatagcctgggtgacagagtgagacttgtctctaaaaataaataaaaagacaactagctttttcttttttaattttcttgatttcttaactattatattctcattttcttgtttgataagaatcaggggtctgccagtcaatttttatcttagacaatgccactaatgtttttggtcatttaatccagagaaagaacccccagtgttttgtttgtttgtttgtttgttttgttttgttttgaggcagagtcttattctcaccaggctggagtgcagtggcgccgtctcggctcactgcaacctccacctcccaggttgaagaattcttctgcctcagtctcctgagtagctgggattacaggcatgccctaccacgcccagtaatttttgtatttttagtagatacggagtttcaccatgttggccaggctagtcttgacccctgacctcaggtaatccacccgccttggcctcccaaagtgctgggattataggcgttgccaccacacccaaccactgtttctcatatttgaagagccaagtgttatatctagatagcatatgcttagaaagatttgcagactttacaacaccttttgctggttttgcccccttcttatcttaaatttgtctttttggtgcagtgcactctaaactttctaaatttaaatttattttaaaatctaaaatttgatagcccaaaaatgtcttcacagtaatccctcaacttcattgtttattttttaatgtgaatttc

SEQ ID NO: 5032 - DNA, 57303 bp, Homo sapiens
  misc_feature 6648, 6649, 6650, 6651, 6652, 6653, 6654, 6655, 6656, 6657,6658, 6659, 6660, 6661, 6662, 6663, 6664, 6665, 6666, 6667,6668, 6669, 6670, 6671, 6672, 6673, 6674, 6675, 6676, 6677,6678, 6679, 6680, 6681, 6682, 6683, 6684, 6685, 6686: n = A,T,C or G
  misc_feature 6687, 6688, 6689, 6690, 6691, 6692, 6693, 6694, 6695, 6696,6697, 6698, 6699, 6700, 6701, 6702, 6703, 6704: n = A,T,C or G
ggatgggccctgcagtcattgctcaggattattgtaatgattcaatgagaatgcaagtgatatgcaaaagtagctcacaaactaaagagaaattgcaaagtataattatttgttatggaagccctgttccctggaccaacaacactcgagtgctgattcaaaagtgctgggacgccaactttccccacttcattactttaccttccggcgagggaaatgaatctttctttaccttacagtaaccagaaagaggtcactgtttgagacccataaactcactgcatatttgctattgagaacacataaaagagagggacccagaagttgtaaattcccccttttgaccttggggtttggagattctcacaacagtaataccatttattgggaagcagtataatcacctgcctggggtgaatgctggcctcaacccttagtacttgtgcaatctatctacagacttaacctttcttggttcattgtccccagctgtaaagtggtgataatattaggttggcgcaaaagcaattgaatttttgtcattaaaagtaatggcaaaaaccgcaattgcttttgcatcaaactaataaaacagtaccacctcctagggttgttgagagccttcagtgatgtagcatatgaaaagcactagaaaagtactcggagggcacctggtaagtatttaataaatgatggggccaggcgcagggctcacgcctgtaatcccagcactttgggaggccgaggtgggcggatcatgaggtcagaatttaagaccaccctggccaacatggtgaatccccgtctctactaaaaatacaaaaatggccaggtgcagtgatgggtgcctgtaatcccagctactcaggaggctgaggcaggagattgcttctcgggaggcggaggttgccgtaagctgagatcgcgccactgcactccagcctggcaacacagcaagattccatctcggaaaaaaaaaagatggttatattattatgaagctttgctgtgtgttagccctgtgctaagcagtttatatgggttaatctttacaaagcccttgagttagaactgttaatattcccattttatggatgaggaaactgaggcctggagggattactaacttgctcaaaattgcggaatttgtggtagaaccaagatttgaaccttcatctcttgactttagaatctatgttgtctactactaagttagtgtgtcttgtataccagatggattttcccttctttcctttatatcagggctgtccagacttttggcttccctgggctacactgaagaaggattgtcttgggccacacataaaatacatgaacattaacaacagctgatgagtaagaaaaaagaaatcgcaagtaatctcatgttttaaggaagtttacgaatttgtgttggccacattcaaagccatcctgggccatgcaagtctcaggttggacaagcttgctttatagaaagccgtgagaaagtggtaagatggcgggagtgggagagatgagatgtaaaaggtaaattttagttaacctctagagaaacatcctatgagcacattaacatatatcccaaaagctgatggcttcatgatcaaagataccttgcggacagaccttttccatagtgaattgcattagtggaggggctagagcccaggcccctggaggctaagggagcttgcgatgtggctggcagtttcaaggccagagcatagtgaagtgttctaattcaacacttcttaaaatgaaggctgcttttgccacccacagtcatttgttttctttcttcactcaccattcttttccttaaaaaggttaaaagctgcctttatgatcacagccaggacttgagtgaaaaggcagaattccaccttgaggaccccagagggacagcagttgcccagaagagctggctttttggagtataatgtgctgtttactgtatgaatgcccaagtcaagcgtttgcctgaccggtggctgcccgcccttactgcagcggacgctgagatgttgatttgacatgcaggaagtcgaggcccttcaactgctgcaactaacttgatgcccaccgatggaatgctttgttcctacagtctgcgcgggggaatcgggacttctgttatcactcagccaaaggcgggggtggggccctaaaaaaacaaacgggcttaaggttcttccctaccagtatgacttttcatttgcacgcagccccaggacactgcctacttgctctattctggtactctgattcttaatatcaaggccttttggaaaaatttagctccacagccctgcatctgcacagccctgcatctgcacaccccagcctccattattgaaatctttggtgtgccaaggcataagattagttttttccacctttattttcttgtctaatcttgttgctttttttttttttcgagacagagtctcgctgtgttgcccaggctgcagtgcatggcgtgatctctgctcattgcaacctctgcctccatggttcaagcaattcttttgcttagcctcccaagtagctgggactacaggcgtgcgccaccacgcccagctaatttttgtattttagtagagacaggttttcaccatgttggccaggctggtctcaaactcctgacctcaatgatctgcccgcctcagcctcccaaagtgctaggattataggcatgagccaccatgttcgccccttgtggcttttttacaaacaagaaaactgaagcttaaggggctacgtgacttgccaaggtcaactggctggtcgatggaacccaagtctgtctgctccaggtccagtgctttgcctctgcctaacctcctcctcctattcccccctacttcctctctgtcctttccacagcttcatcctgaactcccctctggtacatccccactccctactgtgtgtggttagcagcattctcaacctctgttgatgttttgggccagataattctttgtcataggggcctgtctgcatttatagatttttttttttttttttgagacggagtttcgctcctgttgcccaggttggaggcaatggcatgatctcccctcaccgcaacctctgcctcctgggttcaagcaattctcctcctcagcctcccaagtagctgggattacaggtgcccaccaccatacccggctcattttttatttttagtagagacgggggtttcaccacattggccatgctggtcttgaactcctgactcaggtgatccgcccacctgggcctcccaaagtgctgggattacaggcgtgtaatcctgatagaattatacacgttatagagtctttagcagcatccctagcttctacccaccagatgcggtaagcaccgccaagcaggacaaccaaaaatgtctccaaacattgctaaatgtcctcgggggacaaaatatccccagttgagatccttattagccttatcctttttcttcaccatgtaccccatgaaggggatctgtgtaccggggagtcccatcacatggagtggaattaaacactttgctgttcaatccagctagagttcaccaaaagggtgcctacagctgtgctgagccttcatactactgaagttcctcaggctgtgttgtccaggatctgagtgagaaaaaccctcccccttctcagagttctcaggccagaaaggatggagtgggggcaggggcacctgggtctttagtgcttcctggggaagaatcctctaccctgcatttgtagagagacccgaagagacagagcactgggcttggagcaaggccttcctgtgaggtctagagacactgcacctcccaactgacctcacttggcttccgcaggaaatcctgcatctttttttttttttttttttttttttagacaaggtctcatcctgtcaccatggctggagtgcagtggtgagatcatggctcactgagcctcaacctcccgggctcaagtgatcctcccacatcatgctcccaagtagctgagagacaggtgtccaccaccatgcctggctaacttttgtaaatttcttttctgtagagacaggttttgccatgttccccgggctggtctcaaaactgctgtgctcaaaggatccacctgcctagtctctcaaagtgctgatattacaggcatgagccaccgcgcccagcccaatcctgcatttttctagagcagctgattaccatagcatgtggagggagagggccaggcctcagttgagatctggtgaaagctgtgatcccttaccccagaaacgtacattatacctgtagcatcaggattcacagaacccaaaagccatccatccatccatccatccatccgtctgtccgtccatcatccatccatccatgcattgcaggctaggaagttttaccttatgcttgcacttactcttgggttgagatggagagggaaagttctagagctctctccctgcttttggagggcatggcacacacctttttatcctggccctaagccctaggctaggccaaggaattataatgtgagacaggatgtacatcaaggagatgagctgagagagaaaagctggaccaggtacagagtatagaagaggggtgacaatttcgagctgactccttctctgtttcagcccagcctgagggcaggtccagctgagggaaggaagaggagaagaaaggaagggggagagatgagccatgcgctgcgccccctccttccccagctgcgagcagagcagcccagcgggttggatgaatgctgggagggggagagtgaccctggcagaaccctttgttccagctgaggctggagcagggcactgagcattcacacgccatcccagggcatcctgctgggcacgctggggagggggcacagcagctgtcatgggacttggccaggcagatagctcgatgctcaatagggaagcccagctgcgtgcgctgaagccgggggagaggctgcatctgccagccttcctcaaggctgtggcctgtgccaagacaggaaggccctggcaggtcccagttactctgccctgaggtggcctgggggactcaagcagcccaccctgcttcctgctcccctgtgtggattccttatcctaaagaggctccagattttaattccaccattagttcttgccctccctggccaacatcccagggtctggtccaaacagaggcagagcgtccatatctcaacctagttttagtgagaaggctatggaggcctctaacatcaccctttctgtcccttgttcctcttcttcaaaagcaccaaacctctgagtggctcatttttttttggagggggttgtttctttttttcttttttgagacaaggtcttgctctttgcacctgctggagtgcagtggtgtgatcatagctcactgcagccttgacctcccaggtcaagcaatcctcccacctcagcctcccaagtagctgggactacaggcacatgccactacctcagctaattttttagttttttgtagaaacaaggtctcactatgttgcccacgatggcttgaacttctgagctcaatcaatcctcccatctcagcccctcaaagtgctgtgatatagtatgagccactgtgcctagcctaggtggcatcatctgtttctgggcccttagaggtgcatgcaaaaaagccctgtcatagagcgggtcacctggactctttgtaagcccaaagtcagcggtatctgctgggtcgtttatgccctggaggaggcatggttttactgcctgcatctccttgaagtgtcactgtgactctccaggtgacagtgcccctggactaggctcctctactttccctcggaatgggcttgggttgagtgggagctgagccctcactgattccttttccctcccccaggcctggccagcagccccgagtgtgcttgtggtcggagccacttcacatgtgcaggagtgctcttggagagtgtacctgcatccctgcccagtggcagtgtgatggagacaatgctgcggggaccacagcgatgaggatggatgtagtaagtacctccccagaggcagtgggagtggtggagagggacctgggggtggggggcaaggacaaggctgatggagtattttctgctcaactgtgtcggactcagagagttggtcttttgcaagcttgatagatattgacatttggtagtttcttctctatatatggctccaactctcctgtgtttcttttggttggttcatgctatatgtccaagaaaacaaacttgacaacacgtgtaagagaacacaacagggagtttcttaaataggtctctctgtatttatgtgaatatgtttgtgtatatgtaccgcatatttgtggttttaaaatttatatactatacacaaatgtggattatttctatgtttcttattttggtttttgtacaataaaaccttttttttttttttttttgatacagagtctcattctgtttccaggctggagtgcaggggcacagtctaggctcactgcaacctccacctcccaggttcaaggattctcctgcctcagcctcctgagtagctgggactacaggcatgtgccaccatgcccactaattttttgtatttttagtagagatgaggtttcaacannnnnnnnnnnnnnnnnnnnnnnnnnnnnnnnnnnnnnnnnnnnnnnnnnnnnnnnnagaccatcctggctaatacgctaaaccctgtctctattaaaaatacaaaaaaattagccgggcgtggtggcaggcacctgagtcccagctacttgggaggctgaggcaggagaatggtgtaaacccgggagacagagcttcagtgagccgagatcgcgccactgcactccagattgggcgacagagcgagactccgtctaaaaaaaaaaaacttatattttccttaagtctcccttttcccctagcatggtaacatctcacagttggccagggtgacctgtcttggatatatagaaatatccctgctaagccaatagctggattagaggcgcaatctctgacctacctgtagcatctatgtctgagggtggctaatagtctaatgggaacggaggtacaacctggacctcattaaccctaaccagttcagctaatgtgttgatgataaatgcttcactttcatgtagcattttcataggcattatatcaaaaggctctatgaactgagtataattatccccattgtacagccaaaaagacttcagctcagagaggtaaatgacttgctcagagtgttacgtaatgaactggaaattgagcccgggtgtgtcatcatcatttaacaagaggaaaggaggggaaaaaggcgcttctttctcttgctcatgttttcttatgttttcttagctcctgtgagttctttgggttgttcttcccctaccctgtgaaccctcaccacaattaccttttgaatctctgtcttagctgcagtttctgcttagcttctcctcagctggggatgggcctaggagtcagtaaggaaggactataaaacagacaagggggctggtgtggtggctcacgcctgtaatcccaacagtttgggaggccaaggcaggtggatctctgaggccaggagttcgagactggcctggccaacatggcgaaaacccacctctactaaaatacacacaaaaaaaaagatagccgggtgtggcggcgggcacctgtaacaccagctactcggaggctgaggcatgagaattccttgaacccaggaggcggtggttgcagtgagccgagacataccactgcactccagcctgggtgacagagtcagactctgtttcaaaaaaaaaaaaaggccaggcgccatggctcatgcctgtaatcccagcactttgggaggctgaggcaggcagtcacctgaggtcgggggtttgagaccagcctggccaacacgacaaaaccctgtctctacaaaaatgcaaaaaacaaaaacaaaaaccaaaaaaacctagccaggtgtggtgaagcatgctgtaatcccagctacttgggaggctgagtcagaatcgcctgaaccaggaggcagaggtgcagtgagccaagattgcgccactgtactccaacctgggtgacagagtaagactcggtccaaaaaaagaaaaaaagacaaggggatttggagcaaaaggctatctggcctagttgagctgagtaagaataccaggttgattgacttttcttttcttttcctgggattcagtactaccacctgttcccctcttgactttcactgtgacaatggcaagtgcatccgccgctcctgggttgtgacggggacaacgactgtgaggatgactcggatgagcaggactgtcgtgagtgttgcagaggctgggcggaactccattgagttccactgggaaaggattttcaatcagaaagcatgccccaggtccacatgagcccttgtgttttcagcactttgtcctgtcctttcacttccctcgaagtcagataagctgctgagaggcagccacctccttcggagccctcagggcagcatggagctacttgactgctccggagggctttaagtcaggcttccaggcaccagacccccatgcctgcagcagcctgactgctctgtgcccacagccccccgggagtgtgaggaggacgatttccctgccagaatggctactgcatccggagtctgtggcactgcgatggtgacaatgatgtggcgacaacagcgatgagcagtgtggtgggtgaccccaacgggggaaggcaggcaagtggccagtgggtggcctggccatgggagaagatagcagcaatggccctagcactgccaacctccaactgcccagatatctggagcagctagaggaacgcagagggggcagagccgctagaccccccagaaactgtggaccaggaggctgaggcccagtctctccagggcctccgtttccctggagagtctgcactgactctggggtgcctttcgggggctaggtcagacccgccaagccagtgaggttgggagtcagagaggagggtgagagggttgcctgtggggccccctcaaactgctgtcccatcgcatccccccagacatgcgcaagtgctccgacaaggagttccgcgtagtgacggaagctgcattgctgagcattggtactgcgacggtgacaccgactgcaaaatggctccgatgaggagaactgtcgtgagtggccccagacctcaggctgttgggttggagagggcagacagttctgcccattggctaagggcgaggctgaggagtgcatgtaccaaggcaaggagcatgggtgcctcagcagcagctcctcctaggctgagctagggagggagcaagtccccaggtgggaagggaaggcttcctttggtccacctgaatatgggcgtctataagggtgtcccagatgaaacctggttacatctcacttgaagaagctctcctgcctgagcatcctcctgcttgaggaatcagggcccctctccttcatccaggcctgagtgtgtgcccctcccccccctgccttccctccagcctcagcagtgccagcgcccccctgcaacctggaggagttcagtgtgcctatggacgctgcatcctcgacatctaccactgcgatggcgacgatgactgtgagactggtcagacgagtctgactgctgtgagtactctggccagctgggaggtggggagccaggctgggaagaactgcttgggtggcaaggcacagtcgccagctggggcaggagttcgagaggagtttctggattttctggtccctcttgggaagagatggaggaactgggattctgggctgtggccttctagtctgccatgggacactgcacagactggctagagacagaagtctgtgtttccctagcctcccaccagccctgccgctctggggagttcatgtgtgacagtggctgtgcatcaatgcaggctggcgctgcgatggtgacgcggactgtgatgaccagtctgagagcgcaactgcagtgagtggggaaatggaattaggttgggcttgaactaaggagaaggttgtggagccaaagaggccactaccggctgggcgcggtggctcatgcttataatgccagactttgggagaccaaggtgggtggattgcttgaggtcaggagttcaagaccagcctgggaacatggttaaaccccatctctactaaaaatacaaaacttagctgggtgtggtggcgcagcctgtaatcccagctactcgggaggctgaggcaggagaatcgcttgaacctaggaggcgaggttgcagtgacccgagacggcgtccctgtagcagagtgagatgacatctcaaaaaaaagacaatccgggaggtgagggggcgcctctgcctggccgcccctactgggaagtgagggcccctctgcccggccagccgccccatccaggagggaggtgggggggtcagccccccgccggtcagccaccccgtccgggagggaggtgggggggtcagccccccgcccggccagccgcccgtccgggagggaggttggggggtcagccccccgcccggccagccgccccgtccgggggtgaggggcgcctctgcccggccgcccctactgggaagtgaggagcccctctgccaggcaccaccccgtctgggaggtgtacccaacagctcattgagaacgggccatgatgacaatgcggttttgtggaatagaaaggagggaaaggtggggaaaagattgagaaatcggatggtgccgtgtctgtgtagaaagaagtatacatgggagacttttcattttgttctgtactaagaaaattcttctgccttgggatcctgttgatctgtgaccttacccccaaccctgtgctcttgaaacatgtgctgtgtccactcagggttaaatggattaagggcggtgcaagatgtgcttgttaaacagatgcttgaaggccgcatgctcgttaagagtcatcaccactccctaatctaagtacccagggacacaaacactgcggaaggccgcagggtcctctgcctaggaaaaccaagacctttgttcacttgtttatctgctgaccttccctccactattgtcctatgaccctgcaaatccccctctgcgagaaacacccaagaatgataataaaaaaattaaaaaataaaaaaaataaaaataaaaaaataaaaagaaaaaaaaaaaaagacaaacaggccactacccataatcttgaagacactgggtaagaccaccaccatgtacagttgtgtaggttgtgcactgtgagaggcaatatgtccaaagggaagccagtcacataatagatttatatactcatcatggcgttttccagcagatggcagtaaagtgtcttgaggaaaggatacttttttctgattcacaaaagacactatatagaccagctgtgatcccggtgtcaagagtggcatgggtactgatatagctgcagatttgggtggcagggagaatttcaggctgaaatggggcccacctttcattagcctttgctttgcccagccacctccatgtgtacggcagaacagttccgctgtcactcagccgctgtgtccgcctgtcctggcgctgtgatggggaggacgactgtgcagacaacagcgtgaagagaactgtgagaatacaggtggtgtctcccggggtgccccagaacccttagccttagttggggtggaagggtggaaaagagggtgctttggtatctttccagttgggttgaggtttaccagtgtaaaatccaggtgcatcattgacctgcggccttatggcctggagcacagatcagagctgcgagtttcaattgccactcctattctaactcacacacagccagtgccttagctctggtctagtgaggaaggactaccctccatctggcagcccccatgtgtgctccccggccacacccagtattgagcatgtggttgcactttttcattctgttccatattcctcacatcccactgtggagtcctggggagaaagcaaatgcagacattcagccagccctgtctgactgcttcctgcccaggaccctcaccctcccaccttgagtttcatctgtctccagcttacctagaaaatgacaggctcccatctctttgttggcccaagccctgccttgctatgacctgccctccatctctctaggaagcccccaatgtgccttggaccagttcctgtgttggaatggcgctgcattgggcagaggaagctgtgcaacggggtcaacgactgtggtgacaacagcgagaaagcccacagcagaattgccgtgagtgtccccagtgggcggacctggcccatggttttggccgaaccccacccatagggttcaaagggaatcctccctcaggactcttgcagctttggagctgttctttgtggtccaggtggaatgccaagttggctctctgggggaggattctggctcaactcccaactctggcttggctggcacagggccccggacgggtgaggagaactgcatgttaacaacggtggctgtgcccagaagtgccagatggtgcggggggcagtgcagtgtcctgccacacaggctaccggctcacagaggatgggcacacgtgccaaggtgagctggggctggtttgcagcagagtcggggttctgagcaggggcagcagacaggcagctgtgtttccatgggtcaggcatttgaacggtgtgacctcatttcgtcctcacaataaccctaggaggtgggatcatccttcccatttcacagatggggagactgaagcacagagaggataagtagctaccaaaggccacacagctggcgagtagcagagttgggattccagcccaggtctgcatgacttaaagcccttaaccatttcttcttttttattttttatttttatttttttgagatggacctcgctctgtcgcccaggctggagtgcagtggtgcgatctcggctcactgcagcctcccctcctgggttcaagccattctcctgcctcagcctcttgagtagctgggactacaggtggcgccaccacgcccggccgcccttaaccatttcttagacagccttcccactaggcctggaagtagatggggatgtgggcagaaaagcagctcggcagcctgggagcgggagtgggaggcgacagaagggagatctcttgacctgcctggtgttcccagatgtgaatgaatgtgccgagaggggtattgcagccagggctgcaccaacagcgaaggggctttccaatgctggtgtgaacaggctatgaactacggcccgaccggcgcagctgcaaggctctgggtaagggctgttgcacttggctgggtgggcagagggccgagcatggaggaaggccaggtactctggtgctcaggatttgcagagaggtagagagatttctgtcacagtaaaatgcagcaacagttgcattcgagccccaagaaaaatgctgctggggtggagtggggtggggaggggtggaggaatatagttaaaggttgccactcttctggtactgatgctgacagcttggggcatgtccttgtgagcagtggctccatcggtcagctgaagacctgctgatgggtaccaggggcggctctgaaaccagtgggtatcccatgtttatactgtttcccagggccagagcctgtgctgctgttcgccatcgcatcgacatccggcaggtgctgccacaccgctctgagtacacactgctgcttaacacctggagaatgccattgcccttgatttccaccaccgccgcgagcttgtcttctggtcagtgtcaccctggaccggatcctccgtgccaacctcaacggcagcaacgtggaggaggttggtctactgggctggagagcccaggtagggaacaaggccccatggagaggggcagagccagccacatgcgcagcaacggtgggaggaataggccagtggtttgcaaaccttaggcagcagacatctttttcttccagggaaatcttagttggagccctaatatagaaagcatttgttatgtatatcaattttataggttcaaatataacatttgctcatgattgagctcaatcagtggaataatgagaccacgttggtggttgtgatcatgggaatcagatttatggatgacagagtctccatcagcctttgcatctagtttatttctgagttttgtttcgattgcttagtattagaatattctgattgacctggataagtatatcaaaatgttttatagattgttaaaaaaacggccaggcacggtggctcacgcctgtaatcccagcactttgggaggctgaggtgggcagtcacctgaggttgggagtttgagaccagcctgaccaacatggagaaaccccatctctacaaaaatacaaaagttagccggacgtggtggcgcatgcctgtaatcccagctacttgggaactgaggcaggagaattgcttgaactcaggaagtggaggttgcggtgagccgagatcacccattgtacttcagcctaggcaaaactccgtctcaaaaaaaaaaaaaaaatagttcaaggtggtggcttacgcctgtaatcccagcactttgggaggctgaagcaggcggatcacgtgggtcaggagtttgagaccagcctggccaacatggcaaaaccccatctctattaaaaataaaaaattagccaggcatggtggcaaatgcctgtaatcccagctacttgggaggctgaggaggagaaactcttgaacccaggaggtggaggttgcagtgacccgagactgcaccactgcctccagcctgcgcaatgggagtgagactccatctcgaaacaaacaaacaaaaaaccacaaaacagctcacttgtcaatctcaggctattttacaaataggtgaagtggtcaaattctatttggtatcaagcacattggactcaaatgcctagggaatttctgaaatgcctctgcaaaccccagatgacaatttacaaacccctgggtcagtgcagtgggggaccctgggaatgcgtagggagacagaattcagaaagtgatgtatggttgactgtgaggagcaagtgcatgccctggacagttacttaactcttttgtgcctcaatttcctcatcctcatggaaattacagtattagctcacagagttgtgatgcttaaatgaattcatgtatctgaagtgatgacaatagtgctggcccaaaaaattgcttcctgtaagagtttgctcctattactatgggacatgggggctgggttgactccttgacattttttgctgctgcttctcaccagggggcctggctgtggatgggtccatgacaaactctactggaccgactcaggcacctcgaggattgaggtggccaattggacggggcccaccggaaggtgttgctgtggcagaacctggagaagccccgggccattccttgcatcccatggaggggtaagttgtatctcaggctcccgaactttcttgcaacctccgggacagctcccaggctacctggactagacattctgggagtacatcctcaaagtgtgggtagctgggcgcggtggctcacgcctgtaatcccagcactttgggaggccaaggcgggcgatcacctgaggtcagtaattcgagaccagcctggccaacatggggaaaccccatctctcaaaatacaaaaattagccaggcatggtggcgggtgcttgtaatcccagctactcgggagttgaggcaggagagttgtttgaacccaggaggcacaggttacagtgagctgagattgcccactgcactccagcctgggagaaagagcaagactctgtctcgaaaaaaaaaaaaaaaaagtatgatgttaataacatgggctctgtcccccacacacttgagtctaggtcctggctcgtaataactggctgtgtggccttgggccagttaatctctgtctgccttgtttactcattctaaattggtgattaaaaaaaaatacctccatcatagttgtatgaagattaaatgaggtatgcattttaaattgcatataacacacattagataagttgtaggtgtttcgtatttttatattagctcataaggttgacctaattaatacaaattaatagttattagtaattcataagattgtaattaattattatagcctaaaaattaatagaggggccgggcacagtggctcacactataattccagcacttttggagaccaaggaaggaggatcacttgagtccaggagttcagatcagcctgggcaacatagtgtggcctcatctctacaaaaatgttttctaaattagccggcatagtggcacatgcctgtagtcccagctacgtgggaggctgaggtgcaaggatggctgagactgggaggtcgaggttgcagggaaccgtgattgcaacagtgacctccagcctggtgacagagtaagaccctgtctcaaaaaaagttaaataaataaaattgagaaatctggtcggttcagtggctcatgcctataatctcagcactttgggatgctgaggtgggcagattgctgagcccaggagttcaagaccagcttgggcaacatggcaaaaccccatctctataaaaatacaaaaattagctggacttattgatgcatgcctgtagtcccaactacacaggaggctgggtaggaggatcacctgagccctggagttcgaggctgcagtgagccatgattatggcacgcactcctggatgacagagtgagactctgtctcaaaaaaaattaaatttaaaattcagaatctgaattaaagaaaaactcctgaaatgaagttctcacctctggcttttaaaaattcttgcaatcaatggagggagtatcttataaggtcctacagtatgtatcaactgttttagaactgtgtgtgtgtatgtgtgtgtgtctgtgtgtgtgtgtgtgtgtgtgtgtgtgtgtataaatacaaaaggagccgggcatggtgactcaagcttgtaaccccagcactttgggaggccaggcaggtggatcacttggggtcaggagtttgagaccagcctggccaacatggtgaaacccatctctactaaaaatacaaaaattagctgggcatggtggcgggtgcctgtaattccactacttgggaggctgaggcaggagaatcacttgggtccaggaggtggaggttgcagtgactgaaatcgtgccactgcattccagcctgggcaacagagcgagtctcaaaaataaaagaaataaaatacaaaaggcagtggaagagattgtgacaaagaagaaagtgcctgtcctaatttacattatattgtcaattctgtgagacttttgtctgttttgttcactgctagatttccgtgcctaagatagtatgtcctgcctgttgccagtatgaaaaaaaaaattattaaatgaaaaatgccctgtctaaagacatttaaactcagacacttaaaaagcattctgaggctgggctggtgactcatgcctataatcccagtactttgaaaggacaaagcaggaggattgcttgactcaggagtttgagaccagcttgggtaacatagcaagacctcatctctactacaaaaaaaattagttaggtgtagcgatactagctgctcagaaggctgaagtgggaggccttctgagccaggagattgaggccgcagtgagctgtaatctcacctgccctccagcctgggtgacaaatgagaccccgtctaaaaaaaaaattcattctgtggaccaaacattggagtcccctgagtaaatggataaaagcgccctacctgattattctcctggttacctacctgttttctgctgccacttcccaatttacttttctcttcctagtaccatttactggacagactggggcaacacccccgtattgaggcctccagcatggatggctctggacgccgcatcattgccgataccctctcttctggcccaatggcctcaccatcgactatgccgggcgccgtatgtactgggtggtgctaagcaccatgtcatcgagagggccaatctggatgggagtcaccgtaaggctgtcatagccagggtgagccccttccttcagtctccttcatctcttgtcctcctgcccccgtcctgccccccaggagccttggtagaggttttgtgtagttgccaggcctgggcccaggggactggcagaccacatccagactgaggtcttcctggactttccccaggcctcccgcatccctcgccatcacagtgtttgaagacagcctgtactggacagactggcacaccaagagcatcatagcgctaacaaatttacggggaagaaccaggaaatcattcgcaacaaactccacttcctatggacatccacaccttgcacccccagcgccaacctgcaggtaaaaaactgcccaccggtgagccaaagtagcctcgtggttgaggtggcctctggtgcctctgagaaccttccttcccttagagttgccatttcttctgatggggaaatccagcagggcactgacatgggctaatcctccctctgctggacattcggggcagtacaacaagattcacgaaaagattcattagactcaccgttcccatctaattcaggcagacatttacagggcatctcctctgtgccgggtaccactgtgctagcagcaggggcagatgtcaaaaatataagacatagtttctcccttcaggaactatcaccctacctaaacccctattccctagtcttggggtcacttttgcagaccttcctgatcctcttgccctgggctctttgagcagggaaaaaccgctgtggggacaacaacggggctgcacgcacctgtgtctgcccagtggccagaactacacctgtgcctgccccactggttccgcaagatcagcagccacgcctgtgcccagagtaagtgggtctgcaacaccagcctcatggaggctgttgtgaggatggggagaaggaacaagggataggacgtggagggattgctgtcatgggaaaaaccacattcctcagggagccctggagaggaagaacttaagaggctggggatcttctatcaaagctgaggactgaggacccagcactagtggctgaaggctcagcataccgcccggtcgagtgtgaacacctgcagtgaggctcatgtatcattttaccaggcagattgccttctctataggcagcaagagggttttatgctcttctagaaaacaggggaatgattcctacctttttacctttagcgtcaccctgttgaagactttctttcggcccttaaaccggaagccaaaattagaatctctgatgatgttctgtgtaagcgggtcctggataaatatggttaaacaagtggaagatcatgggatcttccctggtctgtccctgaactgctactttggttcctttgggctccttaggagttattgttttgagagggtaaccctggagagcccagcaccgatgactttttctaagaatagtccagagaggagcggtccgggcatatggcacgaccagagggcacctggggtgattcctcacacatcagcagctgttcttgtttactgctgtgtacccactgaccctctgaaatctgggtaaaataaaattctcctgggacctgggtcctttctaggagtgtggttagggaaaacattcaaaagtttcattcatacacatattaactaagaacctatttcattctctgagttttccccttgcattcttttttttttttttttttttttttttttttttgagacagttttgctcttgtccaggctggagtacaatggcacagtctcggctcacccaacctccacttcccaggttcaagctattctcctgccttagcttcctgaatagctgggatacaagcatgcgccaccacacctggctaattttgtatttttagtagggacggggtttctcatgttggtctggctggtctcgaactcctgacctcaggtgatccacccacctcagcctccaaagtgctggcattacaggcatgagccactgtgcctggcattttttttttttttgtcccctcccgggttcaagtgcttctcctgcctcagcctcctgagtagcggggattataagtggcactaccacacccagctaatttttgtatttttagtagagatgaggtttcaccatgttgtcaggctggtcttgaactcctgacctcatgacctgcccgcctctgccttccaaagtgttggattacaggcataagccaccgcccccggccttttttttttttttttttttttttttttgagacagggtcttgctctgtcacctaggctggagtgcagtgttgtaaacagtgctcactcagcttcgacttcctgggcttaagcaagcctcccgccccagccccctaagtagctgggatacaggcatacactatcacacctggcgaattttgtggagttttttgtttgtttgttttgttttgagacagagtctcactctgtcacccaggctggagtgtggcggcatgatctcggctattgtaacctccacctccctggttcaagcgattcttctgctttgggctcccaagtagctggattacaggcacctgccaccatgcctggctaatttttgtatttttagtagagatgaggttcactatgttggccaggctggtctcaaactcctgatctcgtgatctatccacctcagctcccaaagtgctgggattacaggcgtgagccactgtgcccagtgaattttgtatttttatagagacggggttccactatgttgctcaggctggtctcaaactcctgagcccaagcaataccccacctcagcccctcaaagtgctgggattacaggcatgagccaccatgcctggcccttcctcttgcattcttttgtgtccagcgcttcccctgttgtcttagtgagatgcaagaataaagccccctgtcccctgacagcttccccttaaggatttcccagccctaggaagaagaatttggcaacattagtcaggaagtgcctttctggatagaaaagtctactgagaaagtatcagactgaccagaggaaaggcagaggatggggaagagctggctggaagtaaactatgtaaggactggccagagctctttctctggagtcagatctgagtcccagctctggtgctttgtgccatgggatcctgggcaagtttcttgatctctattagcctcagggttgctcgtctagaaatgggaataagaataacacacgacagaggcttggtgtgagatcaaaaaagcaccaagccagtgcctggcaaggaaagtgctcagcttaagctactggcttaaagttgtaaagaggaggcaagaggaagggatccaggtgatggagtggaggggcaggagccctgacacagtcatgacatcagggaagtaggggtcaggggttggcagtgggcaagccaggacaccagaagaggtgagaaaagtaagaagagagaaaagttgagatgaagccgacagatgcttaaacagcatgcattctgggaccttagtagagtctgtttccatttgatttagaagtctgattctgctagcatgcagtgcttaaaagaagcctgaggtataaagtatagggggcaaagggcaccagatcccagaagtgtgattgaaccagatgtcacgcaggtgagcgtctgtgtctgtcactgttcttggtttagagcattaaaagaagacccctttcggcctttgatcaggtcttgacaagttcctgcttttgcccgaaggatggacatccgtcgaatcagctttgacacagaggacctgtctgatgtgtcatcccactggctgacgtgcgcagtgctgtggcccttgactgggactcccgggatgccacgtgtactggacagatgtcagcactgataccatcagcagggccaagtgggatggaaaggacaggaggtagggcccagcgtggggaggttgaagggtggaatccaccctctccagaaagggcttcccatacctttgccaaccttgagaattggtggagtttgggctccagaactaagtggaagtacagttggtgatacagctttgcttcctgcccaggtggtagtggataccagttggagagcccagctggcctggccattgattgggtcaccaacaaactgtactggacagagcaggtatgcataggggagccgtggcctgcctggctccctgggattcctcttgtttaaaccctggcctcagatagaaggagcccagtgtctctcctggaccacttctgtcttcacttcagtccttggtaggtcagaagccggagggctgctgcagagccgaagtgagaagctcccactgagaagctcacattgtggcagctgcttctgctgtgtagctgatgctggggagtgttttaggcatttcagatcatgaacctatgccttgttttctttccatcgctttctgggtaaatcggctttttttttttttttttttgaggcggagtcttgctctgtcgccaggctggagtgcatggtgcgatctcggctcactgcaagctccgcctcccgggttcatgccgttttctcctgctcagcctcccaagtagctgggactacaggcgtgcaccaccatgcccggctaagtttttgattttagtagagacggggtttcaccatgttggccaggatggtcttgatctcctgacctgtgatccacccgccttagcctcccaaagtgctgggattacaggtgtgagccaccgcgcctgccaaatcaggcatttttaattagccaggtgggtttgggaggcaaggggataccctgaaaagtgctactcagagcgtggttgctggaccacagaggctgatgacaaccttgcctcctcgcgtggcagcatcagcatcatctgggaagttgttggacatgcagattcttgggccccacctagacttactgaatcagggttgggcatggtggctcacacctataatcctagcgctttggggaccagggcaagatctcttgagcttaggagttcaagatcagcctgggaaatatagcagacccccacacgcatacacacatccccaatttttttttttaattagcctggtgtaatggacatgcctgtagtcccagctacttgggaggctgaagtgggaggattgcttgaatccggggttcaaggctgcagtgagccatgatcacaccactgcatgccaatctaggcaacagagcagagcctgtctccaaaaaacaaaagtcaagacttactgaatcagaatctttgggggttaggagcatgaaatggactagaatttttttttcttttttaaattttgagatggagtctcgcttgctgcccaggctggagtgcagcggcgcaatctcagctcactgcaacctccacctccctggttcaaaggattcttctgcctcagcctcccgagtagctgggattacaggcgtgcactacacacccagctaattttttttttttttttttttttttgagacggagtctcactctgtccccaggctggagtgctgtggcacgatctcggctcactgcaagctccacctcccaggttcagccattctcctgcctcagcctcccaagtagctgggactacaggtgcccgccacgacgccggctaattttttgtattttttagtagagacggggtttcaccatgttagccaggatggtccgatctcctaatctcgtgatccacccgcctcggcctcccaaaatgctgggattacaggttgagccactgcgcccagccaatttttgtatttttagtagagacggggttttaccatgttgtcaggctggtcttgaactcctgacctcatgatccacttgcctcggcctctcaaagtgcgggattacaggcgtgagccaccacgcccggctgaatatttttattttaaaaaaaatcttgggtgttaggttcagaaatctgtgttttaacaagctctcctgattcttacgcacactaagtttgagaatcatcgccttaaattatggttgcctatgtttgggaagtcttgctctttcagaaatccaactgatcacatccttgaatttcttcttgcagttcaagtcactaaatttccgtgtgcatctgtcacaaaatatcttttgagcccctactctgtgctctgctggcgcataccggctcttgtgttggccatggaaggtaagagggtgaatgaacaagactagaattaatctcgtatcccttcttgataggtacagaccggattgaagtagccaacacagatggcagcatgaaacagtactcatctgggagaaccttgatcgtcctcgggacatcgtggtggaacccatggcgggtgagtggctgccccttgggaatgagctccatccacccctcccaagatctgagctcagagaggagtctaaagattaggaagagtgaccagatcttatggatatgcccaaggaagcagagcagctgtagaaaccagaggctggttgccaagaccagctctgtcggggagaccctacccagtggtgctagaggaattaaagatacacacacagaactatagaggtgtgaagtaagaatcaggggtctcacagccttcagaactgagagcccccaacagagatttacccacatattattaacagcaagccagtcattagcattgtttctatagatattaactaaaagtatccctatgggaaatgaaggggtgggccgaattaaagaaataggttgggctagttaaatgcagcagagcatgtcctaaggcacagatagctcatgctattgtttatggcttaaaaatgcctttagcagttttcctgccctgggcaggccaggtgttccttgccctcattcgggtaaacccacaccttccagtgtgggcgttatggccatcatgaacatgtcacagtgctgcagagattttgctatggccagttttgggggccagtttatggccaaattttggggggcttgttcccaacagcggtgacaactttgtattctctgtggacaaggaaacttttcaattctttctttccttatctttttttattgttggtttacttgcaaaagtaactcattgttaaaaaaatttaaatctgtgaaagtaaaaattctctgtgatctcactctccagcaataagttaacagttcaggatattttttccaggttttcttctaaatgtatgtaaacatttgttgttggtggtgatggttttggtttacaaaaatagcatactttttgtgactttttttctgcttgcccttatatctagtgtactttccagttgagtgtatagatctaccttgtttttgttgttgtttgtttgttttgagacgggtcttgctctgtggcccaggatggagtgcagtggtgcaaatcacggctcactgcagctcaacctcctgggctcaagcaatcctcctgcctcagcctcccaagtagctgggactgcagcacagaccacaatgcctagctaatttttacagtttttttttgtagagatggggtcttgtatgttgtctaggctggtgtcaaacttctgagctaaagcaatcgtcctgcttcagcctccaaagtgttgggattacaggtgtgagccactgcacctggcctatgttgttcttactggtttatagagttctgttaacttatttaacccatccagtcaagaaacatttctctttttgttttttcttttttttttgaaacagagtctcacttgttgcccaggctggagtgcagtggcccgtcatggctcactgcagccttgacctcctggattcaaatgatcctcctatctcagcctccaagtagctgggaccacagatgtgcaccaccatatctggccctttttttttggtagagagggatcctactatgttgcccaggctggtctcaaacttctgggctcaagtgatactctcacctcccaaagtgctgagattataggcatgaaccatggcgcctggccaaggaaatgtttctattcattttcacccctcctctttctttattcccatgtacactttatttgtggagttttcttaagctgtgggctctgcttttattaagactctgtaccttttgatagtaatagaagacaggcattcagagatagtgctgagcccagagctgggctggacactgatgcaggaggctgagctgatgaggatctgcttcaggcagaaaccctgaaatcctaggtactctgagtccctgcggatattaactagcttgtaagacctgccttgccttgcctttgcccaggtacatgtattgactgactggggtgcgagccccaagattgaacgagctggcatggatgcctcaggccgccagtcattatctcttctaatctgacctggcctaatgggttagctattgattatgggtcccacgtctatactgggctgacgccggcatgaagacaattgaatttgctggactggatggcagaagaggaaggtaagggtggcagtaagaggaaggtaagggtggcactaaaacatcttccccagccttgacagcctccaggacagtactttttggctggcagctgattggagataaggggtctggaggttatgggaccagcatggggcatgtgctgtttctctgaggctgtaggtgctgccagagcttgggggcaggggtgggaaagggctgctggttgatgatgaaaagaaactaggacttgtgtggattgtgagctgggggtgtaaatgcacagaatttcctgttaaccagcacactaatgcttgttaaattaccagttgcactgtgggcctgtgattcatctctttttgttttgttttggtataatttcaaacttacagaaaagttgcaagaacaggtaaaaagaataaataaattttgccacatttgctttatcattctgtttctgtacacactcactattattttttggactgtctgaaattagagtggagacagcctgcccttgactccagactattcctgtgcacattcctaaaagcaaggatgttgtcttacatcaccacagtacaatgatcaaaatcaggaaattaaatttaacattgatccaatattactgtctttttttttttttttttttttttttggtttttagaggcagggtcatgctgtgtcacccaggctggagtgcagtggcacaatattgggcactgcaccctcgacctactaggatcctgagtagctgagactacacgcatgagccataagcctggctagtttttttctttttttttggtagagacttcctgtattacccaggctagtccaaacttctggcctcaaacgatccttctgcctcagcctcccaaagtgttgggattatagcacgagccaccatgcccggcccaatattactgtctaatcatagtccttgcccaatttcataccaattgcctcagtgatgtcctttatagctcctcccaccccactttttttctttgttatctaggatccaatcaggatcacccattgtgtttagtaattacgtctcttttaattttttttatttatttatttttagacactcactccgtggcccaggcaggagtgtagtgccacaacatggcccactgtaactgcgacctcctggcccaagggatcctcccacgtagctgggacccaggcacctactactgcaccctagctactcaggagcctacgggtttgaggccactcggcgattttttattttttgtagagatgggggtctcactttgttgtctaggctagtcttgaaccctaggctcaagcaatcctcctgctttgacctcccaaagtgttgggtttataggcatgaccaccacacatagcttttttttttttttttttgagactgcagtcttggtgtgttgcccagctgacctgggctcaggtgatcctcccatctgaggctcctgagtagctggagctgtgcgcaccgggcccaactaatctagtctctttactctctaatctggaacatttcctcagctttctgtgactttattgacatttgcattttttgtttgtttgttttgttttgagacaagagtctgctctgtcgcccagactggcgtgcaatggtgcgatctcagctcactgcaatctctgtccccgggttcaagcaattctcctgcctcagcctcccaagtagctgggattataggcacccctaccacgcccagctaatttttgtatttttagtagagacagggtttcgccatgttggccggctagtctcgaactcctgacctcaggtgatctgcccacctggacctcccaaagtggactttgcatttttaaagagtaaaggccagttattttttataatgtctctcaacttggattttctaatgtttccttgtgattggattcagagtgtgcatttgcagcaggaatactacactagtgaagtcatgtccttgagttctcagtgtgtctcatcagtagacacaggtgttggcctgtccgttattgtgatacttactgccattgtatggttaaggtagtgtccactgtaaagttgtattttttaattttgtacttaataagtaatttgtccagagatactttgagatgatgtgataatagatgacttccaacatcttccaataaaaccatcacacgacccttagagccaggcagatcaagtcacagattgatagagcaaggctcagagagattttataagtagctcttactgaggtcacccagtaggtgttagtgggagagctgctttctgagtccacagtgagctctttgcactgctctgtactgtcagactttgttgaagatgacacagtgttggggccctggcaggtctgattggaagccagctcccccacccatttgggctgaccctctatggagagcgcatctatggactgactggcagaccaagagcatacagagcgctgaccggctgacagggctggaccggagactctgcaggagaacctggaaaacctaatggacatccatgtcttccaccgccgccgcccccaggtgagcagcccttggctcgcattggcttctccgtggccctcctatgccctagtctccccattgaacatcccctcctctctacccagtgtctacaccatgtgctatggagaaggcggctgtagccacctgtgtcttaggtccccaaatccaagcggattcagctgtacctgcccacaggcatcaacctgctgtctgatggcaagacctgctcaccaggtgagtgaaagcacacagatctagatgcagcctctctgggagggggcaatggctctcttccttccttgcagagggctccaatgtggtctgagaaaccatgagtcctgctgcttctagaggcccaggggagaactcacggcttttagaaaaggggacgggcctggggagaggccctggggagcaagtagaaggactggaggcagggtccaactagttcttatgatgtcttcatgcatattagataaagatctcctttctcaagacactttcctctcatctcttagtacattgtcataatatactgatttgttggaataagacacttctggctgggcacggtggctcatgcctgtaatcctagcactttggaggccaaggcaggcaaatcactagaggtcaggagttcaagaccaacctggccaacatgtgaaacctcgtctctactgaaaatacaaaaattagccaggcatggtggcgcgtaatccagctacttgggaggctaaggcagaagaattgcttgaacctgggaggtgaaggttgcagtagcagagatcacgccactgcactccagcctgggtgacagagtgagactctgtctcaaaaaaaaaaaaaaaaaaaaagacacttctaactgcccaaaattggtataataaaaacagaaagtatgatatctacaatgtcacagtaccctcctccttagatgtgccacttttgtgagtgccaacctatgtgacaaccttattggagggtcccagaagcagtacctggctacccagatgtggaagtcaaggcttctccctaggagatgctgcagggtaggctgcatttgaactctaaccccctgggaatttgagtgagaaaggagctgtgaactgtgcctctcaggttgtgagtaaagcccctggggtccctttattccctttctttttttctctttcttaatcttcatggtaaaggtccttcaaagagagccactttcataatattaataaagaggcattatttatgaatatgtggagacctaatggtaagtgctttatgtacatgatcttttaacccttacagccaccccattttgtccccattttatagataagaaaactgaggcctaataatttaagctgagagtagtggtcatgcctgtaatcccagcattttaggaggctgaggtgggcagaggcttgagcccaggatttcagaccagcctgggcaatatgacgaaaccccatctctacaaaaaaatacaaaaattgctgggcatggtggtgtgtgcctgtagtcccagctactcagggggctgaggtgggaggacgcttgagctcaggaggtcaaggctgcagtaagccatgatcatgccagtgcactccagctgggcgacacagcaagaccctgtctcaaaaaataataataatttaaataacttgcctagataacatagctagaaactagcagggacagggcatgagtttcagtttgcctgattccaaaccatttaatggctgtgctcgagtgatcctcttccctcctctccacctggcaggcatgaaagtttcctcatcttcgccaggaggatagacattcgcatggtctccctggacatcccttatttgctgatgtggtggtaccaatcaacattaccatgaagaacaccattgccgttggagtgacccccaggaaggtctgtatggccctctcttcccacctggccttctgtccctgcccttaacaattactgtctttcctctcccaccacctttgtctcctgccaagagccagggtgtttttccccattccctctggcatagcccctgtccctgtctctctagcactttctctttggtttgagagcatggtttggggccctcttctctccgtctctgccaagagctatcctgctatgaatttctgcgttttccttgatttcctctgctagaggctccagagctctctgacatgctctgtgtttcaagacatgaatcagctgtgtgtgtcccattgtaggcggtgagggtctaggttagccaagctttccctctccaggaaaggtgtactggtctgacagcacactgcacaggatcgtcgtgccaatctggatggctcacagcatgaggacatcatcaccacaggtgggccttcccctagcccagggaccacctgtctggcaacagggctggggaaatagcccatctgttttaaataggagccagtgtgctcttttgacttcccacagggctacagaccacagatgggctcgcgttgatgccattggccggaaagtatactggacagacacgggaacaaaccggattgaagtggcaacctggacgggtccatgcggaaagtgttggtgtggcagaaccttgacagtccccggccatcgtactgtaccatgagatggggtgagagctggctgtatcgcaatgggtagtgtgggggccagctcagctggggttatgacggggtaaaggtgggtagtggagaggaagcttgctcacagaaacaaggtgacctccctggggctcttccactctcttgtgacttctcgcagaggacagtacagtgtagaagttaaaagcatgagccttgaatcagaataccaggattgaaatttttcatcatctattagctatatcacttgggtccggtatttaacctctctaattctcagttccttacctattaaatggaggtggtagtgaaaatacataccttgtggcccttatgaagttgagataatgcacatgaagtattttgcaaagtactttgtcaagcaaaaattttgcctgcatactgtaagtactcaagtgtatctgacatactgttaagtattcatggtatgtggtagtgctggaataactagctaatatagctaatattcttcctcactcaggtttatgtactggaagactggggggagaatgccaagttagagcggtccggaatggatggctcagaccgcgcgggctcatcaacaacaacctaggatggcccaatggactgactgtggacaaggccagctcccactgctatgggccgatgcccacaccgaggtgagagccgtgtccctgctgcttcccaggacctgggaagatgggaaaggcctgcctaggatctccatggagagttcccaatctgctgataccacccccgaccctctccttcctctgcagcgaattgaggctgctgacctgaatggtgcaatcggcatacattggtgtcaccggtgcagcacccatatggcctcaccctgctcgactctatatctactggactgactggcagactcggagcatccaccgtgctgacaagggtactggagcaatgtcatcctcgtgaggtccaacctgccaggcctcatggacatgcaggctgtggacgggcacagccactaggtgagagtcagagggctggggctgtgagtcagagcctctggcttctggggccatctcaacatcagagatatatccagagcacagagctcctttacagccagaagacggtgacctgtttaagctcccttccagattgggctgtgttctctctgggtatggctgtactacagctgtcaccttcaaaggactcctggagatcctcctgcagaccctccttctactcaccctgccaggcactgaatcctgtcacttagaacagcaaagagccagccacaaacactgggacctttgtaagattcagatgatgttccaggctaggtgtgaatacttgtgcttctatcaccaggttttaacaagtgcggctcgagaaatggcggctgctcccacctctgcttgctcggccttctggcttctcctgtgcctgccccactggcatccagctgaagggagatgggagacctgtgatccctctcctgagacctacctgctcttctccagccgtggctccatccggctatctcactggacaccagtgaccacaccgatgtgcatgtccctgttcctgagctcaacatgtcatctccctggactatgacagcgtggatggaaaggtctattacacagatgtgttccggatgttatcaggtatgagcaacactgaaacctccagaagacacagatttgcttctggtgcccatgggtgaggttgtgttctgaccactaaatggatgagtgatttggcactttggatgtgagttttaatcctgacttgttcactttgtagtgttgtcacttacagcagagtttcaactttcatttgtttagagattatatggaagcctagtatgtaaaacaaacaacaacaacaaaaaaacaggtaaagtcaggggacctggagactttcacatctaccattgtgccctgaggggctccaagaatcccctaggacttactgatgagtaggccatataaccagtatctgtattgagtaaaggagccccaatcaaatgccaagtcttatggtggtttacaaagctgttgtttttattttttcgttgttttatttttagtctttaaatttgtggccctaacacagcttaggaattgatgtcctgccaccagtaagagtggtttaccatggcagatattctcacatggaggaacgggaacattcccctttgctctccccaagggatgtattagaatctcaaactggggacaggaggcatatacagtttagggaagtcccctaggtgacagtgacatgctccccattctgaggagagttccctcctgcccatagggcctttgcaaaagtgcacagttagggtctggcgtggtgctcgcgcctataatcccagcactttgggaggccaaggcgggaagattgcttgagcccagagttcaagaccagcctaggcaacataatgaaacctcatatctacttgtatttaaaatttttttaacttttaaaaaatgcacaggttggttttgacaaatctgcgtttcttatcatcacacctagcaatccttgtctcttcccaaaggtatgtggggaatgataaacttgtcttctacaagacatcccctggcaaccgccattatgtccagttagcaggaaatactgtgtcctcctagaactggttccttcattctgcaattattttattgagcatctatcatgctgggtgctgagaatgtactcatagatacctggtctctatccctgtggagcttacagttcagtggggtccgttatgggaacatgggttaaagttctactctattctgggtcagtctggttgctcatccacactgggctctccccaaggcgagcagacctgaacggcagcaacatggagacagtgatcggcgagggctgaagaccactgacgggctggcagtggactgggtggccaggaacctgtactgacagacacaggtcgaaataccattgaggcgtccaggctggatggttcctgccgcaaagactgatcaacaatagcctggatgagccccgggccattgctgttttccccaggaaggggtagtttatggccagcagaagagagatccagggaagaagggctgggtggaaagatggtgttgtgggtcctctgtgttctctcaacctctgggtgctgtcttcccatgccttgatgatgatgcactgttgtgtctcaggtacctcttctggacagactggggccacattgccaagatcgacgggcaaacttggatggttctgagcggaaggtcctcatcaacacagacctgggttggccaatggccttaccctggactatgatacccgcaggtgggagtcttgcatcaaacagcctccggaaatcgggtgggcagaagagagaatggttgagattaaccttggaaaaatgaaaagatgaaagcttcttggtatgtggggaagaggaatcattgagaaggataagggaatatattctagagcagcgattgctaaatccagccctcaacccttatgtgggttttgtttggctggtttcatgttcctaatttgagtgcctttggcagagcatgtcttctggctggaccacaggtctccacccctactcatttaagggctgattcttatatttgttataatataacaaatcctgatccttcaggctctggaactttgttgttgttgagacagcatcttgctctgttgcccaggctgagtgcagtggcgcagtcacagctctctgcagcctgaacctccctggctcaagccatcttttacctcagcctctcaagtagcagggactataggcacatgccaccatgcccagctaattctaaattttttgtagagacagcatctcgctatgttgcccaggctggtctcgaactcctgactcaagcaatcctactgccttggcttcccaaagtgctgggatttcaggcatgagccacacgcccgacccaggctccggaatgtacaactccttgtctagataagaaatgctaagggcgggggaaggggctctaaagcagtctgtgcccccttctgatccaaaagaaggggaagggatccaagacttctggaaaggtggtagaatgccttcttcttttaacctcagcaaggtccattagactgggctcacttccttttttgttgttgttgttgagacagagtctaactcttttgccaggctggagtgcagtcgcacgatctcggctcactgcaacctccgcctcctgggtttaaccattctcgtgccgcagcctcccaagtagctaggattacaggcacgtgtcaccacgcctgctaatttttgtattttagcagagacggggtttcaccatgttggccaggctgatctcgactcctgacctcaagtgatcccccgcctcggcctcccaaagtgctgggattacaagcgtggccaccatgcccggccgagtgagctctcttcttaaagaccatttttaagaaattgggcttgattattgggtaggagtcaaagggcaatcaaattcctgaagatgaggctgggtggtggtcctctgaggtcactagactttctatgcctccccagagcagccctgacctccccactcagaaccaccagctcccttcttcagctttgggactcacaatgacccctcatcgagggtgctcttgagttctcatagcatctgccagtcagctcaggaggggacaaacaggttcataggggaagagctgggctccctggcaagcgtttggagcagccactcttttcattttcttcgcaggtctactgggtggatgcgcatctggaccggatcgagagtgctgacctcaatgggaaactgggcaggtcttggtcggccatgtgtcccacccctttgccctcacacaggtactggctcagagagaggtaactaaacctccttgactgggatgtttctttggggttctaagtcagcagtccagctatagctgctactgaacagacgtgctattgcagctcattttagggatttttcctggccctgaagccttggtaggttggtagggccaccgagtgccttgctactcttatcctgccttcccatgttctagcattcaaaggagtggctctcaaagagtggtatacagaatccgataggtgcttgttaaaatgcaggttcctaggccctgactatagagattatagagaagctgctcatgagggctgggcacagtaaaatacattttgacaagttccccagttaatcctaatgctcggtcccagcatctgggcatagggagctcacttagtggcaacagggtggagtggctaaagccagagttttgaggcatctagccagtttgtaagtatttaatgagtaccatcaatttgcaggtacctggattcaagttctatctgtattattaaataactgtgtaactttgaactagatgactgaacctctctcagcttcagttatctataaaataaatcagcctaataatagtatctcctgaaatagacacaaagcattagcatagtacctggcacacagtaagcaccacatacagttatcgctacccattttaattattattagctgtcacttttgagttctaacacaaaaaaaatttgggccaggaaaagaagatctaccaagcctgaggccaacaggaattctcgatcattaaaaatcttggccaggtgtagtggcttatgcctgtaatcacagcactctggctgaggcagagtatcacttgagcccaagagtttgagaccagactgggcaacatggcgagaccctattctataaaattttttgttaaattagccaggtgtgctggtacacacctgtagtctcagctctcaggaggctgaggcaggaggatcgcttgagcccaggaggtcgagctgcagtgagctaatttgtaccactgtgctccaacttgggcaacagagcaagatgctatctcagagaggagatcagagaaagagagacagaaaggaaagaagaaaggaaagaaaagaaagagaaataaattgacccttttttgccaaatattgtcaactctgtctgtattctatattatgtcccactagcaaaaagcattttttttgtttgttttgttgttgttgttgtttttaagatggagtcttgcttgtcgcccaggctggagtgcggtggtgtgatctcagctcactgcaacctccgcttcctaattcaagcaattctcctgcctcagcctcccgagtaggtgggattacaggcatgtgccacacacctggtgaattttttttttttttgagatggagtctcgctctgtcacccaggctggatgcagtggtgcgatcttggctcactacaacccccacctcctgggttcaagtgactctccgcctcagcctcctgagtagctgggattacaggtgcgtgccaccatacccagctaattttgtatttttagtagagacagggtttcaccatgttggtcaggctggtttcgaactcctgactcatgatcgcccaccttggcctcccaaagtgctgggattacaggcatgagccaccgcactggcctagccaaaaagattttatctggttttacttaatgatagtctttttttttcatatctaaatgtaaaactacagggtactactgcatataggtttttcagtctacaggtttcccccagtttctgatatatacccttggatgaggatgagaacaccttcattgcccctccctcccttgattgagaatttcaccatcattgctttagaagaaagctgcctacagaagtaaagagagatttggggcagtgctctgagcaaagggcccagaggaacaggaacctataagaaccttcaatttcctcctatttgctagagagggagtcattcaatcaactaaatggggactgagtgtaggtgctagaattcagagatgaatagaacacattcttgtccttgaagaactaaactggtggatggacagaccagtaaacaaattgcttgagtgtaaaaatgtacttgggcaagtgacttaaggtgcagaactgtatagaggagagaatggtgaagtctatatggatttggggagattccttgacaatgtcatgtctgttgatgcacagaaatgaggaagagatgaagagggcatttagcagaggcagtggcacatggtgaggcacagaagctgtacaggaaggagtctgcttgctaataatatttactgtttttgggcttcccctgttgagtagcaagacaggtggatctactgacagactggcagaccaagtcaatccagcgtgttgacaaatactcaggccggaacaaggaacagtgctggcaaatgtggaaggactcatggatatcatcgtggtttcccctcagcggcaacaggtgggctcccgggtactgagcctgcttccttaacatctgtgggattggtcggtcacccaaggactgttagggaccaagacagttagggccacaagagagcttcttggttcacatttaaacgcttagaactttttactccctcgcggttctatctctcctcctcccctgtccctggagtagggtaatcctggatttcctctgtttttgagaagccttaaattgggagacctgatctgtcccagataagacattcatctactttgcctccagggaccaatgcctgtggtgtgacaatggtggctgcacccacctctgctttgccagagcctcggacttcgtatgtgcctgtctgacgaacctgatagccagccctgctcccttggtgagttggactgtatggctggagccatcggcagagcccctggaagggctgagagtcagcagcctctgatactggtctgatctgtcttctgggtgggatccccataaagaaggtcttattagtggagtgattggtagcagtctgctgggttttgggaattgctcaaacctgggtttgtctgccctctggcatttgcaggaacagattcaggtctcttgattcccaggtccctgctgtgggataatcagtggcctgtgcatcacctctcttcctgactggtgagccagctgtcccatccagagctattattattgaatccaaccctttttattgatagtattaagaagggctactaatgaaggtgcctgggactagggcagcaaaagattgttttgtcaagttctccagctgctactcttgggccatatgtggatgtttatgttccagtggcccactccaatcctcttttttgtctagtgcctggcctggtaccaccagccctagggctactggcatgagtgaaaagagcccagtgctacccaacacaccacctaccacttgtattcttcaaccacccggacccgcacgtctctggaggaggtggaaggaaggtaaatggttcaatgcaggatcatgggccctttgattcaaatcaccatcccatgaccaactcatatcccagcttgataaggcagttgggagatagattatgtcaggagctaccagtccctgttattgggacagaaggtgatattcagacttgtagattgttacaagtgattccctttttagcttgagggcaagaagctttaagaacaactttaaggctgggtgtggtggctcacgcctgtaacccagcactttgggaggctgaggcgggtggatcacttgaggtcgggagttggagaccagctgcccaacatggagaaaccccgtttccactaaaaatacaaaattagctgagcgtggtgcacatgcctgtaatcccagctactctggaggctgagacaggagaatcacttgaacccagaggcggaggttgcggtgagccgagatcgcgccattacactccagcctgggcaacaaagacgaaactccatctcaaaaacaaaacaaaacaaaataaaacaacaaaaaaaagaacaacttaaacagaaatcacttaggaggaccctcccacgtggtattcctccttcttctctctgtgcatttgctctcacatcataggtttggcatattggcttgtccaacagtagtctctgggcttggctttatgacttggaacaaaaaggtttccccagagatatgatggccttagcttataagtcatgtgcacccccccgcaacacacacacacacacaaacaccattatgaaataagcaacataaacacgaacagttctcaaatcaagtataaagtatcttatttcattaaattaaagggctattcattataaaatgcttcctgatttgagaaattaaactgaaaagataaccaacagaaatgtgaaatgctattgattgtaagtcacatgcctgtttaagagatggtaggccatagaaaaacaaacatcttaaaattgattaaatatgatgttacattcaattcagagacattctttttttcttttttctttttttttcttgagacaggatctcactctgtcacccaggctggatgcagtagcatgaacacagctcaagctcactgcaccctcgacctcctggtttcatgtgacctcctacttcagccacccaggtagccgggactataaatgtgtgccactatgcctggctattttttgtactttttgtagagatggggcttcaccatgttgcccaggctggttttaaactctgggctcaagtgatccacccgcctaggcatcccaaagtgctggcattacagatgtgaacactgcacctggcaaaaaattctaatgactgtgttttccatttatattttataaaaaaaatctgggccaggcgcagtggctcatacctgtaatcccagcactttgggaggccaaggtggcagatcacatgagtccaggaattcaagacaagcctgggtaacatagtgagatcctattctacaaaaaagtttttttttaattagccaggcatggtggcccatgcctgtagtcccagtacttgggaggctgaggttgggaggattgcttgagcccaggtttaggctgcagtgagcttgattgtgccactgcacaccagcctgggtgacagactgagaccctgtctcaaaaaaaaacaaaaaacaaaaaataaataaataaataatctggaaatacatatgtgaataaagaagaaggaatatcctatacctatatataatttactcttaatgttttgatgtctatcttttctagcatttttctaattagaacagtttttttttttttccactgcaacatactggtctctttattttaatatcatcagtagcttacaaggtagttaacacttgatttcaattctgaaagcagaacataataatgatcccaaataaaaactttagactcaatgtccctaaagttacaagatttcacatgatcaaattcatatgctgtgtgcccccattctctgtttttactacagtttgtaagaaaaggaaacacccaggtataaacatgtgcctttctcactaacttttaagtactatcatcattattactctcggattttctttaggtttatttagaaaacttttgaccccgctcggacttttcttattgtcagagttctatttgaaaattcagtgcatcttggttccaaatgctctgcaagtagctttcctctggctgtttaggagatgcctttgattgcctgctcataatgtacacaaagaagtcaccttctgagcatttcaagttagttatctgagcactccctctggatgtttgcatattcccttgtgaaagaatgaagagaagaaaaacattttttgaccttgggatattagctcttgtgataatttttatccaatcagattggcttggctagcagctgcttctgactatcctggtagtttaagaaagcctaatattgatgtccttagtattctttctgcagacttcaactcactcccaaacctgcttctcatttttaaaggtacatattttataacacacttaaaatggtataacggcttgaaaacagtgccttgcacggatttctctccatttcctgttgttgcctctccatgcttctgatgtcttccatcttgtacattctcatacctgaaagcccccactacaggcctttccccctttcctggaggaaggcatgaccttcactgagtatgagtaggcttacatccagttttctgtgccccacagatgctctgaaagggatgccaggctgggcctctgtcacgttccaatgacgctgttcctgctgctccaggtaagccctgagtaccccactgttccgaaaagaagatgtaatgaatctaagtctccactgatatctttcataaccttcattgggatctggggttgatgaactctttttaaactaagtccatagaaataataatcataatagctccaccacttacagtgacagcttatggtatgctttccgtatgccaggcatgtgataagccaatatatgccacattatatgtgtgtgcacatgcatatatacatactctcatgtaatttccccagtcctatgagcaatttattatttacatttaactaaagagaaaatgtaggcttacaattaagcatcttgccttatgtcagatagctaggaagtggtcgaaatgggatcagagatgcggcagagtgacagatttcttctcagcctcctccctgcacctcccatttacctatctgaaaggaggcccttagccatcctcagatggtatggggtccaacacctacaaaaggagcctttagctttccattcctcacaccagcaccgctagaaagttgtcggtggcccctgcctagtgttctctattcttcctaggggaaggacttcatatcagctacgccattggtggactcctcagattctgctgattttggtggtgattgcagctttgatgctgtacaggtaacttcagtcttgtacaggggccacatgctcattggtcttcatgagcatgtctgggatctcccgaagctctgagttcactgaatcaagctctgaccagccttattgcaaggttgggtgcctggtcagggcacagaaggaaagggtggaaacctaaatacttactcttctccagtcacagcctaagcatttccttattgaatgactgtaacaacccttcggattttctttatagactaggatgctgagtgacagaggatattacccaaggtcacaaagtaagaggcaaatctaagactgactcttaacactttgctttttccagtactccctgcttcaaaccactgaaattggaaatgattttcccctatacaaacacagccttttactacaatattggtttgtacatctttgctcagtagcaatcatctggaaaggtagaatgtgtcatttataatctttttatgtccctctttctttatattttccccaaatgctttaaacgtagcttacagtttgctgctgttgttcttcatcatcatcatctaacagttaccattaatggatatatatcaatgtcatgacaacctcgtaacacaggtattttattcctcactttacagatgaggatctgaggctcagaaagtttattttttttaattttgtcttatttttttgagatagagtctcactctgttgcccaggctggagtgcagtggtgcatcttggctctctgcaacctctgcctcctggattcaagcaattcttgtgcctcagcctccaagtagctagaactacaagcatgcaccaccatgcccagctaattttttttttttttttttttttttgtatttttagtagagagagggtttcttccatgttggtcaggctggtctcgaatcctggccttgtgtgatctgcccacctcagcctctctaagtgccaagattacaggtgtggccaccgcacccagccagagagtttagattatatctatcaaggtcccagctaataaatccagaggtggaattgaaacagatctgtctgactctaaagctcagtgcatcagttctccatgctgcataacaaattacccgaaaacttagtgacttaaaatgacaaccattatctcacagttctatgggtcagaaatctggatgcagcttagctaggtgcctctgcctcaaggtgtctccagactgcaatccagatatcagctggggttacagtctcatctcaaggtttgaccggggaggatccccttccacactcactcacatagttgttggtaggattcagctcctcataggctgtggctggaggccttcctcattagtttcttgccttgtgggcctctccataggacaacttaaacatggcaggttgcttctcccagagcaagagcaaaagagaatgagggagggcaactcagaccagaaccagtttcttggtaacctaatctagtagccatcacatttgcataatcttttattagaagtaagtcaccagaacagtccacactcaaggggaggggattcttaagggcatggtaccaggaagtgggagtcactgggatcatcttagaggctgcctaccagactcagtttaagctttcccaggtatcatccccttaaagatctcgactaatttctcatcaccttccctccaaagacacaaaaaatccaagttcactgatcctggaatggggaacctcacctacagcaaccctcctaccgaacatccacacaggaagtgaagattgaagcaatccccaaaccagccatgacaaccagctgtgctataagaaagaggtaaaaattgaaatttatattcaagggtcttttggcgaggtgtggggagggattttactccaaatgcccaaataagtcagtaacggctgctggtaatcccatctaccattttggaagttatagtgaacagaagaactgaatgtaatttgggttctgggaagttctagaatctctgagggattagtttgagggaccttagtgagagccaggtagaaggcagatctcagaagatttaggtctgaaagcagttgccctgccatgagatattttccaagcttataggttctttccctccaggaactgtcattcccctgcaaaaggctatgtgttctgaaacaagggagctctcccagacaacacccaaaaaacccaagagctcctggactccccattactaacctccagtccaagctagtagcacctatggttgggaatggcttgtttttactattcttcctcttatcacaaaaatttctctagaattctgaaggtttacctgcttttgttttttttttttttttttttttgagacagagtttcgctcttgttgcccaggctggagtgaatggcacgatctcagctcactgcaacctccacctcccgggttcaagtgattctcctgctcagcctcccgggtaactgggattacaggcatgcgccaccatgcccggctaattttgtattttagtagagacagggtttctccatgttgaccaggctggtcttgaactcctgacctcagtgatccacctgcctcggcctcccaaagtgctgggattacaggcgtgagccactgcgccagcctgcttttgtttgtttgtttgtttttaacttctttgtcacttcaatggaaaattattgctcaatgtgaaggcatgaaaaatagtcccatttcaatgagctgggtgtggtggcttggcctgtagtcccagctacacaggaggctgaggtaggaggatcacttgagctcaggagttgaggctgcagtgagctgtgatcatgccactaccctccagcctgggtgacaatgagacccgtctcaaaaaaaaaaaaaaaaaaaaaaaaaagtcccatttccacaaggaaactaactatcctggtatttcagattttcctaatccaatataagccttgtttttttcctaaaatcctgtactcttcatcagaagttattccttatgaagatcctcatcagtctacttctttggcctattagcacagtcagaacctgctctcacacctgcagggctctcatgtgtaataaacacatttacataataatcatgtgctttctggatccatgaattcccgtatttaaatagcttccactattctggttcaagttggtgtttgaaaaaaaaaattgaaattaaaaattttttaaaagctttactgcagtcaaaacagaatgtgcagggatggcttgtagttctaggaatggtagaccccccccaatatctttgagagaaagactcttgaagattcttgggttcctggagtatctgatgtccagaaaagaaccacaatgaaggccacaggatagcaatgaaaatagtgtgacctctttttctgttgtgtgtttcttcctcagcagctctttcacccctctgatagtctttcacctttctcttctgatttcctcttgatttcaggtacctgttgctgtgtgtttgtagagggagtgggtttcccaaattgcaagtgccatatcccccacctctccctaacttacccagcgtgtctctaattaagacattgagtggtctgcatcttatactaatttcatcttggagggtgtgctggtgaacagacatctgtgtgtttgcttgtgtgctatgtcccactctgcatggctgaggggatgtcactctcagagggcagggaccatgttttatattgtataatcatcaaagcacctagccagtcttctgcttaacataggggctcagtaaatatctgtggaattgaattgttacaaaatagagccacagccacagttgcagaactcttggcaggaatactatcccagggacagaaccaagatgatccattttcttctagcagtggtggtatgtcggttggtataccccagcagccagagtgaggctgctctttgaagaagccataaagggagaggcccgagcagaactccaggcttgcctggaagaatcccaggttttgcttgggaatggtcccaggactcatggcagcagagcagagtaacctcccaaaaaaggttataagttgcaggaccccactatattgacgtttaggaccagataagaagatttccttttttttagttttttttctttctttctttcttttttttttttaatggaatcttgctctgtcacccaggctggagtgcagtggcatgatcttggctcacttaacctcagcctccggagttcaagggattctcctgcctcagcctcccaaatagctgggatacaggcacccgccaccaaacccagctgatttttgtatttttagtagagatggggtttcccatgttggccaggctagtctcgaactcctgaactcaagtgatctgcccgcctgggcctccaaagtgctgggattacaggtgtaagccaccacgcccggccagataagaggattttctgagtcccctgtcttacctcccaagttttctccttaacaaaattagaaaaaagagatacaactagcacccgaagtagcttaaaatcctgaataaatgtacatttaattgctcttgccaatgcttttgatgatttatatcagcatgatgtcccattaataaaccacagtaacaatgtaaatagctaacatgttatagtgcatcttgtgtcaagctccctgataactgcattccatgtacatctcatttaaggtgacagcagttggttgtgaggtgtggatactgttactctcctcacctgcagagtcttaagagactgagttttagaaatgtgaaataatttgcctaaggtgacaagccagtgagtggctgctgcaggaccggaagccatggttttccctcctcctgtatggtaaggtaataattatcacagctgcctctccccttttaggctaggcctcatacacttgtcttatcacatttccccatttgtttgtgggatttttgtgcgcttcactcctactcttaccccatcacttcctttttcagtttaccatgggatcctttgtagaaggccaactgactgaccatattgcccactctccaccctagggagggcctgaccataactacaccaaggagaagatcaagacgtagagggaatctgcctcctgtctggggatgatgctgagtgggatgacctcaagcaacgcgaagctcacgggggggcctcctccgggatcatgtatgcatgaagacagacacggtgtcatccaggccagctctggctccctggatgacacagagacggagcagctgttacaggaaggcagtctgagtgtagcagcgtccatactgcagccactccagaaagacgaggctctctgcagacacgggctggaaacatgaacgcaagctctcctcagagagccaggtctaaatgcccaattctcttccctgcctgcctgttccttctcctttatggacgtctagtccttgtgctcgctacaccgcaggccccgcttctgtgtgcttgtcctcctcctcctcccaccccataactgtcctaagccttcaccggagctgtttaccacgtgagtccataactacctgtgcacaagaaagatggcacatcacgagaatttagacctggattttaccatgaacctcacatcttgtactcatcctgggccccctgaaactgcttattcgtgattcctcaccagcgtagagctccacctccctttccccagtaccctcagtgcctgcttctcagtgctgatgcagctgatgacccaggatgcgctctgccccatcacagccagcatgactgcttctctgagagaacttgcccatcagggctgggacatgggggtgtgggtaaagacagggatgaaggatagaggctgagagaagaagaagaatcagcccagcaggtatgggcatctgggaaacctccagcctcaagtgtgttggtacatgaaaaagctctggggggtagttggatctgggtgtctggtccattgctggcagtggaattattcttgccctaagagacactgccttttcagcagcagatactggtgagatgggggtgctcaggctgttcttcctcctcctagaatgtctggagctgtttctacattcagataactggtcccctatcacaaggctactggctaataggaattccctcctggtgccaccactggccgtacctttcctaagtctttgctcaaattaaccaggttgtgagccagtggcttgagtgaagttaggccttgggggctgagtctctgaaaagtctaagaagctctgcctagaccaaatatgtatacctcctgacccctctctccctcatgtcctgggattctggggaagagacctagaacaagctttcaaagaaaaaccagaagttgtcataaatggtcagaaagaacgatcaggttgagacttgggaaacccagggcctaaagagaagtatccatgagggtcaaacttcctgttgacttcctatgttctttctcaagtgctcagggatctaagttagtggacagcaagcctgtggtacggggtggtgatgttcctcttccagctgtcccctcagctaaggggcttagtttccattgggatgccatcacttggttcatgctcattcacacaaagggcacgtgtctcagcctggttcagggaaattgagacttatttttgccctaaaacgtctccctagctgttcttcgtggggttttttgtttgtttttttgcctaatttgctttttctgaccaagccttgtggcaccagcatctccaaagtcctgtggtgggagggctgaataaataaaaatacaaagaggtgggtaagggtaggaaggtagagagcaccactgatgaggccctcctagcccatggcagacccagacctttctcccccaggaattagaagtggcaggagagaacaacaggggctgggaatggaggggaaatttctaggggaagtttcctgagttgaaacttctcctgtggttactggtattgagaaacagctaccaaagtgaaaaaggacaagatcaattcttttctagtcagttctaagactgctgagagagataccaggcccttagccttgctctcagtagcgtcagccccagttctgagcctcccacattacacttaacaagcagtaaaggagtgagcactttgggtccttagactcatgttggggaggaagagcaagtagaaaagtggcattttcttgattggaaagggggaaggatctattgcacttgggctgttcagaatgtagaaaggacatatttgaggaagtatctatttgagactgatttactctgtaaaaagcaaaatctctctgtcctaaactaatggaagcgattctccatgctcatgtgtaatggttttaacgttactcactggagagattggactttctggagtttttaaccactatgttcagtattttaggactttatgataatttaatataaatttagctttcttaatcaccttgcctggcttggagtcatgactaatcctgcacctgctctgtctggcagcccatgctgtggaaaacctgcttacagacatcacttttaagtcctttgtggatgtgggccagtgaagagcaataaagagtgtgaggttcctgctggagttttcagctcatctggagaaacaggtcgaggccagagttccttgactgatgaaacctttatttcctctggaagaggaatgtagatgggtttcctcttgagtgctgactctgactggttggtagtggctgcctgagggctattcgcacccaatgggaagaatgtcatatggctagtgacatctcttctgtgcactggaggaaatgtcatggcatgtataccatgtatcttctatttctgttctaggtctttgttacaaactttactttgccttgcagtgatggtcactggcaagactatctcatgtagtaagaaaatactggagctggggacatggagggctaattccagtcccagatctgccactagctctgttgatcttagtcaactttcatagttagtctgagagtggatcaaattatcactaggatttcattatttttaaaagctgtcttttcatagctcatccactacttctcaaggctagaacaagggctagggatcccttctcaggttctctggatgtgatatccctcagtgaaaactgggaatctgttaatctcaacgcccgatgtagaatttcatgtcaagtctcaatagttgattttctaaccacacaccatctataggataatatccccattcattcattcattcattcattcattcatcatctgctatgggctaggcactgcccatgcctaaacaaagacataatcttacagagcttgagtctagcaacaccattaccaccaccatcccaaaaaaagacaaaaaatgaaagtaagaagactgaagcttcttgtatttaagtgaccagagatctgagtataagctacagtgtataattttctaactgtagtaaggagtaggtgtgccagaacaaaaacaagtagaatagcccaagataaccatccctccaacccccactgttctctttgggagggaaaaaaaaagcagaaaaggggacatcttgggataaaacaaaggttgggaattccttgtctagttctctggtataaaattgaaactagggtcaggcacagtggctacaccaaagtaatctcaccactttgggaggccagacagaagtaaggagtattgcttgaggcctggagttcacgatcagcctgggcaacatgaaggaccatatctctacaaaaaaatttaaaaatattagtcaggtgtggtagctcatgccttagtcccagctgcttgggaggctgaggcaggaggattgcttgagcccaggagttcaaggtacagtgagctatgatcacgccactgcattccatcctgggtaacagagcaaaaccttgtactaaaaaaacaaaacaaaaaaaccctgaaactgataagtgagcagatggtgggtcaagtctaacaaactggccatatttttgcaaactcactcaaaatacagtcacggtctgtctatgtgtatgaacaaactgtggaatctaaaatgaaaggatctctggcccatagaaaggactcggataaactgaagctgtcaccaaacgtaggcctaaattcaatgcataggaactcagaggagcatctacaaaagctgagggtgcacaggtttctaagtgggttctaagagggttctaagggacccagtaatgcactgatatccaaggttatccagggtctcgctctgtcgcccaggctgagtgcagtggcacaatcttctgcctcagcctcccaagtagctgggactacaggcgcccctgccacgcccagctaattttttgtatttttaggagagacggggtttcaccgtgttagcaggatggtctcaatctcctgaccttgtgatccgcccgcctcagcctcccaaagtgctggattacaggcgtgagccaccgcacctggccctaagttgtctggtttctatttatggacatatgataaaagaaatgtggctgagtcctttttatggctacgaaacagtctgtaatatatctttcttcaaatgtgaagttgagtcgactgattcacttaataggatgtgtgttttgggattttttaggcactctttgttttgaaacattccctcatctgcctacttattttctctccacccattctcccgttaaccagctgcagaggctagcagagctcagcatagggaataaagtttatgtctagtcaaagctccaactcataactttggtctccttgacatggtgttaaaacagaccagacagcctaattaagggtcatagtttaaacccaaggctaagttagccacaagctaccaatctgcttatttcattttataagacacaaagagccaagaactttcatgtatcttgctttcctgatggttttccctccaggccctaaaagcctgttgatagtcttctaatgaggtcctatctctcccttctccctccttcctctttggtggcgctgatgcttctgtggtcaaagttttggacagcctacattttgggggctatggaaaatgaatatgagaaaagaaaaaataaagctattcattccttcattcaaccagcacctactaaatgcaatcaagtgcaagccagggtagctttgcaatcctggaagacagttaaggcactaaaacccacagccacttgaaatctgtataatgtcaccactgctatctccagggaaataatgcagagggcacctgcattgaaagttgaggaagctcatcactgaagctgctccttttaggctggaaatatggatacatatcccatgtagggatgcttcaaccagaattcagcttgtgattacaaaagaatgagcactgtctcaacctaacaggcttttcagaaatgcccagcacagttattcagcagccacagtatttgacattgtttcctgttttcagttgcaaaaatacagcattcactttgatctctaatgcccacaaggcttcactgccctcagagggcagtatgttcataaatatactccttatgtaaaaggactacgagaagaccctggaataaaagcacacgtaactccaataaatacacagataaatgctattgatgataatcctagaaggcaaaagatgactgggcaaacatttattgaatacctactacggcaaggtactgtataagatttctacaaggccttgtgggatctgccagtcctcaccccccctgttataagatttcttctgctactacccctctactgcatgctaccctgggccagtgacctagcctctgtcttcctcaaaaacataaggcctttgcacagttgttggcccttgctggcctttcttcccctagatatactcatggctaactcctttgcctttaagtctttgctcaaattaatctcagtgaaacctaccctgaccaccctttcatatataaatattttgttgttgttgtgtttgtttgttttgagatggagtcttgctctgttgcccaggctggatcgtgcaatggttgatcttggctcactgcaccctccgcctcccgggttcaagagattatcctgcctcagcccccgagcagctgggattacaggcatctgccaccatgcctggctaatttttgtatttttatagagacagggtttcaccgtgttggccaggctagtctcgaactcctgacctcaggtgatcacctgcctcggcctctcaaagtgctgggattataggcatgagccactgcccctggcctcttttatatacatatatatattatagtcagctgggtgtggtggctcatacctgtaatccagcactttgggaggctgatgcaggagaattgcttgagtccatgggtttgagatcatcctggtaacataatgagatcctgtgttttttccaaaaaaaaaaaaaaaaaaaaaggtgttttatgcatgcgtatagtttcagctacttgagaggctgaagtgggacaatcacttgagcccagaggtcaaggctgcagttgagctgtgatcacgccattgcactccagcctgggtgacagacaagaccctgtctcaaaaaaaaaaaaaaaacaaaaaaaaaaaccaacaacagaaagaaacacagcctttcccttgaaatataaaaatcctagaagaaaacctaggaaatacccttctcttatcagctttggcaaagaatttatggctaagttgtcaaaagcaattgcaacaaaaacaaaaatgataaatggataaatgggacctaccaaaagtagagagcttctgcacagcaagagaactatcaagggagtaatagacaagctacagaatgggagaaaatatttgcaagctatgctccaacaaaggtctaatatccagaatccataaagaacttaaatcaacaagtgaaaaacaccccatttaaaaagtgggcaagccgggtgcagtggctcatgcctgtaatcccagcacttgggaggctgaggtgggtggatcacctgaggtcaggagttcgagaccagcctgaccaacaggcgaaaccccatctcgactaaaaatacaaaaattagccaagcatggtggtgggtgtcttaatcccaactactcaggaggctgaggcaggagaacctgggaggcacaggttgcagtgactgagattgtgccattgtactccggcctgggcaacagagtaagactctgtctctaaataataaataaataaataaatagtgggcaaaggacatgaacaaacactttcaaaagagatacagtgaccaataaacatatgaagaaatgctcatcatcactaatcatcagagaaatgcaaacaaaaccatgagataccaccttatacgagtcagagtggcttttgttaaaaagtaaaaattaatagatgctagcaaggctgcagaggaaaggggacacttgtacactgtggtgggaatgaaattaattcagccactgtggaaagcagtttggagatttttcaaagaactaaaagttgactaccattcgacccagtaatcctattactgggtatatactcaaaggataaaaaatcatttaccaaaaggacacatgtacccatatattcattgcagcactattcacaatagcaaaaactggaatcaacccttgtgcccatcaatggtggattaaagaaatgtggtacatatatcatgaaaactatgcagccataaaaaaagaatgaaataatgtccttagcagcagcctggatgcactggaggccattatccgaaacaaactaatgctgaaacagataaccaaacgttgcacgtttcacttagaaacaggggctaaacattgggtacacaaggacataaagaagggaacgatagcacttgggactactagagatgggagagtgggagatgagcaagtgtgggagttcagttagctggtgggaaaattttaagatgaagttataaaatatagacacaaatcttcttggaaggcggaaggttttgcaaaagtctcaggatagggttatggctgaaagccgcctaatccttacttgagtaaatagcttaaagtagatacaaaggaatgtagagtagtttatctgaatagcttgttactcatgtggtcttaagaccaatctttgatcaaccgggtgcacaaccgcagggggtggggcggggttgttggcaaccaggtcaattaccctctagcagtgtttactcaaaaccttttcatttaatctatactgaataaatgcaagcttcgctggctgatggggccggctgctacttttacagcaccttccttggtgtctgtgaggggcccagacccttagctggagtgacaggcgaatatctgtgttagtgtacgttattcaaccgttgttgggtcaaggtctgtgggacagacccggcaagcaaggactgataaactacttactgttaggtactatgctcactacctaggtcaatcataccccaaacctcagcatcacacaatatacctttatcacaaatctgcacatgttcctcgattctaaaatagaagttgaaaaataaaataaaattatagtctttccaaccccattccctatccctttacctagttttattctttttcttttcccactggacatattgtctaaaacatactatataatttatttatgtgttgattgtctacgtttcctcactatagtgtgagaccacaaagggagg

SEQ ID NO: 5033 - DNA, 13156 bp, Homo sapiens
tatacatttacatgaatataaattttataaatagtatattagttagcatagaataaatttgctgtgataattgtagcaggcagaataatggactcccaaagatggctacatttcacttccagacctgagaatatgttatctcacatggcaaaaaagactttgcagatggttaaggattttttttgagaccaagtcttgctctgttgcccagactggagtgcaatggcatgatctcactcactgcaacctccacccccagggctcaagcaattctcctgcctcagcctcccgagtattaggattacaggcatgcaccaccatgccccgctaatttttgtatttttagtagaggagggttttgccatgtttaccaggctggtcttgaactcctgacctcaggtgatctgctctccctgcctcccacaatgctgggattacaggggtaagccacctctcccagccaagttaaggacttgagatggggagattatctgggcagattgaagagcccagtgaatcatgggattctgaaagtgaaagagaaaggctgggcatggtggctcatgcctgtaatcccagcattctgggagccaaggcgggtggatcatgaggtcaggagaacaaaacaaaacaaaaaaattgccaggcaggcggcacatgcctgtagtcccagctactcgggaggctgaggcaggagaattgcttgagcctggaggtggaagttgcagggagccgggattgggccactgcactccggcctgggcaaccagcgagactccgtctcaaaaaaaaaaaaaaaaaaagtaaaaacaaatattctccccaggtgggagatcggtgtcagatctccaggggtggcactgaaggaaatcagcctgaaggccccccaaagttaaagtgactagcccactcccaggcttctttttggtacaccttcctgatcttaaccttaattactgggggaggaggagaacagttgaaaacacagctggtctaggagattattcggtttcatggaacaccttctctgtgcaggcagcgtccaggaacagctgtagaccaacagccaggctacccagcgtgtgggcccagcagccaggctggaactctatctctacttacagctgagtggctggcaggaagttactcagcctgtcggtcagcaacccaaactctgtgtttagttgtttgttcgctgacaaaatgaggcttctcatcattctcatcaacttcacgggctgctgtgaggaacacgtgagctgattccatcacagactcctcagtaggcagcagtaggttttagtgaacgggctatggatgctgccccactcactacttcctttctaggggaggccgattcaaatgcgtgcacacacacaaacaggatggcctgatgcagaccagctggtctagaaagccttcacggcctcagggagcctgggaggcggcctgggggagaccatgaaacagcagatcaccagagaccagagatcagagagaaaacaaaggacccagagatccacagacatccagaaccagaggcaacaagaaactgagagactcagaggcccactgagacccaggcagcttgtttgtgttacgaggggaaaaataaaataagaaacaaaagagagactcggggggcctcagtgaacctagagactcaaggaggccaggagattcagagacacccatagagagccagagacccgccctagcaaggcacaatcaatgaaaaaaaactcgcccaccaggccctcgcagtccgggctcatatcccggctcagcaccttggcgctgcatttgtcaagaggggaacagggatcctactccctgcctgtcctatggggccttaggccctggggtccagctggcctgccttcacccccttgtagttgatgaagctttggagaggctttcaaaccctggggagccacagctgggtgcgactggactcactggcagagaggcaggcggtgaaggccaagcctcgccccccaggaaggcctgattggtggacgggctgctttgggcagggccgccctcaggctatataagcgcactccggcggcgttggtgttatgctctgggccattcctgagctcgggtaaggctcgctgcaggggaggctgggttgcttgcgggcgcctagatggaggggcccagattggccctggggtggtgaccgcacgttctcctcggccccgtggttggcttctctctctcagggatgagggtgggttaggacgggagcttgaaatgtttgaagtggccccatcaacttgctctaaatccaggtattttctaatttcattcctccctgagggcctcagtttcccctcggtgtaagggatcagtggcctttcaactctgctttggtgaggggtcgggggtggttgtgagttggggcctagaggagagttaaactcttgggttttttttttctttttttttggccaggcgcagtggctcacgcctcaatcccagcactttgggaggtcaggagtgtgagaccagcctggccaacacggtgaaacctgtctctaccaaaaaaatacaaaaaaaattagccgggcgtggtggcatggcgcatgccgtaatcccagctactcgggaggctcaggctggagaatcagttgaacccgggaggcggagttgcagtgagccgagatcgcgccactgcactccagtctgggcgacagagagagactgtgctcaaaacaaacaaacaaaaaccaaaaaacctcttggggttttggagaccaagggcttccttttaaccggctgttaggcctcagcttcagtttcctcgtttgacgaccggtctgagttaacttacctccttaccaggatggaataagataaggcccttaagcacagccccaggcactaggaagccctcagcggtgcttgttgctgctgttactctggcctgtcctggggtgccaggggagggtgagggtgccacaccctcacctatagcaactctttgcttcttttctggcctcccactcttgttgcatcccggctgccttctgttctgagcccccaagtctctgcacccaccctccaccgtcctggcccctgtcaccaccctcttgatttgtgagcatcacgggggtacatgtaagtcctgagcctcctttctctacaggtcaccctgccccatctccatctcctatgagagagtgactcccaagaccccaccacttcccctgtagttaccacccaggtagagctgggggctgcagccggcaaggtgggggcaatgggttcctccgttttcgccagcaccaggaggtccggccttcctcagccttctgggtgagtttggagggctggcacgggaggggccgtgaggtcagtgtgaaagcagatgtgaagtgtggggtctcacctgcctgtacagacatctgagaccttgaccctctccctctcaggtatcccagcttaggcaggtgggaggggtgtcctctcagaactggattcagggccaggcaccgtgagtcatacctataatcccaacattttgggaggctgaatgggagtatcacttcaggccaggagttcaagaccagcctggtcaacatagtgagactcatttctatttatattaagaaagagagagagaaagagaaaaagggagaaaaagagaaaggagagagggttcagtggtggcttgggctttggagcttctgatgccactcttctccatggggtggtggtaacctgcgtcctgtcatgtcttctctaccctcagaggacagttttgtccagaattcctctccaaagacccctgcttccagatttcagataaggtgagggagtacaggctggggtctcttgagggtcaggttgagttggtgggaattgagtgccctggtctggtagggaagccactcaccttccatccttaccccctcatctttgcacaccacttcccaccattttacgactttctttccctgcagcaaaacctccctgggtgcaaatgaacctgggtgcaagcccccctcctcagagaataactaaccccccaccccgatctgtctctgcagtatctcctggccaggtgctggtctacttccagcgcgcccacctgaagctcagcgagtatacccacagcagccgttcttggccctgtgagtggtgggggcaggcagtggaggcatttgctggaggtgtcagagggacagggcagatgtgtggcctctgctccctgaccttgtgcctctgtggctaggtacctgcaaacgacatggaggaggacctggagggccccaaatgtgagatttttccatgggcccgggaaaagattggtgtttacgagtggggaaattcctgcaccagagggataagctttgggacggatgggtttccgggctgttgtgagccgccagtgctgtgaggaggtgaggctgggagcaacctggggtgtggggaaggctggggttcccaccccatttactgtccactctgctcctccaggtcatggcaaaggagccattccactgggcttggactcgggaccggcgcccccacctggtggggttcagagggtctgtccacaggtccctgttcgccttccccggggccctggccctcgccgccccactgttccccctgtggtttgccccagcactgcagcagccacttgcttagcctgtgtcatccaagtgcccttctctgacctctgaatgtcatcgccctccctcccaaattatctctcaagggtcaaaaacgcctggggtggggactttctcatcgtcttgcctccccgatgcaactggaaccaggcacctactccctccgcagtgagtgcaggatgggacaggagcgggggctggtgtgggagcttgggaggcaggagtgaggaccaacaatatgagagagagggcatgggcctggggtcgacgtgctgcccctcccgtgtgagcttggcaggtttcttctctggcctcactctttcctctccccagtcttcccaaagcctccggcacgccctgggcactgaactctgcagggtgaagaacagcacgcctgctggcccactgactgacacaccattggctgtctcccacccctgccccttcctcccagcctgcagcttgtgcccactctggtgccagtccctctaataaattcatgtccacaggacaccaactgtgcttaggtcctggcctggttccttgcccaaggttggggtggggagggggtatctaccagggttacaacatgtgagcacaggctcgtaacagcttggccccttcccattggtggccagttattctgagcctcagtttcatctcttgctatccatgcctatggatgatgagatctacacagtctagatgggattaaatgagatgggtatctgcagcccttagaagagggccagggagccgaacgtggtggctcacacctgtaacccagcactttgggaggctgagccgggtggatcacttgaggtcaggagttcaaaaacagctggccaacatggtgaaacccctttgctactaaaaatacagaaactagccaggcatggtgcaggtgcctataatcccagctactcgggacgccaaggtgggagaattgcttgaactgtgaggcggaggttacagcgagttgagatcatgccactgcactccagcctggacgacagaggagactctgtctcaaaaaaaaaaaaaaaaaaggccaggaacatattgggaaacaaaactgaatggaagacagctctttatttagtctagaaatgccttcagggccaggtttacttaggataagacttgatcccttccttgagctacagtcaaatataatattgtaattataataaacacccccctcccccaagagacatgaggactcaaaagggttaatttctttttttctttcttttttttttttcacatcactcctttattatactgatctggaaaaagatttagtacagttagctcagatgaacactggacccatgtggcagggccaagcaagtagaacatgattcagaaacagtgaaagacatacttggacaggaccaagaggcatttcactgtcacgaaacaaggcagaagggattgtaatacccacaccaggaagcactcctgcccctcagaggtcaaggagctgacctatattggtatgaggaatggcttattttctgatgactacatgtgggactatttcaacgccacgagaaaccccagaagggttattgttttgtattatttatatatactatacttcttaattaaatgtaacacataactaaattcaggattgatcccaaccttctagagccagctccctggcgtcagggaggaaacagttgtcacatcaccatgcaggttacattcatcttccactgaatgactagagccctcaggcagtggcctgactgcagacgagcagaggactggctcctgggacagacaggctctgttgcttctcctcattggtcatggcttagcatggttcctccccaaagtccttagtaaacaaagcaactcgcaaaaacccaagtcactacttttaaactctgttgataaggggagcttttccacagcttggactgagaacctgtgctctagaagtgctattctactagattgtatgaagggagtgggtgcaggagacaaaatggctaaaatgaaaatgggagcactggtccccatctgcagctacaactcaagatgtctacagatggggtcagtgtgacattgcaggtgggaggggcagagggacaagacaggcagggagggtgctcctggggacagtatctccctgctggccttcacttcttggccttgccctgggcagccacagcttccatggctttcgtaccatctcttcatcccccagaaactgcatgggcttgataggcttcaagttcttgtccattcatagacaatgggaataccagtcggcaggttcagctccatgatagcctcttcagaagaccctccagatgcttggcaatgccccggaggctgttgccatgggctgcaatcagtaccgtttcccctccttgatctggggaactatttcttcattccagaaggtcagagctctggcatagtgtccttcagactctcacaggagggtagcagatcttctgtgaggtctgcatacctcgatccttactgatgttgctatagaaaggatggttgggctccattggaggtggtgggactcataggagtgcctccagatcttcacctgggcctcaccatgctttgcagcaacctccgctccctggttcaagcgattctcctgcctcagcctcctgagtagctgggattacagatgtggtcaccacgcccggctaattttttttttgtatttttagtagcaacggggtttcatcatgtggtcaggctgatcttgacctcctgacctcgtgatctgcctgcctcggcctcccaaagtctgggattacaggcgtgagccaccgcacccagccgtgaggtgccagatttttatctttgcaaactgctaagtgggaaacagtctcttggtgaaattttaattcacatttgcttttcaggagctcaacatcttgtcatatgtttaagacctatttgtcttcttttatttgtgaacttttttttttgagacagggtcttgctttgtcatccaggctggaatacagtggtgcgatcacactcactgcagcctcgacctctgggatagctgggactacaggccaccatgcccagctaacttttgtatttttggtacagacagggtctcaccgtattgtccaggctgatctcgaactccgggcttaagcgatccacccactttggcctcccaaagtgctgggatttacttttattttatcttagagacagcatcttgctctattgcccaggctggagggaagtggcacaatcatagccactgcagcctccaactgctgggctcaagccaccctcccatctcagcctctggagtagcgggatgacaggcatgcaccaccacacctggctaattttctaatttttttatagatggggctcattatgttgcccaggctagtctcaaactcctagcctcaatcaatcctcctgtctagcctcccaaagtgttaggattataggaatgagcgaccacacccagaacatgattttttattatgtatatggagaaaaatactcctttaagatgttaattgtaaatgttttcttcagtcctcattttgacataactgtatggatttttaatgtagtaaaaaatgcaattttatgactttgggttttgtgtcatagttaaaaagactgtttccacactgagatgatacaaaaagtttctctttagctcctggctgtattttttttttttttttttttgagatggagttttgctcttgtgcccaggctggagtgcaatggtgcgatctccactcaccgcaacctccgcctccatctccgggttcaagcaattcttgtgcctcagtctcccaagtagctgggattgctggtgtgtgccccatgcccagctgatttttgtatatttagtagagatagggtttcacgatgttggccaggtggtcttgaacacctgacctcaagtgatccacccacctcagcctcccaaagtgctaggatacaggcatgagccaccgtgcccagccagcttctggctgtattttcgttttcatttttgacgtttaaatattgaaggttaacatttaatttttatttttatttatttattttttttgaacgttgtctcactctgtcgccgaggctggagtgcagtggcgcaatcttggctcactgcagctctgcctcctgggttcacgccattctcctgcctcagcctcccaagtggctgggactaaggcgcccgccaccacgcccggctaattcgttttgtatttttagtagagatggggtttcccgtgttagccaggatggtcttgatctcctgacctcgtgatccacctgcctcagcctccaaagtgctgggattacaggcatgaaccaccgcgcctggcctattttttattgattttttgagatggagtcttgctttgttgcccaggctagagtgcagcggtgctcactgaggccttgacccctaggctcaagagagcctcccacctcaggctccgaaaatgctgggattacaggtgtgtgagataccacaccagacctagagtttttattttttaatttttaaaaaaatttttattatttttttgagacggagtctcactcttttgctcaggctggagtgaagtggtgcaatctggctcactgcaacctccgccccctgggttcaaacaattctcctgcctcagcctcccgagagctgggattacaaacgcctgccacccaccatgcccagctttttttttttttttttttgatttttagtagagacgaggtttcaccatattggccgggctggtcgtgaactcctgacctaggtgatccatctaccttggcctcccaaagtgctaggattacaggtgttagccaccacaccagcctttttaaatgtttttttcattaggaacaacatattccaaacctataaattgagtcatctgtaattttttctaagatacaaattatgaatccaacttactttttttccagattctcccttttcttcctaatgtcttttattaactcatcttttctcaacagattagaaatggacttttatcatctactacattcctgcctgtatttgaatctgtttctaaatttctctgtctctattgatctctatgtgtcagtaaccctctttaattattaccttttaatgatagatttttgtgttttaatatctggtaggattagtctatactcattatgtcttttattttcagaagttcctacttgtttaatttgccatatgacctttaaatcagcttttctagtccctccttattcccaccagaagactcttaaaatttttcattgtgatacacttagagattaatttaaggaaattgacatctatatgaagcatcttcatatgaagaccaaggtgtcagcccccttgcctcgctttttggtggctagtgactcccaaatttgtacctctattttgagcacaaggtctgttctcacccctaggaatctcctcttggatagggggatcccaaagataccccataccctgatccatactgtccctccagcttagtgcattcccccttctctttaatctactcaggtgctcagccagatccagggtctgaagttgtctttggtctctcctggtgtccaagagccatatctaccagtgactaagttctatttttttttttttttttgagacggagttttgctcttgtcgccaggctggagtgcaatggtgtgatcttggctcactgcaacctccatctcctgggttcaaggattctcctacctcagcctccctagtagtggggactacaggagcccaccaccacgtccactaatttttgtattttttagtagagacagggtttcgccatattggccaggctcgtctctgaactcctgaccttatgtgatccgcccacctcagcctcctaaagtgctgggattacagggtgagccactgcgctcagcctgtggtatatttgtaatcactgatgaaccaatattgacaaatattattaattcaagtccatagtttacattaaggttcactcttagtgttgtacattcgcaggtttggataaatgcatgtcatgcatccgtcattacagtatcatacagaatagtttgctgtgctaaaaatgccctgtgctccatccctctcctacccctctgaatccctggcaacgctgatctttttaccattgctagttttgccttttctagaacgtcatatagagttattggatcatacagtatgcagctttttaataccagcctcttttacttagcaatatgcgtttaagttatgctatgtctttttgtagcttgatggctgatttctttgtatcgctaaattttaaagaattgccaaactgtcttccaaagtggtggtgatcattttaccctctcttggtgtatgacgctccagttcttctatatccttgacaacataacaacacttggtatggttgatcttaactttagccattctagtaggtgttcttttagaagcagtccttctagtggctttaatttgcattccctaagagtaatgcactcagtgttttttaatgtgcctatttgccatccagagatcttttggatgaagtgtctgttcaaatgttttgtccattttttgacaggcgcggtggctcacctgtaatcccagcaccttgggaggcagaggcgtgcagatcacttgaggtcaggagtttgaaccagcttggctaacatggtgaaaccctgtctctactaaaaatacaaaaattagcctgggtggtggcgggcgcctgtaatcccagctactggggaggctgaggcaggagaattgcttgacccaggaggtggaggttgcagtgagccaggatcgcgccactgcattccaacctgggtgtggagcgggactccatctcaaaaacaaaaacaaacaccagaaaacaaacaaatgttttgccatttttattggatttttattcaattgtaaaagttctttatacaagtcctacatcagaagaatttttacaaatattcgtcctagtctatggcttatcttttcatttttaatagtttctgcattttgagaaacaaaagcgttttattttgatgaagttcaatttattgatttcttcttcatttacactttttgtgtcatatttaagaaatctggccaggtgccaaagctcacaccttaatcccagcactttgggaggctcaggcaggaggactgcttgagcccaggagttcatgacagcctgagtaacacagcaggaccccatttctacaaaaaatttaaaaattagctgtgtgcgtggcacgtgcctgtagtctcagctactcaggaggctgaggtgagaggatctcttgagccaggagtttaaagttacagtgagctgtgatcagggcactgcactcctgcctggtcaataaagcaagaccctgcctttagaaaagaaaaaagaaatcttttcaaacccaatattgttagattgtctccatttttaaaaaaaaaagttttatggtttggccatttatatttaggtgtgaatccagtttgagttaaattttgatggtgtatcctaaatagttatcaaatccatctactctgcctgccacctctctagtttaaaccacccttctctgtccctggacacctgcgcagaagcctaggagctggttccacccatcactcaccaggttaggtatttcaggcaagtcacacctctcaggcctcagttttcctcttttgttaactgagggtgaaagtggggttagattagatagcggctcttaacttttgaggggtcgtgggccctagagtcctgggaacgctatgcagttcctcagcaaaatgcttgcatccacaacatgcaagactgcagcagctgctgggctggggcgcgagaccagcgaaaagccctgacttgggggggtctcgggagtctctgcagtctccccaccacacccccggcctccgcgccgaatcctggccccccaacttcttgcagcccgtgaagcggatctcagggtcctgggggtggggagagggggctgccgtcctgctcgcagcctctgccccctctcctgggtaaggtgacacatgggcgcttccaggtgggtgggctgagagcctggggagagaacagggatgtccacctctctaagtttccaggttcaagaaaccccagaacgttaagaaagatgggctcccacaattgcccaaccccatcccataggatgcacgcatgcggaaatcgggccgaacggggcagggacttacccaaggtcacgcagcgagcccggtccccctgcgtccccggggagcgctgagccgggacgcggcggtggggtggggaaggggagtggcgcggcctgcggggtgaggctgccgtttgctgagtgtccggcaggggtctgctcgctgccagcccgcccctcctcagagcagctgccgcagcccgaggtaatctcggccccgcgccggggctggtgggaacggcgggagcagctgcggtcgcgcggagcgaggggagctggggaccgggcgg

SEQ ID NO: 5034 - DNA, 19691 bp, Homo sapiens
tattttagaaggtaaggcggtccccaggggcttccaactggctttttctactgtaagatctcgtgttctaggggtagggtgccctctccctccggacccagctgagatgaacttgggcgaaaccacaggcagcaccttctcccacacgctccaccttgcgtgcctctcgcatgttctagtcctggagatggccacgagcgcaaagccagcacacagaggttctggtttttccccatcccgggcaacagccaaggcctgtgccagtccaaccattctatcctcccctaggccaggagcctcctgagcacccctcacccacctcccaggctccacgccacacctgaccctccctgcccgggactctcttgtcccagcagaaagcagggtgtccctgtccaggcccacctcgccctagagccagctcccacctagacagtgcagctcccagtgctcaggtgagggcgcccctcccctccatccgctcacatgacattttttgaaggccttttctctcaccccacggctccaatcccctacagccttatttccctggaaagcacctctcttctaacatactagacacttacgtgttattgttggtctagccccaccctcaactcgaaaccctgtaaagacaaagatttgtatcgctttccacctgaccctatccccagtgcctacaagacagcagggagtccctctgggccccttgggggcacggttcccacacgctgtctgtgatgacgccacccagtcacacggagggccctttgtgtgacagcgcccgtgcgtccaccaatcgccagtgagccagctctgggtaccggcaaggacagacgaggctcgctcaggtcacctgtgtgcccgctccagcattcaggcagtgttctcaggtctcggcctgtgggtcaccaagggtccctgaggttgcagctgctttcatctagtctgatgatcacggggtcttcacggggtcttcacggagctgacatgcgcactgatgggcaagacctgagcaggaacgcaggcaggccccgagccccggcgcagccctgaggggtttcgcaccgcacagctgcagtgtgaaacgccggtcacttccaaatgtccgtgatggagtgaaatggtcgagtgtgtgaggtcttgacccctgggtccacatcttttcaacgtcctgcccagcaactggaaggcgcgcctgccccacgtccacgctgaggaaatgcaggtgtgcaatggctgagctgccgtctggatctggaacacacgtatggagcacactttttactcaaaaaaagatgtgcaaaaactctggttgttcagccttgggtgtcctggcagactttttttttttggaaacgaacaaagtgagcctgtctcattcaaagaaaatagctgacagcatttgttaccaatataaaattcaagctttcatgcaaaaatcagaattctgaaagacaccaccatgagttcacacctttccaactgaaagacttttctaagattggtgatatcgccaaaagtgattttaaaaactgattaaggaactgtgtcagcatttggaatatccgcataacttagtgaaccaaaggccagcgtgtgaggtcacaaaggcatgatggacagagtccttgaagcacaagacggaccaaggattctcctgaaatgaagtagaagttcattgatagggtatcagattccacacacaaccgccagtaaaaaaccaccacctgtcggccgggctaacacctgtaattccagcactttgggggccgaggcgggtggatcacgatgtcaggagattgagaccatcctggctaacacagtgaaccccatctctactaaaaatacaaaaaattagccaggtgtggtggcgggcgcctgtagtccagctactcaggaggctgaggcaggagaatggcgtgaacccgggaggcagagcttgcatgaacccaggaggcggagcttgcagtgagctgaaatcgcgccactgcactccagcctgatgacagagcgggactccgtctccaaaaaaaaaaaacaaaccaccacctgtccagtgttgaataggatcacggaagaatataccgattatttgcaaaggttattaaaatgttccttttctttcaaatacacatctgggtaagaatgagcttctccattcactcctatacttcacaaccaaacacccccaaagtggacggacccagagcctgctgagaggccagtgggcttctcttaaccagagatttacgaccatgtaaaactatgccacacttctcccgaaaactttttgttttgaaaatatatttttcatacaattgttatttatgttaatatgtcatgggtttattgctatttgaaatgaatacatgttttctaaaggtctcaggtttaatttctaataagatattctaattgtattaatattggtcattagaactcacataagcaaaagttctttggcacttttaatgattttattttattttatttttatttatttatttattatttttttttgagacagagtctcgtctgctgcccaggctggagtgcagtggagtgatctcagctcactgcaagctccacctccgggttcacgccattctcctggctcagcctcccaagtagctgggactacaggcgcccgccccacgcccggctaattttttgtatttttagtagagacggggtttcaccgtgttagccagatgatctcaatgtcctgacctcgtgatccgcctgtcttggcctcccaaagtgctgggatacaggtgtgagccaccgcacctggcccacttttaatgatttttaagagcgttgaggggtctcagaccagtttgaggacggctgccgcagggtggcctgtctaggagtggcactgaccaaggaaatgcgtttcttcagctttaggacgggacaccaaattgctcctggaagcggctgcccacatcccaccagcaacgcaggagtctccatttcccgacgttcgtcctggcctccagcgccacatgatctcagtctgcggttccaactccccgactccgagggaggccgagcggtctctcacgctgactggccttggacttttggccccgttcttttttcatatgaatttaaacatatcgcgtccatgtcaaaaccaagaagtgatattattgagactatgtttggaatgacattataaaatgatgacattgactttggagctttcaggagtgtgcgaagtttctccagcgctcggtattatttagatttttcagtaagactgcatagttctcttcagtagaggtcctgttcctctgggttaaattcattccaactctgaatgggatatttcttcatcctcattttcaacaatttaagctggtttaaagagctcccagtcttttgtacatttggctttctgggtatacaaaatgaaatctgaaaacaaaggtaactctactttcttcatttcttatcctgcttattttattatctttttttaatttttttttttttttgagaccgagtttcactgtcacccaggctggatgcagtggtgcaatctcagctcactgcaacctccgcctcccgggttcaagcgattctccgcctcagcctcccaagtagctgggattacaggcatgcaccaccacgcccagctaatttttatttttagtaatgacgaggtttctccatgttggtcaggctggtcttgaactcctgacccagaggatcctcccgcctcagcctcccaaagtgctgggattacaggcgtgaaccaccgtcccggcttttgtttatttatcttaatgcattagctaaaaacgtcaaaacaacatgaaatctacaggtgaaaagcaagcacatctgcctggctcctgattctagttttcaatgttaacagctgctttgctgaatcttatcaaatattttagcaatggctgagatcattttttttctcctaatggaccaacaactaaggaagaaatcagaaagttgttaaggacatgctgctgatgaaggcaccaaccccacgatattctacagctgagttctgctgacatgaggcgatgctgctccgcctggagaaggtcgggcagcgcctgccccttctctaaggtgatggaagggcatgaatcctgactctgattagagagggcgagaagaaaacagaccaaaccacttctaacccaagcacgcagcgactcgcggtgtgctgtcccggatgcctggcagttactgaagtaccggtgcgtctggctgactctacagcagtttcagggtgaagaagttgctacatcatttagaacctccattgttatgtcttgtgggagcgtccagcctaaccttcctgccagggccgcgggcacccttcctctcgagggcttgtgactggctccctgttaggaggctggggaaccccacactggcccctgggagctgctagccagcctcagtggtcagcagctgggggcaggtgcctgtgtcatggcgggttcccagcatctagggtggcacaggtgtccagttggagcccagtgtgtttgttaagaaatgatttcttgggtggtgtcttgcctacgaggcgggtgggtcccggagctggaaactgctagagcaaaagctcccaaaactcaggcccgcatcagatgtgcccgcatcctctgtcccctggggccacccttccttctgcttctcggcaggtgctatggcagccacactggcttgcagagctggctctgtgcatctcttctcaaccacagggtcagcggcgtcatctggcagctgaaactggcaccgtagcgctggctgctgctccctcctcccaccactgccgccgctccttaaccctcacgacactctgcctctcatcccacagcaacatgggccgagtcctcggcacacagctctggggagatggctgaggagggtgggagctccaggaccctcagagtgaagtgaatctgcttgcccagctcccctttgggctccacagaacacgccggcctctccttcacacaggcggccgagggcaccctccacaccaccatggtccacaggctggtcccacacccagtggagtcaagctgctctcttgcctggctgacctcaagaccccctagagggtaggatgagctgctgtgcttgtcgcaggatgactgcagcactgcctggcaggatgcctgctgccacacctgccttgcacctgtctccacggcctgctcgcttggcagccagagggagatttttctgaaccctggtcaaaccatgctgttcacctgctgacccacctgccaacaaccttctatttgggcagcacttgcctaattccaggaggtgactcaaacacacctggccccagcctcctttgcagccaggcaaccagacgcccgagtcccggccaaggaggctcatagagaattcagctttgggaaagtggagcttctagaaagagtttgaaactggtggaagggccggcagtgaggtgagcttgcactgtggccgctccaccacccctctgtcccccaccgatgtcagacccagagctgcactggcaaaagactcccactaagcttgaaaagcatgaacactcctccccacgggctgcacgggctccgtggcctggctgctggccaccagcctcctagctgctcctgggcttgctccagtgtctctgcctctgggccttcgcactggccgttccctgtgtggccactgttcccagctccacgatgtctgcctccgtgtcctcaggccaacccctcccttccagcacttatcacaacctgcaccatttctctactgacccatgtgtcttccccgcatgggagcataagctccaagaggccaggcctttgtgtcatccaccatgatatctccagcacccagaacactcaacagggctgtgctgtgaacaggtgttacgacttttattagtgtcattgctaaggaggcagtggaaacacctatgctccaaacagagctgaataaaagcctcctggaaggtcgctggggttttcatcaggctcagaggccatttaaggagagacgcagaggtcctggtgagggaggacacagggttccctcaggagagagctcccccagctccagcctgccccaacccgtttccatctgctttcattttgggatccatcaatcagggcatcctcaccaagccagcaacagcaaactgtgcgttccaggaagaatgaaaaagtatacgtttaatatcaaagccacgtcaagtatcattgatagtaacgcactggagagtggctctaggacgttcttactcggagtgaaccccagaggccctggcctggtccgaggaagggcattcatgctggagactggagcctcacggtccccagggcctgggggtcctcaaaatacccctcagaagggacatcctgccagaggccaggtggaaggcggtctccctcgcggggcggcccccttgcccgcctggcctgagtggcctgccctgggtggcctgagcgtaccaccagccgcccggccccgccgccgccgccgcctgctggcctagacgctggacttgtgatgatcctctccagcagactcatcatgcgctcctgcagctgcaggctctgcacctgaggatgtgctgctggtccagcacacggcgcacctcgcggcaggtctcctccacggcgcgctcagccggcgctgctcctccaccatggcctccagcagccgcagctgcttcttctgcagtggcagctctgcaccttgcgcttcttcaccggccgctcctccgacctggaaggacagtgcggctgtggacgtgctggccacagagcctgggcacaccaggggcctcaccggaccctccgacaatcctactgggcaaatggggaaactgaggccccagggagtcaggtcacttactcaggtctcatattccatgtgcaaaggaggggccagaacccaccgcctttgacagaaagtaaaggggtggccgggtgtggaggcttatgcctgtaatcccagcactttgggaggcagaggcggtggatcacctgaggtcaggagttcaagaccagcctggccaacatggtgaaaccccattctactaaaaatacaaaaattagccaggcgttgtggcgggtgcctgtaatcccagctaccgggaggctgaggcaggagaatcgcttgaacccacgaggcggaggttgcagtgagccaaatcgcgccactgctctctgcacaagagcgagactccgtctcaaaaaaaaaaaaaaagaaaagaaagaaagagaggccacaggcattgccgtcctttgcgactagcggatgaccccaataccagggtcccaggacaatccacaccccttcggtctggaaagggtgggatgttctgggcgcagaggggcatatcctgccagggagcacccttcacccaccaaactgggcaggtgggggtcagccccagttgggggccaggggtggagagaccacccccagggagagatgaaggcagggtggggggtgctgggtagtgcagagtactcaggacccctgtagggaagccaagaccaccgccccacccggccttaggcagatggggaaactgaggtcccagaaggaagggcctgagattgagcccccttatctcccggcggcctagaaatggggccggcacaccttggtagagaggcgaaggacaggcacctagagggtgtggggcccacaagaggcctgggctctctccccaggactcagagctctggtagaggtggtgagtaaaggcagtccagccctgtgggcgcctcctgaagctctgctgctggggtaggggccacccgtggtctcagcagacctccctgaagggcaggagctgccaaaacccacagaccccagggccctgctccagtgcctgctcatccctggcccaactctgctctgagctgagagggtacagccaacctcaggggcgtgagatccgcgctttggcctgatcagggagggcagcccccacgccccagtcctgtgcaaggccccaggcagctgagctgagaactgggctcagtccacgggaacaacagccacaaatctcaggcctcctgctggtccttctagctgccagcaaaagcgtttttgtctcaggtcttcaatgagaaatcctgagtcagcagcggcccccggcatgagagggaccctcctcggagacgccttctctactaaagatattttctgacacctcctgtcagaaagacttgaagaccagggcaggggagaagctgtgactaaatccacaatcttcctgttcttgcctccaaatggccaacttctattttaccttgaaagccaccccaaatgtcccctcctcaaaagcaccttctctgggctccccaggcccaccccgcggtgtctgtcctgcatgctgcctggctcccggctgccctgtgagcatcttgcaggcacatcacgtggccagcacgggacgggtctgaggtgtgggatggatggcagaggggacgggtctgcccacggcaacacgtgatgaggtgcagcccgacaccctccccagtgctgagagggcactagcctgtgagggtggggtctgtgtgggctaagggaggccagggggcgcattctggggctggggcttggtctccctccgtgtgccgggccccatgctgcgtcttctctcctgtgatgtcccagccaccctctgagaaaggtactgatttacccccattttataggagggagactgagccagagaagtcaaggaactttccgtgcagctcaaaagtgatggagctgggagacaaaccggtctgcctgtggacactaaagccctccctggtctgaggccgcctgtccctggaggcgtgcccgcagccacggcctctgcaaccactgtggccgccgccgccagccttgccactcccgtccctttctctaaatggcgggggctgagataccccagggcaggggaaggacaagcagaacactacctgaacttaagggacagtaagctggaggagctgtcggagcgatcatcctcgagcggccttcgtaggagcactggttatacgggaagtacagaggggtggacttagcgggcgcgacagggacgcctcggtctgggacgtggagggccccggcggctggctgtccggcagttgccatcacaggactcggggaccttggccagaatcccatcaatggctaggtaatagggccgtcgggcggggcggactcgctatctgtcatgcattttaatttcctgaaacgagagacacagagccaagggtgagaaacagagctggcccagcccctgtcctgcccagcctcagcagagggcgcgccacgccggcacaggcaggagccgctctcggctggcaagggcctccccagcaaatcggccaggctccagggtcaagatgacaatggacttagaaagaagctgggcttcaggactacacgggctcagatgttaaaaaggaagcacacgtcccagtattactaaggttatctggcatgctgggaccttggggctggtcctattgcttttcccttgcttttctatagtttctaactctctgcaatgagcaaatactgctttttaaataattcattttgaaaggtagagtaataggttttattgtaataataaggtattataagatatataaatatagtgataatattttgtatataataactgtgttgttcgggagagaatgcctcagggagcgacagccactggcgttaagcacaggcttcagtgtccacagccctgagtcagtatctcatctccacactttgctgtggactttgggcaggttcattcacctctctgagcctctatttttatatcaatgacatagtgtgatcaaagtaagcccctcccccagctacagggcagatttaataaagcaaacagcaggcgggctcccatgccattcttggttgaacctacagtctgggcaggagcctagatccagcgcacaacctgcaacctgcccagaggccctggggtgggccggatgggccccttcccacactgctgatgcctcattaccactgggacccccagcacccacctactcctgcagacaggtcctgcctgagaggctaagtccccaggcctcccctgggcctcggctgccctctgggaggtcaagcaggagacacagggccccatggcggccagacagctctggccaggccagggaagaagccaaaggtgggggtggggcaggggcatctctgcctcactggacccagtacctcctaaggcccgtgcccactccccactctgcctttgagtgacagagtgccccaaggccgggctccaaaccaacctgtgctcggagtgggtgtctcctctctcctactcttgctacctgccagggtgtggcattggccgttggaaacaataagctggattctgaatgaggtgcccccagcaaacaggcaagccagatggtgagcaggggatgctgcccagggtggcacgtggctgtgaagacaccagccagagcgtgtgagggcaggcgctgggtgcccatccctaacctctgccccaggcttctcttctgccctacttgagccagcccactctttggagaaacgagaaaaggcctattctcagtgaggaggcccccaaactgtacttcaacaaaccatgctccacagaaccagccaccctctcagcttcttcagcccaacagccttaatatataaagagttcttgtaaaaaaaaaaaaaagaaaagaaaaaaaaaagaaaagcctctgctatggggagactgcgggtataaagaaaaaggacaagatcgagtcacccagccacagcttcctctgctaaggactatgtggccctgggcaagtcctctcatgctctgggcctcagcttccccctcggtgaactaaggctgactgtggcagcttgaggggctgcggtgtggaagtgcttcatcagccatgacgtgcagtgcaccggtgcagccttggccagcccagactgcagggtctggagtggaggcccccactctgctgcaccctcattctcagcctccaggaatggagacagaaaccctcccctgggactctgaagaggctttcagataaataatgaataacctggccagacaccaaccagagccagccagggaggtggtgcccggaattcctgagtcagaggggagcctgctggaacagtcgtggccacctcccactgccctcgcgtcccttcctcaccaggtgcctgagcaggactaggaggccacgggaacagtggggcccgggcagctgcctgtgtccaccgaacctctgaagatacccaggctcacacctcagccctacgtcgcaagccagccgctcaaacccaacatccgtcatgctcagcaccctaggtcccggtttggggcctgcctaggggcctttgggcagggccaggccccggacccctccttcaaggccagaaaaaatcaaatcaacgcaactgaaagcggagacctcacaggctggcggtctgtccgggccttgctgggcctcttccccactcccactagggctggggactgggggttcccttctctgtgctggaggccggctcctcgcctgaggggggcagtgggggtggcctctcccacaagggctcaggtgctctcagcctctctgccccaggctcacctgcctgacccggaggtggagcgctgagtgaggccactcccatcctggaagctgacaggctctccggcagccccaggcccaccctgtccaggccgcccacagggccgggtgctctctgctgccattctccccctgcagctccagctcttgctgccaccctcgctccgtgcaagaccctccccacacccaaaaccatcacccacacctgtgaccttcaccgcacacctatgaccttcacaccctgcaagaccctcaccgacctgtgaccttgcctgtgcctgagaccttcaccccaccatgacccctgcccacccgggccctgtcctaatgggctggggacccacgcactttaagatgctgggtgtgtgggaccacactgtcccctcctagacgccaacatctccctggctgggtggtcccctccggccttccctgaggttgccagggcaggaagggcccacctgccatgtagcaggagcagaggtggggccaggcgggagcccccacgctgggagtcctgggccagggcaggcctccacctctttcttcttcgaccgtaagccccacccatgcgctggctggtcctgcacctcacctggtgatttctggaaaaccccaccgtgaccctagggccagccccagtggggctcaccggctcatggcagaggctcgtggatgctccaagtcgcagagcactgagcctccttctcacttgcagtctcaatttcccaatgacgcagtaggcccctgaaacccctgctgagcttgggagcttggtggtggggagggactggcagccgccgcctccctatgggggagcagggtgtgaggtcagtgggcaccaccatagtgttgctgcctccgagggacagtgcccagaccgcccatacgtcctgggagccatcctgcctctgcccagcaccagccccacccctgctacccctcagctcttagactggtttcctgccttgctgggcctcagtttccccacttccccaatggaaggctgcacacacggtttccgtggccccgtctcaccccgtggggttctgcccatacccggccagaggagaccgacaggcagccacgacccacacatcgtcccgactcagagctccaagaaagtcaggagcggcccgccaccccgggcccgcccgtcctggtggggcccacactgcccgctcgcccacctgtactggaagtcatgttggtgatcttgatcttgatctcctcgcccagcctgcgctcgccggtcatctcgagagcttgctggccatcttctcgtacaccttggcgttgcgcttggtctgcttgagctcgcgaagaactcctcccagaccagcatgaggccgcgcatctcggcgtccgtccagttgcggcccgccggtgcttctccgcctggggagacacgaggtagccgggcccctcggccgccgcctgccggaggcgcctgtggggtgagagagcgcgctcagcgagggccccggcccggccccagcaccatgggcgggaggcgccgctcacgctcgctcgaaggcagctccacgctcaaaatgggcctacatctgacaggcaggaatttagttaaaagcttttaaacgggaaacgtcattttatgtcacgtttccatagcaacagagcaactgcataagctacaacaacagaaaccttttactgaaagcacaggaatcagggccgcactgacgggccatcaatattgcggcgagcgggccggcccaaacccagcggcccggctcccggccctgcctctcaccgccgcccaggcggatcgcccccagttcagtgccgccccggctcacgcaggccaagagggggcctcgggtgggaacagcaaggagaaagggggcaaaaggtgggagaaacagagaggacgagcgacgaggaggctggtcccccaacgctggccactggccctggtgggggtcctgggctgtgggacccttaagctcctcagaaggcccctgccttctgaactggggctgggccctggggctcctgggtgtcctgtcctggggtcctggggctgggccctcacaagaaccccaaacccccacccttggctcctttgcttctcttgctccagcccccaggcgccctgggccttaggtctgtggacactggaagccgggttggtcagagccaggccctgcccagaggtgcagacacagggtacacagacacgggctctggcaccggccggtgaggacagcagtgatggcaaaggtgagctctgtttgagacacggagggaatcagcccagcaagccagggggaggccacagggcactcctgggaagagccacggcatggcagggcacagtctgggtacgcagggagctgatgggcagccagattcggcacacgtgcggagacggggctcgaggcccaggctgcggggcaggcccctgtggggctgagggatgagatgcccccaggctggccggaggaccacagcctgccgagagccccagatgcagcggaccggaaccggagcggtggcctgggggttctgcccggagaagtgccgcccaagggcatcgcacccgaaacgtaacacatgcatgtcaggcagggctctgtggagcccacggcacctgtcagcatggactgtgctgggcgcggtgcccaggctaaatgccactgtggtcagcagagggcagcaggcacccccctgccctcctcaggcctgaccaactgcaggagactctcaggtgtggctgccccaagaagggcagctgagcctggaatgaggaggcatctcggcctctgcccgctcccctgctgtcctctgaggcaccttggaggtgggaccgaggctctcaggggaaggacaggcaggggcatggcgggggtgcccagccccactgtgggtgcccagcatagggaaggcgaatggggctccctcttgcccgcagtcaggataggaagtgtatggggagggccccagggatggtgaggaactcagaggggtctctgcaccccctacactgggtccctggtcaaggcctggcccaccatcagccccatgagactagtccagtcccttccatctgggcctcaggagacatcaccctactgcctggcactggggcatctccactcgactaaggtcagccctccgtgctggggctggcacagagagctctgtggagtgcctgcagatgaaggagtgactagaaggcctacctctctaggaagccctggctcctcaggaacagggttcggccctccccggtgaggtcagggacggtccgaatgccctttccgtagccatgactccaagggcagaggtggggctggctcccacatctcttggcatctcccggcacaaggggtaagcagaaaggcatggggtcccagcagtgttctgggtgcagctctagcgactcagcatggaccttagtcatgtcctccccactaaccttttcctcacctccacaacaggggtaacaggatctgactatatcacccagcatggtgctgctaagggggcacagccctcccagaaccctggggaggtcatggggcccctacgtgccctcacccccttccacaaatccaccttggagctgctggggacagcgtcaggcctactgtcctgctgaaggggcagctgctggccagtggacaccaccaccactgccgggggcccccaccggaggctctagaggaggcacctacacccctgcctgcccgagttccagtgggcgcagggaggcgggccctgcctggcagggtgccaccccacacccgcaccatcctccaggcagcattcccaggtaaaaggctcaactccaaccctctcttcccaggctcagtgcacatgggaggccctggcagggcaagctccatggcctttcccgaggcagagccctcacactgacctccaatgtgagacaagaaccaggcaggcagcagatggcagcaccaggcacccagctgctcctgcctgggaggtccccacatctgtcccctgctggggaggggctcgtaccttggcaaagctgcatggccgctgggaccctcagtcgctacggggtctcctagggccagaggctggtcaaccagcagcactgagggagaaggggcaggtcaggcctcggcaggagctgtccctggtgcagacctgggaatgggcggggccctgctgggctcaggctagaagcatgctccctaggcctccatcccttcaaataatgaggctgggcccaactagactctcatcctgctcagcatttctgggtggatttctgccctgcctgacaggccagcaggacatggggactgaccaagggtgggggcagcagggtcccaaacacagaagcccagagaggaggtgggcgtcccactgaggggcaccttccaggacagcagtggtgagcacagcctgtgcagatgggtggggatttggcagctgaggagttcaggcttgggtgaaggcagagaaccacgtggagtcctgggcccaaatcacggggggcccctggcaggctccggagcctggacttccccagagcaattggggccaggaggggaaggatgtggcaacactgccgccgctggggcagggtagaaggttgggcgggtgggctgtccagagggtaaggggccaggatccacctcaggaccagcctgtcctagcagttttgggggtagctgcctgccaagcatggagggcaggggcctgtgcacacaaggggaacccagacccacaacttcagcctctgcctccagtgatgccctgaccctgacctcacaggtccacagggcccacccagggccagacacccccgaccaggacacctggaggcctggtgtagggtggagaaagccggccacatggcgggcccccccagaggatgtggctgcaacaggactgggtcctctgtggctcaagcccttgcccaaaaggcagccaggctgctggggctgcagagcctgggggacccgcaagcgattccacatggtttcccaaaagaggtcctggtgatgacacaaggccgggtccacctctaccacagacactgtcacggtgctcatggaccagactcgtgggctcgcggaggatgcctttcccaggccccactgcaggcttccctgaggggtgcaccccacacccccaggaacggggcttctctgtcctcggttggctgtgtcacatcatgtagaggcaaggcccccctacccagtccctcagtggcggctccacccggtactcacctcaccctggctacttccctcatctgacttacatgctccacgcaccacgcaggggaagcgacttccagatcccaacaaagccagtagcagccaaatcaaataccaccgaaggcacagggcacagctcggcaaggggacagggtgtgctctcgatgaggaagaggaaggctgtgttgagggcagctctgccgtggcatggggagggactgcaagcccactcacgaggggttcaccgctgcttcccactggaccccggcccctcttctttcgaaattaccagccatgccaggtgtgctcagtgtgccaggctgtccacacctggaccaggagaagggggtgctccatttctctgaagtgaccagaatttaggtagctctgaaaggagagccactggggggccctggagcggtgtcacctatgaggagacagatttagggagctcaagtgcatgccccgccccaaatgctttaggcctgtccaccacatccctccggcagactgatcctatccctgctcagagaaagggggcccccgcacgtgcccaagaggagcaggcagcaggagtggccccttggccgactggcccccgtctctcctggcacagacagcagagcagggaaagatgggtggacgacccctgccaattagccagaaccagacgggacctcagcaaacattgactaataccctgcaccagaggaagccacagggtttttgttcttgcaggttggtaagacatctcatcccaagatgactacaccaccaatcaccaaggcttccgagaggctcgtccggagcttgaagcatccccgctgggctgagcagaggcttcttggagtaggcgctggttcagacaggaaaacaagctagaatagacggggcaggccctgcggacacacagcagccccggccacaccaaggtgggatgtgccagctgctttgggggttacctgggagcagctgggccagggacgcagtgtcaatggccaaggaggtggaagggtggtgggccctgtgagaacacagctctagtctcgtgctgggcctgatgacctgcttcagtgccatgggccaagtcctgaggcttgtgtatgtatataagcttatgatgtcacttgaccatgaaggctccagcagctccagcagctcccacactcccatctgcagggcaggaagaccacctgtactgtggtttgggaaggcccttgcagaacacccagccaggcccatgccctggggccacttcctcatccctggctacagaaaacacgggcctgtccctgctggcagctgcctgggggaccctccataatgccagatgttagctggtggacagtttctgcccctgctggagaagcacttaggagactgcttcctaagactccagctcgcaaggtctaggttctcatgaagcaaagcaagcctcacacagcaacaactgatggtttcatttttttcctttaatttggatgtacaatgtttgcagcagttaaaaaattaaatatacactctcgtcagtccttccctttgctctcagaagcattcaggtctgggtggggctccgggatcgcccatcacagccctgctggctccaggggagctcaagctcagctgacagtccctctgccacggtgcaaagcagtgagacctggacaaggaggccccacttgggtcagagcccacccccgtaggcaggtccacgttggccacgatcctccaaggctggcagttaccacccagattgagcgggagactctgctcttagaaacaactgaggggaaggcgttcctttgactgcaccaggcgtgacaggcacatgggggaagagcggcccctgaaccttccaggttgccttcagttgtatgcggcattctgagcagctccctccttcccaggaggcccaggcccggcaagcgagtgtctcgtctgagccatcctgagctctccaaggtccctcagcagctctcaagatcttccttctctcactcctacacgtgacccctctggaggacagctccaagtctaccctggccagcagcgtggtcccgggtcctccccgcagagggaggaagcgggggagggacaaagcccgatgaggtgtctgctgggaaggatgctcacaggtagcaagagaagcctgactccacccaccagacaacagaactaacctcactccaccccgcaacgggaggaagttccacctgccaggcggccaccaccgagttattgctgtctactatccgtcccgagctccacgtggggctcatctcagctcaagaggaggagctgttcattggctccgagggctctgaaatgaccccctccatgaagatggggcgaggggtgtcctttagggcacagggccttctcagatgctacattctgggtgtctgagggggttcagcttcacattttccccttgaaaggacacatgcgctggcagaaatgagggggacagtaacaaagagcacttggcagctggaaacatcacctacatagactcagctgggccgcagcggaagggaggcacattttgggaaagaaacacgcttcagtgcattgccaaacaatctaccctggtttcattaaaatctttcccgatattaccagcaggaaaacaaaagcaatcccccacagcccacccccaaaacttgacaaccaaattaatcacatttgcaacaaaatttgataatacgatgggtgcttgccacagatttttaggaacatgataaagtcttcctcccttcgcagagagctgatatggagaccatcttcgccagtgggatcctag

SEQ ID NO: 5035 - DNA, 20674 bp, Homo sapiens
acctagctgtttgaataggtttcaatttggtaattactgtatttagataattctgcctcctttcccactacccttcattaccaagaaaaccagtgcaaaaaatcaaagcatgaaaatggagacgcacattgagtcaaataggaaattgctcaactcagtggcttctgagtgcatgagcagagaccttttaagcatgtccttccttccccaggttgcaactgactttctccagggaagaatatattcccaagttgatcaaatcgtgtggatgcaagtcttccaatgtgctcagtcacaaaaatgtctgagcctgggatgtcaggtaacccacttttcagaatacttaaatcacacaaggagcattctgtttagtactgggaccacaatgcttaagctgagccttaagaagtcagaagaatcttaataagatttggacatgatgcccacagccctgatactacgtccaggcagctaaaattgcttgaggttaaacatttaagttttatacccagccaactttctcacaaaggatggaggtgatccacactgacatatgtataaaccatacatttaggatttaacatatgttaggttataatattaatccgaaattaagaaaaacagaacacaaacgctataggaaaacataacatatgaacaaagactagaagaaaacaaaaacctaagtagttgttttaggaggatgggttgtaagtaaactcgctttctcaaaaaggaatctgaatgtcattttactacattttagaacaatagaaggaaaaagttgtgtatatccagctggaaggaaacattgcaattggacattaatgcttgggtctgagctttctggagctaagttaacactttgggttatgtagcttttacgaccaatcaaagaaggtgtataagtcagttctcaaaagatagacatttttctacatttgattataaatgaattcagggaacattgggtgtagccttaaccataccacccctcatctcttctctcttgtaaggtccatatctttggcctctttgcctaggtcctacctcagaaacaaatgctttgaaaaccaaatgacaaggattaaaagattaaatcagcatgaagcttgagttgacacagttgtacattttcttaacccaatcatggacaactatatgcaggatggaatcacttctggtaccttagggagagagaaataattacaggactaaactattaagtctagccaattaaatctcaatcagtgtgctttagactgtttagagaattatctgctgatgagggcttcagtaataaaactggaaaaaacatattgctaaagtaacagtaatgaaattttgcaaaactagatctacttgcaccaggctaccaggttccaggatttggggtagggaactttgtagtcatttaaaatatttttgctagaaatcaagctataaaaagttaaaagatcaatgagatcttttcttagaaaatgtggcaaaactgactgaaagctggacttcagaaattctcattagtaacacacgcagcaaattattcttccatcttgtcttcttttcctcaaatttcacatttttgaggtaacattttggaatccgacagtattttctgaattgtttgttctgaacagcatactataactttatattttcacttagtttataaagaatattttgaagagcgagcgaaagcagaaacaacggaacttgctgcagttaatgctttaaataaagtgacttatgaatggtaatttcaaatggttccaagctgaaaaaaaattttagatttttttctagaattgactcaaagttgcacacctgaacttttgactcctttttcaaaataatttctgtgtgttttttttttaacattagagcatttgacatttttcctaaaatcagccacttttctccactggtgagcattgcagttctgttatttattctgccattaggtgctaaatgcatagggaaatgagatccttgcaatcccacctgaccacatttctaaccactctgaatttaatttccagttatagttttcagaattgtgctatttgtatcacaaggtaagcctgaataactttgcatcaattctaatttggcagtccaccattatcctaaattcccctagggaatactaataaccttctgattcccaggtaatgtaaggtaccaacgttgcatttgcattattcttttccttttcaaaagagagtatgtgaatagtttgaaaattggttttgtgttgaagcaaaagtatctttgatgacaaatagttcggagacctggcctgggataagctttatgctcctggctcacctttggagagggagtgggggcgggcacgggagtccccggtccagaggccctgcggaggtcagctgaggtgctgtcattatgtatcatgcttggcatctcatttctgaaagcaatcgtccagctccactcttgcacacccgtggcctccccgttcacctccgtcccccgactgttggggagcggggccctggctgcagttcagctggacccagggctctccgtgtccccaaggggcccaagacagcggctcagccttcagggccagctgcaggtccgaccctcacccagcgggcctgtttcccactcgcccacgtccccgctcccttgagtcacccccatatgcaggcccactgtgagctcggaggcaggagagcctcgctcccaattcccgctctctgccccctacagaaaacccctaaaggtctcgacccctcttaagccctccaccccggggagccttcccctgcagactccacgcttctgcgcggccttttgaccccattcgcatgaaatctgcagagcgaccgccccaaggaccagcgagcgctaatcagatccgttgtgtctgcagagcttcacctgaggcctgggtccccgagggcggatgagcgggccggcttcgggcccgggctgggggacccgcagtccgcggtcggcggggatggggaggggtggccgctgccgcgcggctcccgcgggccgtcgccaggtgcacggtccccctggtcccccgcaggaggacgccccctggtgcccccgccgccgccgggcctgggagctccagagcgggcgggagcggggtcggcggggctggatcttgacgccagtccaaggccgggtgactattggggtctgccgcgccgcggacgcgccgagccctctcagtgtggcgctgcccggcggcgaggggggtgggaacgaagcacggtcaagacagaaaacaaagtcagcaggtcacctggcaggttctggggaattatgcaacgaaagcaggggaatgtttgatgcgtcccactccacacccccccaaccttttttttttttttttaagctcctaggaagccggttccagtttaagggttgggtagggacgaccaagcagctcctctgatgtggttacgactttgccgaactcctcaagggcgagcttcctccccatctttctttcagtaataggaacattactctggagaaaaaaaaaaaaaaaaacatgaatggggtgaaatggtaggcttgatccaaaagcaacgccgagaatcaccctacgattccgtcaggtactgaactgaatattaggcaaaaatagtaaatgccgaaacctaaatcaacacatccaattttttttattttttttttaatctccccgggtctcaggactaagctttcaacagaatttaaagagttaacgctggccatagctctttgttttccatgctaacatttgtgcattaggactattttgttaactaggtatatgcaattcacagaatttcacggtaaattcccagaccaaatatttggctgaacaaataaacaacattatccattcctgaaaataagccataggagcggggaggatggaggaaggggctggttgctagaactggacagccacagggctcgtactggccctaggataatttgttcaagtactggagatctactggttccttttcaatgaatcgacgtttcagaaagttgctagaaattgggcaaaacaaaatgaggctgcctgagggcatctataaggggcttccctaaatgatttatttgagctccataccattaatcaaaggggcgcgacctggggggttggaggggtgggggaaggatccctttttgcggggagttttggaggactgtgtagtcttgctgcctttgcctgaggctctgatgtcttctctccacctgcgctctcggggagctggggttttggcaaccaccccgcttcaatttttattggtttccactaagctctccttttggaggagtgtaggacttcagtaattaaaaacaaaaatgaatcctgcttcaccactccactcccaggagcgtatgtaagaaagtgtgtacaagaatgcaagggtgcacacccacctagaaaaatgcaaacgccaggagtgtgcaccacacacattctttgggtgcacacacaccagcaacagcaatactaccgctcatatctacaccttcatgatggagaaatgcgctacagccttccccacagagaacatacaaagacactaaatgtttctgctccaaagggatccaagggatcttggtctgtgctggctcacttcatatgtgtgaattttctcagcacacatatgaatgagccagcacagaccaagattcaaggcttaatttagttgttggtggcaagtaagaaaagcaaaggcctctcctctgctcctcttaatccctacacccgtcattccagaaaggcattatctgcctgctgggagcccttaactgagggtacattagcatcctcctttttattaacttgtccaaaaattgagcttttccctttaagaaaccctagcacagaacatcagatctaccttttctgcccaagtccagggaagagggtgtgagggaggcagtacagagcgaaaaggagagtgacatttgactcgagatttctgtataatagtgggacaccttcacagtgcctgcttagaattctgaccctttagtatctgaccccattgtcaacccccacccagcccaatctgttgggtcctaaacttgatgaaggccttcacattgggaaaagaggacaagggaaaaagtcaagaacaatgggaaattctatcaagtggcatattaaaacagtagtcatcaaactttttgaaggtgggtacattatttgttacaaaaaaaaaaaaaagacaaaatagcagtgcatgcctgtaatccaaagaggccgaaatgagaagattgcttgagcccaggagttcaagaccagcctggggcacaaagagagaacttgtttcaaaaaaaaaaagacaaaagaaaaaacaaaagagtcctactggagaaaaaaaaaataagtttaaaaacatgccttcacacacacattatgatgttagtgacaaattagttttgatttggaaatatcacattggtacctgtaataactggagataccctaggtatcatgaaagcagaggtgggtatcatttttctagggttgagacctcatcacgctcgctgtgatacacctcaacaggtgagtgaaacagaagatgtacaaggggcctgaaatgaatctttaatctgacctacactcctttcatcccagtgtttctccaaggcatgtgtcatccaatgggagaggatactgcatccttgttaacattaaatagaaatagaaaacaattcatgctgcaattaccatctctctctgccaacagtttacttcctgtccctacaacttaaccacctcaggtaccaccttttgacttccatccagcctccaactcacctgaacagaaaaaagcctcatcaaaagagatgagcccgaaggaaaagagaaaggattaaggagaaaaaaaaatcatgattacctttaaaataatgactcattttatttttttcttttaatacgtagttataaatatatttgtcaaaatatatgatcaatatggtcaaaacatttgcacgtaaagtcataaataaggtaaggtgaatgtttagggattttttccttttttttttttttttttaaataaaagtccagcataaggaagcagtctgtgtagtgtgtgggtgagtggatgggaacgtgtgtgtgtggtgttgtggtgtgtgtgtgtggtgtgtatatctgtctatcctcaaggactgcctgatctcagcgcacccacatccctctactaccatctcctgataatttttcagtaccaccttatcatactatccaggtacagcatggagatggcactcagttcagtgggcacacaacaggctttggggaactggaattgacagaattgaccagggtctgcacaatggcatggttggttgagttgaggtgtcagccagtggaaaggggcagtccccatggcagtagaaggcctggtagcctggtggggcacaatccagtcattccagcccacatcgctgaagtccacatagagcgagtggcgccggcgttcttattcttcttcctggcccgctgtgagtgatgcttagggctacgcttggccctccgcgtcgggtcaaggcatggccccggccatcatggccaaaggtgaccaggaggggccggactgggcccaattcccactcccttgaggtaacgatcggctaatcctgacatgctggccctgtgggtccgagtctgatggaggtgagtcacctcaatggctagcccatagtttggctgctctcccgggtccagcgaaggaccgcagggctcacatcaaaagtttcccaccgtgtcacatgtggtggaccagtctcgtgtccagtagtcgtgtgatgaggtgcccaggcaccacttctgtgggggcttcataacctcataaatgtttatacggtggaagcccctttcccaatcagggcctggtccacctgctcccggaagagccgaagctctgcagaggagatcacctcgttctcaggatgctgctgaggttaaagaggaaacgaaaagcagagttttcactggtccctgggatgtctccagatgttctaggcacagttaggaaggaaggggaaaagaaaaagcatatgaactttttcaaagatggaagagtcaagagatagctcagggttgggcaatgaatggtgaattctgctatgcaggggaaacctactgggggaaaataagcataccccttaatttgaaggagcagatagtggggcagctaacaaaccagcaaaatgtagctagcatttctcaagcaccaaagacagaactatatccagcctccttgatatgtctaataatttctatgtgtcaactcctctatggcccacaatcagactcctcttttaaaccccccaccttggctttgtgtccacagttttctttcaagtggttgtaaagaaaaagaggggccaacagagcacaggcaggaggaaacatgcagaaaccaccctctccctcttccactattgagtatgttactaaacatttccccagcgatcttgaaacacagagcatgccttgttgatcatgttacagaggggaaaataaattccaacacagaatgatgctggtggattaataactcagatttactttggaaaagaaacatccgctaggaacattcagatcggattacaaggcccctattgaataaacccgacaaacacacagctgtaatttaaattcagtaggtgctttgaaaaaaacgggcagaaaacctagcagaaaaggctttgaatagcaaaaacacaccgctggggctagcccacgtctgagtgctgtcattccccttccccgaacacctccccctctgtctccaaaaaataagttcggcggcagctctgcaaattcttggggtaagcagctctgttcctcagcctcctggactggggctttgatgtaacccgaactcttttccccagggctttcactgcccctctagccagtcccaccagccctcccccacgcagactggggaagagactgaccttcgtggtggaagctcctcacggtgttggcccggctggccggggctcaggatactcaagaccagtgctgtggatctgctcttcctcctcctccccagactgagccggtaaagatcccgcatgtagtccggaatgacggcactcttgctaggctgcgggcggggcgcagcccaaacatctgcagaagtgtcgcctcgaagtcccgcaggagctcatggctcgccctgagcggcgtcctcccgcgtggccctgaatctcggcgacttttttcttccccgtccaggtatcaaactagcatggctcgcgcctcctagcaggacttggcataataaaacgacctcagcattcggttaccaggaatcatggtgtctctggggagggggaggggagtggaaggtaaagaataaacaaacaccaataaatagggagaaatagagatgtgtctgcatatgcatttgggctagaaatggaggggcaagatggaaagcaggtcagaaagatcaagtttgtgtcttcccctcacaccacccgcccacccaccagctgcagccatgcacggcctgaaagtaagaattccctgtaattacttggtctaacttgtttacagtcaaataaccccaaatcagatagcctcatcctgttaatctttttttgtcctaactgctatctgggccatgatctcagcgtggcttctgaaggataaacagttaacattgagggggtgaaaaggggtgggggagggagaattaaaaggcattgctctccactttagaccttcagcttctctcccttttcctccaccctcagagccaactttcacaacttccagttggttcagagccagagggagggaaagtgagaggcaggggcgggcgaagacagagggcgacagggtccagaagccgagaaggtggtctgggagctaaccggtggcttgagggcttattttattgtggccgatgagtttgaaatattcagccaaaagtgctgatcgtgcccgctcatccccagggaaggggtgagagacgattccggagagacctctgtagttttgacaagagagtgggaacgcgccacggagacactgggggctctcccagacaagtggataggggaagggagtggttagccctcaaggtacaaccccgggctttcatctctttagtccctcgcgctcccctttcttgcaacgctgagagggcgagtgcgcgctagcagcactttaaaggaacccgtacgcttccagcgccccggctgccgggccaagaagggagcgacagtgcgccagggagcagagtgtggatattgtaaaggaggtccgacggaagggacagccggcgagaggggtggtgagggcagagtgaattccggggagggggaaggaagaggtgtctactcactacagaaaacaaggcatataataacagtccatgattcttgacagccaatcttgaacaaactgctggaaaggctcagggaagctgcagcagtgcgttgctcgggatggcactacggaatgctcctaaaaggaatatttgaatataatgagactccaccgcagacaggctctgtttttctccagcccctcggagtcacgtgagcgccgaggcccctcccgcggcaggcggcgaaagggctgcgcgccctcccctcctccacagccccccgcccctcgcgggcccgcccctccaggcgagccaacctccgcgcccgccgcccgagcctcagcggtccgggaggagctcccggcggcgccggcagagccctcggccggtgccccgcggccgccgcgctcccagggctactggcgcagccacggagaacccggttctcggcgcggtgcgtcgtgctgggcccccgcgccgggccacctaagccagaggatttggggcgcactgaagggactgcgtctcccagctcgaacccggcttagtggggccgggagcgaggtcgggaaagtctcacccgcccaaagcctcaccaccgagaggacttaaaaaggaaagcgcagagggaccctgcccacgcgcgtgtacacacacaccccccccacacacacaagcaaacacgagctccccgccacttcctccccagggtctcctcaaggccaatattgctcccaatgacagccagtcaccccttggcgaacgcctgctaaggctccgaaggccgggccaccgatctagctcccggctgaaagcagccgaccttgtcacgcgcggggccggaatgggagggagggtgttagagggtgatcgctgtgggaaagtgagagggagcggctgtagtcattgctccgggtccattaccgagaatccccaaacctagtccgccgctgcgtggccctctccccatgcaaagcagacccccgaagaagccatgccaggctgagggacagacgccgggctcgaagctccgggcagattcagaaagaggcgtcgctgcagaaaggacgcatcacagtttcagatcttaatgtggccgaggttttacaactcccgacccggcgcagaaaggaaatccaccatgttccccggagtcgagaaaacggtgaacagctttcggcctgcgctcgacctctcgtctgcgtctctctcgcctcggcttcccttattttttaaaccaccaccacactccttccccgccacttccttcccccacccccttcctccgttgcaccagcagcagagtcgcacgcacaaatactccttcaagaattttacctacctacagttcaagcagttactgggatgtcctgctaatcgaagatgctgccgcgcgcgtgggtcgctctgcgcaagggcctcttcgaaaaccgactaggcgcaactcagcgttcagcagggccgggagcgccaggtcgtccccggggcccggccccatgactcctgccccaaagcccactccacccgacctccctttcctgaggctgttccagttgctgctttgggtcgctccggagctcaagaactcgggttgcctgccgccccactcccacgcacatacttggttttcttcttaggggcattggcaggtagactttgaggaagaaagtaaaggatcgaacagctcagccctccctcccgaccgtggatgcccggagtcgaccaaccctcaggtccgggtgcggaggccgcgggcgcccctgcgcgaccgtccgcgcccggcaaggccgcgcggctttcgcctttgctggtcccgcgccaccgctggggcgggctgcgaaagggtgggaagagcaaagggtttttttgttttgttttgagacgcagaagccctttaaaaagccggcgaggagaggtccagaagtagagaaagcagacggaggcaagctgtgcccgcggggcaagggacagtagaaggggcgggcgcccgggttccccggaaaaccctcggccccaaggaattcctggggcgggagagcgcggttctaaaaccgagaggataggaaggggaagggggagtttgtttcaatttcggattcaccaggattcatctctagtcacatttttcttctcaaattttaaatcgaaaagataaaagccaaaagaactttcatccccagagctttttattgggggaaagaatgtaactcggggtggttgtccttcacttccctactcgaatcttctcctaatgccgaatgtgtttacaggtagcctcagtttaccaagtatgtatcttttgggggtttaacctctccaaagccttcaactcacaaaccgcgatccttggaaaccatcctccaaagcagtgcttggggcctctaaggcccccggaccaactcccgctggaagaagcctgcagggactcgggaatccgggaacctttcccgtcggttccgggcctggagggccaggaagagccgcgcgtccgccttcgtcccgccaggaactccccataggacacgacaccgcaggaacaagcgtcctgggagccctgggatcttggctgtcgtctctagggaccctacaccgtgaaatgatagaggcgaggtccttgggttccgcaagtcgacgaaaatagctcgtggagaaggcgcgtcctgcaactgcattcgcaagctctcagggcgccccgccagctgggggccagattgggtgacactcccctcgcgcagcctccggagcggcgcgcactctccagaggccagcaggactgcgctctctaccgcgaacctgctccagctaggtgttctctccccatctcgccgtcgctctgccccctcactcttctggacctcagagccggttctctccttcctcctcccgcgctttccgtccggggatcgcacctccagcccgtgggcaacgcgttcagcccaagaccccacagtttttcccaacgaccccctaccaagggcttctcttgtttctgctctcctgccccgcacttcccaaaggtgagacttcccagggactgctggacagagaaggcctgggcaggggcagtagccgatatttaaaggttttcagcgccagcatccccacctccagcaccactattggaaaataattaggccacctttgcctcggtcacagcctgtgaccagcttcttccccccaaggaggctcctagaccccctctcctgtctcccctcaccaggtagccttgctcaccataggtccctgcagtagcgggctcgcagcagcagctcctggggacctctgaacggttgcagtgaacctgggcgagggccggggacgtggcgctgcaggctcgagatagcttggacgggaatcccatcggggagacaagctagatctcagccggagcagcagcggcgtctcaggctcgcgtccctcagctcggatgccacactccctagcttccgggccgggctccgcgctccttccctccctccctcctcctctgccttctccatcttccttcctcctctttccctccctcgctttctttctttccttcctcctcctcttcccggcggcccctccctccttccctcctccctcgctcgcctccctttctggggatgggagcccgcccacatcctcccctccagccgcccgacctcgcctagcaggcccgggtcccggaacccaggcagcgcccgagtccgcagctgccgtcggagctgggacgccgctgcctccagcttgggaagcggctggggctcacctggggaccacgtgcggaggtactagaaagcatgcaccactagtcgccgtaccttccaaaaatacccatgggagtctgggcttccctgagtttagtgaactgctgcccaaactgatgattaaaacactgagtaatcaccatttaccctgagtaattgagataatgaaacacctctaaaatcaggttatggagaaaggagctgttggatcggtttaaaggtggccttccataaactgttaaaagatttccaaacgttgagaaacaggctgtgtgcgaactgtgtgccagagagagatacctcttgggctgttaaaaggtgaatttccttccaaacattcttaaagtgcgttttgtagaacaccttggtgatgaccctgaggtagaccccagtaatgagctcacttccctcctccccccaaggcctaaagacagaggtggcctgcagacaggcggggccacgttttttacagttagaaaaatctgtttctagctcagaagccgtcttaagaacgacacagcagttatttttgttggtgttatggttgttgttgatttttttgttcatttttgtgtacctaagagtcctgacactctgtctttccaaggagataaccacagaagcagtaacttttaggccacagggagacaagaaaagatgccccttggtctgtttttaaaggaagagggagatgaggaattggccctttcatataaaaacattttagtaatcatattagcagggaggtgaatgtggtggcttttaaaccttcccaaacaggaactaatttcacacactgcctctgatgagctgtgagggagctatcagcctcatctctctgttttacaaacaaggaaaggaaggacaccaggttaaagggacttgcccagatctctgaagtaaatcacagcctctgctccagagcaatgcttcagggaggggttgaggctcatagcctgagctccaggtagccagaggagtgctgaagactgagcatttcctgtcctggatttctttccctgggacagacatgacactttacttctctgcaaagcatttaggtctttacttaaacagatattggccctgggtggctcatctaaaaaactttacgtttatacaccttcgatatttaaaaaacaagaactacttcctgtgtggacacagattacaaagggtgggaaatatctgagatcagagaagcaactgtcagagcaaggcaagacatcctgccatattttccatctattaggcctaggtcttttggcctaatgcaccaacaacagaaacaagctgtatggctttgggcaagtcttttcattcctatgagcctcagtttctcatctgcagaatgaaaggattgggccagatcatctgcatgctccctttatatttgaaatgatttgattatttaattgtaattttagccaaagtccgtcttccttcattttaagtcctcctgagttcactttctctaagaaccactgattaaaacagggcagggcaataacaccacccaaaaggaggacaaaatatacctgtagcttccaaatagtcaaaatcacaattaattataaaaataataacagaaaattaaaactccattaaatagttacctaatgtttctcctgcacatcaggcattgtgctcctttagcatggtacctgaagtcaggacagattaaatgctcacgagcccctaaatcaatcactgttgttttaatcattaacgaaatgtggttcttaatatttaactcagaaacaacagtgatatgctggacttaaaggcaggactttattttactttaaagaccaatgtcatttcggggtttttttaattccaaaggtttttgaatgacagctattgtctattttgctgcagcccagacactaaagtggccactgattggcccatccatgagtctgtgaactcacagtccaggagtttccaattaagctacccgacataccatgtttagacccctgattgaatcttcagatatatgacgagagaactcagctttagttctcttgggacagctttattctctccccacattttagatgggcgcaagccatctgttatcagctgcttttacccactccccttttccccccttactcatgccaaagaacaaattacttgttggttagagagctaaatcaccacagcctagtgatcagagttcgtgagaagaatcagtttagttattttctgtatctcaacttacctgtgaattttcatgtttttatagaacatggtagatagaccaaatgaaactgacccttaaagcacattgatgaagaggggaaacccaccataattcaggagcaactattgccctatgctgctactactcaatgaaaggcattcctttgttgggtttttcctggagaacataagaaagagtagctggtcaatagcctgtctgcgagcccttgggacagcctttttcaaagatgttctcaggactataagcctcagagtagggtgggggtgcagatgaaatgcagacttctggtcctgccccagatctggacccagaaatctgtatatttcacaaggttctctggtcatctgagcacactaaagcttgagagctactgttttaaaagttattttgtttccattttctagctgataagtaccattaaaaggctgataccaagacatcattaaacaggcaaagaatatgtgggcttgaactttataaactgttaaatatggcaattatagtatcactatgccctgaaccaccaaataggtctatgcaagtgaaaagataatcctatagatacagtagcccttaattcccatccccaattaagaaccacatcaggtcttcaaaccttcttggccaattaggtgtctgtgaagctacggaaggaattcccagaatcactgctaagttttgagaagcagtaagatagacaattggaattggaattcgaattcgaattggaattggaagtggtctctgaaattggctaaaatttagttttcctcttattaatatttatcatatcttatatatttgccctatatatcttagcccttacaacaacccttataaaatccctgtcctacagatgagaatctgaagtttaggacgttatgtaagttgctcaaggtcacaaagctagaaagtggtggaccccaagtccaaacatgtcagtctgtctcctctccctgggcaagtgaggggtatggtggatggatccccgagcttatcctggaagctttccccaggccaaggcaccagctgctgctccatcctggcagcatctattaccaggaatttcaggatatcttcccaagttcttagataacaaaacaaaatcaagcctagaagtttgtttcttcctgacgttactatataagcccgccttagggcaagactttttgtgacctttcctgagaaaaaggttatgatcttgagaaaggagctcattatctctgctggtccaagtttcctcattgtaaaatgtggagcttgaacagggtcctcacaggtctttctcggctctggaatacagagacaatatatcctggtagttaaaatcacagtcaaattgcttaactccaatgtccactcattatgctttgtctatatagatctgacccatgaacatagctgtgcaagataactactcactgtcaaaatcatacctactctgagcaattagtttttactaatagctgagactgaatgacatgtccaaaaagcattctccgtctgttttgcggattcctaacactctaacttttaagaattttttttcctgtccctcaagctaaaacataaactcattttcttattctgatctaaagatgaacttttaacccaattgcacaagttgttccttctctaaacattaatattgttgccaacctttgatatgcctcactcaaagtaaataatactggatgctgaattttctcatgacaaaaagaaaatccaatgctatttcagttccctatgttttaaattgcgccttgatactttctggaatatggtcctttctataaaaacccttcaatattaacatccagccaggtgcggtggctcacacctgtaatcccagcactttgggaggccaaggcaggtggaaccgaggtcaggagatcgagaccatcctggctaacatggtgaaaacccatcttaactaaaatataaaaaattagccaggcatggtggcgggcgcctgtagtcccagctactcggaaggtgaggcaggagaatggcgtgaacccaggaggcggagcttgcagtgagctgagatcacgcactgcactccagcctgggcgacagagtgagactctgtctcaaaaacaacaacaaaaacacaacaaacaaacaaaaatccaaaatggacagagacttctaaatgaacccccagtgatatagacagatgaaaagactgtttttatgtcataacatgtttaacgtggatggcagacagggatggatatgaaaagtcttttctaaggaatgatcaggatgggattggcatgcaatgacagtatttgggttttgactattctcagcttcctctcctaaaaaaatagtcgactgcactcattaattctacaacagggatgctctttgaaaataaattattttagaggatataaaaaagataaaccttgaaatttctttgttttgtgctcatacatccttctccttctctttttctgacccagtgtgtgggaacagtgtaacctgaacaagaacgtagtgtctataggatgagtgacactggaagcagaggcagagtgctacatggacacctgactgtaccaaatggttattgtgtttctcaatcagacgccaattgcggaataccagctgatattctaccctcaactcatgctaaagctttctagtctttctcaaggaaacctgtccaaagggatatgtgatcccaggaattattttgtataagtaatacttggatgtttttactaatagttcacacatttcacagccctttggggagagcctttttcgttaatgttctgttcaagaataattgcatagtatttataatcctccagggattaagtatagatgtaatacacaactcaaagatgcttgttgatgttcactttgtaaaattcatcaagttgtatacttgatatttgtgcactttctgtgttacatattttttaataaatacttatagaaactatgcttttgaaatgatttttttaaagttattttctttgaccttagttgaagcctactagcaacacacaatgtttggagccaaatggttaggcagggcaaaccagggggagcctaatctttggtcctctggtggccacagcacctgagaaactgaactgtgcttcaggaaatccactctggggccacagaagaaagaacagttgtaccaaccaaggcctgcctctggggaccagtacagcccatagcagaaggcaagatgtctgacacaatcctggcagttccttaaactcatgggagggctggtaaccactggaccagaacagaagctcctggaggatctgagacttgtgctcagctctttccttccttggcttctcttgctaagaagctcagacggcactgcaaaccatcaatctctggggcgaaatggcaaggtcatcagatatgcatttctaggatagaaatgcaggaaggtaaaacttcatccaaaacagataacagtttaagagaaagtatgggctccacccccaaattctgggagccctgggcttaggagatgggctggggaaaggttgtgatagagaaaatgggactcccaagtgactgtcttggtccctcaccacagctgaatccagccttgatgcagagagatggagctaagtgcatgtggccggactttggcccttttcaaatcttgcaaccacagggccaggctcagagattgtgcaaactcagtttcaaggagtcaggaaatcaagacaggtgttgagagcctgggctgcaagtaaagtatgaggtgaagggttgaggagggagtcctgctcttgaggagcagcccagatggacactccgctcacctcctccaggagaagaagaacaaggtgtgcacgcggggaagttcggagtccctccttgtctttctagacgcagctgcgacaacatgctggggacacgaggctcaccagccccagtacctccccacccccctcgagccagctaagcaggacaactttccagctccttatccgcattccctccctgatcggggcagactgtacttccccgatgtccgctaactaacgtaaagaaacgtccgcgtgctcgctgataccccagggccaccggaggagagcagtggggtgtgagaactaggctgtgtccatggctggtggtggggggagcggctactgcgccttccccttgggcactcctctcgggtcctgaggcgacgccctagtaagcctccacgcacgtcagcgaagggtgggtggagggtcacctgaccgcgccccacagctggctcccgcgctctgcccaccgccacgccaccttcaccgcggatctcggcactcccgcctttctcttgccctcgttatttttagttcggctgctgcacctcctgcctgcaacagctcgccccactctcagactcgttttgcaggatttgtgcccctggtgctaacctgatccacacttgaataaacagcgagcgcccgggcaacctgggcgagccaccgcgcggaatttgcatccatccgcacgagaggttcctgagacgctaagcgttctcgcctacagaacttggaaacaatggaccatccccagaatgaatgaatgaaatttttaaaacgaaaggacaggaggtcttaacgccctggcagcggcagagcggctcctgggacaattttgtcccgctccctgacgttctctccgtgaagcctaaggggacgccggggcaacagggtacaggagcccgatgatagtggcagaaaattaaatttggatagtatttgttaagcttgctttcctagtagctgccccctccactaccatttccatcttaagacaggctttccaggtggcagaggatgcttttctgatcagttaggaaaaagagcgtgctcccccaatgtctgaatttctgtgatggctgtttccacttgccaagcccagcggtggtacctgcaagcttatgcgatagtagcaaatgggatttataaggcctggaggaggtgtgagcttgccagaggccgcttcagatagtcaggcctggtgggttagtgaatcattgcagaacaacctcaagggctccagccttcctgcaagcagtcaaacaaaaagaaaacataacagagtttcctttattcagcataaagggatggctgctagctgttgaagcttttccctcagaattctgatttttattctgaaaatctgagttttgttcttgttcacctccaacaagttaggatgtcaactacagatgacaggtaaacatgcctcaaatgtgctgtggcactctgtcacatgcctagttctacagctagaacccaaggagtttgatgatccagtttatttccccagtt

SEQ ID NO: 5036 - DNA, 100000 bp, Homo sapiens
gtccattcagtcggttgggaggcttagaattttatttttgccttacagtttcccaaaactccagtgaacctcgcctctcctttagaagtgtcgtccctggagcccacgaaaatgtctgaagatctgcaagggccaccttaaagcccgtgccaccttaagcaggccccacccctggccagccaatgggctgacagcagcagtagctgctgccacagtagctgactggtcaccctgcccccagtgctcacaccctctggccagtgcctggctatggcccgactgctcaggtctgcaactgggagctgttcccctggaggggctactgctcccagaaggcaaaggtaccgggagagagagaagtcctctggagggatgaggtggggagcggggagcagggggttctgatcccaagttcctgggctctgtgacgccccagcaccaagtgacctgaccttgggcaaaagggcactggcttaccctgtggcaactgtgggtgggtgtagagtgagatcagctgagtccccactgctacatgagtggggctgggggagtcaaatggatgcccctggaataaaacacacctgtggaagaggccctgaaggaaagggcctgggttccaggccaggctctgtccttaacttggcctccattctcatctgtaaaatgggaagaaacacatcccccgccccgccgcgccccgccccccacaagggcccagaagccccaggcaacgtagagtggggagggggcagtggaagcttttcctcccctaattcccttatcaagctctgagttccctgtggctggggtggtgcttggttggcccggagaaaggaggaagtgagggatcttttcggttgctcaggctgggctggctattgaaggaccctgctgatagcctttttggagagtgaattctggttttttatttggatggctgggcgtgtggctcacgcctgtaaccccagcactttgggaggccgaggcaggtggatcgcttgagccaggagtttgaaaccatcctgggcaacatagttaagaccctgtttttattaaaaaagaaacattaaaaaaattctggtggcgtttttttctgaggggaaactttgacccccaatggcctgtttggaaaagaggcatttctggatagtgggtttgtttaaagtgggcccacctggcaggatgttgtcagcggggcgggcgcaggggaggctcactccagcctccagcccccagcccccccccgacactggggcagggctgtggccccatgtgtctttcgggggaccctggcagtggtttcttccctgcagggagagctctgcagggacttcgtagaggctctgaaggccgtggtggcggctcccacgtgtccactgccgcggtggtccgagagcagcacgggcgcgatgagtcgtgcacaggtatgggagggttcgcgggcccctcccctgtcttctggattcaaccccagcgagagagagggtgctgggttgccttcctcctcactcatctgttttggggtgctctggcagttctctgcccctcgcttgctgtagcctcaggccctgcaacacctcgggaccagagggttcacgccccgctaaatcgctgagggtctggttctaggtgcgaacctcctgatgctgtgggtggccccagaacgtggagcaggtcagccggctggcagccctgtgctatcgccaaggtggcccatcatcccattcggcaccggcaccgggcttgagggtggcgtctgtgctgtgcaggacagtggggctccctcgcccggcccgaggatggtcccagcacaccttggcacacctgtgctgcctcccccgccacacacggcaccttgggtctgctcccgcccgtgggctgcctgccttgggggtctggtctggctgctggggggacacccgcggggtgtggtccggggacgtggccggtcagagacccaggtctgcagtggtcttagcacctgccccaaccagggcggcgtctgcttaacctgacgcatatggaccgaatcctggagctgaaccaggaggacttctctgtggtgtggagccaggtgtcacccgcaaagccctcaacgcccacctgcgggacagcggcctctggttcccgtgggtaggactcgcgaacctttcctgggaccctgagggcaccgtgggagcaggctgtgtctggggttcaggggaccttcctcccccagcccgagggaaaggacctccggtcctgaggctgccttctgtacgccgccctccagacccaggcgcggacgcctctctctgtggctggcggccaccggggcgtcggggaccaacgcggtccgctacggcaccatgcgggacaactgctcaacctggaggtggtgctgcccgacgggcggctgctgcacacggcgggccgaggcggcatttccggtgagcgccctctgcggggggcccgggctctggccctgggcactgctgggggctgccctgcagagaccgggctgtgaaaagcacctcctggcggccccctggtttggcggctaggcttcctcaggctctgaagccctgtcagctgggccaaagtggatgggaccaggtttgctctccctgcctgaggccgactggctttgtggagcagaaagcactgggccagggaactgggcccgagggaggccagcccagacctcagtgcctggggtcggtgtcttgggttccgcttcggcttctggccagaaatccctcatcacacagcctggtactcaccttgtgtgtcctgggacgtaggaagagtgcagccggctacaacctcacggggctcttcgtgggctccgagggacgctgggcctcatcacagccaccaccctgcgcctgcaccctgcccctgaggccacatggccgccacgtgtgcgttccccagtgtccaggctgctgtggacagcactgtacacatctccaggctgcagtgcccgtagcccgcattggtgagctgaggatgggggcagtcagggtggctccctggaagaggccccctgggaaggccaggcctcacctggcctgccatctccctggtccagagttcctggatgaagtcatgatggatgcctgcaacaggtacagcaagctgaattcttagtggcgcccacactcttcctggagttccatggctcccagcaggcactggaggagcgctgcagcgcacaggtatgctggggtggagtggggcagcagggtgggctgcctcagtggggcccggtgtcagccccccttccccaactgcagaggagatagtccagcagaacggagccctgacttctcctgggccaaggaggccgaggagcgcagccggctttggacagcacggcacatgcctggtacgcagccctggccacgcggccaggctgcaaggtgagctggggctggggtcagatggggcccacagctcggcccacaaaccctttcctcaacccaccactctactgcacgagcagcaggctgagcctcaacaacggggctgggcctggctgagcaggcgctagaaacagggctgcagaccgccccacccagctgttcagataccgtctacagggaaagcacagttgttgctaagccctcaaaagcccttcctgtgagccaggtcatgggaacggtgcggtgctcttggagctgtacatggaaggaaggcttcctggaggaagagatgatagagagggggatgttacctaacctggggaagggaagtctgggctccaggcagctatgcaaaggctcagcagcctgggcttgggggtgggagccacaggggaggtgtggcaagcacacctgggccattggtctccgtgttgtgtcggggggaggtgagggctgaggcctagagaagagcaggattatttccttggtgaggccaagagctgaagcccagtgccctccgacccatcctcagccttgaccacggtgccccgtacacccaatcaggcaggggtaactcataggcttccctctgaccagggctactcacggatgtgtgtgtgcccatctcccggctgccggagatcgtggtgcagaccaaggaggactgaatgcctcaggactcacaggttctgcccaccctgctgctggggagaggtggggagggtcagggctgatcagagcctggggcagcaggaggcaagaggaggactgggctggagaatgttctgtcctctgggcccccaggaagcattgtcgggcatgtgggtgacggcaacttccatgcatcctgctggtcaaccctgatgacgccgaggaactgggcagggtcaaggcttttgcgaacagctgggcaggtaggagcaaagccagggaggggaagagctgagggcagaggaaaggagccccctgaggatgtctccttcctgcccccaggcgggcactggctctccacggaacggcacgggggagcatggcatcggaatgggcaagcggcagctgctgcaggaggaggtgggcccgtgggcgtggagaccatgcggcagctcaaggccgtgctagacccccaaggcctcatgatccaggcaaagtgctgtgaagggggtctgagcacttagcccacaagttccctgactacgagccggttctggaacttttcttcatgccacggcccctgcaaggaaatagatgctgaggagtcttcctgccagcgagcccactgtatctgggcccaaggccagagggcccagagagaacctgagcaccgtgttacctccctggccctctggctggccccaggagcctttggttcagtaacgacccagggtggttcccagcaaagctgcttcctctctgctcctacgcatcctgtccggcgggaagagagcgtctgggtccattcaagactctgatgacacccctccccgaggcctccactgccggggtcccaggacccttcccccttcacctggtgacaggaacactcctttccggtatggaacgtgagctcccgtgacatgatgataggtcttctccttggggcctcccccataaatctgtaataaacctgaaacccacctacagctacctggaagtcagcaggcagcactcctcccctccccctccagggtctctgtcctttggtcagtgacccctttgttttggggcttcctctgacttcttatagcctggggaggaggttggtgctcagggttcggaaaggaacccggtccctgtcccagctactccgcctcagagctgaggacctgcccacggcacatgtcactaggatgggctccccaactgggcctgaaccgggcctctgaacacactgaatgtgttcctcgcagctgccacgtctctagaaacagagatgagactatttttgcacccacctcttcatgggtgatgtatcgtaccaccagctgttttgccctcaaggtctgtccacccgagggcctgccctgtcttgggccggagcccgtcttgagaccttggcagttgttcccccctaagcccacagagggcgcccgaaatcatgaagctcagataccacgcggcatctgcagctcacgactcctcgcccagggcctgcggcactcagccctgggcaaacctcctcctagggtcaggtaagtcctgcagcctggaagccaagctagtcctccatcccctgcaggtcccaggaacctgcagtgcttctcatcttccttgcccctctagccttcggtcccttttggaaagaggcatgtcacacccacgccctccctggcctccgcccctctcctcctcccatcagctgtcagtgctcaggcaggtgctaggccttaggcagaggcagctgcgctgagacgccccagtccaacttcagttcttgaacccctcctccgtgctaatactgggctccagccgacagcagttacaccaacctgagccggaggctactcctccgtgacgtttctgtcccgtgctgccctggtggggagcagagaccggccaagggctcactggtgacaaatctcagccctctccccaaaccaccccagcacgcgtggctcatcaccgagacagccctctcgcccctccccttccagccagccagccagccacccatcttccaggcgagaatcctgcagcagctgcgctctccctcctgggtaggactcttctttatgcgccctccagtgcctggcaactaggaggcgctcagcaaatgaccatttcccacaatttttattaagaaaaattccaaacatacagaaaagttgaaagaacaagtacactgttcacgaaataccagccactgcagattcaacaatgaacattttggccttatttgctttgtgtatttggggggaactatttggaattaaattacacatttcttgaaggcattcacctatataatcagcatctatctcctaagaatgaggacattttcccatgaactgcagtaccgttaaatggtattagaggaatggttggtctttgtgagggtctcacgtccaggaacctcatcaaagcgtctaggcccttagcagagagggtagaacctgctcgccggctccctcaccttctctcccatccagaaaggcagaacaggggcaacacaggattctggagagctgtccagatagaggatcaaaacatgagctccacctgggaaacacagacagccccaatcccacccccacaacaagagcggcaacctgggtccaaattcagaggacaccacagccggcagagggctgcagcatgccagtaggacggaagtcgctgggggtggggatgagcaccagcccctagagcctggaatagcaccggcgtgggctacagccctgccccacccacctcacagctgctcggctcacccatggcacgccaaagcagcaggcttaagccgccaaggcgggcacatgaagcctccatttccaggtccggggtcaggcaaggagatctccttcagggctgggccctgcctcgccagctttgctggtgaattaaatatagcacagggagacacagttgccaggcagaagcaggaggtgctgtgaataaacagtgccctttgtggtgacaaagctatggggagcctgctgtgcatgtgccaagacctcagggcagctcccccagcccccacagggacctctgagctgcatggttttgtccccgcttacatgtgaaatatctgaagttcagatgaagtcgtttccccaagatcattctgccaagtagagagcctgaatgcacagtctagagcccacgttcctgccaccgactcacaacagccccaggtcttcaccccagacgggtcccgcgctgagacccaggctctgaaccaccgagtcttcttagtgtttctccgctggccctggctcacgtttgcccactggcctgttgtgaatgcccttcacagagtaggtgcttctggaagcatctgatggagggtgactgcggagccaggggccgtgcagcagggggatggtccagcacatcaggcgggcctgagaagggtcagagcagagaggcgtggagtcgtctccctctagagctttccttcgctggctctgcaggaggctctggaatgcgctccgggagcccgctgggcacggggacacaggccaggcctgcactgctgctccctgcccgagctgcctgcccagcccgcattttgccaacttttgtgagcctgagcagttggttctgttcaagggctctgagctggcacagccccaaaccagggcctcttcctgggcctcaatgaacatgcccgtgagtcagcactgagacgcaaactgaacaacaggcagggcgagtggaacgtggatggggagcaaaggctggaaggaggggggctgggcccacacctggaagaacccacatcttgcagcctccggtggctgcaacatcttggcccctgcagatcttttcagaggtccggccaatgactccacagagggctgactggttccatgatgcttaagaggttaggaagcttgtagaggcacgcctgacttgccactccctccacccaggcctgactatctgaggaccaattcaacacctggagccccgagtagcagcctgaaggaatgctaaggaggtaggtgagggagtgggggcaggcccttgcccccatttcttgattgtataacacttcattaaaataaaatcacgcgtgccatcttttattagacattttaataccatatcaaaacaccttgactaatgaagaaacttttctcccaagctttgaacatttttttaaacattttataagtttttttttgtattttatatataaatacagaaacctatcttgcatgggctgatgccacgtgtgaacatcaatggcaaaatgttctcaaacatagtgcctgaaaacaggggtagctgtacatatttcttagtaagctttttttgtttaagttttctgaaaaaaaaaatccacgagggcctaagaataatgttcagcatttttgcaggacacttgtgattgttaaatcctctgaactgaccggaaccaggaggaagaagggaaaagagatgggatcagtaggaagaaagttctcaatgggttgttttttggcatgaagtcaagatattagggtctcaaggggagaaaagagcaaaaaaccagccagaaaaatgagggaaaaaaccaaacaaacccaaagtagagaagttggtggtggagagggccagttgggcaggggaagagaccgtgtgctcgcccgccgtcagaaggctggcagcgaggccttagcttgttcgtctgtcactgagtgggttatggctgggcagcaaacagcaagctgtaaacatcagagggaaaacaccagtcgacactagactttttttttatataatttttttttgtaaacacttaaagacagacccacaatgcctttcaaagatgaaaaagaaaatgccctttccctcctggctgaggggtgaggggaaggatagcagttgattcattcttctctcaaacttgctctcatcaatttggtgtcctcagggaggaagggagaaccatgatctggaagtcagtgcagaagggtgccctgttcccgctggtgtcccaagctcagctctgccccagggtccggtgagcctcctcctggagcaggggcgctctgtccctgtgtggaccgtaataaataagtcgtgctccatcggccgagggctgtctgctcatcccagggcagctgcatcccaagagggcaggcggggctgggcgtctacacaggaccccagaagccaaacagcacacggggaatttgcagccatgtgcctggcaggttctactcccctgcctcactctcccccctggctctttcttctccccttgtcatagtttttgaggtggaggtaaaaagagcaaatgtccctgatttgtctgacatcatcagctttctgggagtttacttggaataaataaaataaacctaacaaaagaaaacgaaagcaagaagagagaaagggaggggggaagaaaaaggtcccaaaacctttggctgtgagatggagttggcttttggtttttatgggggttttgtctacttgtttgccagaaaaaggaaaatgccagccagaacttggaggggacaggtgagatgggggtcaggggtggatggttggcagcaagtgggtacccctgggggagaaatggggaggccagacccagcggtaagccagggggatgtgtgagtcagcacccagtgctgtgggatagagggatcgagtctggcctggaggcctcagattctctggaagcggcatgggaagaagcagtggtcaaatgatcgctgaccagcactttgcaggaacaatgcactgcccatggctgtttagtaagtgcaatgtccttatggcaacagggagtggattatccccgttaccatagaagaggcggagactcagaggtgagcgaggatgaggccaaccaggcacaaacccaccgctcaggctccttttcctgcccgtgcacattcccaggggatatcctgaactttctttaggaatgtagattgtactggtctcttccccaactgatcctaactttctgagcctgttcttcataactgtccatgttggtttgtatctcttgtccttcccagggaaatcatttccggatgactaactgctcactgatgaggtgctccttccctctgctcctgcttcttctcagtggcataagggcagcccggctccctaaactgcaggcccccaaagtgaccgaccccaagccttgagcccggagcacccccaaacgcgggctcacctttgagaggagtcacaagcaagcccgcaggtcagtccgcagggtgttccggacaagatctgttcacttcaaacacgagtctatgcagctgggaggagggggccgcaagggaaaccacgttacctgctgcccagctgctttgaaggggctctttcagagggccagattcctgagcaggagcttcctaagtctttctgaaaggaccccagggaaacacagtcatgtccccagatatccctactttctgaagccgaagaagggtgaacaccaagactagtcttggcccaggtggaggcagcagtaccggctcgggggatctggtgctgcaggaaggggcagagtggctttcagaaggaccaaagctttctggcagagcccaggagaatggcagcagccaccagtgagaaggtgagagcggtggacccctcgggcagctagtcagctgtctccaagactcccaagggcagggaagtgggaacaatggcatgcaggagggccacggctctgggtgccacagtcctgaaagagctccttcctgggtcaaaaaacagctgtgaagctccctcccagtgggtgacctcttaggagagccccaagctctacccgctcagccatgatcagctgatcagcagcatctagtccttcctgcaagaggcgggagggggccagacagtgaagccctgctctccagtgtttacagagaaaggctctctgcatcaaagaggaacagagattgccccaagacagcttcctgatttgtaaaccaacatctgggcattttcaagacaggaaccagacagataattggcataattctccccgagggccaaagatttcctttctggttctggttagtgccgccctgggacacaagcaaggctccgtgctgggagctagaccagaatctctcccaggccagccttaagcctcctctgcaccagccacactgcgtgccatgccggttgtcaccctgtgcagcagtggccctgagagtcaggctttgaaaggcctgagtgtcggaagaagctctgggctcgaggattcagcaggtgctggccccaggcagcacagtgtccttcttgggcaagagggtgccttccttccagctggaaacaaggacgaggctcacactggagcccaaggcatatctgggccctgctacttttaactgtgcccagtgctgtggccccacaggaatggctcttcctgcctcccggccctctagggagaaggccagtgcaaggcagtgggtacccctccgcctggccttcctcgcacagattgatgttctacccctgtggagcagagggaccgtagaggaagaagaggcagggagacagacggagaaccaaccttcccagtgggatccgaactcctccaacctgtgaggctctacgggtctccccatcagctcccaccacctgagccctcaaccagagcacacctctggcaactccactctgctctgcacttgggatgctcgcaccttccgccggcacagtggacacctgtctgacggcctctgcccttacccgctcggagccagaggcgggggagaggtcatcccataaccaaaggagacagaatggctggagatgggggtccgccctctgggaggtggggtgcactaagctaccttgccaacccctcctaccttttgtgatagagcacaggcagggcagcctggctatcgtgtccccctgcagcagctcctccaggcagatcaacactcacccgcgtctttagtcagcacatcatctgcaagggggacaggggagagtgcagagggttagtcaccagtggacaggtggcatggggcaagcaagggcctaggaactaggggatgcttagctgccccaagctgtgcccggctctgcaggggacacagaaccccaagagggacttgaccttaagactttcaccgtggagataatgcgtggacatcacatgttaattacccaagacaaaatgggattaatctcaacatgtgattaaccaaaagcctaggtgacagcggacgaaaaggcttggagaagggtagacaggaagcaggggcagcatgaggcaagctgtttccctcacagatgctttcctaaacacacacgtagccagtgtgctgatgtctggtttggaaaaataggtaatgggtagagtggtaggaggcaagaatgagaggaagaaacaggtccccaagaaaaccttgtgcacggaggttcacagcagcattgttcacaacagcccaaaggtggaaacaaccagtgtctacaaactgcgcaacggataaacaaaagatgatgtatccacacaatggaatatactaagccaagaaaaggaagaaccaccacatgctaaaacatggataaacgtcaaaaatatacacaaagtaaaagaaaccacctattgtatgaacccatttatatgaaatgtccagaatgatacatccatagagagggaaaggagatcagtattggggacagagggatatggggagtgctgcttaatgggtagggggttttctccccccccaccaccccgcttttatttgagatggatctcactctgtcacccagactggagtgcagtggcactatctcggctcactgcaaccccccctcctgggttcaagtgattttcctgtctcagcctcccgagtagctaggattacaggcgccaccaccacgcctggctagtttttgtatttttagtagagacggggtttcaccatgttgccgggctggtctcgaactcctgacctcgtgatccacccaccttggcctcccaaagtgctggattacaggtgtgagccaccacgcctgacccgttttttccccttttaaaaactttatttattgtggtaagactaacatatgctctatcctcttaacaaatcttcaagtgtacaatatgtattgtcaactgtaggcactatgttgtatggcagatgtctagaacttactcatcgtgctaactaaaatgttatacccattaatccaccactccccttccccccgcccagcccctggcaccactagtctactctctgcttctatgagtttgagtattttagctacctcatgtaagtgaatcacaccagaggttttcttttggggcgatgaagtgtttagaaccagataaagatggggttgtgaatgtcttaaatgctattaaattgcacatataaaaatggttaattttatggtggtttcatctcaatgtttaaaaagaaagaaacaaaagtgaccccgctcaccatcccaaaagaaggaatggaaggaagctacttgcacccatgggaacccactggtttttattaagtccttggcattctgcgtgccggcgacagtgaatagccatgatctcgggattcaagcagctcacgactagcagggatgccgaacaaggaaatcaaaaggcacagcatgaggacttccaggacacttctcacgcgcaggcccagggctgagggtatggggaaagagacctcatcaggatggggctgatctgggaaggttctggagaaggttgaggatggatgaagctggggtggggacgggaattctgggcacagggaacagccttgtgttctgctgtggtgtctggggccgacaacaagggtgcgcagcagccctgcgtgtgcggatgagggcagcgggacacacagcaggtgcctgcataagggagggtgcccaggaggaaagcatgagaaggaagggacggattctgagttgggtggaggaggcccggccagctgatggagacctccaggaggctgctgaagcctagagctgaggttggaacagagacatgggtgccaggcatggatgtgggataaagaggcagtccagggagaagttcagaccaaaatccaaagaaggcagaagacaaacccaggccgacatgaatatttgagggcaggtgaaaagaggcgacgtgaacaaaaggcgacccagaagtcctccaagccacagagaaatatcaggagagcagtgtctcagctgtgaagaaggcagagcttgtggcaggatccttctccgtcactaaaggaacttaactgtcccgaacactgccaatgacaaacacatgtgctgtcttcctttgagcatcaccatcttccaagctgggcagggcacccagtgttattctcatttgcgaatgaggatccggaagcccaaggaagtcacacacctcatgagtgggcttgtggttgtggggctgggactgggaccctctgcttaagaggccttcccattgctgtttctttgtttctcttattattttggtggaaaggcaaacacctggggcccataaaatgaagattcttcgggcccagaaggctatggcttccgctcctcaaagccccccaccaggaaccccaaggaaaagcataaaatggaaccgattcgatccttaagtccccaggcacatgagttgcgagagaagcactctcagcttcctggccaccaggacaacttgtggtcattttctgtctagaacatctgctagcccgaggacccacctgaaagggtgacacaaactgagaagggagatggcacagtctctgctgaagtgtctgtcccctcagactccaaacatggcaagtagtggatgaacacatggtgtgatccccctgcttgaaagcactagctaccatacatattcaaatgcatgtgtaggcaagatcaaagtctggaaggatgcacacactttcacagtggtagaggaaaggaggacttgggaaaaatccttttatgtatttctgtagcgttcgaatgtgcactactttagttaaaaacctgataaggaagcatactggtgtttgcattttactatgaaatgcatcagaaggataagatggttggtggatggataaacgggtctagtacactgcagactccaggtggtgcatgtgctagtaataggggcgttctctctcttttttttttgacatggagtctcgctctatcgccaggaggagtgcagtggcatgatctcagctcactgcaacctccgcctcaagagtttctcctgcccagcctactaagtagctgggactacaggtgcatgccaccacacccggctaatttttgtgttttagtagagacggggtctcatcatgttagccaggatggtcttgatctcttgacctcggatccacctacctcggcctcccaaagtgctgagattacaggcgtgagccaccgcgcccacaataagggtgttctctatacaatgctttcagctttgccgtacactgggtgcagtggctatgcctgtaattccagcattctgggaggctgaggcagatggatcacctgaactcaggagttgagaccagcctggccaacatggtgaaagtctgtctctattaaaaaaccaaaagttagctgccatggtggcatgcacctgtagtcccagctacttgggaggctgaggcaggagaatctttgaacccgggaggcagagattacagtgagccaagattgtgccactgtactccagcctggtgacagaacgagactctgtctcaaaaaaacataaaaactttgctgtgtgtttgacattttcataataaaacagagggaaaaacctcaacagagatgggaggaaaaacagcatagctagtgagggcagagtcgtcatgcagacattcttggacctgtattccccactctctttgtctggacacctcatctatgacatgagcgtatgggctatagcccttagtttcctctaaagcatccttcccctccatacttaaggaggatttcctgggaacatggcaattactgattcctaatagtttatctttgcattttctcctactgattggtaactcaactgtgagcccaagggactgttagaattctctgggtcccatacagcttcccacaccaggtgtgttctctccccatctggtcagctccaggagggcacatgtggtctccctcatcgccccccaggaggtgatggattcgggaagggagaggcaggtatgaggataaggcttaggcgctttatgacaagactggacttactctctttttgcaccgaacctcactaggggaaagggaaggggaaggggaagggggcgcagggcgattcttcttgtcctggggcggaaggcctgtgcactaaaggactcagacttgagagaggaaggttagaggcagcctttcctcaccactccacaaggcggttttatgcacagtgagtgttgtgcctttaccagctggcctgagtctgctgcactggtgggaagaactaaaatggcaggcaccccaaccaggctggcacacggcagggagcacatttcactgggaccaagagcactggctgcaaaaggccacctggaggttcccggcaataggaaggagtcagggtctttgatcagacagcatggggaagccagcagtgcccacacagagcccagtgcccagggagcagcatcttccacagcaggaggcaggaggcacacaaacccagcaagaggttgcagtgggctgagacaacttcctgtccccacccctggggctgtgggagttagtggcctccggatgtccctgaagcctagcagggaagtggaaatggctgaagctgatgcttgcctatcaactggttcctacagacttccagaagcatctgacacgaacctgctgcctgccgtcagagaaaagccatggcggggcctcgcagcacaaaacccaggcgcctggcccacacaaactgagactctgctgcagaggagtcaaatgtcccctggtatctccaggcccctagagaagaggttcaacaaatgctgcggataagaacaaagccaaactttctgccatctgggttctgcccttttcttactacctctaagcacctcccaagtttcctgacgccactgtacaaagccagccaatgtcactgcccaaggagagcttggaagtgtgtttggcctggctggggatggtgtcagtgcctgtccctctaacagaccagggaaccaaaccagaatggcgagcacggccctggagctgaaacaggagggaggatgatgcctgtgatgggctgggggtgggaggcggtggcatcttctgctccctccctgggtccaggcacggtgcttctgacagctgctatttgtcaaagcaaagatatctgggaggagggcaaaagagccttaattctctaagccagctatatgcaggtaactcctcagacacacacacatgactcctaaagcccctgtggggatcttcggataagctcatgcagctgctaagtggtatgactcccaagcccaagtttctgccacccagcgacctggccccttttccttaaaagacaggccataagggtgtcttcccttggggctggaaaacaccacccgtctcacaggcactttcatctccccctttctgtgaagtgtgtgcagaggacccaaggtggatggaggaacctggtactgagtgaacagaccagacaggagagacacacacctgccctccaccatgccaggctcggtattctgcagagttctggcaacacatcctcaagagaccctggaactgctagaagtatgaggggtggggaggctcacacagctgcagacacagatctgcacctggctgggagggaaagccgtgcagctccgaggcagcagctgagcacaggaacatgcctctccatctccacttgtgctggtggccatgaagggcccagagagaaggaaggtgggagtcagaggggaaacccctagaaatgacgcacaggctcaggttccaccccctgacctcatttccagcctaggtgcggtgggtgcctggtcctgctgcctattcagcatgcagagctgctggcccagtctgccagggacagacagggcagtgccacccatgccaggccttgtcagctccccttttgggaaatctgggggctgtgctcttcaggcaacagggtgaccttgagcagagagtgtagcctaccagcagcggccatccaactgcccagccctttgaagtgcaatgcaattgttttggtgagctgggccaccccaatgaggatagtgggggcagccaactaaagctcaggcctggagcgcttcatactttccactgaggccactacagctccctcccacagtcctctttcctgtagccacctgttcctggttccccacttgtgttagggccttgcaggcctcccctagtcgctttcgctcctcatacaccagcagcggccagtctggcagtcagtgcagccggtcagcaacagctggacaccctgggtggcagtcacctgcccctcctcgccctcctgtaggaggagtaacaggacagacacctccgcgtctgactccagcctgtccagcctgactccagcccatccagcatctaacaatggctctggcaatgccccaagcaaggctgggcaaactcctcggccagcacccggtttccccaggcaggaaagggtagggtgctttcattctgaccacagggtctctgagaggaggagacatgggacaagaattgcctgcaggcacagggcaggctatagcaggagccatttctgcttttccaggagccaggtcctctcacatttttattttatattttattttttgagacagggtcaagctctgtgcctaggctggagtgcagtggcgtgatcaagctcactgctgcctcaatctcctgggctaagtgatcctctcacctcagcctcctgagaagttggaactacaggcgcttgccaccatgcagacaaattttttgtttttagtaaatggggtctcactatgttgcccaggctggtttcaattcctgagctcaagcaatctcggttccccaaagtgttgggattacagacgtgagccacgcatccggcctcccttgcctttaaaagacagcttgtgtgacatttagcatctcaagagcttaaagatgggggcaatggcctttggcagaggggaggaagagggcatcatgacataagagctgagcatgggcttctgctcccccagaacacagctgaggggagctctccttggtgctgtggcaaatgaacctgccgccccccagattctccctgggctgaggacccctaagcttccatcaaaagcgggtcatctccacgactccacaggattacaatgctcttccgttcagagcataccaatcagacccccacctccacgcttgttctgctagcccagagactcgagggtcaaaattgaatgcgtattctttagggcaaggtccctcagtctcagagtcacaaacagagatgttgaaagggagagaaattaaaaggcccattcgggttgatccatcttacccacaaaaacaaacaacgaaccccctccctcttatacagtatcctcaccttccaggaaggcgcttaggaggaagggggtttaacattcggtgctctggagtcaaccgcccttccctgcccctccagcagggctcagcacattcccaaacttccccagccaggtgcctgtcctcggagcaccaggcactagtgaaccagttaaactagtctcgcctttcctaagttgtgttttttctaagctagcaggcactactggaggccttccaacccaccactcaggccaaccctcataataagaaaaatactacttctatctgcctcatttaggaggtttctacttttttcctttagtggttaactaaatttctcttatataaccatcataaattttctaaaaatttccgcaattggtgccaacaaccacagaagtgtgtgtgtaaatgggaagtcttcaggggagtgaccaggagttctagtgaatcttctaagaaaactcttcactaagaaagccccgcctcgccccctttccagaaagattccaagactcacacctctgactcttaagtctttttttaaattagaaaaggtaacatgcagcaggtgggttgggatgatgacaaatcatggggaatacattggagctcctgagctttggcccacggctgtgctctctctgagctggagcaggccctgggcgtgcctggggatgcccactccacatcacccccggaagcaaatgctctcctcttacctggaaggtttagggtcttcagaaaagacaagactgaacatgaggagtccataccacatgaacagggtccacagagggccggaccatttttctgaacaaagcacttcaccacgttgagacaaagtccactggaaggactggagacaatggcctctctttgcctccagtggtaaaggactggcttttgcaaaagagagccttaggtgaaagcctctagtttacacacacacacacacacacacacacacacacacacacacgtgcaacatacagaaacacatgcacccttgaggaggtggcctgcccctcaattccatgacaaggaaaaactagaaccagaaccagaggagcagtggtcatgcctcaggctggctggccaatctcccttcctctaaggggggcccggctcccggtgtggtttctgtagtcttgggtgaggctgcggtggtggggtgtaggggggtaaaccaacagcgccaggcactcaagtgctgatacagaggggacagggggacacatggtggcgtcccaggcagttctctggcagaggagctggacagctcaccttcccggttctccacagggcagtgggggtaactctgcatttgggccatgggggccaagagcactctgtcctccacggctgctcttgcaaagttcttcctgagagccaggtttctcaggctgagcccctctgaggcttctttgtattcttcctacaacaaacgcagtgtctaagagaacgccctagcaacccacaggacaaacggaggacttcatgaggtctccacacatggggaaagaagtgaatagggtttttgaggccatggctagggagggctgtgagacgcagggaggctcctctccctccctggtcccaagcggagacggcgaacagggacaaagctgagcctagcgtcctgacagcatgcatgcgacaggactgacgcgaagcctgcagcacatgtgacaaagacttagagaactggcagcagtcagcccaggagaaaggaggcgctgtcccctggggagaaaggggcttcccagaccacagctatgatgcccaggggagggccgtgcgggtcctcccactgagcatggcctaacaaatgcatggagctgagccacgtgggtaatatgcccacctgcaccagagtcttttggctgaacaagtaattaagagagaagttttcaggagacctgagtggagccattagtcagttacttcccaggaaatgctctgagaccatgatccctcctaggctcatctttgtaggggaaagagccctctgggagtgaggaggctgcagggcagagaagagtctcctaggaaacattctcgctgggctggttgcgtgatccagtcctcagatgctctcagaaatccagaactctttttccaaccactactatgacttgaatctgggaaggtgggccagtaccaggttggagtgcactcagatccactgcctggtctagtggaagatgccgttttctgatgaactggtttggagaccagactaaacactaagcatggaaaatcgagggtcagcagtggcgtggctgagcagcactgaggagaagtctgtgggctctggaaaactgcaaaaagaaacctatgaggtctcacatctttcatggcagctgtaacttcccaagcactgaccatgtgccaggctcttaccaaaggcctttatgtgccatctcttacccagttctgacaatcctatgaaccaagtatgctatccacattttacagagcagaaaactgaggctccgctaagctgagcaacttgtatagattgtagacacagagtggtagagggagatttgaactcccatcacctggactccaaagcttatgcacagcatgctaggcagatgttgacagtcattttgtttcccagaggcgtcctgtaggttagcttgggtgttttgaaatcccctgccctcagggtcctaccctctgcggtattactgttcggctctgaggcagcctccaaggtaggaggcaacatggccagggtggagcagcaggtgtcctatccgcattttcaatccccagagcgtctctatgtcacacatagtcccccgcaagctctctggtgtggactcataggactaaatcaggtgttcgtccgagttcgaacgtgcaaggagacgaccagcttcccagcactctatgcatgccaccagcacacagcccccacctcccaaggagggcgggtgcttgctctgggcccctctgctaagccgtggaggacacctggcgtcttggggccttccacagtcaagggtgaaggaaaggctgcatctcccagccaaagtcccagaactgagttgcagagaggcaggggcctaactgagcagcccgagagccttcccagactcggacctgacccctgggccttccttccttgtcccactcctcttcctctctgacctgagagcaaggctcccagaacagtccacttcctcaccaccactgaggcacacctgccagagggagggtgaaaatactgcccagaaccaccctcgactggaggctcccacaaggactggccggtcccccgacggatgctctggaggctggtgaggcaggccaagcccttaccgttgtaggagggcgaggtttgctcaaacacattataaagtgcatttccatctcgtcagaagccacagactggagcaaatggggcacttgaaacctgaaagagaggagaatgggatgaaatgttttctcagatccagtacatccacagtacatgtggacactctcgaatgacagccatgtgggctcaggtcaatgtggaggatgaccatcagaacagaccctggacctgtcctccttcaaggactcattgagcatctgccttttttttttttttttttgagacgaagtctcactctgtcgcccaggtggagtgcagtggcacgatctcagttcactgcaacctctgcatcccgggttcaagcgatctcctgcctcagccttccaagtagctgggattacaggtgtctgccatgacgcctggctatttttgtatttttagtagagagggggtttcactatggtggccaggctagtcttgaactctgacatcaggtgattcacccgcctcggcctcccaaagttctgagattacaggcatgagcaccgcgcccggtggcatttgccttttattgcagcctttgactgactgccagctttcactgggctcaccctgccttatgtgcctcgttaaggtttaaccaaggtcactgacacctgactgagttttatcttctttagaccctttctcagatgggtctggtggacaatggggtagggagcatcaaaccaaggcacctggaaacagcctttgcataacagtttaacattcttctgcctccagcctttcagccacttggttggatcaccctgggaggaatctcatccctcacccagctccagcctcagccgcccatgccaggtagcaactctctccctcacccacagccccctctgcccctttgtggcttaaggccactgtcctttgagatgtgtgtgaactgcttacacatccagatttcaactgatacagaattgtacccatactggagaattttggttgagaatctttcgagtgaactccgttaagcaaacctaatcccctgatccatttgtccatacaacacagatgaatttttctaattttttccattctactttcattgaaatgattttcaaatggatcaattcttttcatatacattctatcaaaaagatctgttgccactgaaatcttatttctctgcattaaatgtgcacatcacagtttctcccttttgtgactgtgattcctgcccgcccagcctggacttctaatgtggcacatttaacaacagctgaccctcaaacaacatgggctcgaatggtggggtccacttccatgtggattttctatcgcctctgccaccctaagacagcaagaccaacccccctcctcctcctcttcagcctactcaatgtgaacacgatgaagacctttatgacgatcccttccacttaacgaacactaaatatattttctcttccttatacatatttttaaatgttataaaaatttttttcttaatattagagatggggtcttgctatgctgcctaggctggtcttaacccctgggctcaaacagtctcctgccctcagcctcccaaagtgctaggattacaggttgagccaccgcacctggccacttccttatcattttcttaataacattttattttctctcccttattgtaatacagtatataatacatttataacatacaaaatccatcttaatcgacttttatgttattggtaaggcttctggttaacagtaggctattagtagttaagttgtggggagtcaaaagttatccacagggctgggtgtggtcgtgcatgcctgtaattccagtactctggaggctgaagccggcagactgcttgagctcaggagtttgagaccagcctaggcaacatgcaaaagcctgtctctacaaaaattacaaaaaaaaattagctgggagtggtggtgtgtgctgtagtcctagctacttgagaggctgaggtgggaggatggcttgagcccaggaggtcaagctgcagtgagccatgtttgtgccactgcactccagcctgggggacagagcaagatccgtctcaaaaaaaaaaaaaaaaaagttatatgcagatttttgactgtgtgggggtcagagctcccacgtagttcaagagttcactatactgttgtaaagactggactcttgtgttagtcaattttccatatgcagttttaattgatactagtgataaccatctgcaatatttcttttctttcttttttttttttttgagatggagtcttactctgttgcccaggctggagtgcagtgcacgatctccgctcactgcaacctctgcctcccgggttcaagagagtctcccacctcagctcccgagtagctgggattacaggtgagcgccaccatgcctggctaatttttgtattttaggagagactaggtttcgccacattggctagactggtctcaaatgcctgacctcagatgtctacctgcctgagcttcccaaagtgctgggattacaggcatcagtcacccaacatttctatgaaacagataaaaggctgaatgtggctgggtgcggtgtctcacgcctgtaatcccacactttaggaggccaaggtggggaaatcacttgagctcaggagttcaagactagcctgacaacatagttaaactctgcctctacaaaaaatacaaattaaaattaaatttttatttaatgggtgcctaactctgcatgaaaagccgtgactctggtggcccggggtgctgagagacagaggctaactgacgcaaccactttgcttaaagtcctctccaaatcctctttttttccctcattggcagtgctttgaactatgggaccaggcagaaaattcagggcctggctaactacaacaaagtggacacttgactccatggcacagtcgccatttccccaacctctttcctcagaattcttagcatctgagcatgtcacttaaaaagtcttggaaacgctaccaatccaaggacttggtggagcttcgggaaagggctgtatttctaacctctgggtggttataaatccatcataacaaagctagaagaccaggcctggtgtggtggctcatgcctgtaatcccagcattttagaggccacggtgggaggatcacttggactcaggagtttgagacctgcccgggcaacacgtgagaccccgttctccacaaaaaggacacaacaacaagaacaacaacaacaaaccccaaagactataaagaaaggaggggaattccatccagttttcttgcacagctggatctaaaccaccaggctgattattttctaactcagtttagaaatgtgcagatccagggtcacagctcatggggaggtgaggtgtgaacctgcgtctcacagatggaagatgcttttccgatccagctaagtccctctgcactcacatggggtttttttcaaccccaaagaccaaggttttgcaacctttaaataactaaaggacaactgcactttaacttggcacctgcctgcaggctgaggcttggaaggagaggagggatgtggtctaggacaggccttctgcctccaggccctgacactccactgcctagcgttaaagtgacctgtgactaagaacaaaactacaccttgcaggtactttgtttctgataactcagaacagattcaaggttatccctataatagcatcatttactccctgtattccagcgtgattccttgagtgcaggaggggagttgagttacagctaaggtactagaagtaggccacccaacaagaaggtctacaagggaatgtcaccagacattcatgtcctaaaaaaaaaggcggagactcaagtttagagcaatcccctcactgtccagatgagggaatggccctggtgaaggcctctgagtagcacactgtcacacaactgaggaggtggagctgagatagcctcagggttctctgcttcaaatctaaagtcctttccatcagggtagggagagttgccatagggttttaagaacgaggcatgttgggaaatattacctctggagaggaagcaccatggtgtaggaagaggcctacactttaactaaagcagggttagtaacaccagcatctactcctctggtgtttctgttttattttggcatagctcaagaaatagctctgggctgggcacgtggctcacacctgtaataccagcattgtgggaggccatggtgggaggatcactttagccaggagtttgagatcagcctggacaacacagggagaccccgtctctattaaaaacttttttttttaattagctgggcatggtggtgcatgcctctaatcccagctacgtgggaggttgagcaggaggatcgcttgagcccaggaggttgaggctgcagtgagccatgatcatgccactcactccagcctggccaacagagtgagaccctgtctaaacaaaaaacaaaaatgagtaagtggtgtctattatgtgagtgggaaatcacatgatgacctggcttttccatcctcgagacatggcaagggcacactggccatgggctatgcagagtccactagggggtggccagcagctccatctctgccgggtgccatcaccgtttcctttgaacctctcgagcactgtgcactacgctggcactttccatactgccaactggaaaccaacagtctctctttaacctctgcagcactactcttgcatatgataataaataatagtttgcatttattgagtcattactatggacagcatggtgctttacatgtcttctcatatacggtaggtaggtactatctatcattaacgcctttgacagatgaggacatcaaggctcagaagattacataacctgatcaagattcgcatgccagaaagaggcagagctggcccacgacacctaggaagtctgcgctcttgctcgtgtgcgtgctactgactgactagcacagaagagttacatggcagaaagaacagaaatactaccactattaccaaatactcatttatgaaccttctacactgtcccagcaatttctccttaagtccccatagtccgggctaacttgtagcctgaaacaatggacacttttttttcctaggaacctgttataactatctggagttctgctttccatttggcactgggcctacagcactggttgaagatgctgaatctgcagatgaccttttaaatggaaaataaagggtaaaaggtaagaagacagaaaaaacacggacagctagaaaagactaatatccccagcttctttcctgaaatgtatccgatgatcaagaaggattctcccagtctattgcccaaatcttttcccataagcgtcactacagccctacagaatgataaatcctgtgatatttatgaactacctgaaggttaaaaatccaggaaattttgattccattttggaaaaaagctcacaccaaattaaaatcagccctcaaaacaaaagtaaaccaaaggtctgcaaactcattcggcctgcatgattttgtcaaactcctcggagaccttcatcagcactcagagcaggtaagagatgcttcaggagacatctacggacactccctaagcctctgagagcaggctctgagcggcacaccctggaggccaggggatagccagccagcgccccagcggctccctgcacatgggctgtgtctgccgaaagtttgcactgtcagtgaagggagatgtcagtttgctcgggcttgctggccaagcctgatactggttaccgtaggcaatcatctcctcccaccagacagaggcagaggcagggaacgtaccccgggtccttgtccttttctgccagtatgttcagatgaggaaggaacgaatgacagagcattgtgggaatgtgtccttaatcacccaattctgctctgggtgggttctgccaagcaaatgcgctacaggatccctccacttccaatcaagagaagccaagagagtccttctaatggagacctgtttcctttctttctcttgtcatcagatcagctcactgtttacacagccagaagagctggcagagagttggatcagccagagtccagctgcttcctgtctttcaacaagtgccttaaggggaaatcctttgccatttggttggctgtaccagagagcagagctcttgagagaaggcagtctgcacttgccatctgtgacctcttactgtcaggtcaaagggacactcacaacatcaggtaagcccactgttaggggaaccaacagtgatcccaggaatgctgatgtggtcatgtgatcaatgttcctggaccagggtaactgggcatcccttcacccaggccctaccatttgacgagcagccgaggaaggatgggggcaactggttcaagctacaagaactctcccaatccacacaacatttatcatgcaatatcaactcgagtttttatgctctggagaccaatgcacttccattttccgaagctgcaaccttttcctttaagacctgatttctcaggacaggaccatgtctggcggcgtgttgctccagtttccctccccagccctcccttctgcccccctccccatgtgatgcgctattttaaaggctgccccagttctgcctgtctctgggatcacctaaaggtaaagaatcaaaggaagcaaccagggtaaagaaagccacgccacacagatgggaggtcctgggcagaggggtagatgagggtaactcttggctgaggagctcagagagcgcgtgccccttactttgcccttagcattcagttcttagtttccagcctcaatctttccgtcacatcctcaggtgcttagtgtcaataaaatgggacttgaataaactaattttcataaatgggatttatatgaataaaagatcaaggggtaacactgatgattttctttcacatttctaagctgtaggatcacattcttcaccctcaaagacacagactccctctctgtcaacacagaaataagtgaaacattggcacaatttatcagttgctgaggtgtgagtcagtctctcctagagaacatcctgactgggaaaggcccaggaattctggcttttgcctcttcgaaaacctctcttctggaccaacctctgcagttctgttctggggcctggaggctcacctgtttccccagaaatttctctaagcagacatcagaagacagccatactgacaaagtttaatgtatctgtgtgtgtgttacatatctgttgtgatgggtcaatttgactgggccatggggtgcccagattatttggctcacattatttttggtgtgactgtgagggtggttccagatgagatcagcatttgaaaccatgactgagtgaagcggaccgccctccccaaggtgagcaggcctcatccaatccactgaggcctgaatagaatcaaaaggcaaagaggagaaatttcactctctgtctgcctaactgcttagctgggacactggtcttctcttgcccttgaactaggacttacaccataagctctcctgttctcaggccttcaaactcgaactggaactacatactccacgagttttcccaggtctccgcttgcagatggtagatcatgggatttctcagcttccataatcatgtaagccagtttctataataaatctctacacacacacacacacacacactcactctctctctctctctctctcctctctcactctgtcggatctgtttctctagaaaacactgaccaataaatctgtctattaaataccaaacaaaaactttaaaggactagcaacaccagatgttggtaatgtcggtgaaatgtgtagcaaccggaactctcacatatgtttgagggaatataaaatgacacagccacttggggaaaggtctggtagtttcttataaaacaaacatacacctagcctgtgacccaagcaattctcatctatgtatttacccaaaagaaatgtcaacatatacctacaaatagtcattacaagaatgttcatcacagctttattcctaacaagcaaaaactggtaacaatccaaatgtggtcaacagaatggatatagaaactgtggtacatccgtggaataaaatgaaacactaccagctataaaaagcaatgaattactgatacatgcaacaacatggatgaattaaaacacgcaagtgaaggacacaaaagtgcacacatgattctaattatatgaaattctagaaaaggcaaattaatctactgtggaagaaatcagaacagtggttgtctccaggggttagggtggggcagagattcactgagaaggtaatgagagaaccttctgggatgacaaaaatgttctatatatgaggagggtttgggttacacacgcgtatgtgtttgtcaaaatccaccaaatatacactaagatttgagatttcattgtctgcaaattttacctcaaccagaaaaaaaacctgtaaaaaatatggaactgcagttaactaactgtagttaatgatctgtgtcaaggaagtacactgtgtctgcattaaaatgaaatgaacagaaacaaagatgcataagttaaacttcttccaactttccaaacgtttgaaattttaataaacattgaacaaagtgtcaagcagtgagctgtgtgtgaagaaaaagccaagtagagtgggtgggtgtgctaatttggatacagcggtcagggaagcctctgaggaggtgacaggtgagcagagcccttgatgtattagaagaacagtgagggagagcatctaggcaccgtgaggacaagggcagcgggtgacagctgggggcacactctcatccttgtatatgctcaaatacctttctttcattctgacagctgaatggatagcttgcctggtacaggatgcttgagctgcattccttttatccccgtggtctgtagatgaaattccacatcttctagcttcttggtgttgtaaataggaaatctggtgccagtgtgactcttttcctaataatttgttcctttggcttctgaaagcttgaagatttttctcttcatcctaagagttagaaacgttaccaggacatgcttagtgtcttctcttatcagttttacctttcaatatgcgcctcaagtcttccttctttagagaaattttcttctatatgtttcattacttcccctggggtaagtcatcaatgctgttcaccaaatatttctagccttcctccttccatccatatatatgactgcatgtgcctgctctcttcgaagttaagggtgggtttgtgatttgctttggccatgaaatgtgaacggaagaacgtgcacacacccaagcggactttaagggccagggcatgcctgccattctacctgactgctgcagtgaccagggagcaggtgttgcgacaaagcctctctggcttaggtccctgagtaacaatggtgagcagagtcccacctcttgacctgcactgttgcagcagcatggggaagaaatcaatgtgccgagctgagccagcaagcttctggaactggtattatgacagtataagctagtcctggccagtcctgcctcaggcacccttcctctacctttctctttctagtactcctgctgcttgtatgtcaaatctcttggttctatcttccaggccttatctctttctccataacttctctgtgcattttctctggagtgcagcctttctaacctgcctaggcctcaactgcctcccccatgcttggctcaaggaggtaaatggttggcattgaagtcaaggagttaggatatttatattctgctctttacaaatataggcttccttgtataactgcaatctaggcacttgtcattttcaatgtttgtattccatatgataatctaataaactgtgcctagccactttcttctgttgggtattaggattctcaatttttaccaactataagatcctcttagtagtgatcttcattttctactctaagcatggtagattccactccaactatctctgaggtttctgaattccacactgactggtatggaagaaagagaatcagactagcatcagaggaaaacacgctttcccaatcactagccagatggccttgtaccagctacttataatattcaagtagtgcccttcctattccagaattgttttaaagtccaaccaaggatggtgtgtgactgctctgtgcagagtaaaccattttatcggctgcatccagtactgcccaaaatactgaagcttgctggtaaatctgtccattcgaggaaattcacaaattcttcaggcaaaaaagtgaaaaatgagttgaacttacataatgtattttgtgactccaagatgccatcaatgtaagaggcatcattataaacctcaagaaagggaagaaaagctgccaacaatttttttaatatggtattccacagatatttataattttaagatgtgattatatagcacatctcgatttaaagttgttacatggtgaagtgtctgtgccttagaatcaatgaacatatgaaaaataatatatgaatatctgaaaaatcatacagactgaattccaataatagacccaatcaatttttcctggccgggtgcagtggctcatgcctctaatcccagcactttaggaggccaaggcagtagatcacttgatctcaggtattcaagaccagcgtgggcaacatggtgaaaccctgtcctaccaaaaatataaaaattagccaggcatggttgcacatgcctgtggtcccagctactgggaggctgaggcaggaggatggctggagcccagtaagttgaggcagcagtcagccttgttgggccattgtactccaacctgggtgacagagcaagaccccgtctcaaacatattccttctacttactgcaaaccagaagagcctaagtgaagacatctatctacagctaggaacaaaggaaggactgcacactgtgtgcatggaggtgagcgtgaagacatcaaacccaccctgcgtacagtaagtccagcctgcagcctgccaggtggatcctcagcaacagtattccagccaatgaagaatggggaaagcatctaccaggaacaggagctatggccattcattggtcctctccctttgaccctctagaccatttcttccaaagagaggccctcaaagggctgcttaggaagaaatgacggggaagcagggaccgggacatgatggtccaatgacctgagtccgagcagaacaagaagctgaaaactgaccaggtacagtggctcacacttgtaattccaacactttggaggctgaggcaggaggattgctttaagtcaggagttcaagaccgccagcctgggcaacaagtgagacccccatctctaccaaaaaaaagcagcagcagctgaaaacatcagcatgagttgaagtgtgaatcaagtccccaactactgtctaagaaagatgaatattgatttataactcttgtcacctggctaccatgcttgggtaagtttaggggcatttaattatgactcagaaatgtggatgtaaagtctccagggaaacacttggcttgtattttggagatgtcttatttaaggatggaccatctgttgaaaaaggagatcctctccctcttggtgcagtagcccaagaattcttctagttcttagacactagggattacctacaagctaggcagtaggatagacaggtcggccaggaaatgcccagtcattcgactgaacatcacgctctccttgcacatacatggctctccacctctgtttccaccgccgacacactgcacacctacatcccttggacccaaaaccactgctgctgctggtgtggacttctagcgtttgggcaatgccagagaacactccttagatggcttgaattcccctgcctgttcctcataaaatcagcaacaactggagccaaggaccacttccctcaagaaacaaaaacaaaggcaacaataaaaactgctctctaggtaaaacaggagttaccactcccaagggatttgtgggctgtctataaagcagaagaaagtgtcacttccccaccttcaggaggaacactgtccaagtaggaccagccatgcaggtcaggcttcgctctggcaggtgccctcagaagaccttcctagaaaaacaggactggccttggaactgcctgttgcagcttcttccctggatatagactgttttccaagtcctggagtccttatttttatttattatttgagacagagtcttgctctgtcccccaggctggagtgcagtggcgtgatctcggtcactgcaagctccgcctcccgggttcacgccattctcctgtctcagcctccggagtagtggaactacaggcgcgcaccaccacgcccggctaatttttgtatttttaatagagacggagtttcaccatattggccaggctggtctcgaactcctgacctggtgatccgcccaccttgcctcccaaagtactgggattacaggtgtgagccactgcacccggccctcatttttatttttaagagacagggtctctctctgttgcccaggctggagtgcagtagtgggatcttggccattgcaacctccacctcccaggctcaagcaatcctcctacctcagcccctcaagtagcgggacttacaggccagtgcgccaccatgcccagctggagtctttattgatgtaattagaattccaacctccaactaacttcccttttttatggagtgtgtgtggggttgggggaggtgttggaggggaaaaggggaaaaacagttagggaagggaaaaggacaatgaaggaaactttacagagaatctatacaggaccaatagttgatttctgggctcctaaaggcactgtctacctactgtccaccctactggctgataggaattttttgccagcaagaaagaaaatgcctgaaatactattagatcatgttcagcacagcatctgactcaccagcgaacagacactcacatgaagtgactgctcatatggaataaaaccatttgccttgcactgtataacttacatcagttatgccaacagcccagcctttctgtcactggaggtctgtgagaaggctccttccacggctccagcataatcctgggatgcagaatgtgtgctgctgtattcatttcatcaaaaccatcactcagccaggcacggtggctcatgcctataatcccagcactttgggaggccaaggtgggagatcacctcaggtcaggagttcgagaccagctttgccaacatagtgaaaccccatctcactaagtatacaaaaattagccaggcatggtggcgggtgcctataatcccagctacttggaggctgaagcaggagaatcgcttgaacccgggaggtggaggttgcagcgagccaagctgcgccactgcactccagcctgagcggcagagtgagactccgtctcaaaaaacagaaaaacaaaaaacaaaaaacaaaaacaccatcaactcaggctggggtcctggcacgcagctacatacaggctaccttcctgccttggacccagtcctggtaccctgtcatcagggcatcctctttcagctgcacctccaacacaggtagatggaggctggaacccagagggcacagtccagtggccacaactgtgttttgaaatggcatctaagaggaagaagccaaaagagtagaatggattgttccaaaaggtaaacagcagtgcagtgatcaatcctatccaagggaaggataaggggagagaaggccttcatacttcagtccttgcttttctctcacccagggctatggtgaccaagagaaagacatgcaaagactctagacagctgtgagggcctgaccgatgggtcaaaaggggtttcttgtttttgtttttgagacggactcttgctctgttgccaggctggagtgcagtacatgatctcggctccccgcaacctctgcttccctggttcaagtgattctcttgcctcacctcccgagtagctgggactataggcgtgtgccaccatgcccagcgaatttttgtattttagtagagacggggtttcaccatgttggccaggatggtcttgatcttttgaccttgtgaccgcccgcctcagcctaccaaagagttgggattacaggcatgagccaccgcgcccggccccaaaagcagttttctagagactctccagacagaaagcacgaacgagaaggaccatgaatctaagctccctaaaatagtgaatgacttctactcaaggcatgtaaagtatgctaccatttgcttttctttgcctctggttcaggttacttgaaccgggtagataagaatgggagaagagaaggttgggagtaaggcatggaggaggctccaacatggtagcaggaacatggacatacttgtaaatcttgattcataataacagttccaaggttaagaaagttaaggatctcctaagataacaagaaatctggctagcaagcaaaagatgtgtgatatgacataacattaaaaccagtatatgtcagtggacagaaatgttaagccaggaagcaatatctgtattggtcctcacaacaaatgtttatgaaagaagaggaccacataaatgggcaattccttcttcattttgactttcaccttgaagactaactttacattgattgtaacattctctcaagtcagcacttcaattcccagaatattggcatcagaaacataaatattgacaaataccacttattgaaatgtgggccaggcgtggtggctcacgcctgtaatcccagcactttgggaggcagaggctggtggtcacatgaggttgggagttcgagaccagcctgaccaacgtggtgaaaccccatctctacaaaaatacaaaagttagccgggcatggtgatgtgtgcttgtaatcccagctattcgggagctgaggcaggagaatcacttgaacctggggggcggaggttgcagtaagcagagattgcccattgcactccagcctgggcaacagagcgagactctgtcaaaaaaaaaaaaaaaaaaaaaggaaagaaagaaatgtatggaagagaattaaaaaaacaagcagccagatataatggaaaacagagatctgggctcagagctacagcattcaagtgctgacttctccacgcacaagtatgtgaccaagggcaatttcctgaacctccgtgaacttccattttctcaactgtaaaacgaaatcatgttaccaccctagccattacatgggaacatgtgtgcaaccagttgtataaagtgtggtaggcagaataatggctccccaaacatgtccacctccgaatccccagaacctggaatgtttaccttacatggcgaaaagcacttggcagatgtgatgaatacagaaccttatcaggtgggtccgatgtaatcacagcatctttattatggaaagagagaggcagagaagaaacatgactatggaagcagacagacagagatttgaagatgctttgccattagctttgaagtagaggaagggaccatgagccaaggaaagcgtggcctccaggagctgggaaagacaaggaatggattctcccctagagcctccagaagcagcacagcactgcagacaccttgatttcacccagcgagaccaatgcagatttctcatctccaaaaatgcaagaaaatacatttgtgtttcaaatttgtggatatttgctacagcaacaacaggaaatgaatgtaaaaccttctaagaaaatggctgttcttctaaaaaatcaactctttttttgtttgtttttttgagacggaatccgctctgtcgccaggctggagtgcagtggtgcggtcttggctcaccgcaacctctgtctccaggttcgagcaattctcctgcctcggcctcccgaatagctgggactacaggcatacacaccacgcctggctaattttgtatttttagtagagacggggtttgtacatgttggtcagctggtctcaaactcccgacctcaggtgatccgcctgcctcagcctcccaaagtgatgggttacaggcgtgagccaccgcgcccagccccagctaattttttgtattttcagtacagatgggtttcaccatgttggccaggacggtctcgatctcctgacctcgtggtccgcccacctggcctcccaaagtgctgagattacaggcacgagccaccatgcccggcctggatcaactctaaaggagagtagctggggttccctggctctgctgaaaattatgaagcaggatatcttatcagtttgagctgctgtaacaaaatactgcagactggacggcttaaacaataaacattttctctcatggctctggaggttgagaagcccaagatcaaggtgctgccaggtctgatgtgggtgagggcctctccctgatttgcaaaggtccaccatcttgctgtgtctcacatgctgggagaaagcgctggtgtctcttcttcttctgggggcactaataattccatcataaaggcacacactcacgacctcttctaaactcacttatctcccaaaagtcctccttcaaataccatacattagggattaggcttcaacacatgaattttgggggaggagggggataaaacacattagtccgtagcacatggcatcctctcttgggaaaccattgaaaactgtgccccaagagagatgccatgtgctatggactgaatgtgccacacttaaataggataagcaatcaagtcagtagtctgtctatccattcatatgtattctagttattaagttgtaaggaaaatggcaaaacaatataatttctcccctcagtgaagggatgacccattagggaagagaagaaaagaggagccacagagctctcatttctttcacatcccgaagtggctgtctagcgaatgtgtcccacaacaggctcttgacctgaaacctatggggatggacatcagcggatccatcagcctcctgaataagatgccacattctaagggagattcatagagttagatgtcaaaagtgtttgggcttgaacccaaaagttcagaaccatttatataacaagagaaagattatagatagaagattaaacatataatagatatgtcaataacaatccaaatatttgtgatttacttttagtatggagagatgggactctgaaggaagaagaaaactgaatcaggccctccagggctctatatctcagatcagggttgtttgatatttgctatggcatacaaaagggccattcagaacaagttctgtaagcatatttttcctctctcctgagtccacatatgtaagctattctctacctcacacacgctctctcaatcccacctacacctgcagcaactgccccagttccaatgaagcatctccatggccatcttcacttcctctcccagttcctcttgaacctgctccaatctctaaaaccacctttccacggttgccaatgatctccacatgacagcatcctaacatcgattcctgagcatcagcagccatgtgagaaaggtgaccctcctcctccacctttgctgcacctgctgtctgggcccccttacagtataagccccttgaaggcagagtctgtttattttactgctgtagcctagagcctggcatatgatgggctcttgaaaatatctgttggatgaatgaacatcacactcacggaaatgtgtgaaaaaggcccagctgtacaaccggaaagagataacaaattaagggagtcagcctgctgtctgagtccattcccagcagaggctaccttctaccagtcaaggttcagtaactgccataccacagcgagggttaagtaggacagtgaagcgtgtgtgagacagaagtcggttaggaacccactgcggtcatgctgcttcctgcccaacccgcagttccgataagggtgcagagaacgatcatgtgtgcatgtgcacagactgcaggcgcccctgccaccatgcgtggtgtgcagtgggcatgaagggagctacttcggctgccacctgggcaggccttgacatactgctggcaggaaaaaggtcagccctttccccctatgctaaatcaagtcacagacagtaggacagcctccaggttctcattcctcccaccaacaatgaagagtaggaggagcctctcatttactccctcccacccacccccacctggaagtgcccagagataggggggaaaagcaacagcatggtgacctgggcttatgaccccaggcaggggttggcaaagtactcaacagcctttcctggacagtgcgaacttttgggtgcttctgcactctgatacaaacatttccttaaacatttattcaatattttattattattactttttatagagacagggccttgttatgttgccaggctggcctccaagtcctggcttcaagtgatcctcctgcccaggcctcctaaagagtgggattataggcatgagccactgcactgggcctaaaaaaaactttattatggaaatttcagacaaacaaaaaaattgaatagagtgagctcccaggtactcatcacccagcttcaacatgatcaaatcagggtcagtcctatctgattttcccctgaggtgtccatgtcttggtttctgcaacaaccccagttcaagcgtgtcgtcttggtgtaattaatagctccctctttcagttcaaacttgcctgggattgaatgataaattatatggtcatctgatctttatcccaactactctccctgcaccagattattttgaagaaaattccagacacgaaataaatccacccataatattcacaatgtgatagtaaaggcttaaatacaactccacaccctttagacaccaactatgcagcactgtgccctctcctctcaaggggctgttggaagggtcacccagtaggctcgtgctacatgctggcatatggagcctcaccgggtggcatgaccccagcttagggatgggctgacacacatgcagagaagccacttatgccggcctgactctactgcatcgcctccttcatggcaccacactgcctccatacaggaggtctagcaacggtcacggacagcaggagagcgaacagactagcagtctgtggctcgttttacacatgcacgcggaaggagcagcacgagttcaatcattccaagtgaaaaaatgcaaacctcaaactgacccacagagaataaaatcccatctttatctctgctctccgggtggtagcactgcaagattctagagccaggctgaaagtagggtattttaagcaacctaccttcctgacatttacgagaaaatagcaagagaaaagggcataatcatgttttctgagtcctcagaagtgaaccggaaagttccctagtctatgatccgcaaccctatttctgggtatatttcctagcgaaatcctcacacaggtcaatcagaatacgcacgaggatgttggccacagaaccatgtcgggtagcagatgatccccaggggaacgggaaggtccccgcagagcatgtacatgatgaatactatgcagcagccacaagcaatggattaatgtgcacgtcggacagatccaaaaacagtgctgagagaaaaaaagaaacaaaagaatcgtagcaccaggccatttgtgccattttacctaagttaaaaacacatgcacacaactaaaccttagattaacaaaacccatgtatgcacagaaatgaaaaattaaaccaatacaccaacatattgacatggttggctacggcggggtggggaatggacaacaggaattaaaaaacagtcaatgtatgaatgaataaaaccaagacagcagcctggccaagaccagtgagaccagcatagtgtgtcaaacatgtaatagcattaactcaacaccatgcactggagggaggtctaaaagaaaggaaaaacaacagctattaataaaaactagcaagcaatcaacaattgtgaaaaaaaaatcttgcctcaattttatatttatgtatataaatctatgtatatagatacgtatactatctatgtgtgtatatatatatacatatatatagacagagagacagagagagagagaggagagagagagagagagagagatggggtctcactatgttacccaggttggtctccaactttgggctcaagcattcctcccaccttggcctcccaaagtatgggattacaggcgtgagcactgtacctgcctggcccctcaattttttaaatgctttctttcactaactagataaccgttgagtgtgatgaacagtagcactggggcccatcactacaccaacacagtatctgcatccagaggggaagctggaggggctcaaatggaggccttcattgtaatgcctccctcacagtagggcctgggattgctggtcacagggccacctgcttccaattgggtgagccatgtcacactctgtttacatttcttacttgcaaaaggaggggttcaatgggacaatctacacctaaattgcttcctgctctaacacttgacacttgcacaagtgtgtatgtgtttgtgtatactacacatagctaatcctatgttctaaactgtgttaatgcttaattttgtgcatacgttactgctctagtgggtggacactgaaggctgaatccactttctccaattaactgcaggttactcgtgtcaggcactggactggacactgaacagtacaaggggcagtttaagctccttcctgagcttaaactctgatgagggatccagacaagtaaacaagccagagcactaccttgtgatcgcattacgacagggacaaggcaaggtcccaaaagtaactaggagtggggcctgcactgcattttggggccagtgggttggggtgacagtgatgtgaggaaagcattcttttaagaaggaagcttaggctgagactaaaagataagcaggccaggcatggtggctcatacctgtaatccagcactttgggaggctgaggcaggaggactgcttgagtccaggggttcgagaccagccgggcaacacagtgaaacccatttctacaaaaaatctgactgcataccatgtatctgatattaaaaaaaaaaaattaactgggcgtggcggcatgcactttgtagtcccagctattcggaggctgaagtgggaggactgattgagctcaggaggttgaggctgaagtaagccatgatctgccactgcactccagctggaaagaccttatctcaaaaataataaaaaataaaagataacaaaagctagccaggcagacaaggggtaccctaggtgcaggagtcaggggtgaaaaggaagagttgcaggtcgagggggcatcatgtgcaaaggccccggggtgacagggagattatttttcaaagaactggaagaataatgatgtggttggatcagaaaggtagacacctatcagcgctcatgggtatagtagattgtattttccccaaacagccccaggactatttccgtcccaatgcacttccagaatcttgccacccttcatcaagcactggagtctgttttccctgccctgaacctgtgtgggcctgggactgttctgacccagagtacggccaaaatgctatgacttgaaggctaagtcacacaaaagatgcagccactgcctatttcaagaccctcacccttggaacttgccaccatgctgtgaggaagcccaggccacatagagaggccaccatcagcatttggttgacggcccttgctgaggtctctgtggagaaccagacacgtgagggaatgagccatcaaaggtacctgtggccaggtacggtggttcacacccgtaattgggaggccaaggtgggcaatcgcttgaggtcaggagttcgagaccagccaggccaacatggcgaaaccctgtctctataaaaatacaaaaattagccaggtgtggtggtgggtggctgtaatcccagctacttcggggctgaggcagaagaatcacttgaacccgggaggcggaggttgcagtgagccaagattgaccactgcactccagcctgcgtgacagagcaagactcagtctcaaaagaaaaaaaaaaaaaagacacctgtgcctgaccttctagttttcagctgaggtcccagacatcatagactagtgcttctgctgtgccctatgcaaatacaatacctgacccacatagtccatgggcataataatagttgttgtaggtgatcgagtttgggggtattttgttatgcagcaccagtatgagacaaatggataaagcatagtttattcacataatggaaaactattatagcaaggtgacgaaactctacaaccctacacaacaagatgggcggctcccacacatgatgtgaatgaaggaagagacacatgagtgcacgaggatcactatctgatccgatctacttaagatacaaaacaggaaggcaagtccacgctgttacaagtcaggaaagcagtacctccatgggagctgcaactggaaggggtatggtgggcggggttgggggagggttcctaggatgtcagtacacagaggtattagtttgtgaatgcatcaggatgtatgcttatgatgtaatataagcactcctttgtatgagagtaaactgcaataaataggtttccttttaaaaaatgctgacagagttgcaaaaaatgtggatgtggatgctaaagaggaaagcaggatcgggggcaaggtccattgagggtttagtgcatcattccagaaacactgcagaactgttgaacagttcagaggtggcttatatttcgaaatattactttggccatggtgcagtaaatggattgggaggagtcgaaaagcttgcaggcagtggggagttactgcagtcattcaggctatcggtggtgtgaatggagaggccggccgggctaggcggccctgctgccctgccaaacatgaaggtccctatgctcctggggccagtggctggctgcccaatgggccatctgctggacttagaatccagaagggacatctggtcaaccgactctgaacaattatttgtcttgattactgagtttttttggcatccccttatatttctgcctggctctggcagaaagtgtatggattaaaaggatttttaaagggtttactctctggacatgttattagcttagaagtcagagatttaggggtgtagaagttaatgatactcaacagctcgcttgggcaactgggtaaatggtggtttttgtggagacatgaactctacaagggaatgggctgctagaaagggggcaggggtgaagatgatgatacagtttggggcataccagttctaggaatgtgagaaacatgtaagtggagatagctggtttatctggtgtgaggggcgaggcccagggggaagatctggactggagatatggattagggtacaaacagttttaaaagtccagatgaggccatgcacaatggctcacgcctgtaatcccagcactttgggaggccgggcgggtggatcacgaggtcaggagtttgagaccagcctggacaatatggcaaaacccctctctactaaaaatacaaaaattagctgggcatgggggcacccacctgtagttccagctctcgagaggctaaggcagaagaattgcttgaacccaggaggtggaggttgcagtgagccagatcgcgccactgtactccagcctgggcaatagagcaagactctgtctcaaaaaaacaaagcccagataagcccactccaggagaatgtacaaagatccaagactaagcctgaggggaaccatttaagggaacagagttaaacacctgggcaaagatggtggatacaggaaatatagagagcagtgaagaatatttacagcagggtaagaggaaaaaataacccccctgccaaacaatgatgttcccatactggagatgtctatgtgcaaagcaactcttcttgccttcctttttttttcttttctgaaaaggcaatagtgccactgaaagattatctcctaactttggttgacaactcagatctttaaaacgatgagccaattaacgctgttcacccctttggctaaagagagcagaaagtaccatttttctgactttcttgggtccctttggtgttcttcgggcatcagttgattccatccattttctgaatgaagagagggaggagggggtgggaccctcgaatttttaatgctcccaaaataactgagtgaggaacttctggcccatttcacagaagagggagaaaaaaaaaagactcagacaagtaagggaatagatgttgggtgaaaagggaagtgtgttctgggccttggctaccagggccaaattttaagcatggatcagggcgatttcactttgtgcctagaggtggtggacctgcgtggctgcagaagtggtgaggagcttgttgcacagatgctaaccccagggccagccccagccctgctcatccactgcagcagctggtctcggaggccctccacacacctggggtagtcttcctccaaaggtcctgctatatagcaggatcactgggtcttagctttttggacaaatatttgaatttggctttaataggcaaaaccaatcaagtagacatccgtgaaaaaggagcagtagatatggatcagagtgccactcccgactctgctgtgggaaaagggattggccacagcagcacagctgctccactgcttgtgccccccgcaaactgagacctggccaggccagggttaactggttcatgatttttttgagacagggtcttgctctgtcaccaggatggagtacagtggtgtgatcacagttcactgcagcttcgacctccagggcttagcaatcctcccatctcagtctctggagtagctgagactacaggtgcatgcaatcatgccagctaatttttttttttttttttttttttttaagacaaggtctcgctctttttcaccagttggtcttgaattcctggcctcaagtgatactcccacctaagcctccccaaatgcttgattacaggcatgagccaccatgcctggccctctaatactatttttaaatttttctgaattttgaaagtttttataataatagttttttaaaactgcagtgaattataggatattcacataagcaggataaatacatgattataaatagcttcacctcagctcaagttttgctgccattgggttaagaaaaagcatttaattttcagagtgttctggatttcagatttgtagataaggacgtattaattttgtggtgttaccattctcatttaggtctttagcccttctagagtctccattgtgtatgatagtctgtgcagatccagttaatgtttctccattttaattagtcaatctcctaacattatctattaagcaatccatccttctcccattgattcatggtgccccttatcgtatattaaattcccgtatgtatatgggtctttctctgagatcattattctatttctttgtctattacctgtttttgcgcagacatcatttgcttttagtactatggcttagaagttaaaagttcccttttctcttctttctgaagtttaacttaggtaatccaaatgcatttaaaataagatttcttcaaaaaatccaattagaattctgaacgggttttacttgtagcagatgtattttccaaagatagcaccaatatatatctcatcccacatgaccttcttacaaagtatattaacactcctctatcgagacatggggtctatgttctcttgtacctagagtgacctcccacctgcctcaaccaacggaatgtggcagatgctgtgtgacttccaaggggcagtcaaaaggcaaaatggcttctacttggttctcttttgggacaagcgctgtgggagccctgagcaacctatacttagtgcagtaacccagaaggcaccacattggagagatcacatggaaaagtacacataaacagatgacggagaactgcagctgtcccagccccaaactgcttgagtctcccagaccaggcaacaggtatgtgagtgaaaagcctttgagatggtcgcagccacagccccatctgactgcaacctcaagagaggcttcaaaagccaaaaacgcttggcagagctgcttcaaatgcttggttcacaaaaactgtgagagataatgattattactgttttaagctattagttttggggtaatttgttaccccacagttactgaaatagccctgaatttctaagtcaagagaaaggaagattatcattttataatactagatctaggctaggggtggtggctcacattgtaatcctagcactttgggaggccaaggtgggcggatcacctgaggttgggagttcgaaccagcctggtcaacatggtgaaaccccatctctactaaaaatacaaaaaattagccggcatggtggcgcatgcctgtaatcccaactactcaggaggctgagacaggagaattgcttaacccggaaagtggaggttgcggtaacctgacatcgcgccactgcactgcagcctaggtaccgagcaaaactgtctcaaaaaaatcttccattgaatataatgtttgctgtagattttggtacaggatttaaaaatcaaattaaatatcccttcatcaatattttattgagaatgttaacataaaatggtactgaactcatcgaatttgttttccgtatcaaatgagataatcatgcttcccctcctttggtctactgatgtaacagggtctctgatgttgaaccagtcttgtatttgggggaaaacagtatttgtgatatatgtcctcaatacactattaggccagttatctgtactttatttggagtttttgtaacagaggtaccagggggctttttcatttgtgattaaaattagtatctgtttagtcttttttatgtagtattcagtttcttcaaagagcgagcctccaactcttgtctctacccttgaacttctggaattgaatgggaaacgagtttggagcctagtgcaaagatgccttctgaccctgtggtttggcatctcactcctaccttcccttcctagggcttggccaagtccatacactcctgctctccagaggagccctcccaacaggtgcaggactggaaaaagtcacctgagagaggagcagcagcggcttccacatacaggactttctaacatcctcttgtctctaaggttaatcgtgatctggctaataattggtggagtgtccacaggagggctaccactagccctgaaaagggtaaaacttcgatatactgacttgtccacaaattgaggggaaaaaaaagcaagttatagacacgaagaatgtgacacccttagcaaacaaaaccattcatgcttgcataagcataaggaaggatacatttctgagtgtacacacccatgctttcaagggctgcctggtcacccaagagcagggagaccagggcagaagaagggataagaccttaactttaagctttctatattgtttcattttgtgatgacgaactcaaattacttttatattaattaaaaacaagtcgccccacaccttaatccctaccctaattatccctggatctcactaaacgtcacaatagttggcactgctactacaaaggtgtaagtaacaaacggccagaggtggctctggccagaacaaaacaacaaaaccctggaggagttgaggagttgccgtgcggagtagtctaaggcacccccgtctcagggaggtgctaacacatccagccctgcaaaccccgtgcaggagcctcagccgcaggcacctcggggttgggtgattgtactagagtaagaagtaacagcctcccccaggctttcttatcatttttgcttttcctcgtcttcagctctggctgctgctatcacttgtaatactataattgccaaggcaatgggattggtataatttctcgttcatgaaaacacattcccttttttccttatttgaaagcacacgagttgctgagcaagggtacaggaacacggcctatctctcacgtgaagtggggtgagatacacccattctacattccgcaggaccaggtttgcaaccccatgcacctgccagtttgctgggccctgtgaggggcaaggacggcacatgcactgctgagggagcaggagggtgagctgtggcagggcccagcagtcgttcttccgaaaagctctctctggctttccttgatacaagacacacagggtgccaagtatagaagaagggccaggaacagcctgaaaaggtctccattctccaaagcagctctgagtcgttgctcatttagctctttcatggagtggggcaagtgagtaggaggaagaaaaaaccacgcggcagcccacatttctagagccactcctacgtgccaggcaggttctgggagatttattacattgttgcatttaatcccatgaacctctgctctaagcacgctttttttttttttttcctcggagactgagtctcactctgtcacccaggctggagtgcaatggcacgatcttggccactgcaacctctgcaccccgggctcaaacaattctcctgcctcagcctcctgagtagcgggattacaggcatctgctaccacgcctggctaatttttgtatttttagtagagatagttttcaccatgttggccaggctggtcttgaatgcttgacctcaggagttttcttgtttattaattattattattattttgagatggggtctcactctgtcacccaggttggaatgcagtgcacaaatcttggctcaccgcaacctccacctcccgggctcaactgatcctcccaactcgcctctcaagtagctgggactacaggtgcacaccaccacccctggctgttttttttgtattttggtagagatggggtttcaccatgttccccaggctggtctcaaactcctgagctcagtgatccgcctgcctcagcctcccaaagtgctgggatttacaggcgtgagccactgcaccggccaaaaccctgtctctttaaaaagaaaagaaatatcaagaatggagccccgtatttaacaaaaatcctaagccaggagactggctccatattctccaacacttctctagtgccactagcatgaggggggcagatacacacagggaggtcacagccaacccaaaaggccacttttccctcctcattgctgaacaaaggcagcgactgcactgtgcctggagttttccctcctctactccttctctgattgagtcttccactcacagagcttggtggcgggggcaggtctgcaagtgctcgcaagcattcacctcttttgacagccactgaatttcagagttcacacagtaactcacaaattcatcattcactctagaaactacccgcagtgtcttccttgatttattaattaaatacttttaagagtagatcaaggtctttaggctaaaattaaaaacatgccaacgaaaaccaccatatatttttccaaagctaaatgccatgcacacctatccacggcaaacactgatgcagcaccctggatgccaagcaggatggaggtgggagacatcagagatgaagggagataagtaaagcaggtggggcctggctggtgatgcccaccccaaatctaggctggaattaaacctcacctccaggaatgtgcacaccccacagggaggctagagggtctgctcgggcctcctgaaggcactccctgcagatcagggtaggaggaatgacctggggctttccagagtccggtgtgagcgcccagcttgctgctggcgtggcgctggggaagcggggctatgtggggagctacaacaggtacgttctcatccaggcctgtccctaaccactcgcatgactctgcaaaaatttagctttgtctcctgtttttcactcgtaaagtgaggcttatgcctctaagtttccctccattataaagcctctgaaaagttagagattattgtcatgtttctttcctaccacaggtccctcaaggggaagttctggaagaaccctgtgttcttccaccctgaagaaagggggcacttctccaggtgagcaaaaggagctgggaagccccaggcctcccacgtggtaaatgttctaaatattgtcagaactgacacctcagtttaaaaaagtctgcattagaaaaggcaagggggacttgctattcacacacagcctgtaacttagaagattcctcctcgttcctcctgtgtgttcatacggccaggccctccggacgcctctcctagcaagcaccagccccaccccatatgacctccattacccacagtggcttgacgtacagaggctctcacaaagtcatgaaagactgagaccgcaggaacagtcatcttgccgcaggcggccaagagaagcctgataagggggcgtcctgctcctcccgggtgatcctgctacacacatagatgacaaagggagctcgggggcatgggccaaagctgctgtggaaaggtaaagacacagtccatatttgcactctctttgacttactcttttaattgactctttccgataaagaattcatttcacttcagcaactgccaactttgcaaaaggtcagtgcactggccatgagccactgtcgatggaaacttctcagctgccttcgagatgccttgagaggctggtgcttgatggtcacgggcctctgctgccttcgtctcccgggctgtgctccacgctgcttcccagggagacaacgaccaggcattcccttctgacatgccttgaacgcagaaggttctaagcatgttattacaaatgagctggaacagctctgtcaaacaagttctgtaagttgtctcgattcttctgaagtgactgaacaaccatttgcttagattctcacttggcttagatctcgtagcataacaacgagaacatgaatattttttcattgacattgtgtcaagtcaaaagtgtaacctaattttaagcttctctcacagattaccttaagggaatacaatataaaccaccatcttctactgtctcggcagcaggctcttgggaaagggaactctcccagttctactacacttgggccaattgtcagtaaaaggtctcagccaggtcagaactgacgcaaagcacctggttcctcaaattagcactttaaaccaagctgctgacaagacgctcgttgtgttaagaaacctaaaggagtgaaagtcatactgtggtgtagggatcaattggaagtcccatactttttatgtcttcttccctaggtaactttgccatcacacacacatgcaaatcaaatcacaaaactgctggcaaaaatatcagagctgtccatcaacagatgaatgttaaagaaaacgtggtacatatacactatgaagtacgattcacccataaaaaagagtgagtccagtaatctgcaacaacatgaatggaaccggagatcattatgttaagtgaaataagcaggaaaagaaagataaacatcatatgttctcacttattggtggggatctaaaaaccaaacaattgaattcatggacacagagggtagaaggatggttaccagaggttgggaagggtacgggggtgtggggggaggtggggatggttaatgggtgcaaaataatagaaaaaatgaatagacctactatttgatagcacaatagggtgactatagccagttaataacttaattgcatatttaaaataaagagtgtaattgtttcgtgtgtaactcaaaggataaatgcttgaggggaggataccccattcttcatgacctgcttattatttcacactgaatgcctgtatcaaaacactcatgtaccccataaaaatgcatacctactatgtacccacaaaaaatgtattactatttttttaatcagagcttcatattaggatctgaattcgttagtgtcccctgaaggggagtcccactgcacagccttcttgagaacttccttccctattttcttagcctcctcctcctcacaagttacaaaactccagtaccctcatagtacaggggagaaatagagatgaccttggaatctaccatcaaaatcaaagctgcggccaagattaaaatccaagtttctggccgggcgcggggctcacgcctgtaatctcagcactttgggaggccgaggcaagtggatcacttgaggtcaggagctcaagaccagcctggccaacatggcaaaaccccatctctactaaaaatacaaaattagcaaggcagggtggtgtgtgcctgtaataccagctacttgggagggaggcaggagatcgcttgaacctgggaggcggaggttgcagtgagccgagatcacaccactgcactccagcctgggcgacagaatgaaactgtctcaaaaaaaaaaaaaaaaaaaaaagattttctgatctggtatgctagggtggatttcatggtcattgtgctcaaatgtagagataggatatattccctgctcctgccacaggcaaggtgggactaccctaacttagaaaactgtcggccggggcaatggctcatgcctgtaatcccagcactttgggaggcaagatgggcggatcacaacgcaggagtttgagaccagcttggtcaatatggtgaaaccctgtctctactaaaaatacaaaattagccaggtgtggtgatgcgcgcctgtagttccagctactcgggaggctgaggcagagaatcacttgaacctgtgaggcggaggttgcagtgagccgagatcgtgtcactgcactcagcctgggcaagagagtgagactcgcctcaaaaaaaaaagaaaagaaaactgtcacttaccttggtttgtaacggcaagtccaagtgctcctgggtttctacaactgagagaagctctaatatcctgggctgtaccaaataatcaaacgaggtctagtcataaaatcctagtcaaatgtctgtctgatcccctagactttgtaaaggagtgaagagagaaatgagatgaaggaactaaagaatgtaacttcaagggtcaaatgaaacaaagccggcctgaaggagagaaaggagggtcaaatccatcagcctaagacctttagtccatgtttaaattgatttatacaatttccaacattacaggtagagtaaaaacttcgaacttttggctccaaacacttctctgctcacatcagaaatggaaggatcagataagacctgagaacaaacttcaagagatagatgggagtcttttgatggctgaaaaaccggttcctacgagatctgagccatttcgtcacaaacaaaagaagaagatgggtagttttctctgatacccccactgcatctgagatttctcatgctttattgaattcattatgctgttctttttgaaaatccaagatatccagcctggctaacatggtgaaccctgtctctacaaaaaatacaaaacttagccaggcgtggtggtgcatgcctgtagtccagctacttgggaggctgaggcaggagaatcgcttgaacggaggaggtggaggttgcatgagccaaaattgcgccattgcactccagcctgggggacagagtgagactctttctccaaaaaaaaaaaaaaaaagaaaaaaaaaaaaaaagaaagaaagaaggaaagaaggaaggaaggaaaagaaaagaaaagaaaaaagaaaatccaagatatctggggccaagcctacaagggaaagggtagctgcaaagtcctgacacctactctcaaaacagtccggatggttggcagttctctggctcttcctagagcaggcaggcctgacacattctgaggcttccttcactgctccagatgctcacacagctggggatcaaggccagtatctagttgtttatattcaagtatgaaagcctggcgggtagcagccccttggaagggtaacatttggcagcagctcatcaacagtcaaggaaaacacaaggtggtcaaacactctcaactaaggcacacagaaagcccagcgcattcctgggggatgagaccgatttatttaaaggacaaacggaaaggaaccacgaggatgtgaacaactctcctgagtccaaccagcagagcaagatgagtaccaacacccactgccatctccctccacctagtctgtcatcaggttaccaaactcaacccaaatcccttttccaaagcacgtgatgaggtttgctacttactttctgcccaagtcctgggagccctgttgtccagtaggctatgattcctctttaactgatccccactatggcagtcatttctggtctagagtagtttcccatctttaacaatttatctcattcttttgagaggccttggctactctgttattctcttagttcctgctgactgcaacagtgttgggccagcaggtttggggaaataatccttgggctaacatttattgtgttattcttagagtgctccttgcaagcaaagctactgaaagccaagtagaaaaagctgcatataatggatgagaacagctcacctcaagggaccagccacagcgtcctcagatctaaacgctcccgcacagaaagcaaaggagcgtccattgtggcacatgctgtagtcccaggcaggctgaggtgggaggactgcatgggaccaggagttcgagatcagccggacaacatagtgagaccacccccccgtctctaaaataataaaataacataaaatatttaaaaaaaaaaaaaaagaaaaggaaaggaaaaagggcaggtcaagtatcagtgtatttagggaccagaaaggatggaatgcggttctctctcaggcctcatatttgttgagaaggtttaaacagcagtggtccctacttttctccacacacagcccaccatgtataaacagcaatttcgggtgggcgtggtggctcacgcctgtaaaccccagcactttgggaggctgaggcaggtgatcacctaaggtcaagagttcacgaccaacctggccaacatggtaaaatcccatctctataaaaatacaataattagctgggtgtggtagtgcacacctgtaatcccagctactctaccaggaggctgaggcaagagaatcacttgaacccgggagacggaagttgcagtaagctgaattgtgccactgcgctccagctggggtgacagagtgagactctcaaaaaaataaaaatgaaaatacatagcagtttccaaggcagaaggaaagaaccaattccatcgaatttcttgcaagcagctgttatgacgatcctgaggccagggaagatgaatcccttatttataaaaatgaagcggtcaagatagcacctgaaagaccagaatgaatctggtcactctgctacaccaaacggccaagcccctggctaaggaataaattgcttcttaaggagcttttcttaatctggcactctttatccaggaccaaatcaatatattaaaaaaaactccaagtgttgatcaaacctgggactctagcagagcaaagaagaaaacaaaactgtcaccatctgtatttgtattagaataccttactaaattccatttatattagaaatctggcatgaataagcaacaaacaagcacgtaactacaatggagtcaaaggagcagggacatgcagcaggacggcagggtgggggtattcaagatgccccggtagtacctgattctgaatgagagaaacccccaggagattctgaacaatctgaaagaaaatgcaacagcattacggtactctgtatggagaaatgtccatcaaaacagactctaaatctgtaataccaactacccaagaaactgaactagaggatgccacaggcctaatgcatcaggagaggaatctagtggcattaaaaagtcttttcctgaccaggcgcagtgctcaggcctgtaatcccagcactttgggaggccaaggcgggtggatcacatgaggtcagagttcaaaaccagcctggccaacatggtaacttcttaagttaccccatctctactaaaatacaaaaattagccaagcatggtggcacacacctgtaatcccagctactagggaggctgggcaagagaatcacttgaacccagaaggtagaggttgcagtgagctgagatcatgacatgcactccagcctgggtgacaagaggaaaactgtctcaaaggaataaaaaaaaaaaaggttttccatgaaccaagtccttgaaatgaaaatgatctatcctctcacatcatgatacttggaacttcagtatctgtatcttcagtatttttgtccaaacatacagtttccattcttgtcgaggaccaataccagatttgtcaaccaagaaaggtaaacatcaacctcacacataacataacatcatacataatcttatacctcacttttaaacctattcttttcagaaccactagaattatgagcagtactgtcattgaaaacgatggaatcttccaccatactcaaccctttcaggcctctggccagagctgcctgatgaaaatgtgaatgaacacacagtcactaggcttacagctgggctgaatagaatgaaactgatccttttacagttcaactttcttaagcccatacccttaagaagaagattccaattcatccttatggatccttaaacttcaaactatatataaaaggagtcttaatgtgatatggggagaggcacctgcagaactgaccatcagctatcaatgctaaaatgattacagtcctcagaattttctccaaaggcaaatatgccccattacatagaatacaacatgcctgctcagcaaaggaattgaggtaaattctgagcagctgagggatagctggatcactggttggcaaatgtctttatcgaggaaatactggaacagaaacattgatggtttcttagaagaccctcttggtccttcaaggatgtgcccagttggagacaaggccagcttcccaggtaatgctacttttagtaggaaaggcaataactacccccacaagactgagtgttatgctgtttttcttctgtaaaatcaaagatctttaatctctaaggtcacttggaaagctggtagggtcccgaggtcaagtctgcagcattcttatgcctttccagcagaaatgagacccacaggctggtaggaaggagctccttcttccaggcaggcagctggtgtgtccacaatgtctgtgggcaaaggaaggaaaaggcctctcatagggagacgagcaatgcctgtcatcagcctgcagtctacccaagactccaatgtttgaggacagaacacgacctactcctgggctgtagcatggaaagtgctggaaccaagttcttcacaacaaagacatccaataacttagggcctggttctgctgcaagaaggtgagattctacatcatacattggggactggaaagacagatggatacacacaaatgaaggagtggttctaaattctagtaagcctgggtgatacagcgaactccgcctcaaaaataaataaataaaaataaataagttctagtaagccagtgttgccatttatttaaacctgagaaacagttcctttagaaagcattaaaatgggagcaatggaaaggtccaaatgacgttcccacacttctcaattcactccctgcatcaatgcagcatggggtgtgcctggccctgcttgttgggagaggaaagccatctctttacaaacgaacgcctgcccaccagtctgcctgttacaaagggccgtctttctgaatttgttctagagagctgatatgatacagtaacagtttcattaggacaccctgctcctttaatttctgctctaaaacaagacagtagacaggagaaaagaccaagaagagagtcagatcctcctgtttggacttgacctgtaaaaaggctagagacaagaagggctgggatggtcccagtgatgtgggcagtgaaggccaaacaccattgccatggagcaattcccacattcctagagaagccacgctccacgtgaataggaaggccaatctcccaggaggattagtatcaggggagaaatcaagaaatgctaacacagacttagcttgagaaaacagccaggggagaacaaagtgccagtattacctgattgctaaatattaaattgctgcttaggctaaaaagcaatggttccttaggccctgaattaaaggcaccgacacagaccagcatgaggactgagaagcccacatagtgacctccactctgaccataccagctttcccccacttccctgcagaccctatggagaaatctgcccagagaatcaggcaggaaagatgagccagtgcctggcttgtcccttgagccaccaaagtcaacaaagcagacagactggcagggtgccagggaggcaaagtggcatcagcttctcccagcagggccacgcctcacacaaatggacttttagaacaagagtaccctaccctcacaacaaaggtcactgcatttatttccttctccaaagcaaaatggctgaagccaggaactgcacttctggtcaacacagttaggtccttcccactctgaaagacaaaatgcactttgcttgttgaaacacagcaggatgagattttccacatgggcttctgcctttttcacaggaaccacgaaaccagaggaaactaaggtccttgcttagggccttgggggagtacaaagggaattgtcaacaaggaaggaagaaatatctcaaatggcatcagtcctattccctgaaggggaagacacatagttcatacgaaaagaaagttttgaccatggcttgggaagactctgatcaccaaagggaatatgtaacaaagaattgcgtggccacaatgagccaaagccagcagaggtgacctgaacagggagtacaggagccaggaacaacctgggaataccctaaaggctcttttctaaagtctagactttctccaaaagtgatgtgtacacaccaaagtacaaactgaaaagacattttctgagcttgtgaggaaatactacttatgtgagtccactctgcttatttaataggtggatgtgttttacagcacggggacatctatcatgggcattagggaagctcacaaatagcccctgatagtgacagccactggcattggtgatttttttttttttttttttttttgagatggagtctcgctctgtcacagaagctggagtgcaatggtgtgatctcggctcaccgcaacctccgcctcccaggttcaagcgttctcctgcctcagtctcttgagtagctgggactataggcgtgtgccaccaggcctggcaatttttgtatttttagtagagacagggtttcaccatgttggccaggctagtcttgaaccctgacctcaggtgatccacctgccttggcctcccaaagtgctgggattacaggcatgaccactgcacccagccattggcgatttttatgtttttagctggagtcctcaagttagagacaaaaatgcttttctgaccctctattcccaccttatatgtatatttagataattgatgttaactttaaggttctagccacccacctgaaccagttttattatgtggggtgggaagtgaataaagccccctagatttcctctgcgatctataaatagagcttcaggaaggcaatcagctacctagggcaggaatttcagtccatttgctcaggaggctcctccctcacttccaatccgaggccccatggagctaagtcagagggcgccgattcacatcatgtccccagtggcagcaatgaaaaggctcagattctcctcattttcacatgggttgccagccttgctttaactctgaagtttgtgttccacagagcaaaatcacaaaagagatcatgcaatgattaagagtgcatttgtgaaatgcatcacaacagtaagctggacggacagacagatcgatggagggaaggcttatagacagtctgtgataaagcaatatagacaatgttggctgcacggttgaggtggtggtatatgggtgttcactgaacagttctctcaattttactgtctgacacacctgcctgctgaaatggaggtggccttgaagaagtgagaatggcagtcatagccctgaggtcagaggacaggtctcaccttaaacaagcctgctgacctggaggaggactttcacatccccaagcttcttatttaaaagggtagtggtcaaaatcagggacctttttacaaacatcttatgtttggaccaactatgagtctactgactcacaatgtgaggcaggtggggtaacataacattatcttttcttttcttttttttttttttgagacagggtctggctctgtcactcaggctggaatgcatggtgccatgctggctcactgcaacctctgcctcctgggctcaagcaattttcccacctagcctcccaagcagctgagactacaggtgcacgccaccacacccaggtaatttttatgttttttggtagagatggggtttcaccatgttgcccaagttggtctcgaacttctgggttcagcaatcctccagccttggcctcccaaagtgctggaaaaacaggcgtgagccaccacgccgggcacattctctatcttgatagggttttgggttttgctgatgcatgtacttgtcaaacccagtgaacatgtacttaaaatgtgtacatttctttgtatgtaaactttccaccaagagaaaagctataaagaaatacttaacaccagttaatgatgtacatattgaaatatttaaaataagtatacagatgtctatagtttactttgaaatgtgtacaaaataagaggtggatagtaaataaaggagtggatagatgaatagatttgtgatgattaaacaaacatagtttaaaaaagatgggctgtgtgctgtggctcatgcctgtaatcacagcacttcgggaagctgaggtggtggatcatgaggtcaggagttcgagaccagcctgaccaacacggtgaaaccccatattactaaaaatacaaaaattagttgggcgtggtggcacatgcctgtaatcccagctactccaaggctgaggcaggagaatcgcttgaacccgggaggtagagattgcagtgagccgagacatgccactgcactctagcctgggagacacagcaagactccgtcccccccaaaaaaaaaaggggaagatgcaggctggatgcggtggctcatgcctgtaatcccaacactttgggaggcaaggcgggcagatcacttgaggtcaggagtttgagaccaccctggccaccatgaggaaccctttctctaccaaaaatgtaaaaaattagctgggtgtggtggcacacacctgtaatccagctactcgagatgctgaggcaggagaattgcttgaacccgggaggcagaggctgcaggagctgagattgtgccactgcactccagactaggcgacagagtgagactccgtctcagaaaaaaaaaatagatgtatttggaggtgggtagtagtggagggggtggtctgtcacccgtcagtgcaatcatagctcactgcagccttgaactcccaggctcaagtgggcctactgcctagcctcctgagtaactgggactacaggcatgtgccacgacacccaggttttgtttttttttttttctttttgtagcgacaaggtctcaccatgttgcccacactggtgttaaactcctagctcaagccatcctcctgcttcagcctcccaaagtgctaggattacaggtgtgagccatgtacctggctacaagttttttttttttttttttttttttttttttttttgagacggagcttgctctgtcgcccaggctggagtgcagtggcgcaatcttggctcactgcaagctccactcccgggttcatgtcattctcctacctcagcctcctgagtagctgggactacaggcgctgccaccatgcccagctaatttttctgtatttttttagtagagacggtgtttcaccgtgtagccaggatggtctcgatctcctgacctcgtgatccgcccgccttggcctcccaaagtctgggattacaggcgtgagccaccgtgcccggcggctacaagtatttttatttttttttaatatcaggaacacacgatcgattgattgattgttgagacaaggcctggctctgttgccaggctggagtgcagtggcacaatctcagcttactgcaacctctgcctcccaggctcaaacatcctctgatctcagtctcccaagtagctgggactacaggtgtgcaccaccacgcccactaatttttgtattttgggtagagacagggttttgccatgttgcccagtatggtctcgattcctggggtcaagcaatcctcccgcctcgacctcaccaagtgccgggattacaggagtagccactgcatctgggcacaagtattttaaaaaggtcctcggatggattaaacaaaccgggtccatccataccatggactactacttagcaataaaaaggaatagactattgaaataccaagagtttggagaattatgctaagtgaagaaagccaatcccaaggattacatgccctagattccatttatatagcattactgaaatgatgaaattctagagctggagaagagactagggctgactggtattagggatggggaggagggaagagagatgggtatgactataatgggcgcattagggatctgtgaggtagtggaacagttatcttgattgtgatgttggatacataacccatatgtatgatgaaactgcactaaaccacacacacacacacacacacacacacacaatgggtgcatgtgaaagtgatgagatctgaatatggtctatggatggtactaacagcaccatgccaattgcctcattttgctattgcactgtaattatgtaggatgtaccactgaagaaaccgggcgaaggtacaaaggaccactctgtgggctagtcttactgtacagaagtaagtgaagcagcgaaatttgttttttgcattttttgtagagacggagtttcgccatattgcccggttggtctctaactccggagctcaagtgatctgcccatctcagcctcccaaagtgttagattacaggtgtgagccactgcacccagcctctacaagcaatttttaaaaactatccagtgtggtggtgcacacctgtggtcccagctgctcgggaggctgaggcaggagaattgcctagcttggaaggctgaggctgcagtaagctatgatcgtgctactgcacccagcctgggcacagagcgagacctggtctaaaaaatttttaaaagattaaagacataaaaaaaaggattcaggccgggtgtggtgctcacacctgtaatcccagcactttggggggccaaagcgggcagtcacctaaggtcaggagtttgagaccagccaggccaagatggtgaaaccctgtctctacaaaaatacaaaaagaagctgggtgtggtggtgcacacctgtagtcccagctattcaggagctgaggcaggagaattgcttgaactctggaggcggagtttgcagtgagctgagattgcccattgcattccagcctgggtgacaaagtgagagactccatctcaaaaaaaaaaaaaggattccaaattccagcaaataaaaaactaataaagaatggaaggaaggacaaagtagacaaaaaaataactaaacaatttcttgaaatgaaaaggatagtcattaaaatttttttaattaatgaatgtaaggattatccacaggttttaaaaaccaccggtcaaaggttactgggaaagagatctgcgcaccatttcagagttggcagctacagatcacctttgcctagtagagatccccgaaccaagccacggacagactgacatcatgagcttcctgataggatgcagtgggaagacacatcatcatctgtgcagtccttctgccaaaaatgcttaactggtaaaggcaggcctaatggttctattctcgagagccgacaagttacaaaagggaatttcttcaactcagtgaaggtatctagaaacccacatcaactgccacttgtaaaggcgaaattttaagagcattctttttaaatctctctatggtcaggaacaaaacaaggatgcccactttcactgctttaattagtggtgaattagagagccaagccagcattattcaatgttaggggctgaatagtgtcccccccaaatttatatgctgaagtcctaacctccagtacttcagaatgtgactatatttgaaataaggcctgtaaagaagtaattaagtaaaaatgaggtcatcggggtgggccctaattaacataactggtgttcatatgagaataggagattaggggctggggctgactcatgtctgaatcccagcactttgggaagccaaggcaggtgaatcacttgagtccaggagtttgagatagcctgggcaacagggcaaaaccccatctctacagaaaatacaaaaatcagccagacgtgcggcgtgcctgtagttccagctacttgggaagctgaggcaggaggatcccctgagcctgggaggttgaggctatagtgagccatgatcacaccactgcatgctaacctaggcaacaagccagaccttgtctcaaaaaaaaaaaaagaatgatgaggacacagacacatacaaagggagaccatgtcaggacacggagaagcggagaagaccaccatctgcaagccaaggaaagagcctcagaagaaacaaccctgctaataccttgatctcggccgccatgcctctagaactgtagaaaatacatttctgttgtttaagctacccagttggtagtacagcagccctagcaaagaacatggtaggcaaaagatttaagggcttaaaaggaggaaacagctgtgatatgattattatattaggaaaggcaagaaaatctacaaatggtaataactaacacaagttcagcaaagtgctagacgcaagatctacacacacaaaagtcaacagcactcctccacatgccaataacattagaaaacaaacagacacaaaagtgttcattgtgactctatttctaaccacggaaactggaatcaagttaactgccccttgctatgaatacaaataaataaattgagccaggcacagctcatgcttgtaatcccgactctctgggaggcctgcttgtagccaggagttcaagaccgcctgggcaacatagccagaatccatcgctacaaaaaatttaagaattagctgggcatgtggcatgcacctgtagtcctaactacttgggaggctgaagcaggaagactgcttgagccaggagttcaagattacagtgaactgtgatcatgccgctgcacaccagcctgagtaacaggtgggaccccatctcttaaaataaataaataaatctgttgaggtatatttatccacatataagggaacactataaagcagttcaaatgaatggggtggatctgtaatgaatacatctcaaaacataatgcttaattttttttaatggcaagagacagattatatccacttttaacatcacacaaaattgtggggattcttataagtggtacaagtacagagaaatccacagaaataaaaataatataaacatttcattttggtgctaacacgtagatgatcactatattattttttgtactgtcccgtatacctgaaatacttcattccgggcgtggtggctcacacctgtaatccagcactttgggaggccgaggtgggctgatcatgaggtcaggagatcaagaccatcctgctaacacggtgaaaccccgtctctattaaaaatacaaaaaaattagccgggcatggtgcagatgcctgtagtcccagctacttgggaggctgaggcaggagaatggtgtgaatccagaggcggagcttgcagtgagcagagatcgcgccactgcgctccagcctgggcgacagagcagactcagtctcaaaaaaataaaaaaataaataaaaaataataatagaagaaaacagctggtgtggtggctcacgcctgtaatctcagcattttgggaggccaaggcagcagatcaccgaggtcaggagttcgggatcaacctgggcaacatggtgaaaccccgtctccactaaaaaacaaaacttagctgggcgtggtggcacatgcctgtaatcccagctacttgggaggctgagtacgagaatcacttgaacccaggaggcagaggttacagtgagctgagatcgtgccactcacttcagcctgggtgacagagcaaaactctgtctcaaacaaaacaaaacacaaaatgaacacccaactcattgaggcctatataaatgcaaacatttggctgggcgcggtggctcaccatgtaataataccagcactttgggaggccgaggcaggcagatcacctgaggtcaggagtcgagaccagcctggttaacatggtgaaaccccgtttctactaaaaataaaaaaaattaccaggcatggtggtgcgtgcctgtaatcccagctacttgggaggctgaggcaggagaatgcttgaacccaggaggtggagattgcaatgagctgagatcgtgccattgtactctagctgggcaacgagagtgaaactccatctcaaaaataaaaataaaaaaaaaagcaaacattaattctaaatgacagcgggacacagtggcctgtagtgccagctatttgggaggctgaggtggaggatcacttgagcccaggaattcgagactgcagtgagccatgatcatgccactgcacccagcctgggtgaattagccctgtctctggaaaaaaaaaaaaaaaaaaagacgaagaagagattcagctgagcaagttaggtttactggcaccagatgcaggttcacactcaaagtcagaccatgctatggccatggcaggaggccagcctgggcaacacagcaagaccctgtctctaaaaaacaaacaaacaaacaaacaagtctattactatggatggctcagataaagccagcattgacactgtcatagcatctttattgctaagttaaaaaaaaatattgcacccagcacatttgcactggtcccacctctacttattagtagtaatcttcacagctcatccatcccctcctatgcctaaggtaatgactcaagcttctccttcccagccttttcctaatagaaaaaaatggtcaagagcacctaacaaaaaaccataatgcaaatgcaaaagggcaggcagagttcagtatttaattttaggtctgttactaggtttttcttgagccctggccagggttattctggcctggcatggggaacatagtttgcatgggtgtgggttaaattaaaaacaaacaaacaaaaaaactctcacatcaagtgctcaaagaacatgtccctaggctggatccttgaggcagccgacaagcaccacccacgatccaaccaggacacctgccagaagatcctaagacgaagttttttcccacattacagaaaaaggacaggggcagcagctaacacaataattatttcaaacatctaccacctccttcttctggtggaagtattatgcaacattagagaaaggaattccacttgaataggcccatgggtgacagagcaccatactaagctctccttagggaattatattaataacagataagctgcttaacatattatgttacttcacttttaagaattccattcatggtcatttgttataaacgcagtcccttttccaagggaaaggggtatgtccatcaaataacttattaaaaatatggccatactgccttgtgaaattagtggcagagaagtcaacaggatgagaagcctgaaagtcaagagcttgggctgggtatggtggctcacatctgtaatcccagcacttatgaggcaggaggatcgcttgaggccaggagttcaagaccagcctgggcaatatagcagacccccatctctatttaaaaaaaaaaaaatggctgggtgcagtggctcatcatgccttaatcccagcacttttggaggccgaggcaggcagatcacttgagatcaggagtttgagacagcctggccaacatggcaaaagccagtctctactaaaaatacaaaaattagctgggcaggtggcgcatgcctgtatgcctatagtcctagctatttgggaggctgaagtgggaggatacttgaacccaggaggcagaggttgcagtaagctgtgcaattctagcctgggcaacagaagagactccgtctcaaaaaataaaataaattttaaagaaagtcagagctctatctgtccacacctagggaaggtgacatctaaaccactctaagaaattccaaagtttaaattctgaagtcaagatcacattttaaaagtacaaagcagctgggcatggtggctcacacctgtattccagcactttgggaggctgaggcgggtggatcacctgaggtcagcagttcaagaccagccggccaacatggtgaaaccacgtctctactacaaacacaaaattagccagtactacaaatcaaaattagccgggtatggtggtgcatgcctgtaatcccagctacctaggaggccaaggaggagaatggcttgaaccagggaagtggaggttgcagtgagcagagatcgcatcattacctccagcctgggcaacaagaacaaaactctgtctcaaaaaaaaaaaaaaaaaaaaaaaaaagtacaaagcaagaatggctggctcctgatatgcaacaggtttcgtggaaaaccagtatccacccaacccaggatcccccatgtctcttacatgctatatatacctgtgtatatatgcatatactgtctcttttatcagagtttatcagattgtgagctctatgagggcaagaacctgtcttatccatttctgtgtatctatcaggactgaaaatgattccttgcatatattatattaaatgttctgtaagtattagctgggtttgagtgaatccagcacaaaaaggcctggtgggtagaaggaagataagaactgtacagttttggaaggcagcctgttcaaaacaaacacagtctaaaatgtaaaagaagaacagccaaattttacaagaaagagaaaaaatgttccttaagtaaaactgaggaagggaagcaccagtttcctctcacaagcttctgaaaagataaaacatgtctggtttcagtgataatgtgttacaggcttaggcaagaacaggtgaaaaaaatctataaatgcaatcaaccatgaagctggccacagctcagggctgagggaaccagacttggcaggctgcttagaaactcattggtataaatacggctttaaaacaaaggaggctcaaaaagggagagatgataaatgcatcagtctcaacttgttctttattgtagacagtctcccactttattcaagtatttttggagtgccaactaccagtgagacaaggaggtgggatgacaccaatataacaccaagggaagcactcaagggtcatctttaccgtcccggagctggccttggccgcgttcccactagctgttaaacccaacatgccaaacctggaagaacgctaatacatcaacattggtgtacagcaggccttcgcttattataacctctaaagagcagtgagcacatttcggccctctgtgagaggtcacaaggacctctgaatgaaaaaatatcaggattcaaaaaccttctgcagaaatcaacaggctgatcctaaaacgtacatggaaatgcaaaggacctaggaagtcaaaacccaacattattttgaaaaagaggaacaaaaatggagactgtacactacccatttcaaaacttatcataaagttacaagtaaccacaatagcaacagacacataaatcaaggaacagaattgaaagccgagaaataaaccactacatttatgaccagttgattctgccagggaattcaggaagaaaggatggtcttttcaacaaatgatgttgctacaactagaaatagtgtgtttacaaaaaaaaaaaaaaaaaaagaaagaaacagacactccctccctcatacctatccaaaaattaactcaaaatggaacacagacatatgtaagagctaaaactataaaactctagatgaaaataggagaaatttttgtaaccttggtctagacacttttttttacatatccaaaagcatcattcataaaagcaaaaaattgataaattagacaaccaaaattaaaaattttgctcttccaaagataccatataagcaaataaaagcacaggccacacattgggagaaatagttgcaaatcatatctgacaaaagacatattcataatacataaactcttacaactcctgacaaacaactcaatttttaaaaatgaggatatacagaaaatcattggaccttcctctaattttgctgtgaacctaaaactgctctattaaaataattaagtctttgttttttgagcggagttttgctcttgttgcccaggctggactgcagtggcatgatctcagctcactgcgcctccgtctcccaggttcaagtgattctcctgcctcaggctcccgagtagctgggattaaggcgtctgccaccatgcccagctaattttatatatatatatatttttttttagtagagtggggtttcaccatgttggccaggctggtctcgaactcctgagagaattaagtcttaaaacagaaaacaacaagcaagcaaagatttgaattgacatttcaccaaaaaagataagtgattgttaaacacatgaaaagggatcatcactagctaacgaaatacaaattaaaatcacaggaggactgggcacggtggctcacgcctgtaatcccagacctttgagaggctgaggcggggtatcacttgggtcaagagttggagaccagcctggccaacatggtgaaaccccatctgtacaaaaaatacaaaaattagccggatatggcggcatgcacacgtagtcccagctactctgaggctgaagtgggagaatcacttgaacccaggaggcagaggctgcagtgagctgagatatgccgttgcactctagcctgggcgacagggtgagaccctgtctcaaaaataaataaataataaaataaattaaaatcacaatgtggtaccactacatacctactagaatgactataaccgtaagtcaacaatacacggtgttggcaaggatgtggcaaaactggaactctcaaccatgcccatgaaaatgtaaaatgtacagccactttggaaaaggctgccagtttctcaaacgttaaacacaaacttctcatatggaatcttatgtccacataaaatcacgaacatgaatgtcacagcagcatcattcataattgtcttaagctagaaacaatccaaaagtctatcagctgtgaatggatagactgactgtggtaaattcatataatggaatactatttagcaataaaaataccgatgtcagcacaaactactgatacatactcaacacatatgaacttaaaaacatggaagtgggctgggcatggtggcttatgcctgtaatccctgcactttggaaggccaaggtggtggatcacctgaggtcaggagttcgagaccagcctggccaacgtgatgaaaccccatcctactaaaaatacaaaaaattagctgggcatggtggcgcgcacccataatcccagctaccaggaggctaagccaggagaatcacttggacccaggaggcagaggttgcagtgagccgaattgcgccactgcactccagcctgggcaacaagagcaaaactctgtctcaaaaaaaaaaaaaaaaaaaaaaacccacaaaaaacaaaaacaaaaacatggtgagtgaaggacaccaaaagaaaataatacatactgtatgatttcatttatatgaaattcccagaaaaggcaaatctgagagatagcagttgcccggtggggagcagagattgactaaaaacaggcataggaacttctgaagtggccctttcagatgtggtggttcacatccgtaatcccagcactttgggaggaaaagtgagaggattgcttgagcccaagagtttgaggctgcagtgagctacagtctcactctgtactccagcctaggtggcagagtgacacccttgttttaaaacaataaaaataaaaaaggactttttgagagatggaagtgttataaaattggattttaagccatgcgtggtggtgtcgcctgcagtgccagctacgtggaaggctgaggaaggaggatcccttgagcctagaagtcaaggctgcggtgagctatgaccatgccactgtactgtagcctgagtgacagagtaagctcaaaaaaaaaaaaaaaaaaaaaaaagaaagaaaagaaagaaacaaaagattttagtgtggtttcataactatatatttactaaatctcattgtacatttataatgtatgaatattaggtatgtcaactatacctcagtttcaaaacagtaacaaccaatatcccacaacatctggggatccctaactgcaggttcctatatacagtgaaaatcttttgggatactttctggtagactgtagttttctggcaaagaactatgaaagggatttctctattaacagtgcttcttcacaacagcacacgtaagaatcacctggaacacctgttgacagaccaacccctctcttcccctggattcagtaggtctggggtggggcccataaatctgcattcctaaaagctccaggacagtcattaaaaacagagatttcaaagtctcaccagagatgtattatatccaaatctctacaaaggggaacctgggaatctgtacctcttacaagtatcagggagaatcttatgattgactcatggtttagtactccatgagctacaacactctcgtataccattaactccaaggattttataagtagtttcaagagtaaaatctgtgtgttcctgggttgaaaatgaccaagtaaatatctgtattttaagtggttctaaagtctttagggttctgcctttggcctccctaaataagcaatttgcaggaaagcaacttatatttattcacagtattctaaatatgcttccacataaaaaaaaaagttttccaaacaaattaaaaataataaataaaacagaaagtttttgccataaaaacatttaggccacttttcaagtttagtctaattttaaatctgttcatttcaaaacacattttttctatatttttaacaggggtatgtaattgttagatctataggaactattattctgcacaattctgataggcactgagaacagcagcaacagtgccattttcaatggttcattcaaggatttatcacatacctactggaatgtaatgctgtgcttaacacagagattaacacagaagaagatatggttcttaccaggaattcaccagtgattataaaacaatagtactaacatcactgtatactggagcagatggggaaattttacagaagtaggactgtgtcctagaaaaaaaaataacagcacttaaattattttcaatttctcttatcagtatggctcaaagggtgggaggactcatcatcttgcacactggaatgccatgttgtatgaaacagaaagagccgactgcagatcgtgcttagaagaacacacacacaggacttcctggagagcatcttactgttcttcagagattcttatttaactggcttacagtggggctcaagctccccaaggaaagtttctgtggtaaattatgtttctaaagatagttgcaacaatagtgtccatcttaccagctttcagcaatgtcccctctcctgcccttccccttgtcacaatgccaaaccaaattcttgtttgaccaacggaaggtggagaaagccacatcatgtaacttccaaggctagtaggccctagagaattacagcttctgcctttgctgcctggtatgctcacttttggaatttagcttccaataacaaaagccaagctagtcacaactagggagacagccacagcgagagagagaaggcttgcctcctcatcatgcccaccaacttgccagatgtgtgaatgaagccatcttagccattcagtcactgactacaatgtcatgagacaccccagctgttagtcacatagagaagaaccaccagctgagccctgcctgaattcccaagtcatagaattatgatcaaatataaaatagatttgttttaagccattaagttttgaggtaggttttgttgcctaacaacagacaacaaaaaaggcttcaagtctgccctagaatattcttctaggtaaatgatatgcaatcatagtcaactatatgaacttggtcactacatctcaggaataagagaagcttgaaatctagctaccagaggaagaaaataagtgttcacaagcaagatccaatccacttcctcatcatagacttttcccatttgtcagcaaaaggttttgttgcttcccaaattttgtattaggaaaacaggttatagagtgctttaactcctttctaaaggccatgctaactaaaatcagtggttagtgagatgtttcagctcagtactctcctgcctctaagcacattctattcatagatttggggtccagaaccattttttacaatgttaaaggagatggaagaaaaggtgaattggagagaaggtctgggtgggggagatctacccacaaacaagaagagtgggccaggaatgctggctcatgcctgtatcgcagcactttgggaggcctaggtggcagatcacctgaggtcaggagttccagaccaggtggtcaacatggtgaaaccccgtctatactaaaaatacaaaaaattaaccaggcatggggtgcacacttgtaatcccagctacttgggaggctgaggcatgataatcgcttgaacccggaggcagagactagattgcgccactgtcctccatcctgggtgacagagggagactgtgctccaaaaacaaaacaaaacaaaacaaaaaaacaaaagagtgaagaccaagtgacattaaactgagtacttcccggctgccttgtttaataaatgaggcaaaagactggcattgcacactatctactgatgtagttccaatcttaagagtttgctgaaacaggaggaacaaaagatctggatgaatacagatctcaacagtatcatccattctgctcatcatgaaagcttcaaaagtgctgctggaatcgacagattgaaattctagctctgtcaattcccatctgtaagatggaatagtttatttccacctcttgggattgttgtgaggaaaaaaataagagcatgtgtaaagactaaccaagtgcctggcacagaacaggcacacaagaactgtcaagttcatgctcacctctctcttctctcccaaatcaacacaactggacctataaaagtgctgcatagtccaagcacttctcgaatatactctaagcaaacataataaagaaatgaaatcacatatggctcaattagagtggccgagggaattaaacatacgtgtgtataatacatacatacaaacatataccaccaggtgtaatctggacaaatctttacccagttatcacaaaggtattagtatcccttttaacatttaaagtttgaacagctgagaaagaaaatgaatgaagttgtttctacatttagaaggttgtccacccggccaaaaaaataagaacttttcttaatccaaatgaaggaaagaagagagggaaaaaaaaaaaaaaagaaacagatgaaagtattggataggaaacaaataagcagataattaatttaaattcaattatattgatgactgcattaaatataaacattccagtttggggcaaagactgtcagtctggattaaaaagcaacatcaagcccggtgtagtggctcacgctgtaatctcagcactttgggaggctgagacaggaaatcacttgaggttcaggagttcagaccagcctggctaacatggtaaaaccccatctctactaaaaaatacaaaaattagccggcatgctaggcaacatagggagagctcatctctacgaaaaataaacaaaaattagctagtgtgatggcacatgcctgtgatcccagctacccaggaggctgaggtaggaggatcacagagcccaggaggtcaaggctgctgtgagctgagattgttataggaggtagctagtaaaaatgagcagagcaggagaggtcccctcacacccccaaccaggaatgtcaggtgaccatcagtgatggtcaggcagttgttaagctgtccccctaaaataataattggtcgcaactggtgcagagaacggtagtctcccagtagatagaaaaagctgaaactggtgatcccaataagctttaggagttgggtgagtgggctcaggcatgagcactaagaggcaaaatggcagagtttactagtttatgacctttctctaggaacacttagctggtaaaggaatgcctcaagtgggcagtgcacaatttcaggaagcacactgtgcatggggcccctcccaagtgttggcggccactcgcatgcggacagccaaccccaagagaagaatcgagggagaagtaacacaagaccccgagcatgccaacatataaaaccccaagtcaaagggtcaaaccgtgcatttgatctctcaagtgcccacttggccctcttccaagtgtactttacttcccttctttcctgctttaaagcttttaataaactttcactcctgctctaaaatttgcttcagtctctccttctgcctatgctctcagttgaattctttcttctgaggagccaagaattgaggttgctgcagagccattcggattgcgggtggcaacaagatcgcaccattgcatgatcactgcagttgggtgacagagtaaatgtctcaaaaaagagaaaaatcaaatgtatactttctataagaaaaacattttaaggccagtgcagcggctcacgcctgtaattctagtactttgggaggctgagacaggaggatcattgagcccaggagttggagaccagcccaggcaacatggcaaaaccctgtcactacaaaattacaaaatatagttgtgcacacacctgtagtcccagctacttgggaggctgaggcagggaatagctcgaacctggggagggggggtggagggtggggattgcagcaagcatatgaagaattggaactcacgcactgcactgttagtaagaatgtaaaatggtaaaatggtgcagttctatgaaaaagttatggcagttcctcaaaaattttaaaataaaattaccatatgatccacaatttcacttctgggtatatgtatccagaagaactgaaagccaactggacgcagtggccacacctgtaatccaagcactctgggaggctgaggctggtggatcacttgaggccaggatttgagaccagcctgggcaacgtggcaaaaccctgtctctactaaaattacaaaaattaccaggtatagtggtgcacacctgtaatcccagctacttgggaggctgaggcataagaatacttgaacccagggggcagaggctgcagtgagccaagatcatgcactgtactccagactggtaacggagccaggcactgcctcaaaaaaattaatcaagttaaaatcaaaagaacggaagcagggtcttaaaggatgtttgtatattcgtgttcacagcattgttcacaatatccaaggcagaaggaactcaagtgtccataaatgcaatgcatgaatggggacaaacaaaatgtgtatgtacataaaaaggaagtaaattctgacatttgctccaacatggataaatcttgagatgttacgctaagtgaaataagccagtcacaaaaagacaaataccatacaattttgcttaatgagttattaagagtggtcaagctcatagaaaataaaatggcggttgctgaggggagaggaaatggaaagcagttgtttaatgggtacagagttatagtttggcaagatgaaaaagtctagggattggtagcataacaatgtaaatatatttaacactactgaactgtacatttttaataactgagggtaattttttgtttttgtttttgagacggagcctcgctctgtcgcgagctggggtgcagtggcacaatctccgctcactgcaacctccgcctcccgggttcaagcaatctcctggctcagcctcccaagtagctgggactacaggtgtgcaccaacacacctggctatttctttttttttttttgtattttagtagagtcggggtttcaccatgttgcccagactgtctcaaactcctgagctcaggcaatctgcccaccttagcctcccaaagtgctaggattcaggcgtgagccactgcacctggccaagggtaatttttatgctaagtgtattttgtcacattaattttaacaatctttaaacaacatcaaagaagaatcattcagaggtaaatattttaaatgtgcacaagacttttattctaaaactataggccaagcacaatagctgacgcctgtatcccaacactttgggaggccgagggaaacagatcacttgaggtcaggagttcaagatggcctggccaacatggggaaaccccgcttctaccaaaaatacaaaaattagccaggcatgtggtgtgcctgtaatctcagctacttggaggctgaggtgggagaatcacttgaacttggaggcagaggttgcagtgagccaagattgcgccattgcactccagcctgggtgacagagcagacgctgtctcaaaaaaaaaaaaaaaaaaaactataaaacactgatgagaaaaattaatagcacttaaatgaagctagagaaataccgtgttcatgaattggaagttgcaatattgtaagatgttaactttcctcaattttatccttaaattcaataaaatcccaatcaaaattccgcaagcattccttttttttttttttttgtagaaataaacaaggtgattctaaattttattggaaatttgaaagcctgagaataccctaaataagaatttaaaaaaagaataaagaaataaataataatatttgatttcaagacttattataacaccacagtaatcaaaggaacatggattggcttaaggacagacgtataaagaaaaacagaataaagtccagaaatagactctactgtattgccaatagtacccttaaaccttccatggtaatccagtggagtcttgctctgtccccagatggagtgcagcagcatgcttacagctcactacagccttgaacaccttggctcagtgatcctcctgcctcagcctcctcagtagctgggactacaggcatataccaccatgccaactaatttttaatttttgtagagacagggtcttgctgtgttgcccaggctggtctgggctcaagtgatcctcctgacttggcctcccaaagtgctggtattataggcatgagctactcatctggtcctttgtaaattttttaattgaattgtttgtcttttggttgttgagttgtagacatttttatacattttagatatactaattccttatcagaacatgatttgcaaaattttctcccattctgtaacttgtcttattattttctagatagtatcctctgcagcacaagtcttaattttctttgtgttgttgtttgtttgttttttgagatggagtttcgctcttgttgccaggctggagtgcaatgacaattgacaaagtcaattgacaaaggacttgcatagacattctccaaggactatatatgaagacccaataaaaacaagaaaaggccgggtgcagtggctctgcctgtaatcccagcactttgggaggctgaggtgggcagatcacctgaggtcaggagtcaagaccagcctggccaacatggtgaaaccccatctctacaaaaatacaaaacttagccggcaggatggcaggtgcctataatcccagctactcaggaggctaaggcgagacaattgctgaacccaggagacggagggtgtagtaagctgagaccgtaccactgcactccagcctggcgacagagcaagactccgtatcaaaaaaaaaaaaaaaaaaaaaaacctcacaagaaaagtgcccaatatcctttgcaaatcaaaactataatgataccacatcagaaccactatgactctattatcaaatagacaggtaataataagtgttggaaaagatgtggagaatcagaaccctatatactgttggtgggagtataaaattgtgcaattcctttggaaaacaggctggcaatcctcaaaaagattcaattaaagttacccagcatttctaccgggtagatccggcagaattactcgacacagtagaactgaccgagcaattctactcgtaggtatatatagccgggtgtgtggctcacgcctgtaattccaacactttgagaagccgagatgggcagaatgcttgagttaggagttcgagaacagcctgggcaacatgccctgtctctatggaaaatacaaaaaattaccaggcatggtggcaagcgcctgtagtcccagttacttgggaagctgaggtgggaggatactcgagctttggaggtcaggctgcagtgagctgagatcacaccactgctctccagcctggggacaaagtgagaccctttctcaaaacaaacaaaacaaacaaacaaacaaacaaaaaccttagaaaaaaaaattttttttaagtaaaacaagaaaatgtctacacaaaaatttggaatggccgggcacggtggctcccctgtaatcccagcactttgggaggctgaggcaggcagtcacgaggtcgggagatagagaccatcctgaccaacatggtgaaaccctctctctactaaaatacaaaaattagttgggtttggtggtgcacgcctgtaatcctagctacctgggaggtgaggcaggagaatgacttgaacccaggaggcggagattgcagagagccaagatcgcgcagttcactccagcctgggcaacagagcaagactctgtctaaaaaaaaaaaaacaggtgggcgcagtggctcacgcctgtaatcctagcactttgggaggctgaggtgggcggatcatgggtcaggcgttcaagacgagcctggttaatgtggtgaaaccccatctctactaaaaataaaacattagctaggcgtggtggtgcacacctctagtcccagctatttaggaggctgaggagaattgcttgaacccgggaggcggaggttgcagtgaaccgaaatcacgccaccgcactcagcctgggtgacagagcgaggctccgtcttaacaaaaaaaaaaaaaaaaaaaaaggaaaaagtgctgcatgctacaatgtgagtgaaccttgaaaacattatggtaacttaaagaaacagatgctaaaagctatgcattatatattatcccatttatataaaatgtccagaataggaagtttacataggcagaaagtggattagtggttgtcttgggtaggggaaaatggaggaaacagagctactgctaatggttatggggtttctttttggactaattaaaaaaggttctaaatttattatttttctcttgtgttgcttgtgctgttggtgtcatatttaagaaactactgccaatgcaaggtcagtaagatttccaactacatttccttctaagagttttatagttttttctctttttctttaaatatttctctcttttttttttcctccagctactgcagatcaaagtttagttcttatatttaggtctttgatccatttggaattaatttttgtatgtggtgtgagtaggggtccaaaccacattcttttccatatggatattcagttgtcccagtagcatctatgaaaacactattctttctctattgaatggtcttgacacccttgttgaaaatcagttgacatagatgcatgtgtttatttctgtactgtcatgagtatggtaaatgtggtgatggttgacaattctcagaatatactaaaaaccattcaactgtttactttgaatgagtgaattgtaggtatgtgaattatttcaataacaggtttttttttttttttttttgagatagcatcttgtctgtcaccaaggctggaatgcagtggtgctctctcaggtcactgcaacctctgcctccgggttcaagcaatcttccctccttggcctcttgagtagctgggattacaagcattcacccaacacaacacctggctaatttttttttcttcacctggctaatttttgtagttttagtaaaatgggttttcacaatgttggccaggctggtctcgaactcctgacctcaagtgatcagccacacccagcctcaataaattttttgtttgtttgttctgagatggagtctcgctctgtacccaggctagagtgcagtggcatgatcttggctcactgcaacctccgcctcctaggttaagcgattctccaagctcagcctcagcctcagctggggctacaggcacatgctaccatgatgactaatttttgtatttttttgtagagatgggttttcaccatgttggccaggctggtttgaactcctgacctcaagtgatctgcccgcctcagcctcccaaagtgctgggattatagtgtgagccactgagtccagccaataatagttttttgttttgttttttaagaaaaggtcgccgggcgtggtggctcatgcctgtaatcccagcactttgggaagccgaggcaggcgaacacaaggtcaggagatcgagactatcctggctaagatggtagaaccccgtctctactaaaatacaaaaaaaattagccaggcatggtggtgggcacctgtaatcccagctacctgggtgctgaggcaggagaatggcgtgaacccggaaggtggagcttgcagtgagctgagatggcccactgcactccagcctgggcgacagcacgagactccgtctcaaaaataaaaataaaaaaaaaataaaaataaaataaaataataaaaaagtcaagactgcagtcaagctggagatgtgcaaaaaaaaaaaaaaggtcaagattgcagtcaagctggacatgtagcatacacactgttttacaaccactaatattaatgacttcaccaagtttgtgatatataaaaagagagttggtcaaggactaagccttcgtgcctttcaacatttgaggtagagagataaagaggaatctgaaaggagataaaaccaatgagagagataggaagaaaactaagtgagcatcgtattctagagcagtgaagacagtgtttcaaggggaaggaaatgaccagctgggtaaaatgcagccactttcccaaactgagaactgacaataggctactggatttagcagtacaaaggtcctcagtaccttgataagagctgtttcaattgagtgatgagggcaaacacctgagtggagtggattaaggaggatggaagaagaaaaatcagaaaaccaagaaaagagaattcttgagaacttttgtcttaaaagaagtagcaggggccgggcacagaggctcacgcctataatcccagcacttgggagcccaaggtgggtggatcacttgaggtcagaagttcgagactagcctggccaacaggtgaaaccccatctctactaaaaacacaaaaaattagccaggtgtgatggcacatggtgtaatcccagctacttgggaggctgaggcaggagaatcacttgaacccaggagacagagttgcagtgagccgacatcacgccattgcactctagcctgggcgtcgagtgaaactccgttcaaaaacaaaaaacaaaaaacaaaaagtaccagaatggactagtatctgtaggggaagagaatcatgataagttaatttgttattcctgttttcaagatggaagaaatagcagcagtagtatgccaataggaatgtaccactagagcggtaatatttagcagagagcagaggaaggtggagcagcactctggatggactcaggaagtgggaatgaaattttgtttgcaaatggagtattggcccttgcaaggatcatgtacaactcatacctagttacaggaaagggggaaaagcagatatacaagcacgtgggtggatacggtggcgagtgccattgttttctcaatgaaatggaaggtcatcaacaaaggctaagaaaggtgtttttaaaagagaggagaaagtatggaaagtcctctaggaggctggagaatgaaggaactgtggaaatacagcaggattcccagacacattaggggcctgtttaaggttagtaatcatgaattaagagtgaggacagcgaatgtgccagtgtttcttctaacccaggggcacacccacaaagtaggcagagatttggatttaaccgagttgtgatttagccaagcaagtgtgacaaggcaaaagaggggaagaggattgagagttagtacatgaggcagtcattataatgactgaccatggaatttaagttgtttaaggagaaagtacaggcatgagggcgtgagggaaagggagaagaaaataggttcaatgggctgtagtcctgctggagtcaaagatggttgaaaggactgatattataaacagcagataaatggagtacagggggcaactcttatggctgacaaggtaagaaaatctactccaccattttacaaaatacaaagaatgtcataggcccagctatagggctaaaaaggattcccacaattcaattttgatggccaaactgattgcaatttaataacaacatgagataccatttattagagccacagacttttattttcttttttttttaagagacagggtcttgctatgttgcccaggctggagtcagtggtgtgatcacagctcattgcagccttgacctcctgggctcatgcaatcctcctgctcagcctcccaaagtgctgggattacaggaaggagccactatacatggctagagccacccactttctagctatgtaacactggctgagttccctaaccgctgggtcttggtttcctttctgtgaaataggaatgttaacaggaatcacctcaaggggtgaggattcaataattgaagttaagcatttagaactgtgccgggcacttaataagatgaaataaatgtctgttattaggatattctttttctttctttctttttttttttgagacagtctcattctgttgcccaggcggagtgccgcctctgggttcaagtgattcttgtgcctcagcctcctgagtagctgggataaaggcacgcaccaccacgccaggctaatttttgcatttttagtagagacggggtttcacacgttggccaggctggtctcgaactcctggcctcaagtaatctgcctgcctctgcctccaaagtgctgggattacaggggtgagccactgcgcctggccagaaatattcttattacaactactgttacgatctactttgttgtatatatttttttaataaccaagaaaaactgctagaaagcaaaagtctcagtagggaagagttcaaacactgaagtattaagcctggctaaggtcaaatcattacagaatttttccaagtacttttcctaatctgctcctgtttctccacttctagaggcatgaaggaaatgacacgtcatccaaaagggctctgagctcaggggaacgcttaaacattgaccttgctgttgggtaatgggttcaacttcattctaaactcttgtttccagttctatgccagtacttttactcttgcccacacagttgctcagtcacatgtaacagcaaagcttaaaaaaaaaaataaataaccttagaatgtttttcttttttaggaatattttaaagttcgtttaaacacagatgagagttcttttacaactcaaataagatgcttagttattggcatttgattattctgcagatcactagaagagggaggaaaattcaggcccttgctgaccttcacctgactcaaactatggggttattggatcaatcccacacaagacccctctgtgggacctatcccagacagatgtataggcctcaccagcatgctgcctatttaacggtttctgttgcagcaccccaaggaagcaaaagcaccaggctgagtgcagacccatgactagctgcctctgcaggcctgacttaaaatcccacccaccccgtccccccactgcctggtgttttcttttgagctctcagatgtcgatccaagataaaaatttcttatgctctagtctagccattggcaaagcaatcatcccatcagaaagaaaaatggaaagaaacagtgaactctgaaacaagttaacacattcagattcttcagaacagagggctgggaaagagaaagtggggctcctatgaatccctcttacgaaatgtcctctgcagtgggggtcgagctctttgctggcttattatttaatggtccctaagaacaaactaagtttataggaggggctatacgatctttcctgtggtagtttataacaactcatagagaaattgtggccaaatggtagatatggtccctaacaaagagcaaacaggtataagcattttggggcacaattttggggggatagtcagggagaagtgtgcttgaatagatttcacttccaggtacaagtttccagaaattacaacagaaacaaaaacaaataaaataggccaggcgtggtggctcagtcctgtaatcccagcactttgggaggccgagagggcggatcacaaggtcaggagatcgagactatcctggctaacactgtgaaaccctatcctactaaaaatacaaaaaaattagccgggtgtggtggcgggcgcctgtagtcccagctatcaagaggctgaggcaggagaatggcatgaacccgggaggcagagcttgcagagagccggatggcgccactgcactccagcctgggcaacagagtgcaactctgtctcaaaaaataaataattaattaattaaataaaataataaaatccacacatgtacatggaacaacatgaaacatgaagaggacattaaataagaaagagaagttgtgaaacaagcataatgtgctttctacgctttacacacacccattcatccagaggcaaaaatttggagacatatacaccagagggacatgggggaaacttccgctttctacattaatgtttaaaatcttcacagtgaatattctgttatttttgtgaccacgaaagaagcaggaagaacttttgtttcttaaaagatttgcttaaagacagaaaatactgatttggaaaccacaaaggtctgttgtcttctgcttctgcacagatgtgcgagttcagcctttccaactccctcacctgctccagggctttccttcttttgtacttcttcctcttccttctgcaaatgctgcctctttctaaaccccttcctgtcatcttacagccatcttttttgtttgagattaatttcctgcagaaagtcaatcccaagccactgctgcaactctacaaaaatcaccagaaagaagtaacccaactcttttccaacacaaactaccttatctttattcctatgattactgtacttcttcatgtgtatatttactgaacttttactagcacctaactccgtatcataggtaataaacactcacaatagactttttaaaaaaacgtttcaactaacatatttggctcatagtaagtactctgcaatcagtaacaatatgccttctctaacagtaaactccgagcctcaattccctaagccaaggacagtaaacaggcttagtctccacatcaactccagcagttagtatggactgtgggcacttggagtactgtgttaagaaggttctgggctgggtgcggtggctcatgcctgtaatctcagcactttgggaggccaaggcagtggatcacctgaggtcaggagttcgagaccagcctggccaacatggtgaaaccccgttctactaaaaataaaaaattagccaggtgtggtggcacgcacctgtagtcctagctactgggaggctgagtcaggagaatcacttgaacccaggaggtggagattgcagtgggccgagacacaccactgcactccaacatgggtgacagagtaagactctgtctcaaaaaaaaaaaagaaataaaataaaaaaagaaaaggatctgagcccctgtagggctccataataaacagtgagtaaattataacagtgtcagccatggccaaagaaaaaggttgggggtcagtggctcttcctcctacatagcttgttggggcccaggctggtgtgacctttttttttgttttttttgttgtttgtttgtttgatggagtttcgctctttcacccaggctggagtgaagtggcgtgatccaggtcactgcaacctccacctcccgggttcaagagattctcctgcctcagcctcccgatagctgggattacaggtgcctgccaccacgcccaactaatttttgtatttttagtagagcggggtttggccatgttggccaggctggtctccaactcctgacgtcaggtgatccatccccttggcctcccaaagtgccaggtttacaggcgtgagccactgcgtccggcctggtgtgctttcttaaccttggtgtatctggagtccagtcactgttaaatgatgctttatttaaagaggtgtgggtatgtgaatgtggggggtaaggtaggggaaggtatcttttcttgagaatcttaactgttctatagcaactcaaaggagaatgagatggcaatttaagggggtggagagaaagatgagttaattacaaggaatttccaacttgagtcaaatttcaagtcataagaacttagctgtttttctccagtcacctcacaaacccatcctctctagtctcagattaaacagagtgcataaaatcaatgtagaaatttttctccattttccccaaagcgtattcaacattggggttcctgcttacctggtttctcctcttccaattaccaaattacaggaaagaaaagtcagttgggatcaccaatgatcccataaatcatcctaagaatgcaacaccgtctctgaattctcctaaacatagttgatgcagaatggtatcatgctaaagagaacctcctagactctcagccaagggcaagttcacttgatccattttctgaaattacacatttaccgattctctctgtatataagagcactacggaagagttttgagcagcactgtccaacagcactttctgcaatgaggaaatgttccaatgacagcagtcactaaccatttgtggttaccgagcactgaaaatgtgctagagtaactcagaaatggaatttaaattttgttcattaattttcactaatttaaattatttatttattttaattaatttgtgttttttgttttgttttttttttgagacggagtccgctttgtcgcccaggctggagtgcagtggcacaatctcggctcactgcaagctccgcccccgggttcacgccattctcctgcctcagcctcctgagtagctgggacttcaggtgcccccaccatgcctggctaatttttttttgtatttttagtagagacggggtttcaccatgttgccaggatggtctcgatctcctgacctcgtgatccacccgccacagcctcccaaagtgcgggattacaggcgtgagccaccgcgctcagccaattaattattttttaaaaaaatttttagacagagtctcgctctgtcacccaggctggagtgcagtggcatgatctcatctcactgaacctccgcctcctgggtccaagtgattctcctgcctcagcctcccaagtagctgggatacaggtgcccaccaccatgccagcccactccagcgtgagcaacagagcgagacggatggtggacggacggaaggattagtgtactgaaaacagagataaggaattacccatagtaaagatataaagaactggaaaatacaaaagagtttaagaaacaggaaggcagacagaaggcccatataaaatttctaggattttcaaaaggagggatgggaaagaataaaagaaaggtaaaattgaagagataactagatgataatttcttaggtgctgtgaaacacatgatatttgatatcaaggacaaatagcaaacagatgtataaaaataaattaaatccggaacatatgacagtaatttggagagcaccatgagtaaagacaagataaagcagccaagagaaaaaaacattaacctaagagttgagaagacttttcaaatgcagtaatatcaaaagctagaagataatgaaaccaataacatcatctaattgctgagaaacagtaaatgccaacccagacttttataactagtaaattatccaatggttatgacaaataaaaacacttttaggtaagcaaaaagagtttagaccaatagactctcactaaaaaacagtgttaaagcctacctctggaagaaggaaatttactcaaaaggatgaagtatgataaaagaaggaagggaaggcaaaaaagttggcaagcagggagtgaattcaaataagcagacttcatcaaataagaatagcaacaactaattccagggttaaaagcaaaggggaaggccaggcgcctggctcacgcctgtaatcccagcatcgtgggagccgaggcagatggatcacttgaggtcaggagtttgagaccagcctggccaacgtggtgaagagtctctactaaaaacacagaaattagcccggcatggtggcacacacttgtgatccagctacttgcgaggctgaggcaggagaatcacttgaacccgggaggtggacgttgcactagctgagaccgccccattgcactccagcctgggcaacaaaagcaaaactccatctcaaaacaaacaaacaaacaaaacaaggtagaattgtaataccgatccacagcaatgtgtaagaaaactgtggatttctatttgggaagagagtagagatattgatttaagattttaatgaagatgcaagccaaaaatttaagagtagcctgtaacagaactgaaagtttccaaatggtagataatgaaaccctttctaagaaaagactgaaggggccgggcgcggtggctcacgcctgtatcccagcactttgggaggccgagggcagcggatcatgaggtcaggagatcgagaccttctggctaacacggtgaaaccttgtctccactaaaaatacaaaaaaattagctgggtgtggggcgagcgcctgtagtcccagctacttgggaggctgaagcaagagaatggcgtgaacctggaggcggggcctgcagtgagccaagatcgcgccactgaactccagcctgggtgacacacgagactccatctcaaaaaaaaagaaaagaaaagaaaagaaaagactgaaaaggagaaaatgcaaacaaaacatggtcaatagcacaaagtaagatatgaaataataatgtatttaatatattaaataaattacataaggtatcaaatgagatattaagataatacacaattgctatataatacttttaaatgggttaaacatgccaatcaaaagacagtctcaaaataggctggaaaaaatccaactatatgtcattcacaggagatacacctaagacattaggacatagagaaaagaaaagggataagaaaagatgtagcaggcaaatatttacaaaaagaaagctgacattataccagacaaaaaaagaccatgagaaaaagtactgttagggataaagatgctctctacattctctaggaaacaattctaaagagaacttcaaattatatgcagacacgtttgacaaattatgaagagaagttcacaaattcagtcattaaaaaaaaactttaacatagttctctctgaattgttaaatcaagaacacctggctgggcgcggtggctcacacctgtaatcccagcatttgggaggccaaggtgggaggatcgcctgagcccagcctgggcaacatggcgaaccccatctctataaaaaacacaaaaattagcagggtgtggtggtgtgtgcctgtggttctagcactcgggaggctgaggcaggaggatcgcttgagtccaagagtttgaggctgcagtgagcgcgactgcaccactgcactccagcctgggcaacaaagcaagaccctgtctcaacaaacaacaaacaaaacaaaacaaaacaaaacaaaaatcaaaagttggtaaaatatggaagatttgacaacataactgataagcttgatgtaaggacatacagaataaaacttcacccaacattttatttttctgcgttccccaaccccctcacccaacagttgttatacaaacttctaaagtcaaatgaaatatttatgaaaactgactgtgtagtatgccacaaattaagtataaataaaacgaaacaatcagtatcatacagactgttctgtgattatcatgcaattaagttagaggcaacttaaaaaaaatttgaaaatactacagttatgtctttgcactccagcatgggaagacctgtctcaagaaaataaataaaaagctgtattttgtccaggcatggtgactcatacctgactctcagcactttgggaggccaaggtgagaagatcgcttgagactgggagttcacgacagcctgagcaacacagtagtctctacaaaaaaaaaacccatagtagtctctaccaaaaaaaagctatattaatctttttgtttgttttttgagacgtctcactctgtctcccaggctgaatgcagtgacaccatctcagctcactgcaacctccgcctcctgggttcaagcagtcatctgcctcaacctcctgagtagctgggattacagtcacgcgccaccacgcccggctaactttatattttcagtagagacagggtttcatcatgttagccaggctggtcttgaactcctgcctcaaatgatccgcctgcctcagcctcccaaagtgctgggattacaggcgtgagccacaagccttgccttattaatcttagtaagagaagaaaaagacagtataacaaaattatgaggaaattttatgacatatgtgcaaaaatccaaaggagaatattaacgtattaaatctggaatgtattaaaaaaatacatcacaaccaagcaggattaatttcaagaatataaggataattaacattagaaaatctattaacataattcaaatcatttacaactgaaaggagaaagcccgatgatcatctgaataaatacaaggaaaactgttgataaaattgctgtttgtgataattagcaaagtaggaataaaagagaataaaggcaatataccaaaaacatatgtgatgcttccaaagcaggaaacattccctttaaaaaaaagcaggagaaaaataaggattcccatgatcaagattctaatacgatttttactggaggaactagccagcaatcttaaaataagaaagaaagtaacacaaaagaggattacaaaagaggaaacaaaacagtcattatttgcaaagggtgtattctctgaattttctgtcgatatttctcattaaaactatgaaacctacaagagcataaaagaaacccgaaacaattataaacaattttaaaagctactattaacagtaaggaccaaactatagggtatcctaacaaaaggaattcaagatcttcaaaaaaatcataaagctttatcagtgacattaaatattaacagcttacattactgatcacttactacctgctgggcactgtgtgagtgatgtggatatgctacaaactcatttgattcatatgagtcctatatgatagacctgttattattgttagcttcactttagaggtaaagaaattaaggcacaggttgttaggtacttgcccaagcttccaaaaccaaaaattagcaacactgggattcacaccaaagacagttggtgccaagcctgtgaccttaactactaccctatactgtctctcccaagagagggtgtccattcctccaataaaggcatctctggctcagctgagccaaacttccagaagccattctgtgtcatcctgatgccaacttgatttgaattatctaccctacaactgtctaagaagccctctttcaacagattggatccaagcaccttgggagcagagagtggcagtggatttatttcgttcacataaggatacagaccaacaatgattaaaggagatctcagttttaggcctagtcaagtgacaccatgtcacttttaagatcacatggctctccaattcccaggagcagatcaaatagatttcttaaacttgaaaagttgtatttattaagatcttaagctgctttccagactaagaacataatggatgtcaatgatttatctttctgataacctttgagaattctgggagaggatatgtaatatttatttgtataagttctgcaacttttctgtaagtctgaaattatttcaaaaattttaaatgtaaataaaatgtttaaaatttttatttttatatctgtaaatcaatctatcagattcatggataagcccaaatttacaaaaatggcttattgataaactcaattaattctaataaatatcctaacagttttttctcctcacagaaagttaacaaagctgattcaaaatttatctggaagcacaaagtgccaaaaatagctaaccagtttttgttgtttttacgttgttgtctgtaacatacagaactgtttactctgctgtttgcaatacaaagacatcagaaatgttattgtttgtgcaatatagtagggaaaaaaatgaaactgcccattagggtgggttgccagatgtcctatcattaaaaaagaataccagctttaaacagagcagttcctggtatctgtacttcactgtgtttattctatctggattcccttatttgtcccttagaaagattcgttagccaacacagttttgcccttccatgtagcaagacctattacaaaacgatagtaaaaaaacagtaggccggccgcggtggctcacgcctgtaatcccagcactctgggaggccgagcaggtgaatcacctgaggtcaggagttcgagaccagcctgaccaacatggtgaaacccatctctactcatacaaaaaaaaaaaaaaaaaaaagccaggcatggtgacagacgcctgtgtcccagctactctggaggctatggcatgagaattgcttgaacccgggaggcagacgttcagtcagtcgagatcaggccactgcactccggcctgggtgacagagcaagactctgtctaaaaaataaaaataggctgggtgcagtggctcaagcctgtaatcccagcactttggaagccaaggcaggcagatcacttgaggtcaggagtacaagaccagcctggccaacatggtgaaccatgtctctactaaaactacagaaaattagtagggtgtggtggcgtgtgcctgtaatccagctactcgggaggctgaggtgggagaattgcttgaacccgggaggtggaggttgcatgagccgagataacgccactgcactccagcctgggcgacagagtgagactccgtctcaaaataaaaaaataaaaataaaagagtattagcggccgggcgcggtggctcatgcctgtaacccagcactttgggagaccgaggcggtggacgggtcacgaggtcaggagatcaagaccacctggctaacacggtgaaaccccgtctctactaaaaatacaaaaaattagctgggtgtgtggcaggcgcctgtagtcccagctactcgggaggctgagggaggagaatggtatgaaccgggaggcggagcttgcagtgagaggagatcgcgccattgcattccagcctgggtggacaagcaacactccgtctcaaaaaaaaaaaaaaaagaaaagaaaagcgtattagcacaaggaagatgactttactactcctcaaatgctgctgagagagctggttattcacatatggaaaatatatatatccctatcttgccccattctaatttaattataggctgggagctgtggctcagtctattatcccagtactttgaatcagtcggatatggcggtgcacacctgtagtcccagtacccaggagactgaggtgggaggactatctgactccaggagtttcaggctgcagtaagggtgatggcgccactacagtccagcctgggcaacagagtgagatcctgtcttgagactaatacacgatttttttttaaagacagaatttcactcttgttgcccaggctggagtgcaatgtgcaatctcggctcaccacgacctccacctcccaggttcaaacgattctcctgcctcacctcctgagtagctgggattacaagcatgtgccaccacgcccagctcattttgtattttagtagagatgaggtttgtccatgttggtcaagctggtctcgaaccgcctcggcctcccaagtgctgggattacaggcatgagctacctcgcccggccaataaaccttttttttaattaccatggattaaggatttaaatacaaagtgcaaatttttaaaacttttagaagaa

SEQ ID NO: 5037 - DNA, 16658 bp, Homo sapiens
ggccaaactaactttgggaggaacttataatttagctttgaaacaaagatgataacagtcttttccaaaacaaacactattgcctatagaccggactgcctaaagccacaagatgagagttatggtaatcttactaaatttaagatgtagctatttttattaaaccaatattaatgtttatttattaaagatttgttaaatatagtgaactccaagtttctcttcaaagaatcagttgtcagtatgttcagctctcttattctttgattctccattttaaagtttagcttcctggtctctttgccccctagcttctagtttcagtaaacaactttcccgccagtcctaatcagtgttcacagctgttcccctggtcacctgctttgacctgagtcactcttggtcacctactcgtcctgattcatcctgagccaactgttctgtaaccgcccttactgctaaactactcacctgccactccggctggtactcctgctctttttaaaatagtcaattggaattagcttagacgtgcggtccaaccctatccaataggggaacgacacagcagtaggggctacctgcatgagaataagaactcctgcccctcccctgtccaagtgtgctctcaccattgtttcatctgcgagggcaccttttctgcagaaagtgaaaattgccttgctgagaaaactaaatttatgtttggtgctatttctttgtggcactggggaataagcattttgcatttctaacaagcttacacagcaaagatcattctgttttgggctgggtatatagttttgtaacccctatgagaaattttacaccttatagtatttggcagggataagtatgaaactgctggattaatatgcaaacaaaatgtatgctggcaattcttcagacatttctaatattactttaccagtaattttaaggctgcttatttattaataattttactgagttacataaacttgaaaaaatatttgacgagtctttttcctgataaagcatttcattcgagcacttttattttcttaagccagttaattagagtcttttaagcattttcagtagtgaagcattgtgtacacaacacataaatacatagacgtttaggcatgctgatagaagtacatcttatggatacactcagattattgataacctgcttacaaccctaggcagttgtcagctaactagccttatgtttgcatattaaaggaaacaactaggtgaaaatcaaatagcaaaatttacatcataaggtacagagagaaaaagtctgatgggccagagggagatgaaagatgaatgccaaatcaaacataaaattaaagaaatttgccggtgtggtggttcattcctgtaatcccaacactttggggggccgaggtgggcggatcacaagtcaggagatcgaaaccatcctggctaacacggcgaaaccccgtctctattaaaaatacaaaaattagctgggcgtggtggtgggcgcctgtagtcccagttatgtctgtactctctgagtacagagatcaccccactgtactccaacctgggtgacagcgagactctgtctcaaaaaaaaaaaacaaaaaagaaatttatcataggattgtataaggagactagttttatttagaaaagggactaccttttaagtggatctctgagctctgggcagagcccacactgaatcctggtctccaagaagggacacttattatgaggttagaacacgtgatgcttttacagtgcacttttaaaaaacttcttttaaacaaagacatttctaagtgtctaaaccatagtcttccttaaaacccaagggtaggctgggtgcagtggcttatgcctgtaatcccagcactttgggaggtgaggcgggcggatcatgaggtcaggagatcgagaccatcctggctaacacggtgaaaccgtctctactaaaaatacaaaacaaacaaacaaacaaacaaacaaacaaaaaacaagctggcatggtggcgcttgtagtcccagctacttgggaggctgaggcaggagaatggcgtgacccgggaggcggagcttgcagtgagccgagattgcgccactgcactccagcctgggcgaagagtgaaactcagactcaaaacaaacaaacaaacaatacaaaaaacaaaaaacaaaaaacccaagggtaacctctgttgcaataactattttagtcaaaaaaaaaaacaaaaaaaaaccaaaaaaaaaccacaaacaggtaacaacaatacaaaagtaagcagttgaagagacgagcgaacttgcctgtttacactctggggattgcataagaaaaaacaggtttctcccttaaaggagcctggtgccttctctgttctctttaaggaaccccagctattataaactattttagtccctcatgcagcagagggtgcaagagaaaggagatacagccgaagtaaatgaagaaaaagaattcagtcaactgagaagaaaaaaactttcgctcaaaaaaagacaagattcttggaaaaaacaaaaacaaaaacatgaagtccttttaaatacaaacacacacacgcacatgcgccacacacacacaccacacatacacatgcacatcttcgatgttagcttttaattaagctgcttttaatcattgagctcctttaaaaaaatcttttaaaatctcattaccatatttcagcaggacaaattgctgctatttcagaagcacagccattgctctttcagtttggcctggctacaaaaaggtggcctcgttgtgtaactaaagccacttagtagtcaaaataaaaaatctttcttttttttttccttttgctggctgtttttcaccccctatcacatcatcctttgtgtattgtgtgtgtgtgaatttagccacttcagaggccttgttccccataatttgggacttccttgtatttgatcaagtcagatagagttgatcaaacccaatgggaaaaagactgaaagaacacaaaaagagaaatgaacaacaacaaaacagttaagcaaaacaaatgatcacacaattttatgattactaagctttctagtggtaaggagaaattaagaccagctggttgtaatcttactttagccaaaacaaaccccaattcagttacttacctagggatgggtttcaggctgaagctgctctctaccatcctagaagcagggaaaaaccctcatcttccctgttggttgcgagccaaacaccataaaggagttacctgccttccatcaacatggaagcaggaaaaatttgcctccttgtgttagaagcaagtaaaactccaaaaaaaaaagaggagttgtacaacaaaatgactttagatcttgaccagattttgaaagataaggtattctctggagggtgtgcttccgggctcagcaaattgtcctattggtttgagccataaagatagctcaagctggtaccaagcacgatagctttgtcaaaggtcaggggcgcctccagtcagaattcttctgtggttaccaaaaatgaaccccccaaatctgagaaaggtctcagttaatttagaaagtttattttgccaatgtgatggtgtgacacagcctcaggagatcccaatgacatgtccccaaggtggtcagagcaaatttagttttatacattttggggagacttgagacgtcactcaacatacgtaagatgaaattgtttgggtctggaaagacagggagggggcttcccggtcataggtagataagagacaatgtttgcattcttttgagtttctaattatcctctcaaaaggaggcagtcagatatgcattagctcagtgatcagaggggtgactttgaaagaatgggaggcaggtttgccttaagcattcccagcttgacttttccctttagcttagtaattttgggggctcaagatatttcccttcagacctcttcagtagaattctttcttctgatgaggcaagcattgagttttatgtagactgtatggatttcccaccactcacatgaagaccatgacctgtgacacattccctggaggtctgagaacatgtacccaaggcagttgagttacaactggttttatacagtttagggaggctcagacagtaatcaatataagcagggtatgcattggttccttctgattgagggaggagctacaggtcataggtgaattcaaagacttttctgattggcgctgggcacggtggctcacattgtaatcccagcattttggggagccaaggcgggtggatcacttgaggtcaggagttcggaccagcctggaccaacatggtgaaaccctgtctctattaaaaatacaaaaattagctggcatggtggcactcctgtaatcccagctacttgggaggctgaggcatgagaacagcttgacccaggagatggaggttgtagtgagctgagatcacgccactgcctgagcaacagagtggactccatctcaaaaaaaaaaaaaaatttctgattttcaattggttgaaagaagttatttccaaagacttggaatcttggtatacaacaacaaaattttttttaaataaaaaattttaaaaagacaacctggaatcaatagaaataagcatctgggttaagataaggagttgtggagccaaggttctttttttttgagacagagtctcgctctgtcgccaggctggagtgccgtgggcgatctcagctcactgcaacctccacctcctgggttcaagcgattctcctgcctcagctcccaagtagctgagactacaggcgtgtaccaccatgcccagctaatttttgtatttttgtagaaacggggtttcaccatgttggccaagagggtctctatctcttgacctcgtgatctcccactttggcctcccaaagtgctggcattacagatgtgagccgctgcacccggcccaggttcttattatgtaacatagatggtaaatgtctaaggcgttaaaaggtgccagactctagttaaatctcccttagatcaggataaaacctggaaagaggctggacgcggtggctcatcctgtaatcccagcactttgggaggccaaggcaggtggatcacgaggtcaggagttcaaaccagcctggccaagatggtgaaaccctgtctctactaaaaatagaaaaattatctgggacagtggcaggcacctgtaatcccagctacttgggaggctgaggcaggagaatcgcttgacccagtgggtggaggttgcagcacgctactgcactccagcctgggccacagagtgacttgtctcaaaacaaaacaaaacaaaacaaaaaacctggaaaggggaggggattctctacaattctagattttccccacaaaagacagctttttggagctatttaaaaaaaaaatcagagaatatattttgggggtaaaatacattgatttctttcagggcctgctatctgtcaggtgagctagagtcaggttggaatttggtatcttattgctacaaagagtctgttttgtgtcttagatcagaatgccttaaggtctctgttttaatgttaatgctggtcagttgtgtctgaatttaaaggaaggagggggataatgaggcttgtcctaaacctcttcccatcacagcctgaataatttttcaggtttattttggaatgccctgggctgagagggaggtccattcagtcggttggaggcttagaattttatttttgccttacagtttcccaaaacgtccagtgaacctcgccctcctttagaagtgtcgtccctggagcccacgaaaatgtctgcaagatctgcaagggccccttaaagcccgtgccaccttaagcaggccccacccctggcctagccaatgggctgacacagcagtagctgctgccacagtagctgactggtcaccctgccacccagtgctcacacccctggccagtgcctggctatggcccgactgctcaggtctgcaacctgggagctgttccccggaggggctactgctcccagaaggcaaaggtaccgggagagaagagaagtcctctggaggatgaggtggggagcggggagcagggggttctgatcccaagtttcctgggctctgtgacccccagcaccaagtgacctgaccttgggcaaaagggcactgggcttaccctgtggcaacgtgggtgggtgtagagtgagatcagctgagtccccactgctaccatgagtggggctggggagtcaaatggatgcccctggaataaaacacacctgtggaagaaggccctgaaggaaaggcctgggttccaggccaggctctgtccttaacttggcctccatttctcatctgtaaaatggaagaaacacatcccccgccccgccgcgccccgccccccacgaagggcccagaagcccaggcaacgtagagtggggagggggcagtggaagcttttcctccccctaattcccttatcagctctgagttccctgtggctggggtggtgcttggttggccctggagaaaggaggaagtagggatcttttcggttgctcaggctgggctggctattgaaggaaccctgctgatagccttttggagagtgaattctggttttttatttggatggctgggcgctgtggctcacgcctgtaccccagcactttgggaggccgaggcaggtggatcgcttgagcccaggagtttgaaacctcctgggcaacatagttaagaccctgtttttattaaaaaagaaaacattaaaaaaattcggtggcgtttttttctgaggggaaactttgacccccaatggctctgtttggaaaagaggatttctggatagtgggtttgtttaaagtgggcccacctggcaaggatgttgtcagcgggcgggcgcaggggaggctcactccagcctccagcccccagccctccccccgacactggggagggctgtggccccatgtgtctttcgggggaccctggcagtgtgtttcttccctgcaggagagctctgcagggacttcgtagaggctctgaaggccgtggtgggcggctcccacgtgtcactgccgcggtggtccgagagcagcacgggcgcgatgagtcggtgcacaggtatgggaggttcgcgggcccctcccctgtcttctggattcaaccccagctgagagagagggtgctggttgccttcctcctcactcatctgttttggggtgctctggcatgttctctgcccctcgctgctgtagcctcaggccctgcaacacctcgggaccagagggtgtcacgccccgctaaatgctgagggtctggttctaggtgcgaacctcctgatgctgtggtgtggccccagaacgtgagcaggtcagccggctggcagccctgtgctatcgccaaggtgtgcccatcatcccattcgcaccggcaccgggcttgagggtggcgtctgtgctgtgcaggtacagtggggctccctccccggcccgaggatggtcccagcacaccttggcacacctgtggctgcctcccccgccaccacggcaccttgggtctgctcccgcccgtgggctgcctgcctctgggggtctggtctggtgctggggggacacccgcggggtgtggtccggggacgtggccaggtcagagacccaggttgcagtggtcttagcacctgccccaaccagggcggcgtctgcgttaacctgacgcatatgaccgaatcctggagctgaaccaggaggacttctctgtggtggtggagccaggtgtcaccgcaaagccctcaacgcccacctgcgggacagcggcctctggtttcccgtgggtaggaccgcgaacctttcctgggaccctgagggcaccgtgggagcagggctgtgtctggggttcagggaccttcctcccccagcccgagggaaaggacctccggtccctgaggctgccttctgtcgccgccctccagacccaggcgcggacgcctctctctgtggcatggcggccaccggggctcggggaccaacgcggtccgctacggcaccatgcgggacaacgtgctcaacctggaggtgtgctgcccgacgggcggctgctgcacacggcgggccgaggccggcatttccggtgagcccctctgcggggggcccgggctctggccctgggcactgctggcgggctgccctgcagagccgggctgtgaaaagcacctcctggcggccccctggtttggcaggctaggcttcctcagctctgaagccctgtcagctgggccaaagtggatgggaccagggtttgctctccctgcctaggccgactggctttgtggagcagaaagcactgggccagggaaactgggcccgagggagccagcccagacctcagtgcctggggtcggtgtcttgggttccagcttcggcttctggccgaaatccctcatcacacagcctggtactcaccttgtgtgtccctgggacgtaggaagaggcagccggctacaacctcacggggctcttcgtgggctccgaggggacgctgggcctcatacagccaccaccctgcgcctgcaccctgcccctgaggccacagtggccgccacgtgtgcttccccagtgtccaggctgctgtggacagcactgtacacatcctccaggctgcagtgccgtagcccgcattggtgagctgaggatgggggcagtcagggtgggctccctggaagaggcccctgggaaggccaggcctcacctggcctgccatctccctggatccagagttcctggataagtcatgatggatgcctgcaacaggtacagcaagctgaattgcttagtggcgcccacatcttcctggagttccatggctcccagcaggcactggaggagcagctgcagcgcacaggttgctggggtggagtggggcagcagggtgggctgcctcagtggcggcccggtgtcagcccccttccccaactgcagaggagatagtccagcagaacggagcctctgacttctcctgggcaaggaggccgaggagcgcagccggctttggacagcacggcacaatgcctggtacgcagcctggccacgcggccaggctgcaaggtgagctggggctggggtacagatggggcccacagtcggcccacaaaccctttcctcaacccaccactctactgcacagagcagcaggctgagctcaacaacggggctgggcctggctgagcaggcgctagaaacaagggctgcagaccgcccacccagctgttcagataccgtctacagggaaagcacagttgtctgctaagccctcaaaacccttcctgtgagccaggtcatgggaacggtgcggtgctcttgggagctgtacatggaagaaggcttcctggaggaagagatgatagagagggggatgttagcctaacctggggaaggaagtctgggctccaggcagctatgcaaaggctcagcagcctggggcttgggggtgggagcacaggggaggtgtggcaagcacacctgggccattggtctcctgtgttgtgtcggggggggtgagggctgaggcctagagaagagcaggattatttccttgtgtgaggccaagagctgagcccagtgccctccgacccatcctcagccttgaccacggtgaccccgtacacccaatcggcaggggtaactcataggcttccctctgaccagggctactccacggatgtgtgtgtgccatctcccggctgccggagatcgtggtgcagaccaaggaggatctgaatgcctcaggaccacaggttctgcccaccctgctgctggggagaggtggggaggtgtcagggctgatcagacctggggcagcaggaggcaagaggaggactgggctggagaatagttctgtcctctgggccccaggaagcattgtcgggcatgtgggtgacggcaacttccactgcatcctgctggtcaccctgatgacgccgaggaactgggcagggtcaaggcttttgcagaacagctgggcaggtggagcaaagccagggaggggaagagctgagggcagaggaaagggagccccctgaggatgctccttcctgcccccaggcgggcactggctctccacggaacgtgcacgggggagcatggatcggaatgggcaagcggcagctgctgcaggaggaggtgggcgccgtgggcgtggagacatgcggcagctcaaggccgtgctagacccccaaggcctcatgaatccaggcaaagtgcttgaagggggtctgagcacttagcccacaagttccctgactacggagccggttctggaactttcttcatgccacggcccctgcaaggaaatagatgctgaggcagtcttcctgccagcggcccactgtatctgggcccaaggccagagggcccagagagaagcctgagcaccgtgttactccctggccctctggctggccccaggagcctttggttcagtaaacgacccagggtggtcccagcaaagctgcttcctctctgctcctacgcatcctgtcctggcgggaagagagcgttgggtccattcaagactctgatgacacccctccccgaggcctcccactgccggggtcccggacccttcccccttcacctggtgacaggaacactcctttcctggtatggaacgtgagccccgtgacatgatgataggtcttctccttggggcctcccccaataaatctgtaataaactgaaacccacctacagctacctggaagtcagcaggcagcacttcctcccctccccctccgggtctctgtcctttggtcagtgacccctttgttttggggctgtcctctgacttcttatgcctggggaggaggttggtgctcagggttcggaaaggaacccaggtccctgtcccagctctccgcctcagagctgaggacctgcccacggcacatgtcactcaggatgggctccccaatgggcctgaaccgggcctctgaacacactgaatgtgttcctcagcagctgccacgtctcagaaacagagatgagactatttttgcacccacctcttcatggggtgatgtatcgtaccacagctgttttgccctcaaggtctgtccacccgagggcctgcccctgtcttgggccggagccgtcttgagaccttggcagttgttcccccctaagcccacaggagggcgcccgaaatcagaagctcagataccacgcggcatctgcagctcacgactcctctgcccagggcctgcggcctcagccctgggcaaacctcctcctagggtcaggtaagtcctggcagcctggaagccaactagtcctccatcccctgcaggtcccaggaacctgcagtgctgtctcatcttccttgccctctagccttcggtcccttttggaaagaggcatgtcacaccccacgccctccctggcctcgcccctctcctcctcccatcagctgtcagtgctcaggcaggctgctaggccttaggcaaggcagctgcgctgagacgccccagtccaacttcagttcttggaacccctcctccgtgcaatactgggctccagccgacagcagttacaccaacctgagcctggaggctactcctccggacgtttctgtcccgtgctgccctggtggggagcagagaccgtgccaagggctcactgggacaaatctcagccctctccccaaaccaccccagcacgcgtgtgctcatcaccgagacaccctctcgcccctccccttccagccagccagccagccacccactcttccaggcgagaatctgcagcagctgcgctctccctcctgggtaggactcttctttgatgcgccctccagtgctggcaactaggaggcgctcagcaaatgaccatttcccacaatcttttattaagaaaaatccaaacatacagaaaagttgaaagaacaagtacactgttcactgaaataccagccactgagattcaacaatgaacattttggccttatttgctttgtgtattttggggggaactatttgaattaaattacacatttcttgaaggcattcacctatataatccagcatctatctcctagaatgaggacattttcccatgaactgcagtaccgttaaatggctattagaggaatggttgtctttgtgagggtctcacgtccaggaacctcatcaaagcgtgctaggcccttagcagaagggtagaacctgctcgccggctccctcaccttctctcccatcccagaaaggcagaacagggcaacacaggattctggagagctgtccagatagaggatcacaaacatgagctccaccgggaaacacagacagccccaatcccacccccacaacaagagcaggcaacctgggtccaattcagaggacaccacagccggcagagggctgcagcatgccaggtaggacggaagtcgctggggtggggatgagcaccagcccctagagcctggaatagcacccggcgtgggctacagcctgccccacccacctcacagctgctcggctcacccatggcactgccaaagcagcaggctaagccgccaaggcgggcacatgaagcctccatttccaggtccaggggtcaggcaaggagtctccttcagggctgggccctgcctcgccagctttgctggtggaattaaatatagcacaggagacacagttgccaggcagaagcaggaggtgctgtgaatagaacagtgccctttgtgtgacaaagctatggggagcctgctgtgcatgtgccaagacctgcagggcagctcccccacccccacagggacctctgagctgcatggttttgtccccgcttcacatgtgaaatatctgagttcagatgaagtcgtttccccaagatcattctgccaagtaggagagcctgaatgcacgtctagagcccacgttcctgccaccgactcacaacagccccaaggtcttcaccccagacggtcccgcgctgagacccaggctctgaaccaccgagtcttctttagtgtttctccgctgccctggctcacgtttgcccactggcctgttgtgaatgcccttgcacagagtaggtgctttggaagcatctgatggagggtgactgcggagccaggggccgtggcagcagggggatggtcagcacatcaggcgggcctgagaagggtcagagcagagaggcggtggagtcgtctcccttagagctttccttcgctggctctgcaggaggctctggaatgctgctccgggagcccgctggcacggggacacaggccaggcctgcactgctgctccctgccccgagctgcctgcccagccgcattttgccaacttttgtgagcctgagcagttggttctggttcaagggctctgagcggcacagccccaaaccagggcctcttcctgggcctcaatgaagcatgcccgtgagtcagactgagacgcaaactgaacaacaggcagggcgagtggaacgtgggatggggagcaaaggtggaaggaggggggctgggcccacacctggaagaacccacatccttgcagcctccggtgctgcaacatcttggcccctgcagatcttttcagaggtccggcacaatgactccacagaggctgactggttccatgatgcttaagaggttaggaagcttgtaggaggcacgcctgacttccactccctccacccaggcctgactatctgaggaccaattcacacacctggagccccgatagcagcctgaaggaatgctaaggaggtaggtgagggagtggggggcaggcccttgccccatttcttgattgtataacacttcattaaaataaaatcacgcagtgccatcttttattaacattttaataccatatcaaaacaccttgactaatgaagaaagcttttctcccaagcttgaacatttttttaaacattttataagtttttttttgtattttaatatataaatacagaacctatcttgcatgggctgatgccacgtgtgaacatcaatggctaaaatgttctcaaacaagtgcctgaaaacaggggtagctgtacatatttcttagtaagtctttttttgtttaagtttctgaaaaaaaaaatccacgagggcctaagaataatgttcaggcatttttgcaggacattgtgattgttaaatcctctgaactgaccggaaccaggaggaaagaagggaaaagagatggatcagtaggaagaaagttctcaatgggttgttttttggcaatgaagtcaagatattaggtctcaaggggagaaaagagcaaaaaaccagccagaaaaatagagggaaaaaaccaaaaaacccaaagtagagaagttggtggtggagagggccagttggggcaggggaagagaccggtgctcgcccgccgtcagaaggctggcagcgaggccttagctgtgttcgtctgtcactggtgggttatggctgggcagcaaacagcaagctgtaaacatcacgagggaaaacaccagtgacactagactttttttttatataatttttttttgtaaacactttaaagacagacccacatgcctttcaaagatgaaaaagaaaatgccctttccctcctgggctgaggggtgaggggaggatagcagttgattcattcttctctcaaacttgctctcatccaatttggtgtcctcaggaggaagggagaaccatgatctggaagtcagtgcagaaggggtgccctgttcccgctgtgtcccaagctcagctctgccccagggtccggtgagcctcctccctggagcaggggcgcctgtccctgtgtggaccgtaataaataagtcgtgctccatcgggccgagggctgtctgccatcccagggcagctgcatcccaagagggcaggcggggctggggcgtctacacaggacccagaagccaaacagcacacggggaatttgcagccatgtgcctgggcaggttctactccctgcctcactctcccccctggctctttcttctccccttgtcatcagtttttgaggtggagtaaaaagagcaaatgtccctgatttgtctgacatcatcagctgttctgggagtttacttgaataaataaaataaacctaacaaaagaaaacgaaagcaagagagagagaaagggagggggaagaaaaaggtcccaaaacctttggctgtgagatggagttgggcttttggtttttatggggttttgtctacttgtttgccagaaaaaggaaaatgccagcccagaacttggaggggcaggtgagatgggggtcaggggtggatggttggcagcaagtggggtacccctgggggagaatggggaggccagacccagcggtaagccagggggatgtgtggagtcagcacccagtgcgtgggatagagggatcgagtctggcctggaggcctcagattcatctggaagcggcatggaagaagcagtggtcaaatgatcgctgaccagcactttgcagggaacaatgcactgcccaggctgtttagtaagtgcaatgtccttatggcaacagggagtgagattatccccgttacctagaagaggcggagactcagaggtgagcgaggatgaggccaagccaggcacaaacccacgctcaggctccttttcctgcccgtgcacattcccaggggatattcctgaactttctttagaatgtagattgtactggtctcttccccaactgatcctaactcttctgagcctgttcttataactgtccatgttggtttgtatctcttgtccttcccagggaaaatcatttccggatgctaactgctcactgatgaggtgctccttccctctgctcctgctttcttctcagtggcatagggcagcccggctccctaaactgcaggcccccaaagtgacctgaccccaagccttgagccggagcacccccaaacgcgggctcacctttgagaggagtcagcaagcaagcccgcaggcagtccgcagggtgttccggacaagatctgttcacttcaaaccacgagtctatgcagctggaggagggggccgcaagggaaaccacgttacctgctgcccaggctgctttgaaggggcctttcagagggccagattcctgagcaggagcttcctaagtctcttctgaaaggaccccaggaaacacagtcatgtccccagatatccctactttctgaagcacgaagaagggtgaacacaagactagtcttggcccaggtggaggcagcagtaccggctcagggggatctggtgctgaggaaggggcagagtggctttcagaaggaccaaagctttctgtgcagagcccaggagaaggcagcagccaccagtgagaaggtgagagcggtggacccctcagggcagctagtcagcttctccaagactcccaagggcagggaagtgggaacaatggcatggcaggagggccacggcctgggtgccacagtcctgaaagagctccttcctgggtcaaaagaacagctgtgaagctcctcccagtgggtgacctcttaggagagccccaagctctacccggctcagccatgatcagtgatcagcagcatctagtccttcctgcaagaggcgggaggggagccagacagtgaagcctgctctccagtgtttacaga

SEQ ID NO: 5038 - DNA, 24675 bp, Homo sapiens
atctgcactgcaattattccctacctttaatcaagactggcttaaatgtgtatgtcggcgagtgcagtggctcatgcctgtaatcccagcactttgggaggccgaggcaggcggatcaaaggtcaggacatcgagaccatcctggctaacacggtgaaaccccgtctctactaaaaaacaaaaaaaaagaaaattagcagggcgtggtggtgggcgcctgtagtcccagctactcggaggctgaggcaggagaatggcatgaacccgggaggagcagcttgcagtgagccaagatgcgtcactgccctccagcctaggcgacagagactctgtctcaaaaaaaaaaaattgtgttgtaatgtgtgtgtatatatatctgagtgcatacacacatgtatatgcataataggtattatgtatatgcaaataaaattgcaaatacctttcaagaaagtgttctccaaagctatctaaattatccacacggtaatttctccaagtcaagcaactgccttggggcctctgagtgatctagcaagagtacttctcagtcctcctgcatttttacttttccagaagcctgacagtaaggggtagtttctctacttccaatggagtggtttaaaacgttaatacaacagaagatacagaacatttttgttttatttgagcatgatcccagtaaaactgaaataacaattacttgtctgagttccagaaagggcatgctctaggatactcaccttccttggtagatgctggaataataaataagactgacagcatacccatttttggaatatatgtattgaaaagtggagcaagaaagagtctcattgatatttgttttactaattgtagtactctacttttcctttagctgtggccccctctctcccacctctaccctattccccaacacgtgcacgcgcatgcacacacaccacacacacacgcatatgtgcatgcacacacacacacgcatacgtgcatgcacacacaccgcatacgtgcatgcacacacacacacacgcatacgtgcatgcatacacacgatcaccttatgttccttcgctaaaaacctcatgtccttggtttgcatatgttattttttccctagcgcatgacaagaaaaacaggtggataatatttacttcctcatttccccagggttggactgatgatttactgatggttaggtagagtctcttgtcgttttgtggctgtctcctatccagtacacgactggactccatatcttactccagcgcaatcttgtcaccagggccttggccaggcttgtgtctggccagaacggctccctttctctcctgctgtcattttgtgttgctctctgctattgtgggcatcaggcctcaccactttatgtgcacttctcacagaaaaccttgaatgtgctggacacgtgtgctaagtccaataagcacagcaaatgcacatgctgggctgaggctcccctgacgaaggacttccttccttctgcctgaaatgccttactcactactcctttgctggctgttgcagtaatgaatgtcttcttttttctttttctttctttctttttttgagacaaatcttgctctgttgcccaggctggagtgcagtggcacaatctcagctcactgcaacctcacctcctgggttcaagcaattctcctgattcggacgagagtcccagcgttgcggtggctcctcattggtctccctgggtgggtctcatgactcggttcctgccaggctcagcccttcgggcgatgtcctgaagcagcaccactctaatctgtcacacccgtgtttagaaatattcagcagctgcattaccttccaagccaagtccaaatttctcagtttggaactcaatgtcttcacaattgcttcccaacttacccttacagttcactcgctctccacctcttgggcaaacaaaaattgataagttaagtgctttacatttcatcctaatgatattcctataagatgtgtgtattatccttgtttttcagatgaagaaattgaggcacattaagattgacttgccctaagtacccaatgtatttagtttcttggggctgctgatattaccataaactcgatgacttaaaaaacagaaatgtatcctcttccagttctagagtatagaaatccaaaaatcttgatgttggggggccatgcatcctctgaaggagttagaggaagatccttccttgtctcttcagctctgtgcttgtaaacattccttggcattgcaaccccaatctctgcatggccttcttccctctggtcccctctgtgtcaaaatctctcttctttctcttataaaggcaccacatattggaattaggttcacccttaatccaggatgatttcgttctgagatccttaactagtacatctgcacgaccctatttcccaataaagtcacattctgaggttcaagtggacacaaattctgggggagactgtttaacccactacacccaacaagtaagaatttgaaactaaatctctcaggctataagcatcatacattaacaccttcacttaacgcctcccagaaagctcccggccaaattggcttctctcatttttctatatagatttttccctttcctgcctctctgtcattgctcatgcattttctttacataggccagtttttccctttttcttcctttcaaccaatcctacctgtgaaatcttgtgtagtcttcaagatgaagctcaacatcacttcctctaagaagacatccatggccagtgcagtggctcacgcctgtaatttctgcactttgggaggccaaggcaggcagacacttgaggccaagagttcgagatcagcctggccaacacagtgaaaccccgtctctaccaaaaatacaaaaattagccgggcgtgttggcacctacctgtaatcccaaccactcagagctgaggcaggagaattgcttgaacccaggaggtggaggttgcagtgagctgagatcatgcactgcactccagcctgggcaacagagcatgattctgtctcaaaaaaaaaaaaaaagaaaagaaaaagaaaaaaaaagacattcattactgcaacgccaagcaaaggatttttcttccccaaagctaaactgccttacagcacatgtctccgatggcccatattatcttcaacctcagttctaggtttctgtgcagttgtctccattccctactacatctgcttcctgccactgttactatattacaagcaccttaaaggcaaaactgcctcctcccaccatgtgttctccacagacttttcttaagccggagctccacaaatttgcccaagtgaatttagaatcatctgcatcttctctgcattgaatagttcatgtatttgtaagcaaaaatgtaggatgcttaaaaactccctttccccaatgctcccacttttcccaactggaattttttaaatggcccaattttctttccacatctaactcaatcatcttaacaaacgttttcatcatttgaattttatctaatgataaaaattgagtcccttcctggtataatcctctcacaatttctttattttcttcctatcccagtgctacctcctttggcttttcaggacaaatttattactcttgagatctctgaggagaggataatatcttagccatcattatattcccagcagctgttagcacctgggtgtccaaaatatttgaagaatgcatgaatgtgtgaaggtgtggatgctgcactagagcaggcagagcagtgctgtccctgagatgatgacataacttttgcaggtctcacataatccttaccacaccctatgaggtgggcattcttcccatgttacagatgggaaaactgaggctatgagatagaaagaacttgactcttggccacacatccagtaagtgatgaaaccagattgaaacccaggttgtctaaccctggagctaaagctcttaaccaaaaatcctcttggattggattgcagccgcattatcctgccctgcttcaagccaagggaatgtgatcatgacaaccttgaacataccttaaacctggagccttggcatctgttggccatttggttgggaaggtctaaaagaagtgagaggaagcttgagattgtgagaaaaatagtgtaaagaatatatatgcatttttgtgtgttgtgtgtgtgtctgtgtattctgtgtataggatgatacctggggatgaaacaggctgtgttataggaaagttttggagataagaatatacaagtgaccaggagtcacaggtggacctcgtcctagctcagacacttagcatctgaacaaacttggacaagtcatttatccacctgaatggtttgctgtgagatggcctattgacctcacataggtgttgggaggatctatgaagctaagaagaaagttcgtaaaatcccagtatatgcagtgcgctgcactgatgagtagaagggaaggaggaacagagtggtggtccctgattcaaaggagtttccattcaaattaggggaaaagacatgtaaaactaactctaaatgatacagaatagaaaatgtgcaaccatgaaaaggagatctcttgagctctttactgtatggcaggttaaaagatggtaatctcacaaagatgttaccttaccaagtgggtattattagcaatcccatttggtagatgagaaaactgatagctaaaacctttaacctttactccaaagccatgttgctaaattccacagccaaaattcaccccgatctatgtaacctgaatctttacttgtatcatctccccatgctattgccttgagcaatctaagatgcaaagtgcagagagatgggaacctttgtgctcaacttggaaaaaggggagaagggcaatgaaaacagagcagacaccctttaaaactgcgtggctttaaggccaggcgtgtagcttgtggctgtaatcccagcactttgggaggccgaggcaggcggatcacctgaggtaagagtttaagaccagtctggccaatatggtaaaaccctgtctctactaaaaatacaaaattagcctgacgtggtggtgcacgctgtagtcccagctacttgggaggctgtggcaggaaatcgcttgaacccagaaggcggaggttgcagtgagccgagatcacgccactgcactccgcctgggtgacacagtgactccgtctcaagaaaacaacaactgtgtagctttagggaattctgaagtcccatgattgtcaccatcagtgtgtgtctcactacaaactcaaaaagctaggagaagagagtgaaatagggtgcatatagggccagagaagatgtgaagggagaacaccaaagttccattccagcaaaagggctgcatacggccgctggatagatgccaagtgattaattcaagccatattaatgtcagagaggagaatttggtgaaagctttgcctggctagatctcggctggaaatcactagcttcctttattttatttccccctaatcctttataacttcctctatgccttagtcaagcttaagaccatcagcctccagggagcaaagtgaagcccatctgttagtcaggcatttgccagaccaaagtaaaaggtcaatctggcttttcctataacagcattagatgaccccaaatacttcccaacggtatcagccaaaaacaactttgcattaccgtgaacgtgatttcaaagcagagatgtcagggatatcctttaaaacggataatgactgggctatgctagtgagaaaaagaaagaaaacaataggcatatgtctctttggaatgtgcttgctctaaggctgtataaaaataatcctaatcatcttgtttggggaggaaaatcaatcaagaatgcttttttcaaatattttatttcttttattataagacatataggtaaaaacttgcatatttgaaaaagatagaaaatggtaataaaatggatatttttcttattaagaaatatgttcataatatgctttatcaaatgttaaaatggttattttgcaaaataataataaatagagcagactgtgacatacaagggtcaaccaaagtactggaagtttttatgctatatgttttataaaattcagacttctgattatacattaaaaattgacattttgcactacagggtatcaataatctgattttaaaaatatttttatgatggctccatgaattcaaaaataataaaacataaaagtggtttgactaaatagaatctgattcaaataatttccccctaaataagaaattgtaagtataatttttgagcctataagggacacatgtatcagttcccaattctatatgtctcggtggcattgaacaaaaattgtttgctaagcctttgtttccagcaaggtccacatcatttctttcacagtttgatggagcaataatagtcacgattctgatgagcctagttctacaattctgctccatggatcttagattcgtagaaagttttccctcctttgaagaaactcattgacagtttcttatatttgtttatgactcattggcctcaaagtcacatatcagaacactgggaaaatttttaatgatgaaaagttcttgttctaggcattctttgtaagctttacttctctacttccaaaatagaagaaacacatgtgaacaccaaacacatcctctaaagagtcttgggtgtcaaatagcaaggtcaggcttttcctggaaataaatactgactttttacaaaaatctttctttcccatgcatcatgttgcccacaaggctaatacgctagctccctgctacaatgggggaaccacatctaacttaagtattcaatctaatatagattattggtcccaatggccttcaaaacggccatcaaagggacatctgggtgaccctgggttcctagagtacagagaggtcatgcaggatttggacttgagcttgaaggccatattcttgttgtttttggccacgatcttgcccagaagcgcctggctttcctgggcatgctctccttccttttctggtaggccagccgccgtcattcttctccttgctgtcccgccgaaggcgcacctgtcgcacaatgccctcaaacagtccttcacgttgtgctggacagctgcagaggtctcgatgaacttgcagtcaaacaccacgcacaggctctcccttctgggaaggaaagaaagaggtcagagggactgcagagcacagtccacatagcacacagtcaagctggatggttcttcgaggtaacactaagtcagctgtatagcagtggatagaggatgctgctgcggcatgggcctcccagggcatgaatagaaaatgtccactggagggtccctggaagtaagggagatgggctttagatctgatcccccataaattcctgtctgaaggtcccatttcatcaaatatagtgatattagttataacagtaaaagccatcccttaatttactgctgacttacaatgtgccaagaacaaggctaagttctttataaacatgttttcaatgtccacaacaatcttggaaaatacattattatccctgtcaaatacatgagaaaccgaggggagtctcctctgcaggtgaagttcacacagcctgtaagtggcagtgaaccaggtctgctcagttctcaagcccatactcaactctttctcctgacccagtttccagattggaaataagaattctactgcttagctttcctctcttttaaaataaaaataaaaataagcaataatgagatatcttgggaaaaaattgagaattttacaaatgtgtaatacagttaattatacaagcttttctgggacagtctcaatttcaagtatttcattgcattcaatgaccagcatcaagttttggtttggaaaaaaaatgattactgtagacagttgtgtcctagtaggagacattcccaaactagtgtgtacattgtctttatcaggtgtctttcctcctgagcagggctggcaatgtagtattttagttttataattgtaccagggatcaaatctgaattaggccataaaatctcaagggctataaaagcacttggctgcccactcagcagatagagattttcccgagctaagtatgaagaagaatatgtgaccccatcagactgatgcctcaaatgaaatttcgaagccagggatggggagtaggagagtaggacagtgtttctagggctcacaggaaccaggtcagccagagtagaattctttttcctcaatgaaactctttctcacagttcccctaaatagagttccctatcctccttgcatgaagatgctactttcatttccctgtactcttgggaatccaggaaactccttaaaagcgggaggattagtatcctgcaggtagaccagatggacaaggagaacaactagtgtggaggagacccactgggactgtaggagtctgagaaacacacctaaatttcatatagcatcttaatgagttcctagatccagcctcgtggaaggagggaagaaccgtgtctgaaggaaaacacatgtgatccagcgattgtttctacagtattggctctgctctcttacctgatacagacacttctcggcaccgcactaagtcacttttgttgccaaccaaattatgggaatgtcctctgtctgccgggccctgcggagctggattcgcagctcagatgcttctcgaagctcgctcggtctgtgattgagtagacaatcaggtatgcgtccccgacctgatgcagtggtcatggagccattcattttccccctaatgaaacaataagatcttctgtgattcagttaggcctggggaataaagcatcagtttgcaaagaaacaatatgtgtatcctaagtacacttgctgataggaaaaataggaaaaaggaagaaaatcgcttccaactccctaaagcattggtcttctatgcctataagatgtctggtggctgtaaagattgctagcctgtccatatttatgccaaaaagttttcacttttcagtatcttctacagcttgatttgataaattaacaacttctctgccaaacagcatttccaatttctatttaatctaccaaaaatgagcctttctgacttcccaaaaactcccttttgccttttccaagtgatgagattaagaacactttttgggactaggagggttttcaattaacagaagtctagcacataggttctgaagctttttaaatctttaaaaagccaatgttgaagactggtattgagaatctcaacttcatatgagatgatgtatgttatttaaaataacagtcaatgcctgtttgtattttccctaaaacaaataaatttttgggtgtgttttttaatagaactaaaggcaagtcactacaacttgcttgttattcgaactcatctgtgaacgacctgttccttagaacagtctcattcttcagcagtatgctttaatcaagaaaatgagcccacctcatctggaacacctactatataggacaaggtcaccctgcaccaaacaacttgttgaaaggaaagccctaaaggaatttagagagctacaggctctgataccttattttcccacatatccaggagtataatcgttgcactttccccatcaaccatcgggttcgttcatatgtatcttctagagaagaaagaacaaagatattggagtcaggcgaaatgcaacacttctccataagagggtcaggtagaaaattgtgctagaacataaacttactaatatgcaattaattatgtaagtatacagatattttcaaaggcaaattactattttttgcaccttcaacaacattctacatataattcctccagtccttatccagcagaacgtctctccgaacatgtgtcactaaaccacatggagtaaaaggcatttgtttgcatcattcctggacttttgtatggcaaaatcatttgtgaggataaacttactcaagagcttttgactcagattaatggttaatgctatgaggaaacattaaccacccagtgaaactgtaagccacattttcaaagtccattgtacctttcagtgggtagttactgaatactcactagcaatttcaggagcttgggctcagagacattgctcctcttcggacaagtgcaagaatgaatcttgagactctcctgttttggctgtagttttcttcctttttttaaaaaaaatgctgttccctaggaataagtggcttgtttttccatcttgagtataatagaaatgcagcctccagctctacttggtaatgaaactttcctccctgcacttgagcccagatcttgtgtaggtgaagggtgaacacagtacgtacaatgggccaaagcagttccagcctggaaaatccatggggggcaggcgtagaaaagggtacagtgggatttttgcaagtgggatttccctcatcccaataccattgagcccatcccactctattttcacaatgaggtttcctgttttgaatttcatcttttgaaaattatgacttcataatgatttatcatttttcttctgttctttttgtctagaatcttttccctcaaataccacaaggcctgtttccttacctccctctgggggaggtgcttcctggccatccatttaaattgcaacacttctatcccacaatattccttctctgctttatgtttctccatctcacttttgccacctaacatacaacacatttaacttacttattctattattttctgtccctcctgccctctcgtaatgttagggcagacatttgcatctatgctgtttactgtgtcccccagcaattggtacattgctggtgcacaataaagtttgtacagtgaacgaatgataaatatagcatgtggctgtgaaaacaagcaaacctgaattcaaatccaggtgccatcccttatgaactcgggggtctacgcaacttaggctctctgagcctcagttttcttcatctgtgcaatgggatgataatagtactcacaccttagggctatgtgacaattacctgtattaagcctgggcacaagtagaaactcagtcagtgttagccattatcacttcttcaggtgaaggaagctggttctgccatactcagcacttcctcactacagataaatcctagcttaagagagctacgttggaacagggcacttcttgttttacaatagcgagcagtttacgaaaaacactgctcctggtttatgcttcatcatctaagaattggaatcaggagaggtttcccttccttagagaaggaaaactggacaaataagaagagagttaaccaggcatggccctgtctttctgtgagtttccccactcccacagcgtcattcttctaatcagtaagtgtttgcccttggggaattaaaactctgttcgcccatcgtgtgcctgctcacaatatgcagaaggaatgagatcacagtgggactattggattaccaggggtagaacctcacaacctcaacctgtaaattagacaatgcaagggagatgtcagagcctgagcagcacagaacggggatggcctgactgctgcttcccaccacagggtcttagctcttctctaaaacccctccctgcactcagacaactccttcaatgatggaggactttctcagcccaccactcaggtacaggggactcgcttgagtgcccagtcattcaaataaaacatactgtgttccaatcgctgacggaaaaggaaaacccaactttctcctggcttaaagatatcagaacaagtctagagaaaaagtggactaaggatcacagccatgaaagtaaaacatgctttcccgttctagaagcttcctgacaggatcattctgtctgatcttacctttgctgaaaattacggtgttggaggcctgggaggctaaaacaatccatctcctccctgctcagacgtgtgctccccactttaccccccaccccagtacatgagtttagatacggcctctggcgtgtgcaccaggacccttccagcacacatggcatcccgactgaaggctctcccctaaccggtgcaagcctgggagtaaccagagctccaggtttctcttcatctaagttgctcagctctcttttatccttttcaagtgctaatcaggtgagaagaagggaaggaaaagaataccagatctaggagagctctttgaaatctgcttccagtaaaggtgtggagaaaggtttggatactattagtctctgtgaggcttttccgtaatctgggtctggagacacccctacttctccagtcactggaagaaagctggggtgtctgtgcacactctatgtagcaaaagaactcatgctgaggggacagacagacgttctataaggggtgatggtggtcagtagccactttctctagaccgtttgtctttcctcatttgatccccctgacagactctctccctgaccaaactttagtcagctcctctgaatcctcttctctacccggcctctccctgggcttccgtttccatcctggcgaattcagctttagcaagaatcctgctaagtcagtttagtgagaatcccccaccttcaaatctgatcaaattcctcacccaccacctctgatagtctaagtccttggcctgacttcagaagaatccccctaaccttgacgtctcctcttagtaattttccatcctctgaccccctccacctgctccttggcctgacttcagcaagaatccccctaaccttgacgtctcctcttagtattttctatcctctgaccccctcccacctgctccttggctaagtgcccacttgttcttctgtacttggaattgagccccatctctccccactattgggatgcctactgcaatggccctaataaagtcttccttaccatgttaataattttttcgttaacactccttgtgcttggaaggaggccccttctgcccaagactggctcaagtgctgtgtgtgtgtgaaacccgcccaagtttctctcactgccagaactgactcctgcagcacctctaaagttctgagactccagcatcctctccctgaaaactttcaactgcttccagctttcatagctcaggggatcccaaggaactcagaagaaatgcctgctctacaaatactgtcctctactctactggccccggtcccctcggacagctccacgggccccagccaacagtgaccaaagtggacaggggccacaagcaaggaaccaccacttttgaaagataagcacatcaaaaggaaatggtagattcagaatcagctcaactaatgctcatttcgtacttactatgtgccaggcaccatgctccatgctcaacatgtatatcctttaatcctcgtaacaccctatgaaggaggtattaccccaattacactaatgagcagcttgaggaggctaagtggcttgtccaagagcacccagccaagtcagtgtcagagcgcgtctaaacccatcatcaaaccccaagcccaatgagacttccgtactttgctatatattgtggtgtgccttcccacctagctcagggcttccaaatcctagttgtccctagggtccattcagagaccatctcttccatgaagcttttatttattttatttattttattttattttttttttattttattttatttcatttttgagatggagtttcacttttgttgcccaggctgggtgcaatggtgagatctcgactcactgcaatctccacctcccagattcaaatgactcgctgcctcagcctcctcagtagctgggattacaggcacatgccaccacgcccggctaatttttgtatttttagtagagatggggttttaccatgttggccaggctggtcttggactcctgcctcaggtgatccacctgcctcggcctcccaaagtgttgggattacaggcatgagccacatgccgggccaaccatgaagctcttaaatccacagtcagaggtaatcttttcgcctcggattcccacagcactctccttacaccactttcaagacatttaccacatcctatctcaattctacttggtgtatacattatgctccattgcatactgtgagcatctccgcagaagaagcccatgactctttgcatgtccccagagtgcctcaccaagctctgtgctatacattcagtaattcttaggaatgaatgaatgaattaatggcattcagtgtatacagagagtcataagattctgtagtgtaactgtaacaatatccatctttattaggagaaatcattatgagaatattagtcgattttttttcttacagtgaatgctgatttaaaaaaaaaaaaatgtaggggtgtgcttagaaaaccttcctcttgggaaacaaaaccaactagtgattccagcaggtcctacagatctctgtgtaagaagctagggaaaggattccctttctctcatgattgaacccaaatccttgtcttttcatggtcccctgcggccccaggatcagccatatgcctgatgcccaatgtgcgtcatattgggcatctctctctctctctctcaacaaagaagttcccaaaatatctgggaggctacctttccaaattccaggtatgagtcagtcttcttaacattttatgcctatgggatattaccctctggatacatacaactccattctaatggacaaacatttttgaaagtctacatccactaacttttttcaattcttccctcttaaaaacaaaaaacaactcccagtccatccttccttatgtcaacgcccaaagcactgtatcgttactgcttaaaatattagttaatgtaccctgctctgcaacatagcaactaacacttagctcattactagggggcatggtatacccatccatcgccttgtatcccagagcttaggccagagccaggtgtgtggctgatgcccaagtgctgtcatacttagtatttggaagctaaatcctggggctgcagggggctatgaaaagcacaggatttgggttcaatcacaactagatttgaatcctggtcataccatgtactagtttttcaccctgggaaagtcacttgactttgtaagcctccatttcttcacctgtcaaatagtatattaatgccagattgattcaagtattatcaaaaatatgtgtgggaagtatttaacaagtgcctggcacatagcaagttccccagaaatggtaaaatgaactgaactaagatgataaatcccaaattctaaatccaccttccttattgggtgattctggataaggcttttgatctcctgagacttagtttactcatgagtacaagaactttgtgaagaccaaaataaacagcagaaatataaggcacctaacaaagtgcctctcccgttgcaaacattcactctaaatgttagcccttcctcccgtttctctttcctagcaagtcacctggcagcctttacaaagaaagaggaatcaattgtacaacactggccctatttctccctttactcttctgagattccaggagtgggagagaaatcaatgttacaacaatgagtcattatttatagcccagttcctgagctgcccatgaggcagtgaactccttgacactgagacaatcaagaagaataaaacctccagatgaatgggctgtgggtagtgaggaataacattaatatgcatcaatgcaggggagaactgagtatcgctaagacacctccctactctgtgattcagttgtgagtcgcgacagaacacagacctgtgacttggggaaacactgagcagtgcttcctttatttctgtagctgcaaatagggactataactaccctggtcgcatacgctcagactgaagctgtggctgaaagacactttatggtggcattggctatcaggatcctcatattacttagcagaacatagggctgtgctttaccctagctgaagaatacatgcattttgagataatgtcacctcaaaacagttttggaaataggcaggctccaatcaataaatagatgaaattgtacagggaaaattgtcttgaaaagctgtcgactctatagaaagtttcattgttatacttcacattttaaaaaattattatgctatttcaatacagattttgaactatttaacacccacaaaactttctaatattggtggaagcaaacgatcaagccatcctaacagcttttccaactggcttgttttaggtataaccatggaaaaagctgtgtctatactgagttccgggaagaatgttcaagtcagagtcagcagaagtcaagtgggcgctgaccctctggctctgccctctctaatcagccttccccaacccatttagaattgaatctgaagaattccctttctggcccaggatcaacagattttggtcctgtctacaagcttttcattttcttgcccgaaagcctgtgcttgggcttttctagagactcagctcccccacaattgtccaaaatgcctaacttcagctcccaactctgtgggtaaataagtcacccacctcactctttcttcctgggccacccctggtggaaagaagcccactggggctgggacacctcctcccagcacctcgcagtcgctgtccatgctgtcatgcacacctgcaaagatgttggcagagtggacttgcccaccccctgctcccctatgagcaccactcggtagtaggtgttcccgactcagaggagatgactgagtctgtggagtcagaggaccagcttcggcggcagtggtctcaggggtagcagaatggcggttgcggtggctgtactggtggggctctttctggaccatagatgcctgccatcagctgggatgctccagcgctgctgctgtggctgcatgcccacagtccctggcgcatggtgacattattcagagtcatcgttgagtcctggggagcaaagcagccagatggcagcattagtaagcatgagtgagagctccgctcaaatacatggtcagtcatcataatattttattagatgagatgagaagcaagtatccctaacataaagaccaccaattaacagtcccccaaaccccaacaagacaggctttcaactggacacacacatgctgcccacacgtcagtaaccagctcctcaggcagactatcatttgcatgggaaaacaaatacggttaactcacccactgcccatgggcttcccccttcctcaaagcagacttggatgaaagaagagctcactcagagctggcacaaaggcagctggaaagaaccagcagactccaaagatggcttgaaagcaacaagttaatgttgctggggaccagctggtcaggttagctgctcttgtctaaactggctcttaattgcaccagtgtccagcaggttttgtgcctcagtgggaaacacgtggcatgacatcaccctcccctcccctgcccactgcaaccctggctggactggacaggcacttatggaacttccatgtttagtaaagttgccttgatgctctccagctgcctggagagcatcccctgccattattgggggtaggggggaaattttctgtttaaagtttatgcctcagctgtgcctcttacccacagataccacttttaaaacatcccggctccaaacctagacaccctggcgagaaatgacctgctcatgttcagacctatgaaatttgcagagaaagtgcctcattcttaaaaaccacatccattctcaagagttctttaattcaactcagattccttttttgagtcaggtcttgctctgtcacccaggctggagtgcagtggcacgatcatagctcactgtagctacctccaactgccaggctcaagagatcctccacttcagcctcccaagtagctgggactacgacctgcactaccacgtccactagtttttttatttttatttttattttttggtagagacgtggtctcactaggttgcccaggctggtctcgaactcctggggtcaagtgatcctccggctcggcttccgaaagtgctgagatcacaggcctgagccaccattctcagatccccttctgaagcaaatcagaaggctgaagactcccctaaatgatattcaacaacttctctacaacttccctttgcagactgcctcccctagccgggaggtctgtttttccggctactggtgacaagtataagtacttacgttgcaatcagcaagatgcacaaacactcctctcccaccctcaccccacactccgtaccccaacatctcgccactaaccaggacgaccagccggttttttagtccaaaagcagcacctcagttggcagacttacattcaaacaacaaatacataaagcatcataagggctgccctctctgaccactcgatctgtagagggaggtgacccttctaccgaattgactaaggaacctgctgatgagaagcgacatcctttgcacttgaagctctgacccctaccgaaaatcccagtgctgagcgcacgttccaggggttctcttctcaacttcgaaagttctggggctgggaaactcccactctctcccttctccgtctcgggccgtcccccttacttggctggccggatcggcgtcggggcgtcagcgtatcgcgtgggtccgcgctgggatacccgggcaacgagcggggagtgctgcgctgtgcccgccgtccttgcccgccgcctgcagccgccgcgccgggcggtttataaccagcccagccgacccgccgcggggcttttccgtgacgtcagccccccgccgggagggggcggctctgcagcaaactcggagttgcagccacttggctaaatagttactcgcagtcatgtgaccccttctctctccatttaaaaaataatgacagttcaatctgggcctcctttattttgttttattttctttttaccagatgaacacaggaaaatggaaaatacactaagtgacacttaatcctccttcccagcaaagcacttgcgagctgtcgggataaggatggaagggagaggcaggtttgagttgagaactcagttttgccaagaaaacagagtcaacctggaatgcgcagagactttagcctccaggatgagactgcagccaccttgaataccaaggcttgttttaaccacatcttctgcaacgaagacagccttgtcaccttcttctggtagggggaagcagatggagccccacaaggctttgtttcccttctctggcaaggacccaggagaaggggccagaaagaggtgaggaaagaggacaagaccttgaaaagggcagtttggaaaacaatttaattgaggatccaagcagattgtgctaaatattgctggccctcctgctctggccagaatgctgaggctcctcaatcagggaatttaatcagcatcccaatcagcagcattctgtaccaggctccctggcaaggctacgccttgggcatgagccaatacagcctggccaggggaggagcactgagaccaacacccctgtaagagactcctgtgaacaaagggcacaggtaataactactactaccatttattaagtacctctgaggacctctgcttagtaggtactgtaggcctcctgggaccttaatccttactatacttctgcaaggtggctctatttctaccccattgtatggaggaggaagataacatagggccagagaatttgcccaaggtcacaccgctgtataagtggcagggtcaggactcaaagcctggttttcctgagtctctgcactgcaccacaagtgaaggatttcaatgacctctttctggggacatgggtatttcccagatgctgtgttagagatgatgctggcctctccaacatatctgcttttccagccagcttcaactctgggtggctggtggctccgggaagcagccaaaggcaccagcatctattgaagcagctggactctctgtgattagagtcaattcacagttatcctgcaggcatttatctgctttgagaattagcacatgaccagctgctgagacctgccaggtcccaagctagcaaaggtggaatccgtagagaatgaaaacttagaattcctttagtctcaggtgttgtggccccaatctcctacttatctatacataagaaacctgagacccagagaggagatgaccgcttaggacatgacagaactggactacaacctggggatcataattctctggatgccctttgcttctgtcaagtttttcttcgggtttcgctgacaggaagtggctacagatgtggggaaaggaaaaggagaggagatgggggtgggggagatcatctccaagagtatatcactgactccattctaaaacacatgtaattatgaataatccatgtttcaaaatgatccatgctttttccatactgacactcctactctgcaactggtctcaacagaaacatcataggagtaaaaactaagaagaaatcagtttataagatatgatatagttcctcagttctacttttgccgattgataagaatctaatacttcacattataaaaacctaattctggccaggcacagtggctcacgcctttaatcctagcactttggaggctgaggtgggtggatcacgaggtcaggagttcaagaccagcctggccaacgtaatgaaccctgtctctactaaaaatacaaaaaaatagccgggcatggtggtggatgcctgtaacccagctactcaggaggctgaggcgggagaatcgcttgaacctgggaggcagaggttgcgtgagccgagatcgtgccattgcactccagcctgggcgacacagcaagactccatctcaaacaaacaaacaaaacaaaacaaaaaaaaactaattccatacctaggcaatatctactagaactatttgtcattggtatatgtgaaacatacaaaagaaaatgaactccagggactgggaaagggaaggggcacacagcaatgttgtgtttggataatagaacaatttttaaatttttaaattgtctgtctcacaagaagccacatgaacacaaagaagaacactacttaagaagatcttgactaaaagttaagtttgagtaattatttagagaaaaatcatagttatacttcacaaaagcacatctgagcgccaaatctcatctagccaagtctcagatccctcgaccgggatccagctcactgggatcatcttgagggtgtggagctggagagaaaaggtagaatcagggctttgggtaagtggcaagttttgaagaggaaaaattggcagaaagttgtcttttgttctagaattattctctccatattctttctgccagcatttgaaggcttcctcagtttctagctaaatgagtagctcaagagtatagcaaagaggcagaattcaaagcaacaaaaataactcactttacttaccaaaatgcatgcctatctcagctaatccgcatcacccctacagttacccaattctatggggaaaggtgctgaggaatgagggttaaataaccagcccagggtcacagggggttaggtggcagatgtgtactctctggggccacagtcttaactgctgttctatttagataggggatatacgtcagtcctcattcccatactagccccaccttggcctaccaccttccaaaaccctcaaaggagaagtttttgtctgattggccaaagcccatgaccttcactgggcacctgttcctagtgggccgagttactctacttaaaggcatgagccatcctttcctctctttttctccacatccctgccctagggcagaaggtgaagttggggtctgtttggggactctcctactactctgccactgtcactgtcacttagcatgtagacttgagcaaccagttcccagatttcaaataggatgagaaaggaaggaaagacgtagggaaagaataggacctttgaccgggttgtaaataagggcatctgggacttgcacagacattaagataatattactttgaatccatgtcttgaaaactctaagagaggagagatgatgggtaggctcaggatctgtacatgctgggtccattatactattctaaaagctgtaattctattctaaaagcaacagaatctaaagcaacagaatcatctatactatagacttactacaaccaaggtcatgcttgcccaagcctcaagtaaatgctactcagtggtaaaggggacaccatgcaaacgttctccctttcccaaaaggaggtagattatagactaaacactgagtaagaaataaattaaatgggttttttcctttattttttaaatgtttctttttttctttctttcttttttttgtatgttttttgagagaagaatcttgctatgttgcccaggctggcctcaccactcccaggctcaagtgatcctccacttcagcctcctgagttactgggactataggtgctgggctctgttttgcattttaatgctttaggcaaagcatgccggccagtttcccacaatccttactaatccttaatatattctatccaagcagtttcatttatactatctacctggcccctaaaggcatttgactttgggatcttgcctgggctgaaagaaatggtaggggatttaacatcagaaaaggaggttcaaatccagcctttcctcttatgcatgtgatgctggggatgtcaccaagccccagaggccttggctttgctgttctgaggactaaagagctatggaatgtggaagtgcttgttaaccacggagcacatgtcaataagagtgattatgattatgacgcaggagccaaggattgaagcttagccaccgccctcggttttgctgcctcttaaggctccagctaaattaatccagcagaattcaagaccatggggtggagggaggatgggcgagaaatatgctcatattagatgttactaggaaaattcattagcaaggaggttgttgtaaacaagaagatggaggccaaatacccagcacacatctaggtctccaccagccacaaaaacattcaggggaggagctgggtgggaagcaatttgcaagtgtctgagcacaaaaagaaccacccaccaactttgggaagtctaaagaaggaaagaatactatatggaaaatcattgctttagagaagggggataaaaaagccttcaatcgcaaatcaagagaggcctgattacaagaaaataaagacagaagaaaagatggctaagaataacgttcagcatccagaggcctgcgagatccagatggacagcccctccagctgcatcctccccaaccagcccccagcttctcatcagactcctgctgagcagattgaattttccattgaaaaattcttagctatcacccctccttccctccattggcccagcctgctgcaggcctggagagtccagtggcagagatagctagagcccttccttctaaaagcttgcagagtaagtgcagaattatcttagtaggctgggaggagcctcctaaagaaagcaaatgttttcttcccaggctcctccatccatccacattcattcattaaacaacagataactactgagaatctacgttatgtaagacctgttctaagggttaagaatatgatccttacattcacagaacttctactctggtggagaaataataaataaagaaataaagtatcaccatgttcagtcattcatgcactcatttttctctgagcatgcgaccctttagcctccattttctcatctgcaaatagggaatgatatactgaaaggaagtataaagtagggattaagggcatacccattcagaggtctgacaacaccaggtcagtgaaaatgtaaagaatggaagctctcatgcccagcaggtgggagtgtaagtcgtaaggccactttggaaatcaactatcaacacctaagatgtgcatatcctttgagatcagcaattccacttctaaatgtacatcttatatgttacagaaaaaacaaatacaaggatctcatgaaagcactgtttgcaatagcaacaatcagaaaccaactaatggccatcaatgataaatgcattgtggtatatttacacaatgaaatagtatacagcactgaaaatggatgaatagatctacttgtatcaacagaagtaaatgttgagaccatatggtaacttgaagaagcaattgcaggatatcaacagggtaatacactatataatttttacataccacactagtgtttatggttaaatacacagttagtaaaaggatagaaacgaggatgagaaaaatagacatcaattcagaatagaattatctcaagtgaaggaggggaatgacaattagatggacagaagactctcaaaaacaaccgagaagccaggaaatacttgcataataagatgaaagtgctcagtgaaataattgttaatgtggaattttatgcccaactaaactgtagttcaacaatgtgagctaacaggtcaggtgcagtggctcacacctataatcccagcactttgggaggccgaggcgggagatcacttgaggtcaggagttcaaaaccagcctggtcaacatggtgaaactctacctcacaaaaaaataca

SEQ ID NO: 5039 - DNA, 39762 bp, Homo sapiens
catggtggtgggcacctttaatcccagctactcaggaggctgaggcagggagaatggctgagcccgggaggcggaggttgcagtgagctgagatcacgccactgtactccagcctggggacagagtgaaactccatctcaaaaagaaaagaaaagaaaagtgaggctcagagaagcgagtgacttgtagcagatatgtgacctcagccctccctccagctgcctccacacgggcaggccggggcctctcttacctgctttctccccttctcggtccagcaagtgctctcagaagagagattgacgagaacttcaaggccctcttcaggcagctggcaggggaggtaggttggggatggcaggttgggaggggcctgtgaggggcagccctctcctggggcaggtgccacctccctctctccccaggacatggagatcagcgtgaaggagttgcggacaatcctcaataggatatcagcaaacgtgagtccccgcggggctgtcccaccaccccaccatttcttccacatcaaatccaggctcctgctcacacattgagctgaacctcatcccttggtctgcatgagtcgggaatcctccagtttttctgagcccagttccctgccatttccatcccatactcctcctccgacctgccatcctgataatccctgtgctcgggtgctgtgcctttgtgggattagcagcgagcctggccaggcacagtggctcacacctgtagtcccaacactctgggaggccgaggcagagtcgcttcagcccaggagttcaacaccagcctggacaatatggagagaccctgtctcgcaaaaaagtacaaaaattagctgggcgtggtggcatgcacctatagtcccagctactcggaggctgagttgggaggatggcttgagaccagggaggttaaggctgcagtgagctgtgtcacatcagtgcactccagcctgggcaacagagcaagaccctgtctcaaaaaaaaaagcggagcagcaccttagtgccaaagaaaagtctacctttcctcccagagcctcctgggccagctgagtggcttggggaacaccacgtgactggcttcactccccagggcagacaactgctgcctctcatcccctcccctcccctttgctgccactgacctccatccacacggtttccttagcagagcttttctcctcctcttctctgctagtgaagcactgcttaccctcctagcctaagcaagccctgccctgccccatctttctacccaatttctcgctcttctgtttcacactctttctttttactttggactaattgtggctgttgggactttggcttgattgctaaaatacttacttgtacttcctgatgatacaaacaatcctgcccacttcctctgccagatattgcaccactcgtcaggatttgtgcgtccttgactctgccccacccagtgctcccagcaggggcggtgcaggaagctcactaggtggagatgttggaattggtttttcttgcagacaaagaccgcggaccaagggcttcagcctagagtcgtgccgcagcatggtgaacctcatggatgtatcttccgtttgcttttgtctcctgagtggggttttgggtggaggtatcggtgctgggagactgtcccaggacagcacagagaacaggacagagccatgcggagtgtggacacacagtgcccatgctcagatgtctccctggacgtcttcctgttggttgggagggagaaactgaggcaagacctgtgtcaagtgaaaggtggagcaagacctgggtccccattgaccctgaggctgggctatttctgacccctccccagcccactccactgcagcccagctcagagaataaggcaacccggctgtgggctgactgtacatggcttttgctgcttctcctcacccagccccaagtcacttgccggctcggcggccatctccccttctgcacagttgcccactctcccatgactggctaagtgatggaatttccttcttaacggccacccagcgtgatggcaatgggaagctgggctggtggagttcaacatcctgtggaaccgcatccggaattacctggtaggttgtccccatcacctcagtcatgcaggtgcgggccgggcaggtgggaagggccgggtgactcagcctgccctcaccctctgccgccacctcagtccatcttccggaagtttgacctggacaagtcggcagcatgagtgcctacgagatgcggatggccattgagtcggcaggtgagactccaaggcgacggcacctgtggggcccaggacaggtagccccactgctcctatgccccaggcccttgccctggggtgctagtggtgacatggtaacagccatcttgtccttttccccacggttactgcaccctgcctagccccagccccctcctggggacccaacccctcccccatcctgttgggaggggctgcgcctcactgaccttcactcactctcctggaccaggcttcaagctcaacaaaagctgtacgagctcatcatcacccgctactcggagcccgacctggcggtcgactttgaaatttcgtttgctgcctggtgcggctagagaccatgttccgtgagtgtccccaactgcccccaccctccagctccgtcccaaacgcgtcccccaggagctggggggaatgacagatggtgaattagcagatacaggccagtgctgtgggtgtgtgccagagaggcctgggtctgggttggggggccctggctgagtgccaggagagtcggggagggagggagttgacagtggcttccaggcagcaggaaggggtgaagcttcccagcttcaaggggtgtcagcttgcggtactgtgggaggtagagagggaccaggcaggaagggggccaggcctggccctgcgtgaatatcccctgagttttcagccctgtatcaccttttcttgaacacacaggatttttcaaaactctggcacagatctggatggagttgtgacctttgacttgtttaaggtgggaacctccctgggccatggttggggaagagttccaggcgatcgaattttcttatctggccagtgttccctgtccttcctggaaatgagcctgggcctcagagccaaccctgaagcccgggccacctgaatcctaaaggctggggtgggggtgtctggattctgggaaaggagcaggaggggaggtccaggccttggaggcccctatgggagcagcactctggtttcccaggggtggaggaggtaagaaagtacccctccatgaggttcctgaggtggctcctgagacgtggagttgggggctggacctgggtttgggtggggaagaagccagggagccatttctgcggccccagctgacctgcctgttccccgcagtggttgcagctgaccatgtttgcatgaggcagggactcggtcccccttgccggctcccctccctcctcgtctgccaagcctcgcctcctaccacaccacaccaggccacccagctgcaagtgccttccttggagcagagaggcagcctcgtcctcctgtcccctctcctccagccaccatcgttcatctgctccgggcagaactgtgtggcccctgcctgtgccagccagggctcgggatggactccctgggccccacccattgccaagccaggaaggcagctttcgctgttcctgcctcgggacagccccgggtttccccagcatcctgatgtgtcccctctcccccttcagaggccacccactcagcaccaccggcctggccttgcctgcagactataaactataccactagctcgacacagtctgcagtccaggcgtgtggagccgcctcccggctcggggagccccggggctgggaacgcctgtgccttcctgcgccgaagccaacgccccctctgtcctccctggccctgctgccgaccaggagctgcccagcctgtgggcggtcggccttccctcctcgctccttttttatattagtgattttaaaggggactcttcagggacttgtgtactggtttgggggtgccagaggcactaggcttggggtggggaggtcccgtgttccatatagaggaacccaaataataaaaggccccacatctgtctgtgatgtgtttctccccagcctactgcctgagggcacctgcaggccccggcccatgggggcagctcgtggcctcagctcacccctccctccaacccctccatctccttccccttgaccttgaagcttgaacccctactggagtactggtatctgggcaagaccacccctggccctgggaggttgggaaggaggggccctagctgcaggacagggccacacagctgaggtcccacatggctctgctgatcctacatgccctccccgcgcccaggaggcctgacccctacctttcttgcacacttcggcccgttgaggtgaggctcggctgaaattcaaacctctacttagcacacacccggccccccagagagctcccccgagccagagccgccttcaggtccctctgtggggagcccctgtgacccagacacctgcacttactaagccgctccagggcctgctgggatctgggattttcttaccagagataagagtggtttggggaaggaagaggggatggggcgaagctgcaaatgcagagcagaggccgaggtggggggggtgggagttggctgctgtcagctgctgtgggccccagcgttggggtggagatggaggggaggcccctgtgtgccccatggggaaggctgcccgcacactgctatcttgagcttgcgtttgcccttgtcacctcctcactgggagtccaggtcctgttgggctcagagtcttcagcgtgagggcagtggctcagctcttcctgcagcttgggctggtgtgtgaggggctggagggaggagggtctgcagggccctgccatcttgctcaaacccttacttgctctctggattgggtttatttgatgtggggatgggaacaccacgtctggatgacctgggaccctaacctctcaaaactctgagtcactgaggtagaggtgggaagagcagggcttcttcctgactgccctattgggctttcttgctttgtttctttccttcctttctttctttctgatggagtttctctctgttgcccaggctggagtgcagtagcgtgatctcggctcactgtaacctccacctcccggttcaagcgagtctcctgcctcagcctcccaagcagctgggattacaggtgcccgccacctgcctggctaacttttgtatttttagtagagagagggtttcaccatgttggccaggctgtctagaactcctgacctcaggtgatcagcctgccttggcctcccaaagtgccaggattaaggcatgagccactgcacctggcctatttgggcattttaaaagggctttttcccacgtgcacctgtgcagccaagtccctgctttctcgggaagtgggggaagggtaagcagctgtaacactgcatcccattattctgaactctcagcacttaaggctccagctgtgatttggagccagagacagggactgtgtcccatgtgccaaagccagaatcggggctcccgaacatgcctcgtgtcctctggaggaaagggaaggtgatggtgctccattcactgctggggtcctgtcgggagggcagtgggcagggcggccagacctgcggatatgggtggtaggctgtgactcagcctcggggtgagagatggagagagctagagaaagggcatgggggaggggagccctgcagattggggacacctgaaccctcctatggggtgtaacctgagccctccgacacagggtgcacagatgtctgcagtcctcacccctggcctgttcctccccctcccagggcccctcccggccttctacataaagccgggggtactgggcctcaggtcaggcctatggccatggccttcacagcctgctggatgctctgggcagcatgggccgcttccagctcaaccacacagccctgctgcgctgccctgcggcctgctggcctgccacaacttcctgcagaacttcacggccgctgtcccccccaccactgccggggccctgccaaccacactgaggcctccaccaacgactcgggggctggctgagggccaccatacccctggaccagcttggggcccctgagccctgccggcgctcaccaagcctcagtgggccctgctgagccccaactcctccatcccgggcgcggccacgggggctgcaaggacggctgggtctataaccgcagtgttttcccgtccaccatcgtgatggggtcagaaggggctgggtgtgtgggggggctgctgccgaggcccagtctgaagcgcccagtcttccctgcagtgggatctggtgtgtgaggcccgcactctccgagacctggcgcagtcgtctacatggccggggtgctggtgggggctgccgtgtttggcagcttggcagacaggtagcccgtggggataagggccccagccacccagtgcgggccagaaagcctaggcctctgcttcatttttctttgttacagttgatttgtgcattttaaacagataatacatatagtacatcacatggtttcaaatcccgaaaggcacagaagagtctgccggggatcacccctttcctctctgcccctccttgcagtaatccccagagggcagcctgctttctatgccttttaccaggacattttatgattctatgcagtcaagcaagtgggtgtatatgttccattcccccattttcttttcctgttttgtatttgttttcttcttcatgtgcccccatttttttctttgagataggtctcactatgttggccaggctggtctcaaacttctacggtcaagcagttctcctgctctgtctcccaagtagctgaggtgacaggcctggtcatcctttttttgtgcaaatgctgcatacaccccacgtggtcctgcacccggctttttcttcgctttggaggcctctcctattcttcagaaagagctgtcccattcctcctagtctttacactacatcccactgtatgaatggccctaacttgttccccgttattttttagaggtgaggtctcactctgtcacccaggctgagggcagtggtacaaacatagctctctgcagcttcaaccttctgagctcaagtgatcctctgcttcagcctccccagtagctgggactacaggcacgcaccaccgcacccagctaataaaaaaaaattatttttagtagagatcggggggtgggggtgggggggggtgtctcactatttgcccaggctggtctcgaactcctgggctcaagcaatcctcctccctctacctcctaagtgctgggattacaggtgtgagcactgcacctaactgacccctattgacagacgatgtgagccagctcatggctctgaagttggctcctacgtctctctctctgcacctctttcccctcctcctcttcgctctctctcccctctcccttctcctctgcccttcttctctcagttcagtttggggggccctcccggactccaccccacactctggagtgtagatggctccctgtgcccacacctcaggccctcatcacaccgtgtcatgatacaccctggtctttctacatgtgagttgtgtcttatccagaatgtcttgtttgtcaccaaccctcaactcaggcctgtcacttaaggtgattaatgatcaatgaacattgtgtcacaatgaatgagtgaatgaaagaatgcataagaaatgaagaaacgagtgagtgagtgagtgagcaggcgagtgagtgggcgagcgagtagtgggcagatgagtgagtgagtggactagtgagtgagtgagtgagccggtgactgagcagtgagcgggtgagtgactgagtgagcgggtgggcgagcgagtgagcgggtgggcgagcagtgagcgggtgagcaagcgagtgggtggataagcgggtgagtgggcgagtgagcgggtagcgagtgagtgggcggatgagtgagtgggtgagtgagtgggagagtgagtgggtggatagtgagtgggcgagtgagtgggtgggtgagtgagtgggtgggtgggtgagtgggcggatagtgagtgggcgagtgagtgagtggatgagtgagtgggtgggtgatgagtgggtgatcggcgagtgagcgagtgagtggatgagtgagtgggtgggtgagtgagtgggtgagcgagcggtgagcgagtgagtcagtgagtgagtggatgagtgagtgagtgggtgggtgaatggatagtgagtgggtgggtgggtgggtgagtggatgagtgagtgagtgagtgggtgcgtgagtggtgagcgagcgagtgagcaagtgagtcagtgagtgagtgaatgagtgggtgggtgggtggtgggtgggtgggtgagtgggtgggtgaatgagtgggtgggtgggtgggtgagtgagtggtgagtgggtgggtggctcggtgggtgagtgagtgagtgcatgagtgagcgagtgagtcgtgagtgagtgagtgagtgggtgggtgaatgagtgagtaggtgggtgggtgagtgggtggtgagtgagtgcgtgggtgggtgagtgagtgcgtgggtgggtgagtgagtgggtgggtggtgggtgagtgagcgagtgagcgagtgagtcagtgagtgagtggatgagtgagtgggtggtgagtggatgggtgagtgggtgggtgggtgagtgagtgggtgggtgggtaggtgagtggtgggtgagtgggtgggtgagtgggtgggtgggtgagtgagtgggtgggtgagtgggtggtgagtgagtgggtgggtgggtaagtgagtgggtgggttggtgggtgggcgagtgagtggtgggtgggtgagtgagtgggcgagcaagcgagtgggtcatggagtgtgtggagaagaaagctgcctgtcttcttggcctgcttccctgctggccaagttgaggctgtgcgctctggcctggaccctcatttgcaaacagggcagatcaccctgccatcctgtccttgggcccctcttggcatggcaaccctctggtccacataatgactccaccctggctcctgctcccacaccaggactggccaagggctcacccgctgtgagttctggttcgaggcctccctccagccacagagtgctcaggtgacctctccccacctgccacacgcccctctggggctttgcagaatcccgcctttcctcgagcccggactaaatctcctcgccagcttccttctacactatgtccctcgtctgtgaccaacctctgccacgaagcctgggtcccagcagtttcaagtttctgttttgaagggtggctttcgcggggtaccccatcttccccgggactgccttgataatcccctgctgggtgaaaggggcaggcgtgggctgcccatttgttccttgggggatgctgctgctgcctccaaaaccctaatgcctgtgcccattctctggactcaggctgggctgcaagggccccctgtctggtcctacctgcagctggcagcttcgggggccgccacagcgtatttcagctccttagtgcctattgcgtcttccggttcctgatgggcatgaccttctctggcatcatcctcaatccgtctccctggtgagtccagccgaggagaggccaggaagggcgggggctcctgaaaggcagggcgggggcggggggacaggggggtggcaacgtcgagggtcatcggacatttttccatgttgttttgttgggattctcatccagcaacctcaactcaaagcctcccgccagagtctggacctgggggacctgggctcccgggtagtggtggccctgctggctgtgggtggggatccctggatggcctttcccaggtctgggctttagtgtactcatctgtaaattgagagggtaggtttattttatttgtgaattagccaacaataaccacttactaagcacctattgtctcaggcttagtgtggggacacagaggccactgggacacaggagaggagtgagccatgatgtccccagggcagcagccagccctgaaattgtatgactctatgaaggctggtgattcctcgcttcatggtggagacctggctcctggatgccagcttggagtgttgcgcccccaagtgaaagtggcaggctcagtcctcactctaggctggttctgggcagcccctgggtggtcctagagaaagcatcacggggcagaaggaagcccacccaggacacaggcctgccacctacctattttcattttaactacttagcttgctcctggggacaccactgggcacggaaactgctgccccatcagctgtgcaaagacaggatggatcttttatatcaggggtcaggaagaaatcttggaccagagaaccaggacacctgacctcccctccctctcccagcacacagcgggatctcaccaatcccagcctacacagctcactctgcagggtgggcatccagccatggcttgaaacagtgtctgaggtccacctcgtgctggaatgggctctaacacctacacagacacatacagaacacacagacacatacagacacacatacacacgcatcagagactgcccagcctcttaaccttcctgaggctggagaggccgggcactgtctggggacatctccgcctgtaaagacgacttgtagagattccatcgagtgccctggagctcccaccacaggccatgccctgcctcgggcccaccgcacaagtgtggtgaccctccatacatatatgcctcccctcatgtttgttcctcgcacactgttctgtatcttgattctttcacttaaccaagctgtcactggtccactgccgatagagagcctcctagtgccaggagaggctctagaggttgcggtgaacacagccctgcccttggagtccatgttctagcgaggcgagatatcaccagcatgcataacgaatcgtatatatgttcgaagacagtaagtgctacagaggaaaaccgaagcctggaaaggggataagaaggccgggttggccaggcgcagtgactcatgcctgtaatcccagcactttgggaggccaagcgggcagatcgcctgaggtcaggagtttgagaccagcctggccaacatggtgaaacccgtctctactacaaatacaattagcccgagcatggtggcgggcgcctgtaatcccagctatcgggaggctgaggcaagagaattgcttgacccgggaggtggaggttgctgtgagccgaatcgcaccactgcactccagcctgggtgatggagtgagattctgcctcaacaaaacaaaaaacaaaaaatcccacaaagaatggccaggttggaggggaggggtctgcagttttaattgcgtggtttgggaaagactcactgaaaaggggtcattttgagcaaaactggaaggagttagggaatgagccctgcaggtttctggggtagaacattccaggcagagggaactgccaggagaggccctgcaggggaaagtgtgcccagggtgaagagcaaggagggccctgtggctgagcagagttgggaggtgggcgacaggtgaggtcggggagggcagttctgcaggaccctgttccagcgttctaggacttcagctttgtctctgaatgagacaagagccaccggaggatttgaccagggagagacctgatctgatttaggatttgagatctgataagatctatgtggctgcatgtgacaccaggacggaagcagggaggccggttaaggggctgctgctgtcatcaagcagagaccaggttgaactgggccacggtggcagcagcagaggcagtgaggagagcttagatctggcttaattctgaaggatttgctgaaggactggacgcacaggcttcttgcccattggaagaagcttcctcattaatttgttacagctgcctcgtaagggtgtgtcatcattacttaccagtcccctacagatggacattcaggttgttccaagttttgctatttataaaaattatattttctgtctttgcatggggttgagcacctctgcccattttccttttagcttgttggcgttttctaattgatttgtgaaaactctttcagtattagggaaattagtctttctttctctttctttctttttttattttttgagacagagtctttagctctgtcgcccaggctggaggtagtggtccaattcatttcagctcactgcaaccttcgcctcccaggttcaagcgattctgtgcctcagccactcgagtagctgggattacaggcacacaacaccatgcccggctaattttgtatttttagtagagacggggtttcgccatgttgtccaggcttgtctcaaacacctactcaagtgacccgcccgactcagcctcccaacgtgctgggattacaggagtgagccccgcgcccagcccaaaattagtcctttatctgctagttgggttacaactatatttttacatttttgttgacgttatggcttgacttacggtgttttgttttgttttattccaatgcggacttttttatttttacgactccaagtttgtcaacctccccttttattgcctctgggttttggactttcttggaaaagcctttccctactctaagattataaaataatctaccatgatttctctggcattgttgtggttttattgtttattgagttctttgatccacttagaatttatctgagtgcagtagggacacctttgcctgtgtctcagagggtctctggaatgagtttaagtgtcagaatcataagggggggtgtggtgaattaaccacatgggtagctgaatgccgctgaagtcactgttttctccccagttgtggagtggatgcccacacggggccggactgtggcgggattttgctggggtattccttcaccctgggccagctcatcctggctggggtagcctacctattcgcccctggcggtgcctgcagtttgccatctctgctcctttcctgatctttttccttattcttggtatgtcctgaacagagtggggtgggggagggtgcacctgtgtggccgagtttcacctggccctgtgagaggttggggtgtgcagtgaccggggcttgctggacttgacagggacacaaaggatggcaggcgttcatggaggctgcaagctctcaagtcctcacgaatgctactgggacgctctggtaaaatcccttgcattagtgtggggccctggaacgtcccaaggcttttgccttcatcaactccttcgcatccctcaacacttcataagtactctaagtgctataaagttataagaatataactggggcatatataagagggtaatgaagcacagcccagaagggcccatgactcacacaaggccacacagctggggtcagaaccagattcaaaaccgggctgggataggtgtggtggctcacgtctgtaatcccagcactttgggaggctgaggtgggagatcacttgaggtcaggagttcgagaccagcctggccaacatggtgaaaccccatctcacaaaaaaaataattaaataaataaaataaaattagccaggcatggtggtgggtgcttgaatcccagctactcgggaggctgaggtaggcgaatcacttgaatctgggaggcagaagtgcaatgagccgagattgctccactgtgctccagcctgggcgacagagtgagacttggtcaaaaaaaaaaaaaaaaaaaaaatgccacgggtctgttgaaatcctaagtcctctgtagtttgtttttttttttttggttttttttttgttttgagatggagtttccctctgttacccagctggagtgcagtggcgcgatctcggctctgcaacctccacctcccaggttcaagcgatctcctgtctcagcctcctcctgagtagctgtgattacaggcacacaccaccatgcccggtagttgttttgtatttttagtagagatggggtttcattatgttggccaggctggtctcaactcctgacctcaggtgatccaccctcctgggcctcccaaagtgctgggattacaggcggagccaccgtgcctggccaagtcctctgtagtctttaaatactgttcagtgagtctctgatgatgtactgcaaaaaaagggaagctggcatggcccccagacttcctgatgctacagaaggaggacaggtcatcttttttgggtctgaaagaaggtagacaagggggtattgggtttgggaatagaatgagctctacccagccccagatccttcttcctcctctcggtcccaggtgcttccagagtcatcccgctggctcctcctgcatggcaagtcccagttagctgtacagaactgcagaaggtggctgcaatgaacgggaggaagcaggaaggggaaaggctgaccaaggagtaagcgagctgggaggaaggaagggtgggaacagtcttcagtcttgctggcaacctccgttgtactagaatttagcaacttcccaggactcacgtgccatccaggtgtagacattggaataaacaggacaggcagagttctcatgtgcgaaagatgttgtttaggtattgaatgatgtgtgatttaggataaataatttaactgctttgctcatcagtcaatccacctttgtaataggaaataaccctattaaccttgacatccagttgaaattttaataaaataataaactaaattattaaaatagcaaccacacagtaaaattactggggaatcaataacaaaagcaccatataaataccatttattataagatagttaccatttattatcaataagcatcatttctcaaccccatgccgggcactaggctgagagctttatgtatgtaatctcatttcatgtctcattttgacaaagaggaaattgaagtggggacaggacgggtaacttgcctgagaacacacagtggaagtggcagaaccacttggaacccctgctcttatctgactcaatctccgagtctatacaggaatggggtgggaggccctccagaaccgcagaacctcagtagtgttggagttcgtgtggagcttctcaacaccctggaaacagtgtgttggcacttctcaacacccctcaagtgcatcagtccttggacggagcggagacaagggccagccacctcaccaaagacctcaaccccgctctcctccacacagacgaaggggttcccagcagggatgtggggtccgagctccctcgtttccctgagcagagtcttcttacctaggtgatgagctcctacatccaaagcgagtttgaagtgtctgcacctccaactcaatcttggacctcttccgaaccccggccatccgcaaggcacatgctgtctcatggtgatttggtaggtgacaggctcatgcccaagactttcacctgggcaggggcatgctctctgcccccactgaaaaactctgttctgaaatactcttaatgcatgagcaggtgagccgtgtgaactcaatctcttcccacaccctttttccagcactcggccctgctggatgctgagatgtggtgacagatgagatatcatgctaacccaggaaccccactctgggcagtgggtctcacctgggtgggaggactattggaatcaccaaggcagcttttccgaatgtaatttgtcccatcctgatatgccctttgggctggctctccagtggattctgggagtgtcgcactctggaaaaaacacttctggatccaggaggggatagacaggaaaattgtattttcatgcagtgagacaagtatcctaacagcatttctgctagctggggctgctgacgcttcaggcaggagatagcatttagactgcttttaaaagatggttaattggctgggtgcgtggctcacgcctgtaatcccagcactttgggaggccgaggtgggtggatcatgaggtcagagattgagaccatcctggctaacatggtgaaaccccgtctttaccaaaaatacaaaaattagccgggcatggtggcgggcacctgtagtcccagctactcgggaggctgaggcaggaaatggcgtcaacccgggaggcggagcttgcagtgagccgagatcatgccattgcactccgcctgggcgacagagcaagactctgtctcaaaaaaaaaaaaaaaaaaaaaaagatggttatcaagtttgcaaggtgggcaggaaggaatacctaacaggttcacaggcatgaagatgtaaatggacaaaaatacaaaggcagcccatatgcagtagcaccaccagctgcaagctgacaatcctaaggggaagggctgataaaaaacaaccgtgttgatttcattccactggatttctgcacatttaaataattggtattgatacttatgaagcagggagtgcaggcaatgaattatatctccttccttccttcctctctctttctctttctttccttctctccttccttccccctcccctcccctcccctcccctcccctctcctctcctttctttccacggagtctccctcttcttcaggctggagtgcaatggtgcgatctcggctcactgcaacctccgcctcccgggccaggtgattcttctgcctcagtctcccaagtagctaggactacaggcacatgccaccaacccagctaatttttgtatttttagtagagacgggaactatctgttttctgtagcagactgggagtctcttttagtagatatcagctgggctctgaggccagactatccaagtgacctggcaagtcagggagcccagcctcctggggcctctttcctacttctgtaaggtccttgtgagatccagagttaagacatgaggccagcccgggtgactcatgtgtgtaatcccagcactagggaagcagaggcgggaggattgtttgagcccaggagttccagaccagcctggtcaacaagggagacgcccactacctgggggtggaggggtatgtatacctgtggttccagctacttggacgctgaggtgggagaattgcttgagcccaggagtttgaggctgcagtgccctgtgatgcaccactgcactccagcctagctgacagagcgagatcccatctcaaaaaaacaaaaaaaaaaccagttaaagcacgtaaagcacttaaaccacaggttgccccctgggaagctctgggtatagagtctttcctccggtttggatttggggctgtgacccctgtgtactgggaagagggacggcccccaactctgggaggctgtgaggccttctgtccccaacagcgtggcaggcgcgcagttccggctctggggagcaagggggctcctgcgaacccgagtccaggaatgggctcttcctgcggtagcccctgccggcctgggcttgcccttcgtccaccttcctctttccggagggagaaacagatcctgagttcaaaattccagagctgaaagtcctctcttggatcctctggaaacagtaagcaaaagcccgtttttgctgagaaagtgactcggcagctatccggactctctgcctgcaggtggggccattctcctatggagccgacccgacccgctcaaagctgcccgggaaccgcaggtttggttcgcgcacgccgggacttgccaaccgcacccgaaaaatggggccatgtccaaatgtttcgcttcgctgccggcagggagccgcgccgggctcgctccgggatcaactgcacagtcctggctttggggagcgggaggcggtgagcctgcccgcccccgaccccttcctcaccagtgtgtctggggtgaggtggggatggggagtcctggggttcgaaaaggatgggggaggagaaagaggaagtgttaggaactggtgaactttcacaaacttcccaaaccctattgtaaatgccttcaattaactgggatttttttctttactggttgattgattaagacaaggtcttgctcgggcacccaggctgcagtgcagtggcacaatcatagctcatgcggcctcgacctcccaggctcaaacgatcctcccacctcagcctctgtagtagctagactacaggtgcctgccaccaagcccgggctcatttttaaaaatagagatggggtggggtttgcaatgtcgcccaggctggtctagaactcctggactgaagcgatcctcccccttggttcccaaagggctggaataacagggttgagccaccttgtagtttttttctaaattctgagagcatgcatactcattgttaaaaacattttttccccaaacaatccagaaacaggcagtgagttcattggttaagaagcaggactcgaacgtactcctttggtttgaatctcagctctgcacttactggctttgtgatccttgacaagttacttaaccgctctgtgcctcagtttctcatttgtaacatgggcatcataatagaacctaccacataaggctgttgtgaaaattagtcgtaaagcaggtagaacagtgcctgaatatgagttgttttctgttatcaggtacataagtcatgtccctctcaacctactctcccttccacctctgaacatctcccatctcccatttcttcaggcatgaatttgtatccttgcagctcttagtacatacatgacacccacatacttaccacacacacatacacacgttcttatagaaatggatttaataggggctgggtgtggtggccatgcctgtaatcccagcactttgggaggccgaggtgggcggatcacttgagtcaggagtcgagaccagcctgtccaacatggtgaaactccatctctactgaaaatataaaaattagcaggtgtggtggcacgcacctgtagtcccaactactcaggaggctgaggcaggcgaatccttgaacccgggagacagaggctgcagtgagccaagatctcgccactgtactccagcctggcaacagagcgagacagagtgtctcaagagaaaaaaaaaaaaggattaatactctacccttctgcttttgtttttttaataacttaatcacatctgtaaaaacttttacaacattactgtaaccagcttccggcatgtgatagctttgcaataaatatttgatgagtgaatgaaccatgagtgaatgaatgaattttagaatattgtgagccacagaattataagatgaaaaggatcttagagaatgtctggtccattctccctgccactgccaatctcgcctgagtggcaatgtggctagtcgtggtccagtctctctgggaagactccgtttctagagctcacattctcagagcctttcccccttctttcctcctaggtgagcagacacgttaacaagcaaaagaactgatgtaaaactggtggtttttgactgagtgtccctcaaatttctcaatggccactttatttttgtgaatgttatagtcttatattgcttataacaaatcaccataatttagtggcttaaataacacccatttatgagcttacaattctgcaggccagaagtgccagctgggttctctgccaggctcttaggaggctgaaacgaagcctcctttctggaggctctggggaagaattcacgccaagttcatttcaattgttggttcgatttaactgcttgcagctgtaggatttatgtcccatttcctcacaggctgttcataaaagccacctacattcctggctaagtggcctcctcacctcaaaggaatatcttcctcatatcaaatctctcccatgctttgaatctccaactccagtctttgacctctagacccagatttaaatctcatgttattagatcaggccctcccagaaaatctctgttttaaagttaagtgatttgggaccttaattacatctgcaaaatcctttccaacacctagattagtgtttgaataactgggagaaggtttgtgtacacccgggccaggatttgatggaccatcttggagttcttcttcccacatacaggtttatttgtttttttgttttgtttttgtttttgttttttcaaggcagagtctcactctgtcacccaggctggagtgcatagtgccatctcagctcaccgcaacctctgtctcctgtgttcaagcaattctcctgcctagcctcctgagtagctgggactacaggtatgtgccaccatgcccagctagtttttgtattttagtagagacgggttttctctatgtgggccaggctggtctcgaactcctgacctgaaggatctgtctgcctcagcctcccaaaatgctgggattacaggcatgagccaccgcacgtgcccacatatactttttattgaagtataacacacatgcaaaaatgcacaaggctcagctgacaaattctcacaaactgtacacacccattaatcaacacactggtcaagaaacagaactgatcagcctccagaaaccccgtccccccatgtcttcttcagtcattaccctcccctatggaatcactatccttatttctaatgccacagattacattagcctgtttttgggctttattaacttgagctacatagtttttgtaatttataccgtttgtgagatgcactcatgttgtctatgtaatttagttcgttctttcttcgtgtataacaatccatggtacgaatatactactgtggtagacagaataatgacccccaaagatgtttgaatctttatagcttttctgtaaattatatttattacaaaataaaaattatttttaaaaagcaaggtatgcagtagaataagatcttgcagaaaccaatatccaacaaaaaaccatatccagaaaatatatctacgtctatattaatgtatatatattactagaaatcaataagtaacattcgtccccatcctaatccctggatctataaatatgttaccttctatggcaaaagggactttgcagatgtaactaaggatctgaaggaggattaccctggatcatctgagtgggcccagtacgatcacaagggtccctacagtggaagaagaaggtcagagtgagagagagacctttggagacgctgtgtgctgctggcttgaagacagaggaaggagccacaagtcaaggaatgcaggcagcctctagaagctggcaaggcaagcaaacagattctcccatggagtcttcagaaggaacacagccctgcccacactcgacattagctcagtaacacacgttaggcttctcacttccagaagtgtaagataatacattgtgttgttctatggcactaaatttgtggtaatctgttacagcagcaattggaaactaaacagaaacgttaccaatttttttttttctgagacggagtctcgccctgttgcccaggctgagtgcagtggcacgatctcagctcactgcaacctcctccgcctcctgggttcaagcaatctctgcctcagcctcccgagtagctgggactacaggcgcgtgccaccacgcccggctattttttgtatttttagtagagacaggatggtctcaatctcctgaccttgtgatccgcagtctcggcctcctgaagtgctgggattacagtcgtgagccaccgcgcccagtctacctatttattgctgaagaacattgggcttttcccaggttgggctgttacaaatactgctgctataatattcttgtacatttctcttggtgaaaaaacacacttgtctgtccttccttccttcctccttcctttcttcctttccttccttcctttccttccttccttccttccttccttccttcttccttccttccttctttctttctttctttctttttctctctttctttctttccttaatatggagacaggatctcactatgtcgcccaggctggtctcaaattcctaagctcaagcatcctcccacttcagcctcccaaagtgctgggattacagatgtgagccactgcactgggccacgcttgcgtttctgtcagatacatacctaggattggaactgctggatcataaagtatggtgtgtttctctgtaatagaagcaagcagttttccaaagtggttataccaattcacacctcattagaagcatatgagttcaacttgttccacatccctagtaacacttggtattgtcgtaatttaattttagccattatagtgagtgtgtagtgatactgtactgtgatttccaattgcacttctctgatgtctaaggaatgtaaaaatatttgcatgaacttattggtattttgatggcttttttttaatgaaatgcttatccaagacttctgccaatgtttctacagggttacttttttcttatcgccttacataagaattttttttttcttggccaggcgcagtggctcagcctgtaatcccagcactttgggaggctgaggtgggcagataacttgaggtcaggagttgagaccagcctggtcaatgcagtaaaaccccatctctactaaaaatacaaaattagctggcgtggtggtgtgcgcctgtaatcccggcaacttggaaagctgagacaggagaattgctgaacctgggaggcagaggttgcagtgagctgagattgcgccactgcactccagcctgggaaaaagagtgagactccttctcaaaaatatatatatacattttttatatatatatataccacacacacacacattatatatatacattatatatatacattatatatatacattatattatatacacacacacatataaacatgtatatatttttttctggataaaatttattttctgatattggttttcttaaatatattctgttagcttaccttcataaaattttggaataaattgtatttattcttctataaatgtataattatagaaaagttgcaaagatagtacagagagtcctgtatccacttcacccagtttcccctcatattatcatcttaaattaccttagtacattgtcaaaagtaataatttaagattggtaatttactattaactaaactagagatttattggatttcaccagctggtatatcccattacatttagttattatgtcttcttggtctccttgatctgtgactgtttcttagtctttccttatttgtcatgaccttgacagttttgaaaagattggtcaggtattttgtagaatgtccctcaatttgaattttttttttcttttttgccccgttggagtgcaatggcatgatcttggctcactgcaacctccgtgtcccgggttcaaggattctcctgcctcagcctcccaagtagctgggattacaggcatatgccaccacacctggtaatttttgcatttttagtagagatggggtttcaccatgttggtcaggctggttttgaatcctgacctcaggtgatccactggcctggcctcccaaagttctgggattacaggcatgaccactgcacctggcctcaatttggatttgtctgatggttctctcatgactaaactgggatgtggatttgggaaaggagaaccatggaggtgatatgaccttctcatcatatcatatcaatcatatgagggcatatatgatgtcaacatgactgattactggtgattttgaagttaatccttggttaaggtagtgtctaccaggtttctccactgtaaagttaataaatgttctcttccatattcttgttttacttttcaattttaatctatttatttattttgagaccaggttatagactggcgaatttttgtacttttggtagaaatggggtttcaccatgttgccaaggctatcttgaactcctgggctgaagcaatccacccacctcagcctcccaaagtgctgggattaaagtatgagccaccatgagcagcctctttccatatactattatttgaaagtgagtccagccacactcaaggggagggaaactaagtttcatctcctgaaggaatggatttttttgttttttgtttgttttgttttgttttgttttgtttgagatggagtctccctctattgcccaggtggagtgcagtggcgcgatctcggctcactgcaacctccgcctcccaggttcaagcaatctctgcctcagcctcctgagtagctgagattataggcgcctggctaatttttgtattttagtagagacggggtttcaccaacttggccaggctggtcttgaactcctgacctcatgatcacccgccttggcctcccaaagtgcttcgattacaggcatgagtcaccgtgcccagcctggagtggagtatttacacacattgtttggagttcttctttaagaaagacttatttatgaatcatttatttatataggctcatgtgtaaccatgtagtttatactttgggttataattcacaacgtttttcctttatttagtagatactacattctttaccttatttcccaaattgctcagctttggccattgggagctcttccacattggctcctgtgtcctttgaccttcctccacttcttctctttttattttttagcactgccttaatttcggcgctgaggtgggtactgcaagaaaagcaaacactccagaacccatgcactggatccaggagtgggtggtagaaagggagtggagggaggggtctgagctctaatactaaagacagagacttaggagactgtgaagggtgtttatggaaagtcagggaattttacctccccgaggagaggaatcctgtgtcatccactttgtgtcccctcccctgggctcacaacagtgaaccatggggtgaacaaggaccattccctgcctctcccaggttctccaactctgtggcttactatggcctggccatggacctgcagagtttgggctcagcctatacctggtgcaggccctgtttggaatcatcaacatcccggcctgctggtggccaccgccaccatgatttacgtgggccgccgtgccacggtggcctccttctcatcctggccgggctcatggtgatcgccaacatgtttgtgccagaaggtgagtcaccccttctgcccttgctgcacaccaagaactgggagcctctggggtctggtagacaacaaattcacatggcagcaaggctgaagggtatgtctccggatctgaaaagaaagcaactgttagctgggcacggtggctcacgcctgtaatcccagcactttgggaggccaaggcgggcaaatacctgaggttaggagttcgagaccagcctggccaacatggtgaaaccccgtctctacagaaatacaaaaaaattagctgggcgtggtggtgtgcacctgtaatcccagctacttgggagctgaggcagaagaatcacttgaacccaggagacggaggctgcagtgagccaagatcgtccactgtactccagcctgggagacagagtgagactcaaagaaaagaaaaaagaaaaagaagcgactgttgattactagagtttgtattaagcacttagtgcccagtggcaattagtggaggtggaggtcttgagccttggccctcagagcttctactgtgtggccagggaggttagaaggtgcacctaagcagctggagagcacaggggctggctcggtgtggccagcagtgtgtgggccccccgaagtctgagcaggcagcatgtccaagggttgagaagttaggattcaaacccagctggactggccctggaacagtggtttgcaaacctggctaaaatgaccttctcctgggcgctttgaaaactcccagggcccaggtgctccatgccagcgccctgggaatctcaagggtggaactcaaccctcagtattttacaaactgtccagtgagtccagcaagatgccagggtgaatagcagcgacatagagcatgggccaaaccatgtgcccattgtgactgcagccttgccgtgggcaggttgtccaacttctctgtgccttagttcttcacctgtaaaatggataaagttattattggtgtcttgacctatttcattccaatcttttttcctatttatagatttgtttcagcatagttgagatattttatatgtttatacatacaaaaatataaataggatacatcatatatatgtatatatgtgcatgtgtacatatatatatatatatatatatatatatattatatagtgcccttatttcattatatgttgaaacatacacattcttttccatgttagcaaaatgtttcatggacctgatttttttttttttttttgagatgaagtctcctttgttgccaggctggagtgctgtggtgctcactgcaacctctgcctcctaggttcaagtgattccccgccttagcctgcagagtagctgggattagagatgcgtgccatcatgcccggctaattttgtatttttagtacagacggggtttcatcattttggccagggtggtctcaaactcgtgactcaagtgatctgcccacctcggcctcctaaagtgctgggattacaggcatgagccactggcctggcctcatggacctgattttttattgctatgtgatccttccctccctccctccctccttccttcctccctccctcccttcttcctttcctcccttctgcctttcctccctccctcttttctttcttcctttctttttctttcttttctttcttttttaagacagagtctcacttgtggctcaggctggagtacagtggcacaatcatggctcactgcagcctcgacctcccagctcaagcaatcctcccaccttagcctcctgagtagctgggactaccggtgcattccacacacctggctaattttttgtattttttgtgtagagacagggttttgccatgttgcctagctggtctcaaactcctgggctcaagcgatctgcctgccttggtctcccaaagtgctgggttatagacgagagccactgcacccagcctagataatatttcatctagattgatgtttctactctggcctcacaatagaatctcttggggacctttaaaaaatacccaaatttgagccctccccagtaggtcttgctagagtggacattgagtaagacccaggtgtgagtgttttataaatctccccacctgattccaatgtgcagccagggctgccacccagccagagaaggcacctcatttccttgactgctgtcctaatgttggatgtttgaataggggttttgctacttataacaacagcgggagaagcatattgaaaatgaggacaatgggccgggcgcggtggctcatgctgtaatcccagtactttgggaagccaaggcaggtggatcacctgaggtcaggagttcggaccagcctggacaatatggtgaaaccctgtctctactaaaaatacaaaaattagctggcgcggtggtgcacacctataatcccagctactcaggaggctgaggcaggagaattgcttaacctaggaggcagagattgcagtgagccaagattgtgccactgcactccagcctcagtacagagagactctgtctcaaaaaaaaagaaagaaagaaagaaagaaaatgaaggcaatgcaaacatttaatgggcactttgcacccctggcattgtgtccagcttacgccaaccccataagcaggtgctgctattttccttattttacagatgaggacagggaggtgcagagtgggtagaaacactgacctaggtcagccagcggggtgagagctgcaatttgaacccaggcctgatctaaagcacctgcctacccagcaggacttggtgacagatgcaaataaaggagcaaggaggagaagtcagagaagggcagtcaggggactcctgggtcctaggaacagttgggaagggaggtggtggaaatcctggttctcctctgggttctgagtgggctctgcctcttccccccactcgccctatcccctcctgaggctccacccctctccactacaccctgggcctccctctctcccctcctcctcagctgcaccctactcccctgtctaggcacgcagatcctgtgcacagccaggcagcgctgggcaaaggctgcctggccagctccttcatctgtgtgtacctgtttacggcgagctgtaccccacggagatcaggtgggtgcatggggggagatgctgcaggttgaacctgttgggctcaccgaggcaggacccctggtccctcctgccctgtcctctgacactcgggcgtggccctcttgggcccctaggggtgcaggttgctgcactgacccatccccatcccacacctcccacaggcagatggggatgggctttgcctctgtccacgcccgcctcgggggctgacggcgcccctggttaccacacttggggaatacagcaccatcctgccacccgtgagtttggggccaccgcaatcctggctgggctggccgtctgcttcctgaccgagacccgcaaatgcccctggtggagaccatcgcagccatggagaggaggtgaggggcctccagcaccaaaggccgaaagttacaggaaataactggggggcaaatggggtgccctccccactcctgcgatcggaaatgtcctggccagatgcaccagagctgtgagatgcctcccccacctccatctcactggcttagctttccccaagaacagacccaatcacgaaggtagaaaagaataaaccggaacaaggaaacacgtgggttggaagtgagacgtggcagagaagtgaggagaggagagcgaggaaagtgaagcaaagacaggctcccatggttgctgtgcaggcttcaaatttggttcgggcttcttcacaacagaaagggagaccccattcatggctgctcttggaaaggaaaacaataccagtccctcaggagagtgaagctttccttagcatttagcactaggagaggtttctttcactgcttggccccccacccctcttttctttttttttttaagatcatcttggcttcagtgtgggtctcattagaaaggtcactaaggtgacagcaatgtcctggacaatgtttctaaacaaactcaagaggggacttgatctggctgcttcttgcagcatttctcagcaacagtggctcagggaagacccttagtttgcgggaatggtgacaggaacagtagccgcgcccgtcttaaccctctctgaaggtcagcttgatcccaaaggtggacccatctgtacccagtggccttataggtgctgtgtttgcaaccctgaaataactcccataaacattccatctctaacctggccatgggccaaggctgaactgcaagagatcaaggatatattctttggcaagtcctatctttcttttctttctttttttttttttttttttgagacattgtctcactctgtcaccccgctggagtgcggtggtgcgatcatgactcactgcaacctccgcctcccgggttcaagtgatctcctgcctcagcctcccgagtagcagggattacaggcgcccgccaccatgcccagctatttttgtatttttagtagagatggggtttcaccatcttggccaggctggtcttgaactctgaccttgtgatccacctgtctcggcctcccaaagtgctgggattacaggcgtgagcccggcgcccagcccaagtcctatcatttctgcctccagaatagacttaaatctgtcattcctctccagccctgtgtccatggccctatatcaagccaccattgtctcttgtctggacaatacgagagcctcatatcttcccctgtccctgtccactttattccctgcaggccaagtggggaggacagtcttcatctgggtgctgagcagggcttggagaggatgagggtatgggaggggagtgttaaagtgcatgtatgggccaggtgcagtggctcacacctgtaatcccagcacttgggagactgaggtgggtggatcacctaaggtcaggagtttgagaccagcctggccaaatggtgaaaccctgtctccattaaaaatacaaaattaggctcttgctacttccttcttccgctgccgggaacacaagcaaaacgttgagggctgcagcagccatctttgaccatgaagaaccttaagaaaggaagccattctccctctccctctccctctccctccctctccctcccctccctctccctctccctccccctccccctccccctctggtctccctctctttccacagctccctctcatgcggagccgaagctggactgtactgctgccatctcggctcactgcaactccctgcctgattctcctgcctcagcctgccgagtgcctgcgattgcaggcacgcgctgcacacctgactggttttggtggagacggggtttcgctgtgttggccgggccggtctccacccctaaccgcgagtgatccgccagcctcggcctcccgaggtgccgggattgcagacgggtctcgttcactcagtgctcaatggtgcccaggctggagtgcagtggcgtgatctcggccgctacaacctacacctcccagccgcctgccttggcctcccaaagtgccgagattgcagctctgcctggccaccaccccgtctgggaagtgagcagtgtctctgcctggccgcccatctctgggaagtgaggagcccctctgcctggctgcctagtctggaaagtgaggagcgtctcgcccggccgccatcccatctaggaagtgaggagcgcctcttcctggccgccatcacatcaggaagtgaggagcgtctctgcccagccgcccatcatctgagatgtggggagcgcctctccccgccgccccatctgggatgtgaggagcgcctctgcccggccgcgaccccgtctgggggtgaggagcgtctctgcccggccgccccgtctaagaagtgaggagaccctctgcctggaaccaccctgtctgagaagtgaggagcccctccgcccggcagctgccccgtctgagaaggaggagcctctccgcccggcagccaccccatctgggaagtgaggagcgtctccgcccggagccaccccgtccgggagggaggtggggggggtcagccccccgcccggccagccgcccctccaggagggaggtgggaggtcagccccccgcccggccagccgccccatccgggagggagtgggggggtcagccccccgcccggccagccgccccgtctgggaggtgaggggcgcctcgcccggccgcccctactgggaagtgaggagcccctctgtccggccagccgccccgtccagagggaggtcggggggggtcagccccccctgcccggccagccgccccgtccgggagggagtggaggggtcagccccctgcccagccagccgccccgtctgggaggtgaggggtgcctcgcccggccgccccgactgggaagtgaggagcccctctgcccggccaccaccccgtctggaggtgtgcccaacagctcattgagaacgggccaggatgacaatggcggctttgtggaatgaaaggcgggaaaggtggggaaaagattgagaaatcggatggttgccgtgtctgtgtagaagaagtagacatgggagacttttcattttgttctgcactaagaaaaattcttctgcctgggatcttgttgatctgtgaccttacccccaaccctgtgctctctgaaacatgtgctgttccactcagggttaaatggattaagggcggtgcaagatgtgctttgttaaacagatgctgaaggcagcatgctcgttaagagtcatcaccaatccctaatctcaagtaatcagggacaaaacactgcggaaggccgcaggttcctctgcctaggaaaaccagagacctttgttcactgtttatctgctgaccttccctccactattgtcccatgaccctgccaaatccccctctgtagaaacacccaagtattatcaataaaaaaataaattaaaaaagaaaaaaaaaaaaaaagaaggaagccatgtgctaagaatggtggagaagaaaggaggaagtgcgtgatgaatttgtaacatccctggactacctaattccagacttttttaagtagagaaaaataaacctctagttatatataaaaaaaaaaatacaaaattagccaggtgtggtggtgggtgcctgtaatcccgctacttaggaggctggggcaggagaatcgtttgaacccgggaggtggaggttgcagtggccgagatcgcaccactgcactccagcctgggcgacagagcaagactccatctcagtgggttggggtgggggagttgggaagattaagccaatcgactaaaatattataaatagaagattaaaaagcaaggatagaaacatagataaaacagtatgaatgctggaaaaaatccaaaatggaaacagcttaaagtagacaggagaaatgggcaagatatgaaacgattaaaacaagagataacagcccaggcgcggtggctcacacctgtaatcccagcactttgggaggcagaggaggtggatcatgaggtcaggagttcgagaccaacctagccaacatagtgaaaccctgtcctactaaaaatacaaaaattagccgggcatggtggcacgcctgtagtcccagctactcagaggctgaggcaggagaatcgcttgaacccaggaggcagaggttgcagtgagccaagatgcaccactgcactccagcttgggcgacagagcaagacttcgtctcaaaaaaaaaaaaaaaaagaggattaaaaaaactaagataattccgtgggaaaacagttatcagtgtccacaatcaaaaataaaaataaatggaaggaattagaacataaatcatttcaaagactagagggttttttttaaggcgataggccaggcatggtggctcatacctgtaatcccagcacattgagagttgaggcggaaggattgcttgagccccggagttcaagaccagcctgggcaacatagcagacccccatttctacccccccatcaaaaaaggcaaaattggatcttgtcaagtgatagaagccagtggggtagcctcgggctatttgggactgagggggcctcaaagtccaggcaagcccccaccaccctcaacctcccctgacttcttcaagagccaaccagggcagggcaggagtgctcagagccctaatctttgtccctccctgcctcctggggtgggagaagaagggtgctatagtgcccagtcgctgggggtgtctgctggcccctgttctccagccaagtgaccttgggatgtgtccaccctctaggtcctcatctgtaagactctttgttgaacttcttgaccctgcgctctcccaagtctgtttccagacaggccagcctctgccagctgcaagaccccagggatgagcaaggagggagctggaggaacaataggagggtggccaccagggtgcccaagagaatcagaggaggggccactgcagcatccacctcccttctggcttcaggagggtggagctgcacctgtgcatatggcaccaccctccccatgacatgcacaccacctgcccctcaccactgcttctgccttttcatttctacagggtcaaagaaggctcttccaagaaacatgtagaagagagagtgaagaaatttctcttcagcagctgagagcatctcccctcaaagagaccatctaactgcctggaacctggtgcttgctagcagcacctgagccgatgtccagacggccccctggggcttctcccaggagcccctggggacactggtgctgaactggaggaaaggtcgctgaaacatcatggctcctatagacagccacccacaagccagggctgcttggagggaaaccccacagaaacagccaatctgtgttacaaatgcatagaaagccaggagaagccagtcccagggacaaaggagagactgttttcctttcccatccccaatctgccccttaaaatgtctctgtatagtccattcttgcactcctataaagaactacctgagactgggtcatttacaaggaaaagggtttaattgactcacagttctgcagattgtacaggaagcatggctgggaggcctcaggaacttacaatcattgcagaaggcaaagaggaagcaagcacgtcttcacatggctggcagagagagagaaagtgaaggggaaggtgccgcacactttacaacagccagatctcgtgagactctttatcacgagacagcactaggggggtggtgccaaaccattagaaaccatccgcagatccaagcaccttgcactaggccccacctccaacaccggggattacaattaaacatgagtttgggtggggacacagagccaaatcatatcactgtttattcttgttccacttgagaatctgtgtctttgcagggttagggtgatatctctgccaaagggttgtccctggaatagcccactcatccttgagaaacgtggagaactcattctattccactcacccggaaagagtaaatctcttctgccttatgggattaaagctctttcccccgtgtgtgtgtgtcttacctccttgcaggaaaatgtctccatagcaggcattcttgcctacctttgtagctccagcagcccctctagtggccttgcagaagctgcatgtttaataaatagttgatgaagaaatgatcaaaacaactcccgcaatagatggagacctttgtgcgttgtttgcattcctagcaataccactttgagaactgggatatggttcttttccccagaagccttcttcaggtgtgtgccactatgatcgctattttttttatttcatagcaatagggtcttgctttgttgccctggctggctttgaatcttggcctaaagcaatcctctggcctcagcttccccaaatgctgggattacagagagggaaggcctagtttggcacagcatcccgctggcctcagatctatttccagcccaggtgttgccatgtatccctgaccttaaccttcactggaattcagattagatttataagggattcgatcttggcccattgggttgtcttggccaaattttcttgtctgatcccttcttcctggagtaccagataatccaacaagatcaattctcagtcccctacagcccaaagaaaggcacaattagggaagaaacaagactatcacagtctgggcaggaagcatggcagcttgccgttttgcaagattagtcttccaacagcttggagcagaggtggaatgtgactcccccaaggacttgtccaaggccctgttattgatgcactgaatcctcagctcctccccagggatttaacctcttttgaacatgtcagggaacacctgtgtgatccgctacatgagcttttccattcgagttgtctccacccacagccctcagcaaatcagtgatttcaataggcagagggctgctgtgcctgccatgctttgagattcaccttgggggttacctcttccaggcagctttcactgaccacactgcctacctctgcgtgctgctccactcccccgcaccacccccatccctcccaccccagctgctgccccatgccctctattgcaatctccttattgcactttcccattgtgttgtgatggtccatttacatgctgatctctccagtggctcctcaaaggcaaagttaaatcatcttttttgacctggcctgcacatggcaggtgctcagttcatgttgccagagtgaatgactttttttttttttttgaaatgaagtctcactctgtcgcccaggctggaggtcaatggcgtgatccagctcactgcaacctctgcctgctgggttgaagcgattctcctgtctcagcctcctgatagctaggattacagacgtccaccaccaagcccagctaatttttgtatttttagtagagcggggtttcaccatgttggtcagactggtctggagctcctgacctcaggtgatccacctcctcggcctcccaaagtgttgagattacaggcttgagccacagcacctggccgtgaatgctattattttatttatttatttttgagacagggtctcactacgtcacccagggtagagtgcagtggtatgatcttggctcactgcagcctcgacttacctggctcaagcaattatccccctcagtctcccaagtagctaggactacaggtgtctgccaccatgcctggctaatttttaagagcagggtcttgctcttttgtccaggctggtctcaaactcctggactcaagtaatcttttgccttggcctcccaaagtgctgggattacaggcatgagccaccacacccagccttatttttatttttgaagaaaatttagaataatggttctcaatcttggaatcacctgtgagtttttaaaaaaaaataccaggccgggcgtggtggctcacacctgtaatcccagcgctttggaggctaaggcaggcagataacgaggtcaaaaaattgagaccatcctggccaacatgggaaaacctgtctctaccaaaaatacaaaaattagctgggcatggtggcacacacctgtaacccagctactcgggaggctgaggcaggataatcacttgaacccaggaggcggaggttgagtgagctgagattgctctactgcactccagcagcctggcgacagagtgagaccccgtccaaaaaacaaaaaacaaaaaaaccagtgctagagcccactccaatccagcagataaggtaattataacaagactgtgacctcatagttaatgagttacttaccatggagttagtaagcaatttgatttccctgcacacagacaatacatacttttaagtgaacaaactagattttcttctttttctttttctttctttctttcttttttttttttttgagactgggtttcgctcttttgcccaggctggagtgcaatggcgtgatctcggctcatcgcaacctctgcctcccggatcaagcaattctcctgcctcagcctcctgagtagctgggattacaggcatgtgccaccagtccagctaattttttatttttagtagagatggggtttctctacgttggtcaggctggttcgaactccggacctcaagtgatccacccgccttggcctcccaaagtgccgggattacagcgtgagccaccacgcctggccacaaactagattttcttgaagaaatattctgaccatgagtttcctatgacaagtataaatgatcttgaggttacaggtttcaggccacggaatcaaccataaagcctttgactaccattgtccttagccaaaaacactggccaggaactattaaaaaaaatgagtgcccaatgatgacatatagactgggctgtttaaataggattccacatgctggcaccttttataataatctttatggtaactggcaaatcacctccagacttcttttctttccatctggaaacactgaatagtcagtacattttattttcaaaatctgtgataacaagttaggcacagtggctcacgcctgtaatcccagcactttgggaggccaaggtgggaggattcttgagaccaggagttagagaccagcctaggcaacatcagaagactccatctctgctaaaaaaatttagctgggcatggtagtgtgtgcctgtagtccctgctacttgggagccctagtgggaggatcacctgagcccagggaggttgaggctgcagtgagctacgatggttccagctgggtgacagagtgagactttgtctcaaaaaaaaaaaaaaaatatatatatatatataatatatatatatatatatatatatatatatatatatctgtatatatgaatgacaaccttttactgaaatctctatacatttccaagtattattaggccatgtggctatgtggctgcaagagacggctcaaggtcaaggtgcccggaggattcaggataccagtgattgcctgggcctgttcacaggcagatcagctaaatgaaagaccgaaggtgtcctgggccattgctgctgtgagccctcaaggaagttgctgacaactgtgtgtggaaaagagaactctgcttaatctgggtgtggtgttgccccagaaaacagcagccagaatgcaccttgttacatcgtcacccaccctgaccacactggtcagacctgtgcagccaggcagcaggtatgttcaaaagatggactttgcctttaaagtttagctctaaatgcaggtgtctccccggaggaatgccccccaccaactaaataattgtttgattacgaggttggggaggagcaaggaggccgagactggctggatgaaccaaaccacataactcacccttctccctcttctgctttctttccatgcctactctgggaaacaggctactggactttcaagtagcaaagaagagagtgagtgctgaggacggggagtctaacctcatgcttcttttgcagccactctggttgctggatttgggcaattatggagacaatgataatgatcatgaacatgaggtgacagctcccaatgtggacctggcatggcccacgtcaggcagcagatgttttagaatagtacaaggtgaagccgggcgtggtggctcacaccgtcatcccagcactttgggaagccgaggtgggcagatcacctgaggtcaggagctcaagccagcctggccaacatggtgaaaccccgtctctactaaaaatacaaaaattagctgggctggtggtaggcacctgtaatcccagctactcaggaggctgacgcctgagaaccacttatgctgggaggcagaggttgcagtgaactgagatcgtgccactgcactcgagcctgggcgaagagcgagactcagtctcagaaaaaagaaaagaaaagagcgagactcagtctcagaaaaagaaaagaaaggaaaagaaaagaaaaaagaaaagaaacgaaacaaggtgtataaggagaactgcctggcctcctaggcacaagtctgggcaaatggtatggggaagacctggcggagatagaaaaagggtgaagccatcgctgcaggaacttgtcatggggaccctggggctgtggaggagaacgggatccacagctggagggaaggaaactgggaggtcaggtggagacagggacactgagctctttcagctcctgtccataggatgttcagccagttcaacccagactgccacgccacctcaacttgagcactgaccaatgaagaatcttaatcagaagtttcccaacatgcggacgtggctcacgcctctaatcacagcactttgggagacggaggcaggcagattgcttagcccaggagttcaagactagcccgggcaacaaggtgaaaccccgtctctactaaaaatcaaaaactagccatgtatggtgacacatacctgtagtcccagctacttgagaggctgagtgggaggatcacctgagcccaggaaggccaaggctgcagtgagctgtgatccagcctggtgacagagcgagactacatctcaaaaaaataaatgagctgggctcagtggctcac

SEQ ID NO: 5040 - DNA, 42060 bp, Homo sapiens
tgttgccatgggctgcaatcagtacacgtttcccctccttgatctggggaactatttctcattccagaaggtcagagctctggcaatagtgtccttcagactctcacaggagggtagcgatcttctgtgaggtctgcatacctgcgatccttactgatgttgctatagaaaggatggtgggctccattggaggtggtgggacatcataggagtgcctccagatcttcacctgggcccaccatgctttgcagcaacctccgcctccctggttcaagcgattctcctgcctcagcctctgagtagctgggattacagatgtgcgtcaccacgcccggctaattttttttttgtattttagtagcaacggggtttcatcatgttggtcaggctgatcttgacctcctgacctcgtgtctgcctgcctcggcctcccaaagtgctgggattacaggcgtgagccaccgcacccagcgtgaggtgccagatttttatctttgccaaactgctaagtgggaaacagtctcttggtgaattttaattcacatttgcttttcagtgagctcaacatcttgtcatatgtttaagacctattgtcttcttttatttgtgaactttttttttttgagacagggtcttgctttgtcatccagctggaatacagtggtgcgatcacagctcactgcagcctcgacctctgggatagctgggctacaggccaccatgcccagctaactttttgtatttttggtacagacagggtctcaccgattgtccaggctgatctcgaactcctgggcttaagcgatccacccactttggcctcccaagtgctgggatttacttttattttattcttagagacagcatcttgctctattgcccaggtggagggaagtggcacaatcatagctcactgcagcctccaactgctgggctcaagccacctcccatctcagcctctggagtagctgggatgacaggcatgcaccaccacacctggctattttctaatttttttatagatggggtctcattatgttgcccaggctagtctcaaactccagcctcaatcaatcctcctgtctaggcctcccaaagtgttaggattataggaatgagcgccacacccagaacatgattttttatatatgtatatggagaaaaatactcctttaagatgtaattgtaaatgttttcttcagtccatcattttgacataactgtatggatttttaatgtgtaaaaaatgcaattttatgacttttgggttttgtgtcatagttaaaaagactgtttcccactgagatgatacaaaaagtttctcctttagctcctggctgtatttttttttttttttttttgagatggagttttgctcttgttgcccaggctggagtgcaatggtgcgatctccaccaccgcaacctccgcctccatctcccgggttcaagcaattcttgtgcctcagtctcccagtagctgggattgctggtgtgtgccaccatgcccagctgatttttgtatatttagtagaatagggtttcacgatgttggccaggctggtcttgaacacctgacctcaagtgatccaccacctcagcctcccaaagtgctaggattacaggcatgagccaccgtgcccagccagcttcggctgtattttcgttttcatttttgtacgtttaaatattgaaggttaacatttaattttatttttatttatttattttttttgagacgttgtctcactctgtcgccgaggctggagtgagtggcgcaatcttggctcactgcaagctctgcctcctgggttcacgccattctcctgctcagcctcccaagtggctgggactacaggcgcccgccaccacgcccggctaattcgtttgtatttttagtagagatggggtttcaccgtgttagccaggatggtcttgatctcctgactcgtgatccacctgcctcagcctcccaaagtgctgggattacaggcatgaaccaccgcgctggcctattttttattgattttttagagatggagtcttgctttgttgcccaggctagatgcagcggtgctcactgaggccttgaacccctaggctcaagagagcctcccacctcaggtccgaaaatgctgggattacaggtggtgtgagataccacaccagacctagagtttttatttttaatttttaaaaaaatttttatttatttttttgagacggagtctcactcttttgctaggctggagtgaagtggtgcaatctcggctcactgcaacctccgccccctgggttcaaaaattctcctgcctcagcctcccgagtagctgggattacaaacgcctgccacccaccatgccagctttttttttttttttttttgtatttttagtagagacgaggtttcaccatattggcgggctggtcgtgaactcctgacctcaggtgatccatctaccttggcctcccaaagtgcaggattacaggtgttagccaccacacccagcctttttaaatgtttttttcattaggaacacatattccaaacctataaattgagttcatctgtaattttttctaagatacaaattatgatccaacttactttttttccagattgctcccttttcttcctaatgtcttttattaactctcttttctcaacagattagaaatggtacttttatcatctactacattcctgcctgtattgaatctgtttctaaatttctctgtcttctattgatctctatgtgtcagtaaccctctttattattaccttttaatgatagatttgttgtgttttaatatctggtaggattagtctatatcattatgtcttttattttcagaagtttcctacttgtttaatttgccatatgacctttaatcagcttttctagtccctccttatctcccaccagaagactcttaaaatttttcattgtatacacttagagattaatttaaggagaattgacatctatatgaagcatcttcatatgaaaccaaggtgtcagcccccttgcctctgctttttggtggctagtgactcccaaatttgtactctattttgagcacaaggtctgttcctcacccctaggaatctcctcttggatagggggtcccaaagataccccataccctgatcccatactgtccctccagcttagtgcattccccctctctttaatctactcaggtgctcaagccagatccagggtctgaagttgtctttggtcttcctggtgtccaagagccatatctaaccagtgactaagttctattttttttttttttttgagacggagttttgctcttgtcgcccaggctggagtgcaatggtgtgatcttggctcacgcaacctccatctcctgggttcaagtgattctcctacctcagcctccctagtagtggggctacaggagcccaccaccacgtccagctaatttttgtattttttagtagagacagggttcgccatattggccaggctcgtctctcgaactcctgaccttatgtgatccgcccacctcacctcctaaagtgctgggattacaggggtgagccactgcgctcagcctgtggtatatttgaatcactgatgaaccaatattgacacaatattattaattcaagtccatagtttacattaggttcactcttagtgttgtacattctgcaggtttggataaatgcatgtcatgcatccgtattacagtatcatacagaatagtttcgctgtgctaaaaatgccctgtgctccatccctccctacccctctgaatccctggcaactgctgatctttttaccattgctagttttgcctttctagaacgtcatatagagttattggaatcatacagtatgcagctttttaataccagcctttttacttagcaatatgcgtttaaggttatgctatgtctttttgtagcttgatggctgattctttgtatcgctaaattttaaagaaattgccaaactgtcttccaaagtggtggtgatattttaccctctcttggtgtatgacagctccagttcttctatatccttgacaacataacacacttggtatggttgatcttaacttttagccattctagtaggtgttcttttagaagcatccttctagtggctttaatttgcatttccctaagagtaatgcactcagtgttttttaattgcctatttgccatccagagatctttttggatgaagtgtctgttcaaatgttttgtccatttttgacaggcgcggtggctcaccctgtaatcccagcaccttgggaggcagaggcgtgagatcacttgaggtcaggagtttgagaccagcttggctaacatggtgaaaccctgtctcactaaaaatacaaaaattagcctggtgtggtggcgggcgcctgtaatcccagctactgggaggctgaggcaggagaattgcttgaacccaggaggtggaggttgcagtgagccaggatgcgccactgcattccaacctgggtgatggagcgggactccatctcaaaaacaaaaacaacaccagaaaacaaacaaatgttttgtccatttttattggatttttattcaattgtaaaattctttatacaagtcctacatcagatagaatttttacaaatattcgtcctagtctatggttatcttttcatttttaatagtttcgtgcattttgagaaacaaaagcgttttattttgagaagttcaatttattgatttcttctatcatttacactttttgtgtcatatttaagaaattggccaggtgccaaagctcacacctgtaatcccagcactttgggaggctcaggcaggagactgcttgagcccaggagttcatgaccagcctgagtaacacagcaggaccccatttctaaaaaaatttaaaaattagctgtgtgtcgtggcacgtgcctgtagtctcagctactcaggggctgaggtgagaggatctcttgagcccaggagtttaaagttacagtgagctgtgatcaggcactgcactcctgcctggtcaatgaaagcaagaccctgcctttagaaaagaaaaaagaatcttttcaaacccaatattgttaagattgtctccatttttaaaaaaaaaagttttatgtttggccatttatatttaggtgtgtaatccagtttgagttaaattttgatggtgtatctaaatagttatcaaatccatctacttctgcctgccacctctctagtttaaaccaccctttctgtccctggacacctgcgcagaaagcctaggagctggttccacccatcactcaccagttaggtatttcaggcaagtcacaccctctcaggcctcagttttcctcttttgttaactggggtgaaagtggggttagattagatcagcggctcttaacttttgaggggtcgtgggcccagagtcctgggaacgctatgcagtttcctcagcaaaatgcttgcatccacaacatgcaaactgcagcagctgctgggctggggctgcgagaccagcgaaaagccctgacttgggggggctcgggagtctctgcagtctccccacccacacccccggcctccgcgccgaatcctggcccccaacttcttgcagcccgtgaagcaggatctcagggtcctgggggtggggagagggggtgccgtcctgctcgcagcctctgccgccctctcctgggtaaggtgacacatgggcgcttcaggtgggtgggctgagagcctgggggagagaacagggatgtccacctctctaagtttcaggttcaagaaaccccagaacgttagagaaagatgggctcccacaattgcccaaccccacccataggatgcacgcatgcggaaagtcgggccgaacggggcagggacttacccaaggtacgcagcgagcccggtccccctgcgttccccggggagcgctgagccgggacgcggcggtgggtggggaaggggagtggcgcggccctgcggggtgaggctgccgtttgctgagtgtccgcaggggtctgctcgctgccagcccggcccctcctcagagcagctgccgcagcccgaggaatctcggccccgcgccggggctggctgggaacggcgggagcagctgcggtcgcgcggacgaggggagctggggaccgggcgggcccggggctgcgggaggcggcgccgccgcacaatgccccggaatgcccgccagggcgcgcgtggggtgcggccgtccggccctgcaactcgagtgctgcccctggttaaaaataccccttgcccgcccctccccctcgtttccccgcgtgccttccgccgcgccccagcccccgcatgtccccccgcgctggcccctccccggggactgcttgccttttactaatttgtcctctcgcggaattggcccccggctgcggagggaggggcgggagacaccgtgagtaagagatagtcagagaccgtgccggagagataagggagagccgagggaagcggggtaggagccccaggaggaggaggaggagaaggagagagggagggcggaggcggaggggcggcgggaggagggcggggaggagcgctcttcctggttgggccctgccctggctgccaccgggaagccagcctcagggactgcagcgacccccaaacacccctcccccagtaagaagctgggtagccgagccgggattccttgaccctggccactgctcctgggctgagggctgccccagcacggtcccttctcgggggcctctgcgttcctggagcaggggtgggggtggcggagcggcacagcccaggcgcctgtcccagcctggctcaccgctgtccccaggggtgggctagggcccaccagctctgatatcgagcctgctgcgggggcctgaggagggggacccgaccgtctggggttttcagcccacggcaaggggccggtgcaccaggagcttggttagttggggagggggttgcaggcctgtgaacaggatcaaagaggccttccctgctgtgtccccctgcccagttccttgtgctgtctggaggctccgccctgccccacctgacctgctggctactacagagctgcaagcccctgacaatgggatccgggaaaggagaggtggccggcacgctgggaactgggaaatccctttcctggattcactgggagcaccgggaggtggctgagaacctacttctgtgaggggagcagtgaggcagggaaaccctaggtttggggatggataagcagggcaggagagcagagcttgcaggcaggagcccaggttctagtcttgggaaggcctgggtctgagcaggcccatctgtccggcaggatgtcggaggagatcatcacgccggtgtactgactggggtgtcagcccaagtgcagaagcagcgggccagggagctgggcctgggccgccagagaatgccatcaagtacctgggccaggattatgagcagctgcgggtgcgatgcctgcaagtgggaccctcttccgtgatgaggccttccccccggtaccccagagcctgggttacaagacctgggtcccaattcctccaagacctatggcatcaagtggaagcgtcccacggtgagggggccatcctgggtgggactcggctaagccagatcctggatgaggagtagggatgggatccatgtccctggtggggaatggggtctggggtggcctggtgccaatttctgggaggggtggccgaggaacaggactctgggtctctcgtaggaactgctgtcaaacccccagttcatgtggatggagctacccgcacagacatctgccagggagcactgggtaggcccccagggcgcgggtcccgggtattttttccacagtagttccccattcccgctccttcaggctctgcccaacccctccctcttgcaagcccaggcaggatctggctatcagcgctggggctggtttgccagattcctgggtcttttctgcaagctgaggggagttaagtggcaccctggccaaggaacccagattctccctagcacccgcttccccccccggggcaggttggtagagcaggctaattgcatccctcctgccccaggggactgctggctcttggcggccatcgcctccctcactctaacgacaccctcctgcaccgagtggttccgcacggccagagcttccagaatggctatgcggcatcttccatttccaggtgagggctcccctggggaggaggggcagcaggcactggggagatgcggaaggatgacccacaatacctgcagttagggccacaccctgtggggccagcctccctctagcaggtatttgacctctcagtgccatctcgggtctgtcatgtgtgaagtgatgggctgggcaggtatttcggctggcagttttcctaggtggttgtatgtatcaggtggaagtgcttgaaagaacagaaagacttttgtgttatatcctgtgggacaaattccactcctccggaggtcggtctcagttgccccatctgagaaaggagtgttcgctggggaaaacagatagcacgtgtggccttctccacgtgtcaagcctcctatcccccaactcctcctgcgctttgcaaggtctgactgagcccagcagaaaagaaagactcgggattaagtctacgtaaaccacttttcctgacggtgtgcccagggcccatttttcaagtcacaccaatcaattctcaatggctgcctttgggagggacatgcccagcaaccctggatgagactctccagccttggaggcccagccctgcccgaaggactcttgggtgttccctccttctgcctggttagagagcccctaccctactctgtccttgcccgccttgcgcgggtggaggtggccctcggaacccagggtgggaacccacagtgcggatccactttggcccagcgccacacccacctgctccagtctgcagggcgcagtctcgcccccttccctcgctcctccaatccgctcctccctggcctccgattgccagttcagtacccgccacccacactctccgcaacctgggctcctagggccgcctccacccgccccgccccccgttgtcctggccccgacccctcagatggtacctcgagtccttggcgcttctgaccccagacgccttcggccccgaccctgccctgggaaacgtggcctttgtgcatctcagaaacaaagcccgtgattgtgagaaccagtcctgcccatcttgtggttgtagatctggatgccacattttcactgctcatccaatgacacaggtgcccctaacccccttgatagggagggaagagccagggggccatggcctaaaagggggctagttccggaaagcccagccccagagcttttccacctctccgtgcctgaggaggaaccctgtttgttcagtgactcctaaaggctttgcctgtgctcttgtttaagtcttccgtgaagaaggcaccgctgctccttttatggatagggaaactgaggctcagaggcgataacttttccaggatcatgtagctagttgtctcgagcatacatgtacatatcaagtatacacatgtctatatgtggtatgcatgtatagtatacagcaaatatgcaggtatctagtatacattgtacaggcaaaggaaagcatcccttagccctctgaaggttcactgaaaaatcaactcacaaaaggaggttagtaggagaaaggcatacaaattgattagcctgcagcgtggggtcgggaaccacagagtgttcaccccagcccacaatgggtacagaagcctatataccatcctgaggttacaggaagaatgggggctcaacatggccaaaaccagtttctggtggtaaatcaggttatagtggcaagacagactatgaagggggagaaaagggggcctgggtagcaaaggcagtcttgttatgtagatgaaacctccaggtagcagccctcagagggaatagatggtaattgtttcgttcagacctttaaagggttcaggctctcagtctgacaagggaaggccttagagaaagcctggctacatcaatgcagatttctctacagatgcaaatctcccccacaaaagacagtattacagggctacttctgtttcagaccctctgaacagctatctcaaaatatgttgaagaagtatatttcagggtgaaatatttgatttccttcaatacctagatacatgtatctagtatatctgtagcatacatgtatcagaggtacacatgcatctagtatgtatctagtatatgtgatttagtatacatgcatctatatgtatctggtatacctgacctagtatacatctagtatgtatctaatttacatgatttgtctatgtgtatctagtatgtatctgggatgtagaatcctgcatctaggaaggtaggggaaggatggagctcaggtccgggggattccaaagcaggtactcaccgtgcccctcccccaagctgtggcaatttggggagtgggtggacgtggtcgtggatgacctgctgcccatcaagacgggaagctagtgttcgtgcactctgccgaaggcaacgagttctggagcgccctgcttagaaggcctatgccaagtgagtagcggctgagggggcaactccagcttccagctcccccaggggtgggggctcatgactgtcttctcagagggtcctgcttgatgccagagtgctgactggagctgcccacagggtaaatggcagctacgaggccctgtcagggggcagcacctcaggggctttgaggacttcacaggcggggttaccgagtggtacgagttgcgcaaggctcccatgacctctaccagatcatcctcaaggcgctggagcggggctccctgctgggctgctccaagacgtgagtgtgcccggccccgatgctttggtaccctggaaccctggtatcctgaccttcacattttctaaaatccccacccaggctccgctccagaccctgtcctgcacttaagctcatctctggatgcataccctgcctcatccatcacttccaccccccatgcctggtgtcgccctgtcctcacctacccactcctcccccaaaacttcacacctcagctctttcctgtgctgttttcccgtctaccatgctgtttccctcattcctgtcatctcaatccatgccatcctcgtccagttcaccagcctcagatttcatctcctggtctcagttcccacccatccctagcccaatcccacactcactccattcccacccttccctgctcctctgttcccacactcaactcgctccccagtcctcaacgccagacttgaccccagtatcactgccatccgcagctctaacccagctcccattcccatttctaactgactcttctgtcctcacgtccttctccgtgaggccactgagggctgtgtggctctggtgggctgtgcacggctgtgtgtgtgcacatgcatgtcgcacaggttctggtcagccctggccagtagcagtgtcagcggagtgcctgggctccccgtcccagtggcagcattggtggggtacccaggctacccctctccaaaagagcagcatcttatgtgggggtgtctataggtgggatcggggtccctgcttgcttctcctagcaactgtttatgtgcaagtgggaacgtccaagaccctgagtgctgggggctcatctgatagggcgggggacctagccactgaccacagtgtgtgcctctttctgcagatctccagcgttctagacaggaggccatcactttcaagaagttggtgaagggccatgcctactctgtgaccggggccagcaggtactgccctgggtggggccttccctgaagggcggttcctgccccctggcctgtcttgcctctctggcacctgaccagggctgtggaaggtgctggctcctcctttcccctcctcagcaccttatctctcttctggggacacccatctgagatgcctatcatgtcctgccctgctgactgtagttcatgtgtgcagctgcctgcctgggctgtgaattccaagaggacaggctcatctgggtgctgagcagggcttggagaggatgagggtatgggaggcggagtgttaaatgcgtgcatgggccaggtgcactggctcacacctgtaatcccaacactttgggaggctgggtgggcagatcacctgaggtcaggagttcgagaccagcctggccaacatggtgaaacttgtctctactaaaaatacaaaaactacctgggtgtggtggcaggtgcctgtaattccagtatttgggaggctgaggcaagagaattgaattgcttgaacccaggaggcggaggttgcatgagctgagatcgcaccactgcactccagcctgggtgacagagcaagactctgtctcaaaaagaaaaaaaaaaaaagtgcctgctggaagctagcactgacaggagctctggcaaatagtgaactaccgaggccaggtggtgagcctgatccggatgcggaacccctggggcgaggtgagtggacgggagcctggagcgacaggtgaggggcagtgggcactgtctggagtgccttgggaaactgttaggtgccccgacatttctgctcgggactctaccaggccaggctggactaggattgagcagaggggcccatcttcgcgcgactgggtctgggggactgctctgacaaactcaggccgtgcgggcccctgtgcccagccgtcgggtgtgtgcagggcatcagactggcctgatgagaccaccccctagaagcggaaccttggcgcttgaccttgaggaggccacctggctgggccgggggaagacaggccagggtagacaggccccagggacagaggccaggcaggcagtgcccaccagccctggcagagccctgctcctcacagctcctcagagtggaacaacgggacccatatgaacgggaccagctccgggtcaagatggaggacggggagttctggtgaggccccctccccttctaccccacctctccacccctacacatcagctctgtgccctgacggctgtgcctcacctgtgtacctcccacctcaggatgtcattccgagacttcatgcgggagtcacccgcctggagatctgcaacctcacacccgacgccctcaagagccggaccatccgcaatggaacaccacactctacgaaggcacctggcggcgggggagcaccgcggggggctgcgaaactacccaggtgcacaggggcgggctctgggtcttgctgcttcctggcttaggggcccagaaggcacgtcatcttactgagcctccgtttcctcacttgcaagatataggctgattcttgaatttgctttgaggagtaaaatattaaatgtcctagtaaattttaaagaggcatcttgactcaccgtcttggggcctgagcccagggtgctcatgaggggcaaagatcttgtgccatccagccacctgcctgtcactcctttcctgggcccttccctcctgccttcgctttttttttctgagacagagtctcactctgttgcccaggctggagtgcagtagcgtggccttgctgactacaacctccatctcccggattcaagcaattctcctgccttagcctcccgagtactgggattacaggcacctaccatacccagctaatttttgtatttttagtagaggcagggttctccatgttggccaggctggtctcgatctcctgacctcaggtgatccgaccaccttgcctcccaaagtgctgggattacaggcgtgcgccactgtgccaggtcccttcttgccttccttgccacctttccctgggcttctagatccatgtggctgatgtgggccacagcctggccctcagttccttgtcactctcactgcagcacgctttttctctaccttagctcagcccccacatgagggcaccagagctgccttgtcttgcaaacacccgctctctgacctccaccttcgctctttccactcccttagtcttcaacccttcgaccaagccagtccgttgaacccatcactgcgtaccatcctgcctctcccatcttgccttctctccttacctaggttagagctatcatttaatcttgttcctacaaacactttcagttccctggcccctgtctcccatcatctggccaaaacccatctccactggcttgggaaccattgagtgtggcaggagagaaatcacataacgatgccatattttccctgtaaattcttagccacaaatctcaaatgagcattttccatatccccagcaattccactactggttagtaacatttccactctcacctcgatatctccccatgttactctcaccttcgggcctggccttgcacttcactgaaaagatagacttcatcctgaggacaccttgtgttcccacctccaaatcccccagccttctgcacctgtgcctgtgtcccatcgcctccccacctgcgacagtggcagaacagtccctgttcatggggacccccacgttgctccagatcccattctccctcacctctgaaagcatttgctccttcatctgtcacctcctctccagtgtcattacggagagtcctctgtcttaacacaaagcaaccctctcgacccccttccctgttcatttctccgccctccttcaaagcacaatttatcaggaattaccatactcctatttcctttctcacttctgcttcattgcttaacccttcccagtccagcttcatcccaccatgctgctaaaaccaccctctcaaaggtcacttaagctttggccttgccagatccgcgctgctctgtcctcctgtgctgcatcctcagcacggctccctgccctctgttttgaagattcttctcccttgtagggatccaatttcagtctttccccaaatagataaccaccgttcctgtaccatttattgagaaatacatcatctcgtctctccccagcagcactagcgccctcagtagtcctgaggtatgtgttggtctgtttctggactcaccattctgtccctgggtctaccctctgccgataacacattgaatccattactacagatgtgtaagtcctgctgttggacgggcaaattccttcttcaagagtctcttagctgttttttttgttgttggttttttttgttttgtttttgttttttgagacggagtcttgctctgttgcccaggctggagtgcagtggccgatctcggctcactgcaacctctgcctcctgggttcagatgatgcttctgcctcaacccctgagtagctgtgattacaggtgcccgccaccacatccagctaatgtttgtatttttatagagacggggtttcaccatgttggccaggctggtttcaaactcaagtgatccacctggttagcctcccaaattgctgggattacaggcgtgagccactgcatctgtcttagctgttctgacctctgtttttccaaatgaattttagaatcagtttaccaagtcttttgaaaaaccatttgagattttaatttggaattacatgaaacctatagaccaatttggggagacttgacattttataattttaagtcttatccaaggatatggtgtatctcttcatttattttggccttaatgtctttcaatagaatgttgtattttttatcataaagaatttatacatctcttgagattaatgctaggtacactataattttgtttctattataaatagtatgttctttaaaattaatctcccaagtgatcttgttgctcatacgataacatgcatttgaccttttagatgtagttttatatccagcaaattttttaaaactaattaatcttactgattcatctgtatgtatttttggcacgatcttagctcactacaacttctgcttccctggttcaagtgattctcgtgcccagcttcccgagtagctgggattacaggcgtgcggcaccacacctggctaatttttgtattttattagagacagggtttcaccatgttggccagggtggtctcgaactcctgacctcagtgatctgcctgccttggcctcccaaagtgctgggattacagtgagccactgcgtccagcctttttggttttctaattaggaatatagcatctgcaaataatgacagattgtttcttctttctaattcttacaacttttgttactttttcttgtctaatatgctgcctagaactgtaagcttcctgctcttgttcctcccttttttttattcttatttttaggagcaaccctattactaagcctcactcttaaaggggaagttttcaccactaagtacctttctaatctaggtttttgtggataccttttatcagactaatgaagtttaatattgttaaatactttgaattgtcatattatgatgatagtatgcttttttcttttatttattaaaatggtcccaggaatttgtaacagcttgggcaatacagtgagacctcatctctacaaaaaatttaaaaaattagcctgtatggtggcacacacctgtagtcccagccactcaggaggctgaggagggaggatcatttagccagggaggtagaggctacagtgagccatgtttgcgccactgcactccaccctgggcacagaacatgaccccatttaaaaaaaataaaatggtaaattgcatttgttgcttttctacgttaaatcaactttacattcttgagataaaaacaacatggtcacgagtgacgtttgccgttattttcctttcttatactaaccatactggtatcagtgctatgttcttcctgtacaggaggtgggaagtatcctctctttttctgtttcctagaagagtttacctaagatgggagtatttgttgcttgaatggttggtagaacttgtctgtaaagctgtcaggcttgcttttttcttgtatgaagattaatgatattcagtattgaaagttaaaggttatagaattgttcagatttctgtttcttgagccaattttgatgagttgtattttcttttgttttttctttttcttttctttctttttttttttaagagagacagggttttttagagagaggttactcactgcaactcgaactcctgagctcaaatcctgcctcagcctcctgagtagctgggactacacaggtggagcctctatgattggctaattttttatttttatagagatgggggtctcactatgttgccaggcttatctcgaattcctgggctcaagtgatcctcccaccttggcctcccaaagtgcgagattacaggcatgagccactgtgcccagccctgagttgtattttctaataatttatttttgcatctgttttcaaagttattagcacaaagttatccttaatatactctttttttttttttgagacagagtcttgctctgtcgcccaggctggagtgcagtggtgccatctcagctactgcaagctctgcctcccgggttcacgccattctcctgcctcagcctcccgagtagctggactacaggtgcccaccaccacgcctggctaatttttttttttttttttgtatttttatagagatggggtttcaccatggtctcgatcatctgaccttgtgatcctcctgcctcggctcccaaagtgctgggattacaggcgtgagccactgcacccagccccctcttaatatactttatgtctcgtgtataataatgtcccctttttatgcatgggattgctcatttgcattgttcttttgtctttattaatcctgcaagaagtttgtcaatataaatctttacaaataaatgcttttggccagctgcactcaggagatcgagaccatcctggccaacacagtgaaaccccgctctactaaaaatacaaaaaattagccgggcgtagtggcaggtgcctgtggtcccagctcttgggaggctgaggcaggagaatggtgtgaacctgggagacagagcttgcagtgagccaggtcgcgccactgcactccagcccgggcaatagagcgagactctgtctcaaaaaaaaaaaaaaaaaaaagacttttgactttgttggtcctttgtatagtatttctttttcttttatatttttacttatttatttagagatggggtcttgctctattgcccaggctggagtgcagtgcacaatcctagtcctctgtgatcctaggtcactgcagcctaaattcctggctcaggtgtcctctcacttcagcctcccaagtggctgggattatacgtgtgtgccacagtgcctggtgtatttttttcatatatcattaatctttactgtttattatctcattccttctactttcttggattgattttttttttttttttttttttttgagatagtctcactctgtcacctcggcggagtggtgcgatcttggctcactgcaacctccacctcctgggtttaagcgattctcttcctcagcctcccaagtaactggaattacaggcatgcgccaccatgcccaactaattttttttttgtatttttagtagataccaggtttgaccatgttggccaggctggtcttgaattctgacctcaactgatccgccctgctgtgggctcccaaagtgctaggattataggcgtgagcaccacgctcggcctggattgactttttgactttattttatgacttcttaaattagatgttatttcgttaatttagatttttaaaatttaagcaactaaagtgataaatttccttttagtacatcgttaattaagttacacaattttgatacatagtgtttttgaaaatcgtgaatggtataattcacacaccagaaaatttgcacttttaatgtgtgaaatttagtggtttttaggtacccacagcgttgtgtaagcattgccgttatccagagcatttcttcaccgcccccacccgaaaatcccgtaattattggccatcactttctatccctttctccctagcaaccatgatctactttttgtctctataaatttacctattctggacttttttgccttagcataatgtttcaagcttcatttatggtgtagaagtacttcatctcttttttatggcagattaatcttcatgatatggatataccacattttgctgattcattcatcagttgatggacatttgtgttattccagtttttggctatgtggagaatgttcctgtgaacattcatgtgcatgcgtttcaaatatgttttcagttctctggggcctataactaggagtgaaattgttgggccatagggtattccatgtttaattttttgaggaactgccaattgttttccaaagcagcagcaccatttttatccccaccaacaacatgtgagggttctgatttctccacatcctcttcaacactagttttgctcttctttttgattatagccatcctagtgggtgtgaagtggtatcactgaagtttttgggggttttttttttttttttttttttttttgagtctggatcttgctctatcacctagctgaagtgcagtggcgccatctcagctcactgcaacctctgcctcccaggttcaagtgttctcctgcctcagcctcccttagtccctagctgggactacaggtgcacactgccacaccagctaatttttgtagttttagtagagacagggtttcacccttcagaccagccgtgttgtcaggctggtctcaaactcctgacctcgtgatctgcccacgtcagcctcccaaagtgctagattacaggtgttagccaccgcgcccggccaattttctgaatttttaaaatcatgaacgatgtgctttttgtgcatcaattgagatgatcattttgaggtttttttccccttcattcattaatgtggtatattacattgatcaactttcctttgttgaactacccttgcattcctggataaatcccacttcatcatggtgtatattccttttaatatgctgttgggttgggttcacgctttttttgggagggggtggatttttgcatctatattcataagtgatattggtctgtatcttctttccttgtggtgtctttatctggctttaaggtaatgctggcctcctgggatggttaggaagtgtcccctcatcttcagttatttagaagagtttgaggattggtgttaattgtctttaaatgtttggtggaatttcgaagccatctggtcctggacatttctttggtgagagttttttgttgttgttgattcagtctttttattattataggtctatttagattttctattttcctaggtcagttttggtgctttgtttctttctaggaatttgttctttttgtctatttatctaatttattatcatataattgtctatagtgtttccttgtaatctttttatttttttaggctggtagtgatgtccctctttaattcctgattttagtaatttgagtcctctgtctttctcctgtttaggccaggtaaagaattgtcaattttgttgagcttttcaaagaactatggttttattgatttttctttattgtttattctctatttcatgtatttggactttaatctcattatttcttttcttctgcttgctttgggttcaatttgcccattttcttttttcttaatcccaagaaccagtgaaagttcattttctagtttctttttttaatttaataaatccatttttatttcatatatcatagtgggacatatttttggggtacatgtgatattttgataactatacaatgtgtaatgatcaaatcagggtaattgggatccatcgcctcaaacatttatctttctttgtgttggagacattacaattcttctagctattttgaaatatacagtaaactatgttaactataatttcccctgccttactgtcaaatactagaacttattccttctatttactgccttttctagtttcttaaggtggaaggttaggttattgatttgatagctctctctttaatatatgtacatttttcatggccatgctatgtaatttctcattaccattatcatctcttccgataaactagttattttagaagaatgttttttaaaacataaaaaaatttctaactaattttctcatagtaaaaaaatgtgacctacataagatcatagctttgaagtgaacagagctggtgctatggctcagtgtatgatgaattttcataaaggttccttcgttcttgaaaaactggctaacaaattgtgactgtaggtgaagcactcctaagtattttaaatatgataatagcttaactcacactgagcctatgaggcaggaactattattatccttatcttagggatataaagaaactgaggcacagaaagatttaagcaacttgatgaagtcactgatctatgaagggcaaaactgggatttgaacccaggcagagggatcctgaagtctgttctctcagccagtcgctattctctgagtactagggggattgttctataattgtccattatatcaaacttattttttgtctgcttaatctatcaattactgaaagaaagaaagaaagatgataaaaatcttaaacatcctaatggctttgccaatttctctctgtatttctatcaattatttttcattataattttgagctatgatatttggtacatcacatttagaattcttataagcgcctagtgaataaacattttttaaaatctagtgaccaccttcatctctaataattatttttactttcaagctatttcagccaatgtttctatagctaattcagggtttttttttgttgaatttttaaaaatatctttttatactgtttgatgtccaatctttctatagcccaatgttttgttttcttgaaacagcactagccagctttttagtaatccagtttgaaaaattttgtccacgctgggcaagtggctcacgcctgtaatcccagaactttgggaggcccaggtggacggatcacctgagtcaggagttcgagaccagcctggccaacatggtggaaccccatctctaccaaaaatacaaaattagccgggcaaggtgggtaggtgcctgtaatgccagctactagggagactgaggcggagaatcacttgaacctgggaggtggaggttgcagtgagccaagattgtgccattgcatccagcctgggtgaaaagagcaaaactctatctgaaaaaaaaaaaaaaaaaaaaagacaaggaatattttgtcctttgactagagagtttagttcatttacactcacagtgattaatgtgtatttatttcagctgacttactgtgtttacttattttctgcttgtcttcctgtcatgtgccttttgtgttgagttcctgcttttctctctactaatttttttctctgtgagtttgaagacataagagtttgcttaatacatactaaagttagttaatcagtgtctttttttttttctctgagacagggtctggctctgtcacccaggctggagtgtggtggcgtgatctcagctactgcaacctctgcctcctgggctcaagccatcctcccacctgagcttcccgagtagctagtggtactacaggtgcacaccaccatgcctggctaatttttgcacttttttggtagagtggggttttgctctgttacccaggctggtctcaaactcctagctcaagccatccacctgctcggcctcccaaagtgctaggattacaggcgtgagccactgtgcccagccctaatcaagactttaccctcctcgtgaacaatgcataaaccttagaaattcagcttgaatcaccccttcctttgtatattatgctatggtgggctagtattttaattctaaagtttttttttcctgcataatttaaacatcatcatgatttgagatagcccatgttatttggattacccacaaataaagtatttttgttcagcattctcagacctttcatctgagatcattttccatccacccgaacatatccttttgtatttcctttgttttgttttctttttgagcaggcttgatctcctgtctcaggtgagcctcccacctcagtgtctcaagtagctaggactacaggcacatgccacatgcccagataattttttttgggagggttggggggcagttgacggagtcgcgctctgtccccaggctggagtgcagtggcgcgatctccactcaccgcaacctctgcctcccaagttcagcgattcttcttcctcagcctcccaagtagctgggattctaggtgtgcaccaccacatcagctaatttttgtatttttagtagagatggggtttcaccatgttgaccaggctagtctgaacacctggcctcaagtgatccaccctcctcagcctcccaaagtgctgagattacaggatgaagtaccacacctggccctttttgtatttgtatttttattttttagcaagggtctgtggttataaactttctcagtgtttgtctaaaatgcctttatagtgtgcttattcttgacgttctctggatatagaattctggcttgacattattttcagcctctcaaagacactattatcctgttctgcttccatcattgctatgtgagccaggagtctgtctaccttgccttctggaaaaatcttaattttttttttctttcatactatacgattcaccatgatgtgtggaggtaggatttcttttcattctgccttgaatgtattgaacttcctggctatgaattgataccttcaacaattctagaaaatttgtagtcatgatctttgagaatatcacctccttcccactcttgtatattctaataaaatctaaactggaccttctcactcaatcctctctttctcttaacttgcttttagatttcccatctcttagtgtctctggattgcattctgggttgttccttcactcctttctcagttcactaattttcttttttgctctgtcaaatctgttagttatttcttcaagaacttaatttcaattttaaaaattttgtttctagaagatgtaatggatcttttcaatctgttcatttttgctcaaattttcaaacttttcatctatttctttaaacatagtaagatagtcttatattctgtgtctgataaggtcaatatctgaagtcttagtggtcagttttttccactgtggctgctgctcagttatcacgccttgtttgcttgtgagatctctgccccgtagagagttctttgagtcctcagataaagttaaattgctccggggtgtttctgctagtcactggaatgccaccaatccagaacacctttttcgttcttttttatttatttacttatttttgagacacagtcttgctccggctggagtgcaatggcataacctcagctcacttcagcctgacctcccaggctcaaggaatccttccacctcagccttcccagtagctgggactacaggacacaccaccatgcccagctaatttttgtagagatggggttttaccacctcgcccaggcagttttgagctccaggactcatgcgatctgtctgcttcagcctcccaaagtgctaggatacaggcgtgagtctgagtcaccatacccagctttgttctttttttttggagatggactccactctgtcgcccaggctggagtgcaatggtgtgatctcggctcactgcaacctctgctcccaggtttaagcaattctctgcctcagcctcctgagtagctgggattacaggcgtgtgcactatgtctgactaattttttgtatttttagtagagacagggtttcaccatcttggccggctggtcttgaactcctgacctcgtgatccacccaccttggtctcccaaagtgctgggttacaggtgtgagccaccgtgcccggccgccttgttctttttttgagacagtgtctcatctgtcacccaggttggagtgcagtggtgcaatcatagctcactgcagcctcagccttctggctcaaactatcctcccaagtagctgggactatgatagagacacacaccacacgcccactaacttcttacattttttggagagatggggtcttgctaggttggctaggctggtgttgactcctgggctcaagtgatcctcccacctcagcctcctgatttacctgggactacagatcatgccaccatgcctggcttttttttttttttttttttttttttttttgagacggagtcggctctgtcacccaggctggagtgcagtggcgcaatctcagctcactgcaagctccttccccgggttcgtgccattctcctgcctcagcctccccagtagctgggactacaggtgcccccaccacgcccgggtaattttttgtgtttttagtagagatggggtttcaccatgttagcaggatggtcttgatctcctgacctcatgatccgcccatcttggcctcccaaagtgctgaattacaggtgtgagccaccacgcctggtcgtctggctcattttcttactttttgtagtgtggggtctccctatgttgcccaggctggtcttgaactcctgggctcaagcagtcctccccctcggtctcccaaaacactgggattacagtccatcagccactgtgcctggtgcaggaccttttaagactaaattatcttcttaaggtttcacaggcagtgtgaattaaaactgaaagtcatgtgaagcctggcttgaggttattttttccttccctccagggaggtttaattttcttctttctttttttttgtttttgagacggagtctcgctctgtcgcccaggcttgagtgcatggcgcgatctcggctcactgcaagctccgcctcccaggttcatgccattctcctgcctagcctcccgagtagctgggactacaggcacctgccaccacgcccggctaatttttttgttttttagtagagacggggtttcaccgtgttagccaggatggtctcgatctcctgacctctgatccgcccgtctcggcctcccaaagtgctgggattacaggcgtgagccaccgcgcccgcttttgtttttgtttttttttttttgagacacggtcttggtctgttgcccaggctggatgcagtggcatgatcttggctcactgcaacctccacctcccgggttcaagcgattttccgcctcatcctcccgagtaagtgggactacaggtgcccaccaccatgcctggctaatttcgtattttttcagtagagaatgggttttaccatgttggccaggctggtctcaaactcctgcctcaaatgatccacccgcctcggcctcccacagtgctgggattacaggcgtgagccacgcgcccagcctaattttctttcatacttcattgctgacattcctgacgggggttccagttaattgcaggaacttcctgttggattctctacctcaggtagatgtttatcatctgcttcataccctggggttcaggggtctacagaagccctttagcattatttaccttgcagggttctactttctattttttaaaaatatctttattgatacttaattcacataccatacaagtcactatttaaagttgcaatttaaatatactattaaatatacaatttaaatgtactgaagtaattacgattttatttatttatttatttgtttgtttgtttgtttattgagatggagtctcctctgtcacccaggctggagtgcagtggccagatctcggctcactgcaacctctgtctctgggttcacgcaattctcctacctcagccttccaggtagctgggattacaggcacctgcaccatggccacctaatttttgcatttttagtacagacggggtttcaccacgttggccagctggtctcaaactcctgaccttaggtgatccagctgcctcagcctcccaaagtgctgggttacaggtgtgagccactgcacctggccatatattacgatttaaatatactattaaataacaatttaaatatactatttaaagtatattcacagagttgtgcaaccatcaccacatcattttagaacatttcattatcccaaaaacaaatgaggtactccttagccatgactccccaccctcccagcagccctggcaaccacaaatctacttcttatctctatggatttgcctactggatatttcatgtgaacaggatcatataatacatggtcctttgtggctggcctttttcattagcataatgtttgcaaggttcctccatgttgtagcatggatcagaatgttgttcctcttgttgccaaataatatcccattgtttggctccatattttgtatattcactcttcagttatggataattgggtagtttcatccactcagctgttataaataatgcagccattaacatttctctttttttttttaaatggaatcttgctctcttgcccaggctggagtgcagtggcacatctcggctcactgctacctctgcctctgggttcaagcgattctcctacctcagcctccgagtagctgggattacaggcatgtgccaccacgcccagctagttttgtgggttgtttgttttgaaactgaatcttactctgtcgcccaggctggagtgctgtggcacgatctcagctcctgcaacctccgcctcccaggtttaagcgattctcctgcctcagcctcccaagtagctggactacaggcatgggccaccatgcccagctaatttttgtatttttagtagaggtggagttcaccatattgtccaggctggtctcaaaactcctgacctcaagtgatccgtctgcctggcctcccaaagcgctgggattacaggtgtgagccaccgcgccctgccacactcttatgaaaaggctttgcatggacacgttttcatttctcttgggtatagagcttggagtggaatttcgggtcatatgaagctctgtgtttaaccttttgagaaagtgccagaatgttcttcggagcgctgcaacattttacattcccaccggcatcctgtgaggttcccatccctccacatcctccccaagttgttattatctttattattattattattattgtcaatggagggcaggggatgagtggcttattagtgcctttaaaaataagttttgcagtttaccgttctatcccgcactggttgttttagtcaagaaggttctttaggcagcaaaatcacccaactgccagaaatgcaacccctgccttcccttgctggctggctgtggcctcctgtcggacccctgctttttctcttccttcttctaagctgttgtccacgcagcactcgagccaccttttagagtcctaatgcagcacatgcctcctcgctgcaagctgtgggagggttcttaccctttgcttcagtccacacgcctagtccctggccggctcctgggagctctgcggcctccctgggtctccgtgtttcctaagcctccgtaagtgctccctgtccgcagatgcgtggggcccttcctcacctctgctctgggtgccctccgcctggcttctgcttctcagcagcttcccagggcagccccttcgggtctagcgcataggtcccctactctgatctactcctgcttgcttttttttgcagttgctctgccgctaacctaacggacttgctcagacttaagcctctagtttccaaatgcaggccgtgaggcatggaccgagcctggcccagcctgcccatcaccctgcatgttccaggtgctcaataaatttgttgaatgaatgaatgcgtgcacagggacgtgctgaggaggcttgggggccaattgctctgccccgccctgcctctgatccccgcctcctcacctgcccgcagccaccttctggtgaaccctcagttcaagatccggctggatgagacggatgacccggacgactacggggacgcgagtcaggctgcagcttcgtgctcgcccttatgcagaagcaccgtcgccgcgagcgcgcttcggccgcgacatggagactattggcttcgcggtctacgaggtcaggagggtggataccggtggatctcactgagcaggcagaggacctggcgcccccgacccgcagtgcaggcggcttccaccagggggcgccagggaccatgcccttccccacaaattcccctccactcccccaccatcctgagggctgggaaatctcagcctccaggaggcacctgctgaggccctctggcgaaagagaggaagggggttggctcagggaagggagattctgggattcacctcacgcttgagggcggcctgctgctcttggaggagggagctggctcagctgatgcctgggagtactggccctccgtcttggaagctgtgagcagaagctggcaggggaaagataggggatagggaggcctgtcggccaaggtgaggctgtgccagtcgctctgggattagaactccttgctcttgcctgtatctgccctgcttcacacactgccctcaagacagggagagaaacttctggacctcctggtcgcagtcttggcccacacccaaaccccctggcagcagcctgcggtggccctttctgtccctgggctttggaacattgcagttggccaccccgggggctggcctggagcctctactcagaatggagtcctagggcaagcattcccaggaccaagaggaccctgcctgagcccccctcctggggccctgctgtggtgcagggaccagatctgggtccccagggccctgcctttgcctccttatcccatcagtcccgtctaagaactcaagacctctgcccagcatgcactggaccccgccctgggacaaacacacatctctgacttcccctgtctctctattgcaggtcctccggaggtaggtgtggcaccatgacccacctgcagtcacacacccctgatggtgccagggggagcaacccagtggcaaacccaccctggcctggagagctaagaagtcaccttgtttactgcttgaaaaatgcttctccccacctgttcagtgggcagagcaaacattgctctcctagggtcagcacaggtagtcagtgagggagctggatttgagccctggtcctcagagccccgtctgacatgtacacatgaggcttttcctgccttgccatctacaccaagtaagtgccaatagggcggtccagcaatgtcaggagcagggcattagacaggctgagagttctgtaccctgagcagttgcttaagctccgagcctgtgtttgtgtctgtaaaatgggtgtaacagcagacagcaaatgaggtgccgagtaccctgcagtacctgacctggggaaagctcccagtgatataatgacagtgttattgaaacacatgcctaatctgcaatccggtgctcctctcctctacctctgcagtgagtagggttgttacattttacagatgaggaaactgaggcaaaatgtcttttagggtcacacaggctgtgagtgagccatgccccagctctccagccccttggccaggaaaggagcctggagtctgggtctgggggtggcccctgagggtgggctgagtgggcagctgagccctgctccctcctccctcccaccagctggtgggccagccggccgtacacttgaagctgacttcttcctggccaatgcgtctcgggcgcgctcagagcagttcatcaacctgcgagggtcagcacccgcttccgcctgccacccggggagtatgtggtggtgccctccaccttcggcccaacaaggagggcgacttcgtgctgcgcttcttctcagagaagagtgctgggactggtgagtcatggactggcccctgccactctcccctctcccagcctcccctctcaggcccttgctgtccccctctgactggctcctttcctccccactctctgcagggagctggatgaccgatccaggccaatctccccgatgaggtgcgtggtcccaccccaccaggccccgtcctccctcttcctcacccctgggtgtgtgatggggacccaggtgtcctgtcccctgagttcctgtaacagggaagatcccctcctggtggaagccataggagtagtgctaatccctcatccgccagcactttacagtttgcagaggacctgtgatactaatggcacaggccctgagctctcaccggtggcgggtttgtgctgagcacttcacctgtgttacctcatttcctccccacatcaccctgtccgggtcttgttaccatacctcctctgaatgggaaattcaggttcacagaggtagggaacttgcctgaggccatacagtagggatccaaactcttgcctttttttttttttttttttgagagagtctcactctgtcacccaggctggagtgcaatggcgtgatctcggctcctgcaacctccgtctcctgggttcaggtgattctcctgcctcagcctcctgagtagctggattacaggcgcacgttaccacacctggctaatttttgtatttttagtagagacggggtttgccattttggtcaggctggtttcaaactcctgacttcaagtgatccacccacctcggctcacaaagtgctaggattacaggtgtgagccaccgcacctggcccaaactcttgcctttactcactgagctgaacagcatccccttcatttaggtcacatgagtgctggatatggggggggcagggcagggcaggaacgagattcccttttcagattagaaaagtgagactcaagcgggctcagtggctcacgcctgtaatcctagcactttgggaggttgaggcgggcggataactgaggtcgggagtttgagaccagcctggccaacatggcaaaaccccgtctctactaaaatacaaaaattagccgggcatggtggtgggcacctttaatcccagctactcaggaggctaggcagggagaatggcttgagcccgggaggcggaggttgcagtgagctgagatcacgccctgtactccagcctgggtgacagagtgaaactccatctcaaaaagaaaagaaaagaaaatgaggctcagagaagcgaagtgacttgtagcagatatgtgacctcagccctccctccagtgcctccacacgggcagggccggggcctctcttacctgctttctccccttctcggtccacaagtgctctcagaagaggagattgacgagaacttcaaggccctcttcaggcagctggcggggaggtaggttggggcatggcaggttgggaggggcctgtgaggggcagccctctcctgggcaggtgccacctcctctctctccccaggacatggagatcagcgtgaaggagttgcgacaatcctcaataggatcatcagcaaacgtgagtccccgcggggctgtcccaccaccccccatttcttccacatcagaatccaggctcctgctcacacattgagctgaacctcatccctggtctgcatgagtcggggaatcctccagtttttctgagcccagttccctgccatttcctcccatactcctcctcctgacctgccatcctgataatccctgtgctcgggtgctgtgccttgtgggattagcagcgcagcctggccaggcacagtggctcacacctgtagtcccaacatctgggaggccgaggcaggagtcgcttcagcccaggagttcaacaccagcctggacaattggagagaccctgtctctgcaaaaaagtacaaaaattagctgggcgtggtggcatgcactatagtcccagctactcaggaggctgagttgggaggatggcttgagaccagggaggttaggctgcagtgagctgtgatcacatcagtgcactccagcctgggcaacagagcaagacccgtctcaaaaaaaaaagcaggagcagcaccttagtgccaaagaaaagtctacctttcctccagagcctcctgggccaggctgagtggcttggggaacaccacgtgactggcttcactcccagggcagacaactgctggcctctcatcccctcccctcccctttgctgccactgacctcatccacacggtttccttaagcagagcttttctcctcctcttctctgctagtgaagcactcttaccctcctagcctacagcaagccctgccctgccccatctttctacccaatttctcgtcttctgtttcacactcatttctttttactttggactaattgtggctgttgggactttgcttgattgctaaaatactttacttgtacttcctgatgatacaaacaatcctgcccacttctctgccagatattgcacccactcgtcaggatttgtgcgtccttgactctgccccacccgtgctcccagcaggggcaggtgcaggaagctcactaggtggagatgttggaattggttttcttgcagacaaagacctgcggaccaagggcttcagcctagagtcgtgccgcagcatgggaacctcatggatgtatccttccgtttgcttttgtctcctgagtggggttttgggtggagtatcggtgctgggagaactgtcccaggacagcacagagaacaggacagagccatgcgggtgtggacacacagtgccccatgctcagatgtctccctggacgtcttcctgttggttggagggagaaactgaggcacagacctgtgtcaagtgaaaggtggagcaagacctgggtcccattgaccctgaggctggtgctatttctgacccctccccagcccactccactgcagcccactcagagaataaggcaagcccggctgtgggctgactgtacatggcttttgctgcttctctcacccagccccaagtcgacttgccggctcggcggccatctccccttctgcacagttgccactctcccatgactggtctaagtgatggaatttccttcttaacggccacccagcgtgaggcaatgggaagctgggcctggtggagttcaacatcctgtggaaccgcatccggaattactggtaggttgtccccactcacctcagtcatgcaggtgcgggccgggcaggtgggaaggccgggtgactcagcctggccctcaccctctgccgccacctcagtccatcttccggaagttgacctggacaagtcgggcagcatgagtgcctacgagatgcggatggccattgagtcggaggtgagactccaaggctgacggcacctgtggggcccaggacaggtagccccactgctctatgccccaggcccttgtccctggggtgctagtggtgacatggtaacagccatcttgtcttttccccacggttactagcaccctgcctagccccagccccctcctggggacccaaccctcccccatcctgttgggcaggggctgcgcctcactgaccttcactcactctcctggaccggcttcaagctcaacaagaagctgtacgagctcatcatcacccgctactcggagcccgactggcggtcgactttgacaatttcgtttgctgcctggtgcggctagagaccatgttccggagtgtccccaactgcctcccaccctccagctccgtcccaaacgcgtcccccaggagctgggggaatgacagatgggtgaattagcagatacaggccagtgctgtgggtgtgtgccaggaggcctgggtctgggtttggggggccctggctgagtgccaggagagtcggggagggaggagttgacagtggcttctcaggcagcaggaaggggtgaagcttcccagcttcaaggggttcagcttgcggtactgtggggaggtagagagggaccaggcaggaagggggccaggcctgccctgcgtgaatatcccactgagttttcagccctgtatcaccttttcttgaacacacagatttttcaaaactctggacacagatctggatggagttgtgacctttgacttgtttaagggggaacctccctgggcccatggttggggaagagttccaggcgatcgaattttcttatctgccagtgttccctgtcctttcctggaaatgagcctgggcctcagagccaaccctgaagccgggccacctgaatcctgaaaggctggggtgggggtgtctggattctgggaaaggagcagaggggaggtccaggcccttggaggcccctatgggagcagcactctggtttcccaggggggaggaggtaagaaagtaacccctccatgaggttcctgaggtggctcctgagacgtggattgggggctggacctggggtttgggtggggaagaagccagggagccatttctgcggcccagctgacctgcctgttctcccgcagtggttgcagctgaccatgtttgcatgaggcagggctcggtcccccttgccgtgctcccctccctcctcgtctgccaagcctcgcctcctaccaaccacaccaggccaccccagctgcaagtgccttccttggagcagagaggcagcctcgtctcctgtcccctctcctcccagccaccatcgttcatctgctccgggcagaactgtgtggccctgcctgtgccagccatgggctcgggatggactccctgggccccacccattgccaagcaggaaggcagctttcgcttgttcctgcctcgggacagccccgggtttccccagcatcctatgtgtcccctctccccacttcagaggccacccactcagcaccaccggcctggccttgctgcagactataaactataaccactagctcgacacagtctgcagtccaggcgtgtggagcgcctcccggctcggggaggccccggggctgggaacgcctgtgccttcctgcgccgaagcaacgccccctctgtccttccctggccctgctgccgaccaggagctgcccagcctgtgggggtcggccttccctccttcgctccttttttatattagtgattttaaaggggactcttcaggacttgtgtactggttatgggggtgccagaggcactaggcttggggtggggaggtccctgttccatatagaggaaccccaaataataaaaggccccacatctgtctgtgatgtgttttccccagcctactgcctggagggcacctgcaggccccggcccatgggggcagctcgtggctcagctcacccctcccctccaacccctccatctccttccccttgaccttgaagcttgacccctactggagtactgggtatctgggcaagaccacccctggccctgggaggttgggaagaggggccctagctgcagggacagggccacacagctgaggtcccacatggctctgctgacctacatgccctccccgccgcccaggaggcctgacccctacctttcttgcacacttcggccgttgaggtgaggctctggctgaaattcaaacctctacttagcacacacccggcccccagagagctcccccgagcacagagccgccttcaggtccctctgtggggagcccctgtgaccagacacctgcacttacataagccgctccagggcctgctgggatctgggattttcttacagagataagagtggtttgggggaaggaagaggggatggggcgaagctgcaaatgcagagagaggccgaggtgggggagggtgggagttggctgctgtcagctgctgtgggccccagcgtggggtggagatggaggtggaggcccctgtgtgccccatggggaaggctgcccgcacacgctatcttgagcttgcgttttgcccttgtcacctcctcactgggagtccaggtcctgttggctcagagtcttcagcagtgagggcagtggctcagctcttcctgcagcttgggctggttgtgaggggctggagggcaggagggtctgcagggccctgccatcttgctcaaacccttattgctctctggattgggttttatttgatgtggggatgggaacaccacgtctggatgaccgggaccctaacctctcataaactctgagtcactgaggtagaggtgggaagagcagggctcttcctgactgccctatttgggctttcttgctttgtttctttccttcctttctttcttttgatggagtttctctcttgttgcccaggctggagtgcagtagcgtgatctcggctcacttaacctccacctcccgggttcaagcgagtctcctgcctcagcctcccaagcagctgggatacaggtgcccgccaccatgcctggctaacttttgtatttttagtagagagagggtttcccatgttggccaggctggtctagaactcctgacctcaggtgatcagcctgccttggcctccaaagtgccaggattacaggcatgagccactgcacctggcctatttgggcattttaaagggctttttcccacgtgtcacctgtgcagccaagtccctgctttctcgggaagtgggggagggtaagcagctgtaaacactgcatcccattattctgaactctcagcacttaaggctcagctgtgatttggagcctagagacagggactgtgtcccatgtgccaaagccagaatcgggctcccgaacatgcctcggtgtcctctggaggaaagggaaggtgatggtgctccattcatgctggggtcctgtcggtgagggcagtgggcagggcggccagacctgcggatatgggtgtaggctgtgactcagccctcggggtgagagatggagagagctagagaaagggcatggggaggggagccctgcagatgtggggacacctgaaccctcctatggggtgtaacctgagcccccgacacagggtgcacaggatgtctgcagtcctcacccctggcctgttcctccccctccagggcccctcccggcctctctacataaagccgggggtactgggcctcaggtcaggcctaggccatggccttcacagacctgctggatgctctgggcagcatgggccgcttccagctcaccacacagccctgctgctgctgccctgcggcctgctggcctgccacaacttcctgcagacttcacggccgctgtccccccccaccactgccggggccctgccaaccacactgaggcctcaccaacgactcgggggcctggctgagggccaccatacccctggaccagcttggggccctgagccctgccggcgcttcaccaagcctcagtgggccctgctgagccccaactcctccacccgggcgcggccacggagggctgcaaggacggctgggtctataaccgcagtgttttccgtccaccatcgtgatggaggtcagaaggggctgggtgtgtgggggggctgctgccgaggccagtctgaagcgcccatgtcttccctgcagtgggatctggtgtgtgaggcccgcactcccgagacctggcgcagtccgtctacatggccggggtgctggtgggggctgccgtgtttgcagcttggcagacaggtgagcccgtggggataagggccccagccacccagtgcgggccaaaagcctaggcctctgcattcatttttctttgttacagttgatttgtgcattttaaacaataatacatatagtacattcacatggtttcaaatcccgaaaggcacagaagagtctgccgggatcacccctttcctgctctgcccctccttgcagtaatccccagagggcagcctgcttctatgccttttaccagagacattttatgattctatgcagtcaagcaagtgggtgtatagttccattcccccatttttcttttcctgttttgtatttgttttcttcttcatgtgccccatttttttctttgagatgaggtctcactatgttggccaggctggtctcaaacttctacgtcaagcagttctcctgcctctgtctcccaagtagctgaggtgacaggcctggtcatccttttttgtgcaaatgctggcatacaccccacgtggtcctgcacccggctttttcttcgcttggaggcctctcctattccttcagaaagagctgtcccattcctcctagtctttacactaatcccactgtatgaatgggccctaacttgttccccgttattttttagaggtgaggtctcctctgtcacccaggctgtagggcagtggtacaaacatagctctctgcagcttcaacctttgagctcaagtgatcctcctgcttcagcctccccagtagctgggactacaggcacgcacaccgcacccagctaataaaaaaaaaattatttttagtagagatcggggggtgggggtggggggggtgtctcactatgttgcccaggctggtctcgaactcctgggctcaagcaatcctctccctctacctcctaaagtgctgggattacaggtgtgagcactgcacctaactgaccctattgacagacgatgtgcagccagctcatggctctgaagttggctcctacgtctctctcctgcacctctttccccttcctcctcttcgctctctctcccctctcccttctcctctgccttcttctctcagttcaggtttggggggccctcccggactccaccccacactctggagtgagatggctccctgtgccacacacctcaggccctcatcacaccgtgtcatgatacaccctgtctttctacatgtgagcttgtgtcttatccagaatgtcttgtttgtcaccaaccctcactcaggcctgtcacttagaggtgattaatgatcaatgaacattgtgtcacaatgaatgatgaatgaaagaatgcatgaagaaatgaagaaacgagtgagtgagtgagtgagcaggcgatgagtgggcgagcgagtgagtgggcagatgagtgagtgagtggactagtgagtgagtgatgagccggtgactgagcgagtgagcgggtgagtgactgagtgagcgggtgggcgagcgatgagcgggtgggcgagcgagtgagcgggtgagcaagcgagtgggtggataagcgggtgatgggcgagtgagcgggtgagcgagtgagtgggcggatgagtgagtgggtgagtgagtggagagtgagtgggtggatgagtgagtgggcgagtgagtgggtgggtgagtgagtgggtggtgggtgagtgggcggatgagtgagtgggcgagtgagtgagtggatgagtgagtgggtggtgatgagtgggtgatcgagcgagtgagcgagtgagtggatgagtgagtgggtgggtgaggagtgggtgagcgagcgagtgagcgagtgagtcagtgagtgagtggatgagtgagtgaggggtgggtgaatggataagtgagtgggtgggtgggtgggtgagtggatgagtgagtgaggagtgggtgcgtgagtgggtgagcgagcgagtgagcaagtgagtcagtgagtgagtgaagagtgggtgggtgggtgagtgggtgggtgggtgagtgggtgggtgaatgagtgggtggggggtgggtgagtgagtgggtgagtgggtgggtggctcggtgggtgagtgagtgagtgcagagtgagcgagtgagtcggtgagtgagtgagtgagtgggtgggtgaatgagtgagtagggggtgggtgagtgggtgggtgagtgagtgcgtgggtgggtgagtgagtgcgtgggtggggagtgagtgggtgggtgagtgggtgagtgagcgagtgagcgagtgagtcagtgagtgagggatgagtgagtgggtgggtgagtggatgggtgagtgggtgggtgggtgagtgagtggggggtgggtaggtgagtgagtgggtgagtgggtgggtgagtgggtgggtgggtgagtgaggggtgggtgagtgggtgggtgagtgagtgggtgggtgggtaagtgagtgggtgggttgggggtgggcgagtgagtgagtgggtgggtgagtgagtgggcgagcaagcgagtgggtcatgagtgtgtggagaagaaaagctgcctgtcttcttggcctgcttccctgctggccaagttaggctgtgcgctctggccctggaccctcatttgcaaacagggcagatcaccctgccatctgtccttgggcccctctgtggcatggcaaccctctggtccacataatgactccaccctgctcctgctcccacaccagggactggccaagggctcacccgctgtgagttctggttcgagcctccctccagccacagcagtgctcaggtgacctctccccacctgccacacgcccctctgggctttgcagaatccctgcctttcctcgagcccggactaaatctcctcgccagcttcctctacactatgtccctctgtctgtgaccaacctctgccacgaagcctgggtcccagcagttcaagtttctgttttggaagggtggctttcgcggggtaccccatcttccccgggactgcttgataatcccctgctcgggtgaaaggggcaggcgtgggctgcccatttgttccttggggatgctgctgctgcctcccaaaaccctaatgcctgtgcccattctctggactcaggctggctgcaagggccccctggtctggtcctacctgcagctggcagcttcgggggccgccacgcgtatttcagctccttcagtgcctattgcgtcttccggttcctgatgggcatgacctttctggcatcatcctcaactccgtctccctggtgagtccagccgaggagaggccaggaaggcgggggctcctgaaagagcagggcgggggcggggggacaggggggtggcaacgtcgaggtcatcggacatttttctcatgttgttttgttgggattctcatccagcaacctcaactcaagcctcccgccagagttctggacctgggggacctgggctcccgggtagtggtggccctctggctgtgggtggggagtccctggatggcctttcccaggtctgggctttagtgtactctctgtaaattgagagggttaggtttattttatttgtgaattagccaacaata

SEQ ID NO: 5041 - DNA, 76427 bp, Homo sapiens
ctgaccctgactgactcccacctgaccctgactcctcccacctgaccctgactccgaccgaccctgactcctcccacctgaccctgactcctcccacctgactctgactgactcccattgaccctgactcctcccacctgaccctgactcctcccacctgaccctgactcctcccactgaccctgactcctcccacctgactctgactgactcccatctgaccctgactcctcccactgaccctgactcctcccacctgaccctgactgactcccacctgaccctgactcctccccctgaccctgactcctcccacctgaccctgactgactcccatctgactcccaccctcacggagaccacctccttctgcgctgctgccccctctggcgtagcctcctggacttctgcgagctcagcagaccctcgtgcctgccggccaggtgcgcgtctgcaggaggccaactatgcctcctgaagagccctctccacctgcaaggtgccaggactgggagggaaagtccagggccccccaccctccccaccaccctccgccatcagcctgcctgggccagcctgcctcctggcctaggatctccctggggcaggaagtgggtggacttggaggaggaacggcaagggccggtcccacactcttgctcctcctgggcatctggggacaggaacacctctcagggtggccaagagggcttccttgggaccagtgtaaggaagttctgctgtccctgggaagtctcagaaccaggaggaaaccctgtggaggctgccctttgacctttggacgccacctgtaatcactctggatgtgtctgtggagttcaggtttattttctatttaaatgaactaaaagccagcatcctgccggcgtggtggctcacgcccataatccagcactttgggaagccgaggcgggcagatcaccgaggtcaggagttcgagaccatcctggccaacatggtgaaaccccgtctccactaaaaaacaaaattagctgggcgtggtggcgggcgcctgtaatcccagctacttgggaggctgagcaggagaatcgcttgactccaggaggcgcaggctgcagtgagctctgatggtaccactgactccagcctgggtgacagagcgagaccctgtcttaaaaaaaaaaacaaaacaaaaccacatctgttactggaacagagacctcagcccaagctcaggacaaggaggcctccctgggaagggggcctttctcccaccatcaccgcctgtgtccttcaggggctgctggagggcagccaaagccaggggcccaccccgccccaccccaccccaccccaccctctgaaatgtgaaaagctgcactcttcctgtgggctgcgcagtgggctcgggggttggggggtgccggggcgatgttccaccctggactgagtgttcggggcagcctgctcggctgtatgtttctcgcacgctccccgcttcagtgcggctctgtccctgctgccgcctccagtcctgagggaggggcttgcccaccttctacattccaatttttatatctttgaattatgtgattagatattaatttaatgtaaaaccactctgaaagctcttctcacttctgggtgtttgaggtctggctggggggcaaagtggatggtcactgtgcttggtacgcagttgtggaggctgtcgagggcctactgcagacgctgggcgcaggggcgtggggagggcggttttgggacgcggccgtggaggccgtcgaggcccactgcagagcgctgggcgcaggggcgtggggagggcggttttgggacgcggccgtgaggccgtcgagggcccactgcagagcgctgggcgcaggagcgtggggagggcagcgacccccctgcagggccggtgtctccggctgcctgtgtggggaggggagggccgtgcctggttggtggggacaagccacagctccagagctgctccggtgtcaccaggctggccaagtccaagtccctgaggccaccagccttgactgtcctgctggtcccacttttaaagctgctccccggaccccctggccgctgtggactggggtccctccgcacctggcccatttgtggctgcgtcacaggggctcctgtggcctcccagagccagctcgggggtcagatggtcgcgggggctaggtcactgtgggaaaagaggttctgggcatctgtggagggaggggtggagcatggagtcccaggactgtggccccgttggtgtgctggacgggccctgccttgaagaccatgtctattttggaccgtcatgaaataagagtagttctgcaatagcttgagaagtgcctgcagagaggtgagaaggcgcctctaggaagggggacttggggacctcaccagcctgcagccagggaagcttctgggaggaaggggcagctgcggccctgaaggtgagcggtggggggacgcaggggcggacgcctagcaaaagcagctgatcctggaggagagagggagctcagggccgggaaggccttgaggaacaaaaggtggggcggggcatggaggggcacggctgagctgctcacagccaggatccccggtggtgctgctgcctcctcgggcgggcgtgctgatgagcactcgaggctggcaggggatggtgggaggcatcacggcctaggagtgtcattccctgagggagccccacagccagggaggtgggtaaggaaggccggagcccggtcacggtgatgggggtggtgaggagggcgggggctaggaccgcagaggccccgtggagcagcttttgtcgtcgtcgttggaccctaggtgtcaggggctggtacttcttgctccaggctcagctgtcttgggaggtccggccttggctccccctgggaaagagcaggagcagaaggcctggggcttggcatgttttgagccagaaaaacactggtggctgctgcctttaaaacataaataggtttgcttctttaattccattgtgcatttacactcttctttattagtggataaatattagaaaatcatctctcagacaggtggctgagggcgggcccctccaggggctccggcttggtgtgcagggtgaggctgtcccccagggctcgtacaccagcgtggaggtctcggccctcttgatggtgaacttataggatcgttgggcagcaggtttcggacgtcgaaggtgcaggcagccacggggatgacgccacactggcgcactcctgctgtgtccgcgggtccagcagcctgaagcgcaactcatactgctccgtgtggctggctggatggtgacgaaccagcgcagccgggcccagtcctggtgagccgccgcgcctttcggtcaaacacgacaggcatcttggtgctcagcatgagccagatgtgcgggacttggtggcactgacatcagacaccaggcggtgcttgacgtgtagccgccccggcaccacatggtcaggaagctgtccatgacggccgacacgtccgccagccgccgctccaccagcgccagtcggccaggaagggccgtgggtctggcgaccggagcagggcatccagctcagcacgccatggtcgagctgttccaacaggtccccgagcagcaggagctggatcttggtctgagtgtgcccaccttcttcatgcgctggaacttccaggggtcgatgagctggaacaaggcgcaggcagcaccagcgggttctggtcgcccagggccaggtgcttgggcaggacctcgatgtgtaggagcacttacgcagcagctgcatgcgggcgtggtggcgcttgagcaggtgcggaccaggtccgaggtcaggaactcacgcagggcattgcggcgctcggtgtaggtcttccacgctctggttccagcagctgctggtcatctgcctcctcctggtccaggaaggactggggatgcccagcttcatcttgtccaggcccaggcctgccacatgggtgctcattatccgggagcggggggagggctgggtgtcagctgccaggcaggctggcctcccctgggctgtggcatgtcgggggatggattcagcccactgaccccatgctggacctctgtccttcttcgggggcacactcgatgggaagaggctgcctggagggctggatgggcagcctacagatctggacacagttatactgaggggcaaaaacctctactgacaaccagtggcctgtgggacaggacagggagaactaggactgcggacttctggccagaaccgcctgacctgtggccttgcaagggccccgttcctaaccctgctgctgaaaggggttgctggcacccctcggggccgtggagaggggaggcgtggtcctaagcagcacaggatccccctcggggacattcgcgggccatcctcccgcccggttctccctggggacgctccacgcctcaccgcagttgtagggcacagagacaggcccaccaaagacgaggccagctggctggtcagcatgggaggagggcgcccaggcctgggccggaggagcagccctcctcccacgctgtgggccctcgctgtggacccgggatcctgtcccggtgagctcatggactccacaagtgacactccatttcccagatggagcctgaggctaagagcttggttcttgttctcatccagggcttgagcccagtgctgagccgagtctgaccctcgtccgtgggtgcaccggctgagtgcagctgtggccccaggctctgccgcagctccctgggagcaagccgcacccctggttgctgccccggctcccagcaaccctggagatctcaggtttcacagccacttgggccttggacgacccacaaatgagagctaagcagttgctgagttcccagggccacacaggtacgtggtgaagtcatatctgcccgggaagggttgcccttttggggtgaggcagatatgacttcacgagcgcactcctcgggaatccctcgagaacaggcccctggggcagcagggagtgtgtctggggtgaggtgccagctgagagcaggaccccaggacccaggcctaagccctgctcttgctggaggctggggcggatttcaccgctggagggaaaccggcctctgtgacgtgtgagggatgttttctagtctccagcagctgcccaggtggaacaccagagaggctggtcgtgaacccggaaaggtggttctgagcccctcgctgcttcctacacgcccggtcccaggcccgcttccctgagaccaccaggtgcccgcactctaccccctccacccactccccttggctcccctggcccgggcccacctccccggccgctctgcctgccccttacttctcgagacccccagccctcctctcccggcccccgccgccgccccaggaccgcgccccttgccctgcctctgaagcggagccgcgcgcggacttcccagagcccagcctccctccgactccgcgggttgccctggggaccagcggcctttgtgacgctgcggcccgggggcgggggggggtggggacccgggaccccgagccgagtaatcttccatccgcttcgcttcctggaggccccagacttctgggggcccgcgtccccgactgaggggccacggcgggtggctggtccagagccaggctccaaggggggttcccgtcccggagcccttccgcgggcgcaccactcccacgcacccccggcttcgggcggggcgcaggagcctcgggtgactgggagggagttcctgtcaaccccccagtccgagcgcactcctcgggaatccctcggaggaatttgggagagaggagtggccggtgaccaggcggatggaccacccagcgcctggacagaggagaggggcggctcccccgccgcgggctctgcccagcaaggccccgcccattacagatgccacccattacagctcctcccaccgcaggctccccccaccgcaggctcctcaaccacaggctcctcccaccagggctcccccctcccccgcaacggcccctcccatcataggctcctcccaccgcgggctcccccaccacggcccctcccaccacaggctcctcccagagcaggctcctcccaccgcgggtcccctactacggcccctcccaccacagggtcttcccaccacaggctcctcccagcgcagctcctcccaccgcgggctccccccaccacggcccctcccatcataggctcctcccactcaggctcctcccactacaggctcctcccaccatgggctccttccacctggggctgcccagctcaggcaccgacctgactctggataaatggggtctccatagctccagggagccccgcggggagctctgaggccatctggtcccgtctgtatctgttcagttgggctcagggcctctggatccccccgttcccccacagcacaccccagctagctgggggtctcctggggtcacaacttagacaccccaaggtgcccctccttcaccttcaggaagatgctggaggaagacacccttccatcctcctcatctccacccccacggaggtcagtgctggggcctcttccaggatggcgtctttgagcccctaccaggctgttctgtaacttgagcctcccccctcctcccggtgacccaccctggaagagctttcccttggtgcatggaggccccaggggttaggcctggcaggagtgggtggatgtgggtggttttttttttgagatagcgtcttgctctgtcacccatgcgcagtcttcacccccggggctcaagtgatcctcccacctgggtctttctgatccttccggttacaggtgtgagccttgcacccagtcctgttgggtgctgtttctgccctgccctccctcctgggctggaactcaataaatgccagctattgttattgttatttagggctccaggggaaaagccggggttgtttggagaagggggtgctgtctgacgcggagggttgggaagcagtagagttagaccccttacccccggccctgcagcccactgacggagaagcggggtgggggcaagcagcctccccttctcttttggggccaggcaggtcctggatgtctcccctctcctgggtccaccctaccccctttctttcaatttctgatttctaatctaattttttaaagttaaactttggccaggctcggtggcgcaggcccataacctcagcactttgagaggccaaggtgagggatcccttgaggccagaagtttgagaccagcctcggcaacacagggagacccctgtcttacaaataatttgaaaaattagctgggtgtggtggtgtgcacctgtggtctcagctactggaaagctgaggccggaggatcacctgagcctgggaggatgaggctgcagtgagccaagtggtgccactgcactccagcctgggtgacagagggagaccctgtgtctctaaaaagaatataatggctgggcgcagtggctcacgcctataatcccagcacttcgggaggctgaggcagcagatcacctgaggtcaggagttcaagaccagcctggccaacatagtaagacccagtcctactaacaatacaaaaattagctggacgtgatcgagaccatggtgaaaccccgtctctctaaaaatacaaaacactagctgggagtggtggcaggcgcctgtagtcccagctactcggagactgaggcaggagaatggcgtgaacctggaaggtggagcttgcagtgagccgagatacgccactgcactccagcctgggcgacagagcgagactctgtctcaaaaaaaaaaaaaaattagctggacgtggtggtgggcgcctgtagtcccagctactcaggaggctgaggcagggaatcgcttgaacccaggaggtggaggttgcagtgagccgagattgtgccactgcactcagcctgggtgcaataagacagaggcctgtctcgaaaataataataataataataaagttaacttttacttttaagataagtatagattcatctgcagttgtaagaagtaacacagaggcccgttaccctctatccagcatccccagtggtagcatcttgcaggactgcagtgcagaacacgccaggaccttgacgtcgatacagacgcaaggcagtgccacccccacgggaccctgcatgttctttacagccacgctgctccctcccacctctccctagccctgcaaccactcattctccggctctgtctggtcatttcaagaatgtcctatcagtgcaggctttcagtatgcaccttgggactggcttcttgcgctcagcatagtcccctctgtgcagggtcaacagtcactctgttcactgctgggcaccaggggccagtttgtgctcagtcttgctcaaccctgtttgtgccaccagggcacgggcagtgaacactttggatctgttgtccctggtggggacaagctccttccctgggccctgaggatggtgaagcctgggggtagtggggccagtcttgggggagaaatgcacgctgaccactgagaccctcagagctgtgccctccagacacataaacccggatgggggtggcctgatgtggcagagctcctgccacaagcctccatctgaacaccaggaaggccctgcaccccatccccctggtctgtgtcctcactgccattgtaagctcagtgctcttaagatggggaaactgaggcacagggaggttcagcactgtatgcccaaggtcatgtggacatgagtctgacagcaggattccagccctggtcatttttatttttttgagatggagtcttgtcagccgcccaggctggagtacggtggcgcgacgatctcagctcactgcaaccactgtccccagattcaagtgattctcccgtctcagcctcccgagtagctgggattacaggtgcccccatcatgcctgactaacttttgtattttagtggagacggggtttcaccatgttgcccagctggtcttgaactcctgacctcaggtgatgcacccgccttggcctcccaaagtgctggattactggtgtcagccaccgtgcctagccttttctttttttaaaaaaatagagatggggtctcactatgttgcccaggctggtcttgaacccttgggcttaagcgatcctcctgcttgcctccccagatgctggtattacaggagtgagccgcctcacccggccaagccccagactctgaccccgtccagactgatcctgtacccaggcccctttcctcactcccctctgtgccaccacccggttagggctgagggaggaggtgaggtcatgtggggggggcacagcaggcagggaggggctgctgacaccgacacctggcaggggccctatgctgggctgtgttgcgcctggtggtgaggtgaggaaggggtggacgggcgggcacaacttggagggcagcgggacagggcactgggcatgcggggccggggattctgaggaccaccggggaggagctggataaagccggctcggctgcctgccgaccacactcaccctggcatgtgtgcggtgcaagggcagcaggtgcaggagggggaagatggggcagacgtggggagctgatctgtgggcaggtggggcggtggggtgagacacgccggggcagaggcccaatggggccctaaccctgatggccaggcctgccttggttccagctgggcatggaatgtgctgagtcctgtgccatgatcccgtggctctaagggcagggagtgtctgggaggaatctgcattcagtgccctgaacatctgaccctggtgtgggggcacaggagctttccatggcctgaggaggcctccctggggctctgcggccttggcgtctagcggggaagagtcacgtcctagggaggatttgggagagctggtagccacacctgtatcccagcactttgggaggcaggaggatcgcttgaggccaagagttcaaaaccggcctggcaacatagtgagagcccatctctacaaataataaaaaatttatctgggcatggtggcgccacctgtagtccggcaggaggacggcttgagcccaggagatcgaggctgccactgcactcagcctgggcgacagagtgagaccctgtttccaaaaaaaaagtaaagaaaagaaatggtggcaaaagcctcacctgcacgtgaggagacggcggtgggtgtggggaggagacggcggcgggggagtggaggggaggagacggcgggggtgggttgtggggaggagacggcgtcggggcgggaggagacgggcagcgggtggggggaggagagggcggcgggggcgggaggagagggggcggggggaagcgcgggaggagaaggcgctggggcccctcgaaggccacccccaatgtgtatttacaattctccacatttctcaacaccccccaccacccccagcagggcacctctcggtgcagagcctgccctgagcctggcgatgtccagtctcccagggcccctgctggctccggctatcagcccggacacagcttggctgctggggtgccctgagagccaggccacgggtgcactgccaccccacaatgcacacaccagtccccagacgtgaggtttctgagaagcccattgtgactccagggcaggcaggtgcgaggggcttgtcattggctggacactggtcacgccattggagggatgcattcagccacacgcatgaagtgggggcatggatgcgtgtgagatgtggaaaggggcgtgaggctccctgaaggccacccaggtgcggaaggggctgctgggggagccggcaggaggagtgagagactgcagatggcctcaccccacccccgtgcctcaggacccgaggggaggtgggaggagtgagagactgcagatggcccccaccccaccccactcaggaccggaggggatgtgggaggagagagagactgcagatggccaccaccccatcctcctgcctaggaccctgtaccgtgctgctgggttttgctgggatttgctcccccagtcctgccccgactggggacctacctgagcgggcagagtttgcttcagcatgcgggggcttggcgctgtccgggagagggtgggaggtccccagccagggactcacccgccgccccttctccgtgtgctctccccctgaactggggccaggcgtccgcagcctccacttccccgcagtggcctttgggttggcctgggcattgactgactcagaagccggtcatcgggcagcatggggcatctgggtgctggcctgcggccgagctccctgcaatcagcatctcgttttactgcatgaaagccgggggctgagagccccctcactcgcctgtcctcagaatttactgcagaggccggaggctcggccctggtgcagggttaatgatgttaaaatatctggccaacacttaaataagcaggcaattttcacctgagtgcagctcaggcttggcaaccactgcaggtgctgaacagcagcgcttctcgtggaacccccacttctccgtgggcacgggcggctgttggactgtggtgcccttgggctgggccaggcctgactgggcagagccattccgcctgcctgggccttgcagagggcgggaagaggctggccctgcccaccccgccctcctcgggcccctcctggagcccgcccccgcccagcccaagctgccctctgccgtcgggttggggaggggacggtgcactccagacgccaagaggtcgaggacaggaggtgctgtcggtgtgcctgaggcagggggtccgccctgcgcccccccagccccaacgccagcccggacgccggtgggaaccgtgtgcctcctggatccaggggcctctgagtgaccgcagggccggggtcccctgtcaccccacggccagggcagggagcgcggacaccgggtcccaccggccctgccagttcctcttccgggctcgcgggctcccatggcctcgggcccagcgtggtgaccccgggggatggagccgttcctcaggaggcggctggcctcctgtccttcttctgggacaagatctggccggcgggcggcgagccggaccatggcaccccgggtccctggaccccaacactgacccagtgcccacgctccccgccgagccttgcagcccttccctcagctcttccttgcgctctatgacttcacggcgcggtgtggcggggagctgatgtccgccgcggggacaggctctgtgccctcgaagaggggggcggctacatcttcgcaccaggctttcgggccagcccagcgccgggctcgtgcccatcacccacgtggccaaggctttcctgagacgctctcagaccaaccgtgagtacctcggcctcggagtcagagcctgcctccccccagctggggagtccagaacaacggcaggattttgagttggaaatcgcatgtccgtgctatctgttcattcattcgttcatccacgcattcattcagggacagctgatgggccccggccggcaggtgtggtaggaaaacagcagtgtccgctgtgggctgccgagagggagaggggctccggcaggcgtggtcaggtcctgtgggggggagcatcagctgcaccagctggacaccagcaggcggttcctccaggaccctgcctggctggccaggccctcccgccctcacacaggagtccagtgttcatggatcggtcactgcttggagggcaggggctgggggctgggaggaccagatgacaggagctccaggagctctgggtgacggcaggtgagcaggggctgggggcgggggctgagacaggggcccatgctccaggaactctgggtgagggcaggtgagcaggggtgggggctgagacgggcccacgctccaggagctctgggtgaaggcaggtgagcaggggcgggactgggggctgagacaggggcccacgctccaggagctctgggtgagggcaggtgagaggggttgcagaggcgcctagtccagatgcccagtgcggctgctctgagcggctgccttgtctggcatccagctgggcaaggcctgagccctggagaccttcggggtcagccttgctcgggccacttccagcctcctgggggccctttggcactcacacatcgtcctgggggttgcagggcgggtgaagccggagtcacaggaaggggccttctgaggggccccaggccctcacccacacctgccccgcttgtcctgagcagtggttggggggcaagcagcctttgtgatgggaagggctcacagtcaccccaggtgtggaggacagaccccttcagcagttcctggagggcaggctcgtggtggagcagggcggtccataggcaaagctaatgactatttgcctaggctggaattaaaagactaaccacactcaggtgtcattagctccagacacctggccccacgccccaggagagacctcagacacatcctctgcatctcaggatcccacaggggctcacctctgaccccaagccctgatgtgggcttcagaggaggctggcgatgttttggggaaacacctgtgtccatccccacaccccacggtgctgggagggacctgagtccctttacacgtgagagggttggtctccctgccagcagaccccagaaggcaggggccctggctgcaggaggagctccatggcagagcgtccatggagtcagtgcctcaggccgctgcctctctgtccctggtcccacacccttcctgtctccatcttcattcccttcaacttaagcccagccccacggccctggtcatgcagtttctattcctgctgcccccattgccccctaggtcaccggggcaggggtgccagacgtgtcctccgtcttgcccagtcccagtctgccaggatggcatggccgtgccccagccccaatcttgtgttgactctgaggcccacctcgggtcctctcctagtcccgcttcccaggtgtttcagccccaccctgacaccggctcactctgcttcttcctcctggtgcttacggggtggccctggggcaggggagtggcaggcatccctctccgggtcccaggaagctccaggaagtggaggctccagggtgggaagctgagtcaggtgtggagtccccgccttggacttcagcagagagttatgcagacggggtggggctgggagcatttctgtcttccttccaaggatgcctcggctcccaggaatgagtagatgtgacctggtgggcggcccacctggacaggggagacccgccggcccctctcccgacacccggtgtgggctcctcgtgtgtgggcatctgaggagtggcacctgggagctccctgccaccctgccaccgtgttcagagaggtctcacctgcacctggttttccgagggggtgtctgtgcgaacagacgccagtgggcttagggccgtcctgtactggcacaactctccagcatgggatgcaggatgctttgaacgttcgcacagcaacccccctgagccgcccactggctgcccctcctgacctcctgcacagcctggcttaggctgcctcctcggacacagcttgcatgggccccctccactaaccaactgcctgaggcaggtgggccgtgccagccaggtgatgcccatggccctgtacagccacgacagcccagcagtgcttccgggcactcaccaggccgtcagctccatgtctgtgcaggggctcagcgaagccgagtttggaggctatggcccatggccagggctgactgttaacctgtggctggggctggcggtcactatgaaagggaactggaggtcacgcccagcagggctaacggagagcccacggccaacgtgaggatctcagggctgagcaggaggatgaggccggcactgggggctgaggcagtgcagaccttgactgggactcaaagtccacggggtggaccttctccctgaggcggtgggacagccgggctcgccctgccggcaacacggaggagagcatgtggggccactggctgaggggcctgcaaggtactgccgcacctgctgtttgcagctggtactttagcggggtcagtcggacccaggcacacagctgctcctctccccacccaacgaaccaggggccttcctcatccggcccagcgagagagcctcgggggctactcactgtcaggtacctggggcggcccctcctgcctctgtcccccccaggtcagtggcccttgaccttggggtggttggtctctaggcagtgctggctcctgatcacacccggcgccactgagggcccaacagcagatatgctggtcacctcctgcacttgctactcacccatttattcattcattcagtcattcacccactcattcattcagtcactcattacttgttcattcattcctcactcactaattcactcattcattcattcatccattcatctattcactcgttcattcctcactcactaattcactcattcattcatccattcatccactcttcactcgttcattcgtcactcactaattcactcatttattcactgatttgttcactagttattctttcactcatttgcttattcgttcattcattcattcacttttccttctttcctccttattccttcattcattcactgactcatggactcattcattctacaagtatttattagtgcctactctgtgcacaccgtcagcagaaaagctccaacctgggccgctctcgctgcccgccccagcctgtggctgcccacactccctcctccacacagctctgaccatctcagggtcccagctaggtctgagccagaccccttagtgggttgtggccagcatcctctggggtggggggtcggggcagctggcagccaaggcaggggtctccatctctgaacccttcctagtccggcccaggccaaggtctgccactaccgggtctccatggcagctgatggcagcctctacctcagaagggacggctctttcccggcctggaggagctgctcacctactacaaggccaactgaagctgatccagaaccccctgctgcagccctgcatgccccaggtgggcctgtgcctgccagctgccccatgctgggcccgaggcatggccctgttctaggtgctcctccccaccccgtacaaaacccctggggctgtcagaggcgcagctccagggccctgcccaggcctgggagcacggagcatcccagcggttccagcacattctgctctctgcgggtgcctctgagggttgttggattcctggggtcctagggggctgggagtggggaaaggagacctgtagcagtgcccagtctgcaggggagcagccaggagggtggggccagtttggggaaggcactcaaggctgcccaggccccaagggcggaaggtgtgggaggagaggcagatcacaagatgctgcacctgggcggagacactggatcccggggactgtccccgatgtgagccaccctgccgagggccagggcgcagtctggtttctctggtctcataatgacagcgcggccaggggcagtaatgagcatgttagacggatatccggctggggcaaaggtgccacttaggcccccagagcaatgagctccccggggctgggccgggcctccaagcctggcacccactcccctttgtcccagccagggtgggtgagtgtgtgctggggacaggggtgcccgccagaggcctggtgtggggggctgtgcctggacagagcacaggggcccacgctgaccagcctccctgcccaccctccctgcagaaggcccgaggcaggacgtgtgggagcggccacactccgaattcgcccttgggaggaagctggggaaggctactttggggaggtgtgggaaggcctgtggctgggctccctgcccgtggcgataaggtcatcaagtcaggtgaggccccgagatcctgcgccacggccgggccccgcacctgtgtccaaccctcaagccccagggcagtgatgttcgtggcgtgggccggtcctggagccaaccctctctcgcagccaacatgaagctcactgacctcgccaaggagatccagacactgagggcctgcggcacgagcggctcatccggctgcacgcagtgtgctcgggcggggagcctggtacatcgtcacggaactcatgcgcaaggggaacctgcaggccttcctgggcagtgagtccctccctgctgccacgtggccctgacgcgcctgcgaccgccccttccctcctggcgcaagctgaacctgcggggtttccgaggtgaaccgggcctctctaccgggagcaggtggcccggctgcagatcccatccctgtctggtctccagccaacagggggctggcgtcaggtctggccaggccagagccttgtggctccggggctggagctggtgttcgggggcggtggggggcgggtcccatctgggtcaccagccttggtctaatgtgacatagacccagcccagcctctggtcttctctgccctggtctttgtcgggggcctgggccggctgccgggtcactgtggtgagacaggaccctcgccctgtctcacttggggcttcccgtggccttagccggccatgccatctcgccacgtcttagagatgaggaggctgaggcatgggggaaggtgacgtgggtggacgcggcctcaccggccgttggccccgtgccctaaaagaccccgcgctgtctcctgcagccccgagggccgggccctgcgtctgccgccactcctgggctttgcctgccaggtggctgagggatgagctacctggaggagcagcgcgttgtgcaccgggacttggccgcccggaacgtgctgtggacgacggcctggcctgcaaggtggctgacttcggcctggcccggctgctcaaggtagcggaggctctgggcccctgacccagagggggtgggtgaggggaccccggtccacctgcctaccaggggccttccctcgcccccaggacgacatctactccccgagcagcagctccagatcccggtcaagtggacagcgcctgaggcggccaattatcgtgtcttctcccagaagtagacgtctggtccttcggcgtcctgctgcacgaggttttcacctatggccagtgtcccttgaaggtgggtccccaggcagccagagggaggatgcaggctctgcccaggagtcactggcccgggcctggacgctgtcggcaaggggttggagggtctggccaagggcaggcagatgaatggggggctacaggaggcctcctccatagggacccccaggcagaatcgaggcagctctgccccgcgcctcccagggatgaccaaccacgagacgctgcagcagatcatgcgagggtacggctgccgcgcccggctgcctgcccggcggaggtctacgtgctcatgctggagtgctgaggagcagccccgaggaacggccctccttcgccacgctgcgggagaagctgcacgccatcacagatgccacccctgagtcctcacgtgacccaacgctctgggctccagccaggccagccctcctccctgcagagcgccaactcgaagggatgccggtctgccggaccgaggagccttggctgtgggcctcaggccctggcgtgcacacatgttcgtgcaccaggcagacgtgcagcggagggctggggctgacgtcccccgtgcagtgtgactcgtgcagacggagggctggggtgacgtcccccatgcagtgtgactcgtgcagacgaagggctggggctgacgttccccgtcagtgtgactcgtgcagacggagggctggggctgacgttccccgtgcagtgtgacacgttccctggcctctcaagagagacaacggcacaggagggtgggtagaagcctcggaggctcgggtgaggaaccctgagccctgtgtgtctcctgcctgggtcccctggactccctcccaggtgaagagccaaaggcccagttctctccctagtcccagcttgggtttgtggaaatgaccgtgctgactcccaggcagaccgtggtgttgaccccactggatgtgtggtatgtaggcacgggtggcaccgtcacctgcccctcacagacacgctggcggcctgtgcacaaacccactccgcacacagcactcagtaagctgggactgacccactcagacacgcacacaggcgcacatacacacaggctcagccccccaaacccagacccaggagctggagcgtacgggtccacgtgctagaaaatgcaggttggagcggcccccatgccgcccggacccccagcccaggacatcaggtgcccagagagcgtgagccccaagggcattggcaggagctgccgattccatctccctggtgggttccaggtggcacaggaagggtgggccgggaggcttggtgacctgggagctgccttggaggctatttccaggggcctcagggtgggccgtgggggatttggagtcttctgccgtgcagggtcaggcagggtcggttgggggctcggaggtagatgccatggtatgctgggcgcaagtggctcaggaagcctctgggtgtgagtcctcgggggtcaccaaggcaggaggggcagggatgtgcagggtccgccctcgtctccccacgtctggctcagggaagcttctgctcggtcttcgtgaaacacgtcaagaagcaagggggccggtggggtctgtttgtggcccccgagaccctgccccccaccctcctgggagcccaggttggcagctgtgcccagaaggctttcgggacagaaagtttggagacaagttcaggcctgactgagtccttgtcccctagagttgggtcagctctgtacctgctgagccgaagtgctgatggctgccgtccacaggccccggccaagcctggctcaggagggagctaagagatgagactcccgtgtgcagagacaggtggccccgggaaggaagaggccactcggaggctccgagaacggaggcagcgcgggggcttcctgggcccgtgcatcggaggaacaaggccaagcggagggaagcagcaggaaccaggacccctgcgatggtggaggcaagaggctttatctgagcctttgggaccctggccacctgcccagctcatctgcatgggagaacctaggggaggggctggttctggtacctgggcccactgaggcctgagctgagcttccagttctggcaggtccccagcacagcagcctgggggctcctctggcaagaaggcctcgccctctgtgctctctgcagccgccactgggattaaggggaccaggtgttctgtggcacctgtgccctcctaggcatctcgccagccaccagctgaacaggtttggtgtcctgggtatctgggaggggctggggacgttcctgcctcctggtgtggcttagactgaagtcctgcacgtccgaactcagggatactcgaggcttcctggacatagactcacgggcccgagtctggccgggctctgagggacgctgcccggccaggtgccccggcaccctccttccgattccccaccccccacccctccccctgcatcctccccaaccgaccccagacagagctggagggcctgagggacactgcccaggccggcaccccgctgcccctccccaccttggtcagcctgagctgggctgcccagaaatctatgagcctgttaaataatccagattattgttcttatctcaaaacaatgagtggaaggtgccattatttctctttgcaataaaaataaaagttgaatacgcagtttagggactttccttaccaccccttgcagactttgaatttcccttcccgcccttcctgcccccttgtggctgccagtccaggtccctgggttggagctcccgggtggaccagtagggtcagtgggagggtggggcggggaggggcctccagggagggggtgtcccgagctcaggggctggggggcaggcggccgtcgggtgcaggtgggggtcacggcagggctcaccaggcatgagtcgggagaagggaggccagctggaagggggcaggggtcctgcgggctggcaggaggaggcagaggctggaggcgggaggggctgcctgggagggacctgtggccttggccccagcgccatgggcgcttccaggccgcactcacggtccttgcctgccccctggcgtcgtgtggaggaaggcagtgcccgtttcttcagccgtgggtgcccctggctctgcctccccgggatcccccaaaaccctcgggccctcctcttccgggaagtcctccgggccgacccacaagctgtcgctgccctgattccactccctcttccctgcttggcccttacccgagggcgggctgcccatgaggccgctctcaggacgcctgcccacagcagctcctgacattgggccctggctcaggggtggagtctggggctgggtgagggcaccgacgggtggaggggaagctgccgaagcggggagagaggcggcccccacctgtgcccccgcagctctgagggttgggaaggcacgcctgcagccctcaccttcctgccctcaggctgcgaggcttgttcccagagggccgttgcttccctgagtgcctgagtgtccataagttggacccccaagaagccccaaccgggaggcctcctccccctctcctgcgctcaggccggccctggcggtgcttgcccagtgggttccctagtgcgggcgctaagtgctcagatgggccccagtgggcctgaggacttgtggggccggtgggccctcaggaggagccggggtgctctggagcgcctgtgggtgctgggtgtggctgctcccggcctgtcatgaggaagtgggacggcccgcctgccacgcccagctctgggtgctcagctgggccacagcctggtcctgccgctgcgcccgcccgccatggtgtcccgggaccagctcacctgggccccaagtatgtgggcctctgggacttcaagtcccggacggacgaggagtgagcttccgcgcgggggacgtcttccacgtggccaggaaggaggagcagtggtggtggccacgctgctggacgaggcgggtggggccgtggcccagggctatgtgccccacaactactggccgagagggagacggtggagtcggaaccgtgcgtgtcctaggctgctgggagctttgcacaggccaccctctaggcacaggggagggacagggctctgggctgctcagggaggccaagaaggtggggaccccggttccatcttcctgcaccccaaagtccaggctgggcatccccttgatcctccctgcaggccccatgcgctggcgcccaggagtgcccaggactgtccctggggagttggagcacgggggtcagagggcacggcccctgccttgggctcatccttgtcacgctcgggggtggacgctgcattgccgggacccagggaggacagagggtccagggtggactctggggcccggtggccagtgacaaggtctgtcggagcgttccagggcctttgggggaacgaagcttgaagcttgcccagtttccaaagtgccggaaccagacacacgacctagttagggagcgggccggctgccgggcaaacttcctgcctgctgtgccctgcggggaaccagacacagctggtgtggcctggccctggcttccacagctgcccggagctcaggctgaggagggtacgctcctgagatcccgcgtttctcatcagtgattgggcacccactgtgtgtgtgcgtggtcacaggctgtgtagggttagctcccgggggacccaagcaacaagcaggggaggctgtaagaggccgtcgggcaggggcccatggtggagacccctctattacgtgcagacccacgactcgttagcagggtcacgcgcagacccacgacctcgttagtgagcaggggtgcaggggtgggtctggccggaggctggtcagctcccaggtgcaaagaccctgagtcctgagaactcgccaggtgagaagtggggaggaggccaggtgaggagggggtgggaggccaggtggagggggagcgggaggctaggtggggggggctggaggccaggtgagggggggcgggaggccaggtgggggggcgggagaccaggagaggaggggacgggaggccaggagaggagggggcgggagccaggagaggagggggcgggaggccaggtgaggagggggcgggaggccaggtgagggggggcgggaggccaggtgaggggggtgcgggaggccaggtgaggacggggtgggaggccagtgaggggggggcgggaggccaggtgaggagggggcgggaggccaggtgaggagggggcggaggccaggtgagggggggggcgggaggccaggtgaggagggggcgggaggccaggtgagagggggcgggaggccaggtgagggggggggcgggaggccaggtggttggaggggcaggggggcagtgcttccaggtgtgcggaagtggagggggtggaccccaggggctccatgctggccgtggtcttctgtgtggggtttgtgttccagtgacctgagggagtcagacacacaaaggcgcaggtcacctggagcttctgcaagctccacctggaagtccacagtccagggctggccacaccccgcagccgggagttagtgcgcgcgagtggctgtgtgtgcgtgcgtgtgagctgtgggcaagtgagcacacatgcgcgtgtgtgttcaggtgtgcgggtgaactgtgcgcagtgtgggggtttgtgactgtgtgtgtgtgagcgtgcgtcacacatgggtgtgtgcaggcgctctgggcagccatcctgctcagctgccctccccagctccaccctaggctctgaccccagactcgggccactcagggcagggtgtggtagcgcctgcccctgcccccgccgggtcctaggggcctgtcctggcctttcgggacattcagggcgtctgggtcagcgacagctcctgaagcagctgtggtcagggctgggagcttgaggtggcaggcaagggcggctggggttccagcgggcaggctggggccagcgtggggtccacgtggggtgggcccaggtccgcgtgttctcgactcctcccctgcaggtggttctttggctgcatctcccgctcggaagctgtgcgtcggtgcaggccgagggcaacgccacgggcgccttcctgatcagggtcagcgagaagccgagtccgactacgtcctgtcgggtgcggccccggcctccgagcctgtgcttgcctgcgggggccctggctctaagccctcccagccacgtggtgaacccggctcgctctggctgagacggggacatgggctcctctccagggagctcccatcccctccgcccacctggcccgctcctccctgggcctgggtcactggctgctagggtagtcgtggggcagggcccctccctgggagggcagggcttctccagccagccctgcccgaggcactcgtgggaggtcctcagcacccatgggacctcgcccagcatgagacctgagcctggggtgtgcggggcgcagagaaaccccatccctcccctgaggatctcagcatggctgggattttaggcagctgccatccaggcggaggccacggctgcctggcacgggggcaggaggggccagagagcttggccagagcgtgcagggcagggggagccgttctgagggaggggaggcaggggtggtactgaggaagcaccaacagcaacttggggacccagaaactctgcgcaggtgtggccagcagggctggggacgcagggaggcgtggagttggggtggccacacagctcacgctctccctcccagtgcgggacacgcaggctgtcggcactacaagatctggcggcgtgccgggggccggctgcacctgaacgaggcggtgtcttcctcagcctgcccgagcttgtgaactaccacagggcccagagcctgtcccacggcctcggctggccgcgccctgccggaaggtagccgctccgccctgacttggtcacgcggggtcggctggggggtcacaggctggcatttcctactgggagaggttggccgggcagcatgggagggtcctgactcactgacctggggcccactggagggaagcccatggttctgcagagcacggtgtttgcctgagttgggggtggggccaggagaccatccccgggcctggccactctcgagaggccagcggcactctgcagggtcctggctccggtctgtctgggtgtttcatgctggctgggggcagcccccaggagagtccacccttgtgtcagacactcagaaacccccaacccggctgatcgtggccctaaatctgaggctaaatccaggctccctgtgctggcttcagactgcacttcctgaaggatgagcccctgccctgtgtccccgactcttcctccagcacgagccgagcccctgccccattgggatgactgggagaggccgagggaggagttcacgctctgcagaagctggggtccggctactttggggaggtcttcgaggggctctggaaagaccgggtccagtggccattaaggtgatttctcgaggtgagtgggccccgatcagggctctgtgtggcccgtgcctgccctgggccaccctcccaccccgccaacagggacctctggcctcgagccccagcagcacccacagcgtccatgcgagagtggttccctttcaattgcacctatgtttttactaaatacatttattataaaagaaaattttaggccgggcacggtggctcacatctgtaatcccacactttgggaagccaaggtgggcggatcacgaggtcaggagtttgagaccagcctgccaacatggggaaaccacgtctctactaaaaatacaaaaattagccgagtgtggaggctgtgcctgtagtcccagctactcgggaggctgaggcaggagaatcgcttcaacccaggagcggagattgcagtgagctgagatcgcgccattgcactccagcctgggcgacagagcaaaccccgtcttgggaaaaaaaaaaaagaaagaaagaaagaaaatttaaaatccttgacgtatggaaagccattaaaatagatcactggaaatgggtaaaacttccctggaacccgtctggccccagcagaggtctggcctctatgtcagaggtctgggccgggcacaggaagaaatcggtggccaccacagccccgtgggtacgccaggctggggccctgtggggccggctgcatctccatttcgtggcctcgggagccaggtgccctgtcgggggcaggaggtctgtgtgtcctgacagctgctgggtgtgatggctgctgtgtgtgggggcagggccttggcctcttccttgggcctggggggtcaggggctgcatccaccgaggccacccgtccccgcagacaacctcctgaccagcagatgctgcagtcggagatccaggccatgaagaagctgcggcacaaacacatctggcgctgtacgccgtggtgtccgtgggggaccccgtgtacatcatcacggagctcatgccaagggcagcctgctggagctgctccgcggtgagtggcatgggccggggctcttgctgaggcagcgggggcacgtgaggaaataaagtgcacacccccccccacgtctacacacacaacacgtagacacacagacacacagacacacacatgcacacacagacacagacacagacaacagagacacacacgcacagacacacatgcacacacacatgcacacagacatacacatgacacacagacacacacacaagacacatcacatgacacacacagacatacacatagacacgacacacacacagagacacacaaaacagatcacacggacacacacagacacacacacagtcacacggacacacacagacacacacacacacagacacacactgatccagacacacacaagacacacacagatcacattggctcaaagacttcatcctctctaagttccattatttccttctcaccaaaaccaaagacaatcgctgccagggaatggagatgcccgtgcgtgaaggccagtttggattccgatgttagaatgggagggaacgttgtggtataggaaaaatgccgtggtgtctgaggagagctacactgaggcaccacgcacgtttgcgctctgagcgaaaggctcgtacccctcgccctcacacaaagggcttgatcatctcagacagtccccacgcccttcaggtcctccgggagggaatgtggggtaaaacaggcaccaccaggccgcaagccgctgacagcattctcctgttcgagttcccactgcctacatcacgcagtcatgagcctcttcgctggtcttctgcgtccagctcctcccgcgtcatcacaaacttccagaagggaaatcgctgggctgaccactaggaactgctccttggttcttttttttttttttgagacggagtctcactctgcgcccaggctggagtgcaatggcgcagtctcggctcactgtaacctccacctcctgggtcaaatgattctcctgcctcagccacctgagtagctgagattacaggcacctgtcaccaccccagctaattatatatatatatatatatatattttttttttttttttttttttgagacgagtctggctctgtcgcccaggctggagtgcagtggcgtgatctcggctcactgcaagcccgcctcccgggttcacgccattctcctgcctcagcctcccgagtagctgggactacagcgcccgccaccacgcccggctaattttttgtatttttagtagagatggggtttcaccgtttagccaggatggtctcgatctcctgacctcgtgatccatccgcctcagcctctcaaaggctgggattacaggcgtgagccaccacgcccagcttgctccttggttcgtgataaacagtgccttccagaagggcggtagctggcctgcagttccaattttcaatcaggccagctgcctttgccccggcccctcctctgagcccgcagagcttggaggcagatgagacatggcccagctccccaacccttccccacctcagctggctcagctgaccccaggctctgctccactccctctgcagactctgatgagaaagtcctgcccgtttcggagctgctggacatcgcctggcagtggctgagggcatgtgttacctggagtcgcagaattacatccaccgggacctggccgcaggaacatcctcgtcggggaaaacaccctctgcaaagttggggacttcgggttagccagcttatcaaggtagggccctcagagggcgtggctggggtcgtggccggggcgtggccggaggctgggggcttcctgtgtgtggagctggggactcggctgggagcaggatgcggcccctccctcgggagcccaggctgggcagggaggtgggaagccaccgtgagtccggtggggccccattctgaatggcacgcacagcagggcccaccacgcagccgctgccttgttcacgtgcctgttcactggcccagccctgggcccctctgacggcctgggagcctcccagttccctgtccccgggccctccggtccccacacacctgcaatcccaggggaagttgggctcctgaaggtgtcaggccccagtgtggccttagctgcagcggccgtgcgtgggtcagacagtggggtcacaccgtcccactgctggggcaatgcggccgctgtgcccgtccatgcttcgggggcagggacaggcagcccccacggcccactcagctccaggctgattgcaggaggacgtctacctctccatgaccacaatatcccctacaagtggacggcccctgaagcgctctcccgaggccattctccaccaaatccgacgtctggtcctttgggattctcctgcatgagatgttcagcagggtcaggtgccctacccaggtactgtccccactgtccctgactgggcatgagaggcagagtggggaggtcctgggtagccggcagggacgctggggggtgcctcccccacgggcttcaggccctccgcgggccatcgcctgaactccacacctgcaccattctctgagcacccaggctgtgcctggagctgcctgttggagccctgtccagagggaggtgttagcagtggacagtgtgtgggtggcgccaaggcatggcagctgaggctgcggggaaggccccaggaaggggcagtgatggctggtgtggcttcttgggggagggtaggcaggtgggccccagctcttctcatcccgtcggccgcaggcatgtccaaccatgaggccttcctgagggtggacgccggctaccgcagccctgccctctggagtgcccgcccagcgtgcacaagctgatgctgacatgctggtgcaggaccccgagcagagaccctgcttcaaggccctgcgggagaggctctccagcttcaccactacgagaacccgacctgagctgctgtggagcgggcatggccgggccctgctgaggagggcctgggcagagggcctggacctgggatcaaggcccacgcgcttccctggggtttactgggtgatgggtgcaggaaaggttcacaaatgtggagtgtctgcgtccaatacacgcgtgtctcctctccttactccatcgtgtgtgccttgggtctcagctgctgacacgcagcctgcttggagcctgcagatgagatccgggagactgacacgaagccagcagaggtcagaggggacctgaccacagcccgctctctggctgtctgtctgcagtgcccggctgagggtgggaggcaacacgccttgttcctgctcttcccagttcagcttggtgggagaaagtcattcgcgtggccgggacgctcatgtaaatttggttttggtgctcaagggttctttcctcccaggggcagggtttctttcctgtttgtcttgtgtcttgagagcttggccttatgaccagtgagaactcttccctggtctctgccagcccaagcatcactgcccgaggcgccagctcagtttcaccgtcacgtccacaaggggcttttcccaccttcacctttgtcgctgggtcagtgctggaaagcgccctcactcctgcgctgacaagggcccttctctactgtctgtggggtggttccgggctggggggctgcctcctttgcacctgattttgaaggtgtctctttcatccatggttaagtcaaaaaagcttattggttttggttttgactcacctgaaagtttttttggtttaaaagaagataggcggggcacggtggctcatgcctgtaatcccagcactttgggaggctgaggcaggtgatcacgaggtcaggagatcgacaccatcctggctaacacggtgaaaccccgtctctacaaaaaatacaaaaaattagctgggtgtggtggtgggggtgggcgcctgtagtcccagctcgtgggaggctgaggcagcagactggtgtgaacccgggaggtggagcttgcagtgagccagatcgcgccactgcactccagcctgggcgacagagcgagactccatctcaaaaaaaaaaaaaaaaaaagaaagaaagaaaaataattttgggagtttctggaaaggtactaggattttcaaaaggatttgtcttctgccttgtgaaagacagatgtcagactaatcaggcttatccatgtgctacatgagatggaaagcgtgtgaaatagtaagtcacactaagtcttctggaggtctatttacgggtttggttttgatatgaatgttgcagaaactctataaaattcctagaatctgatacgttatcctatgatatatatcctatctcacatgctattcctagaaatctggtcaatgttatcagtcataattttggttattacattaaaatgctgcatgccacagaaataacaagtttccttgccaaccgtgtcacgaatataataaactctcatcagatcctgagccatgctatcttaagtcttcggtcattcacagttattatcttactttgattttttctgaaagcttgcaatcagctagtcccaaattgtttattcttcaaagagattcctgggaaggattctgcaggtgctctggagcacaggtttctggttcaggtcatagccttggattgggtgcaaattccagaactcgaaggagggacctggcaggtccatgaaagttctgtcccaggatcaaccagacaagaattaatgacatgggaatgaatgaactgacgaggatgtttactgtttaatgactttgtctgaagcattacggttctttaatattttgttttccagatgtaagaaaacgtttttgtttctgtttttgtttttgaagacagggtcttgctctgtcacccaggctggagcgcagtgcgtgaccacagctcattgcagccttgaattcccaggctcaagtgatcctcccgcctcacctcctgaatagttgggactacaggaatgcaccaccacacctggctaattttaaattttttttttttaggagattcagggtcttgctatgttgcccaggctggtctcgaactcctgggtctagcaatcctcctgcctcgggactacaggcctgagctgctgcgcccagcctgggcacaaagccgtctgtacgagagttgctggggaaatttctctgaagtctgtatcaagtggggcgcttcagcttacagggctttgggaaaagagcagttttaattttcagtgactccatgaggatggtggaagaaaaaattggaaagagtggtttggtgagctgtaggcaaatattggaggaactgaagttcaggacccggtccggaccacaggtgggcgacaaaacctccagacagcaaacgggctagagtctaatagtgggggcacgagttttattttgaaacataatttttctctctcagtcaacaaatttctttttctttttttttttttgagatagagtttcgctcttattgcaaggctggagtgcaatggcttgatctcggctcacggcaacctctgcctcccgggttcaaggattctcctgcctcagcctcccgagtagctgggattacaggcatgcgccaccacgcccactaatttttgtactttcagtagagatggggtttcttcacgttggtcaggttggtctcgactcccgacctcaggtgatccacccacctcggcctcccaaaatgctgggattacaggtgtagccaccgcacccagccaacaaatttccttcttcctttttttttttgagatggagtctcctctgtcgcccaggctggagtgcaatggcgcaatattggctcactgcaacctctgcctccgggttcaagtgattctcctgcctcagcctcccaagtctctgggattacaggtgcctgcaccacgcccgactaatttttgtatttttagtagagatagggttttgccatgttggccagctggtctcgaactcctgacctcaggtgatccgcccacctcggcttcccaaagtgctgggttacaggtgtgagccaccgtgaccggctgcaaattaacgcatttctatcaaagataataaagtaggattgttttcaaattaacacatttctatcaaagataataaaagattgatttgatgcagagtaagtttggcctcagtaaacctggtgtggttatttatgtaagtggaacaagatagtgattaaccacataggttcttcctcatttttgttttccaacagggcctcaccctgtaccgaggctggagtgcagtggtaccatcatggttcactgctgccttgacctcctgggctaagccaccttccagccccaccctccagagtagctgggacgacaggcatgtgacaccacactggctaatttatttgtattttagtagagagggagccccactatgttgcccaggccagtctgaactcctgggctcaagcaaacctcccatctcaggctcccaaagtgctgggattatagtacacctggacacgtgggctcttttaaaatttgctttactggaactttttttttttttttcctgagacggagtcttgctctgtcgcccaggctggagtgcagtggcgcgatctcggccactgcaagctccgtctcccgggttcatgccattcttctgcctcagcctcccgcatagcgggactacaggcacccgccaccatgcccggctaatttttttatttttagtagagacgggtttcaccgtgttagccaggatggtctcgatctcctgacctcgtgatctgcccaccgtggctcccaaagtgctgggattacaggtgtgagccactgtgcctggcctactggaacttttttaaggaatctgagattgggcttttaaaagcctcttgaggctaggaagccatcgcaaagattgccatcagactttgcctgcaataagtacagatttaggggaattcctctcttcttgagtccctaaggtatcttaagattctgggacctgccaggaattgacattctttactcatctgaagggaaccacgtatgtgaggtaccaggccagcttttttccaaggggctttattggacctgcagtcaaccctaactcctttagtcgtatctgaaaataggacattccagtcaaagcctggtaatataaccaatgttttcaattgtgccctattacaagaacagattctcattgaactatgcaaacccactaacagtttctgaattctgggattagggaggaagaaaaagataaatattcaccgttgaggccattctaacctccctgcctttcttccctgaagcaggccataaaaccaggaaggccactcccagaccctctccctgcagaccctcacgtggtgtcccgccccctaccagaggaaagggatgtcagagtcaagtcgggccttgatcacacccttccatcctccgccactcctgctccgctgtgaaatagaccatttctttggtctttgttttgaaggggcccactcacatggaactcgcattaaatgtttgtatgctttttcttttttttttttaagacagagcttgctctctgacgcccaggctggagtgcagtagcgcaatcttggctcaccgcagcctcgcctcccgggctcaggggatcctcccatctcagcctccccagtagctgggactccaggctgcaccgccacgtctggctaatttttttgtttttgatagaaacagggttttgccgtgttgttgccatgttgaccaagctggacttgaagtcccggcttctagtgatccacctgcctcacctcccaaagtgttgggaatataggcgtgagccactgcgcccagtttaatctgtcttttttcaagggtctgttggatacagtgagttctagatttctcttagaggactcagcatgtatttcagttctttgttctccatttaactcgtgcatagtttcagtaaacaaccttttccaccgttttaatcaatagttcacatctgttcccctggtcacctgctccgtcctgactcatcctgtacctgtttttttttttttttttttttgagatggagtctcgctctgttgcccaggctgagtgcagtggtgcgatgtccgctcactgcaagctccgccccccgggttcctgccattctctgcctcagcctcccgagtagctgggactacaggtgcccgccaccacgcctggctaatttttttgtatttttagtagagacggggtttcaccacgtttgccaagatggtctcgatctctgacctcatgatccacccgcctcggcctcccaaagtgctgggattacaggcgtgagccacgcacccggcccctggtcacctgctctgacctaagtcatctttagctacctgttcctgtcttcctgccaaactactcaccccaccactctgggtcacacccctgctctctttaaaatatcaatcagaattaccttagagtgtgcagtccaaccccacccaacaggggaatgacacagcgtagaggctacctgtgtcaggaataagaaccccttcccctcccttgtccaggtgcgcttcaccattgctccatccgcgagtcgcacccttctatagaagtaaaaattgccttgctgaaaaattaatgtttgagtgctatttctttgtggcaccgaggaagcattttgtttctaacagtctcagccatgaagcttgtgatgggtgaggaaaagatatgacttctccccctacagagatctgatgagggtgcagctcccaggaacaggccatggacacccccagggttgtgaggtctccagtcaaggggccccctgacccgaggcaggggacgatgccgcgggcagcctgtggctggctgctccctactcccagctgccccttccaacaagacaccagctcccgggcagtgccctcccccgctgactccaaaagccaggacagcttctttccaagcagggtggacccacccttgtcctgaccccaagccctccagctcagccaagggcggagcccccccaggccatgtgtggggggacctgagcgtggctgggctctcccttcaacaccaactcctgctaccctcacagcttgtgtacatggaggagggtctctgtgggcttcatctggacactgcaaaaggctgcaggggctcaactgccattaggagcagcctcccactcctgggtccatcggaggctcccccacccgcctcagcactgaccaccggcttggatggctgggtgaggctgcctccaccctgtggacagacaaaggctcagccatcagaggccacaagccagatgccttcccaccagcttcccaccactagtacagctatttatagtgcagtggaacagggtaccaggcagggagcacccactgatcccacccctccccagagtccctcccccaccactgaaccccaccctttcccaccccacggggcccctcctctcaccatgtccctggccacacatcaagtctccagctatctcactgactccacctgctcactaagctgcctctcaacagaactgagtcaatccctgtaggctcctggcgaggtgtggggacaccacccaccttggttatgaaggagtctactaagctcacagcccatcactcctgtgtgtggacccccatccctgccagcctgcagcactcccggactccaacactcatgcctataccaggccagaatgatgcagccaccctcactttaagctgggctgcctgtgcaggaagacccctccacggtgcctgcagcccctacccctcagcctgtcttggggcaacaccctatgggaggcccttgggagacacctaccagcaggaaccaggtccctccagagtgaggcttcccagctcacagccagaggctactccccgccccgcaggccctcgggtaaggggccgaatccctcagaggaccagccctccctgctccctttccccccgctaaaggtggcacggggcccacctcagtggctgccctgggtcctgcttgtccagctccaggactgcctgctgtccaggctctccagaagcagcagtgaaccccacccttatcagccccagcaacagcctcacaggtgaggaggcccagaaaggcctgggagcagggccagcccccacaaggcagtgaggtcggagggattcagccatttctcacactcaaatggaacctcgggccacacagctcaggcacacccatcggggctactggctgcttggagtttattttccgcttggtgccaggtgcacagttcaggtgtcaggaaagctagcgagtgctggggccgggcggtagagagcggggctctcactgtttttggtgtctgctgtgttgatgcgaaggtctgcttgctgcagccgcctagtttacaggtggggggtgggaggtggggaggggggcgagggatgcggagtggggagaggggcggggagggctctggtggactagcgcctccgcaggcctggggctggtggtaaccgctcaggtcagacgggggcccagcgctggctgtgctggactgaccgccgggctgcttcctcggggcgtccgagccaggccacaggcggtcatgctgctggaggcctggggaggttccgagtgctctgcgactccaacaccgtggccatgaacgggagggtggacttcccgaaaaagaagctggcccacaatgacccgggtcagccttggggagacctgagagaagcgaagtggggtcttgatgctgcagctcctggaggagcggggggagaaaggggcgatcctgcactcacctggggggtggggatggcttccccggggcactcggtactgctgcaggagctgttgctggaagtggaacccaggggcctggagaggagaggtcccgtcagcaacgcggggcgcggagccccccagcccaccggcttcaggccgagcgctggttccgcagcctgcacggggccggcactggcgccagcagagctccgcgtggatggggggcaggggctactcacgccggtagtagtcgtgggtggccacgaggagccgctggaggggatggccgccatgctttagcttgctggctggtgggatctgcgcatggggtggaggagcccctcgggtcagcggccttccgtcatgaagggcgctccccagcgggggagccgccgcgctgggttatttaccgaggcggggctccccagctcccggcaccgccttgccgcgcggggcgcgggcggctccaaccagcccaaaccggccgagcgggtggaacaaagcgctttgtgcgcggggccccggcccagacgtcgggaacctggtgggcgccgtcccaaccgcccgacccgagaggagcccgccggggaccccgagcccagcgctcgccaggcggagagggaggagcccccggcccagccccgcccctcgccccccgcccctcgggcctgctcgtcccaccgcgcgcggcgcccctcacctgggcggcgacccctcgcgggcctcggcgcacgatcacggtggcggggacgggggcgctaggccacggagcccatttgcagagaagaccgcgggaagcgcgccacgacagagaggcgcgcgcggggtgcgcacgcgcggacgcgcccacttatatggcgggggccgcggcgcgtcacggagggcggggcgcacaggctcctccccgggccccaccggccccgcccctttcctggccccggcgaggccgcgcccccagcttccacctcggtgcgatctcgccgtctggcttgggctgagcccagccctgcggcgttcgtcttggggcggcccggcggtcctgggtctgcaggggttaaaaggccccgcgcccgggtccgggagcccagccccccccctctcccgggcccaggcccccgtctcggacgcgtctcggagccccgcctggtccagccgcccgtcctcttcagcccttgtggaggcgacgggggcgccgggcgggccaaaaagtgtacgtgcgcggagccctccggcccggcctccagggacttcgcagccagaggaacctggactctcccgagtccccctcacagctctggcagctccggaacctgcaccccggttgcccagcccaggacgcgcctgctgcccgcagggggcggtgaaagggtgggcggatggcggggcaggggaggcggggcccagtcggagagcggggcggatttgggcgggtgaggtgagtctccagcgccggaggcagaggctgggccccactgctcggagaccccatgtttggggagcccagaggttcccggcagggccctggggcccgggggacggcccgccatgccaatcaggagggggcggttttcccttcccaggcagaaaggcgtcctccctctcctcctccccccagcgcagaatctccccacacctccctcggccccgcaggggaaatcggcctgcccctacggaaatcccgttctttatacacccggtcctggctgggcggtgtcttccccgtggaagagagggtccgggagtccgtggggcggaacagtccgagggcttcgggagtcagcccgggtggatttgtttcgtgctctcgttgctggctgggacggccgtgtgcccgtgttgttccggagatcgaggccaacgatgccgtactctgtcctcgccgggtgctcagtgaggacccacagctgggcagggaccctggaggcccctgagcaagacttggagggacgcccttgtgccccctgagcacgtggggaagcgctgtcctgggccctgcaccgctctgtgtgttcattgcacgagtgtggtaagcacctatatgtgcacatggccgagccaagcgcagggaacggtaaaccaagggagaacggccttccgtggggagcagtgcagaggctggcgggggcgggtggtggggagagctcaggtttcagctaggtctaaggacggagggcagggaaccgcctgagccccacctgggagggggagctcggtccggagagcagtgccaggacctgcgatgggagaggtgtgcagccccgaggggtcactgagaggcagacgggtcagttgggttgacactcagagggtcctcaggggcagacgctgagacgggtttggggtttggggtgcagagtgagtactggtgatcagcacctgggaaggggtgggagggtgcagggccgggcagggactgtaggggcggcctgcgttgggcttggctggcacagctttgtggcttgcttggacccatatgcagccgcccagggacgggagaccctggtgaggttctgtggtccaggcccaccctgaaggagccgtggggccgactgccgaccacgcctgacacacggccttccaggtcacccgcttccctctaggctggcctgacccagctcacctcattccaacctcaccagtcaacaccggtcaacatcagtcacagagcgtctgaaaggaggaatttcattttcctttaaagtgaaaaggtaaaaactgcatttactaaaccaggccggtgggggcctgtgagcccctctgcacaggaagcctcagagacgctgcatggtgttcccggggcatccggccaaggtgggagaacgcagcctccgtgaggacccgcgggatgccctcgggggccgcccctggttctcgtctcctctgaagtgcagacgacgctggcccacatccttgtcgggcagagggctgccgactggcccctggccatggctcttgctgggagccgtgtggcctgggcttggcccacatccacctcttgctggctgcctgctcttgccagtggctgagcctggcttctccctgacagtggccgcagacagaggggacccgtgccaccaggcaaggtgagctcagggaacgtagctctcctctcccttggctctgaggggttcggcggtgcccttggtgtgtctgggggctttgggaagtcccaggtctgggctctgggtcaggaagcaggagcgaggagagacactgccccgagcctccccggctgtaggaaatgggggcagaaaagctaagcggacggaagatgcatgtgcgcaagctatagcaggccggttcaggcccggttgctgctaggatgtgatcattggagggatgagattgacggggacggtcagctggagaggacagggcacagctggacgagggcgggacggccacaggcttcccacagggcgggagggaaaggcttccagtcccacttgtaaggctgcctgccaccctgtagccactgtctcctcccttgtggacgggacgatggtggcacctgttatggttgggttaacatacatatgttaagaatgcgttaaccccagcgtgtggggagactagatgggagaggcccctagtgcggaggctcacagccttgctcggcccctgggagcttcgccacctgcactgtgctcctcccacaggtgtctgggggcgaggtgagagttctgccaagccggagccagggttggacccccggagctcgttggtcggcccctggagggagagtggttgttcacaccacggccctggtggcccagctctgcccatcttcatcccaggtggcagctgtgcccagctctctggccagtgcctcttagatggtgtcaccacctgcagaagaaaacagagtgctgactaatatttgatgaaggcctgctatgccggcggcacctgatgtggcaggtgagtccggggggcagcagccaaggctgcctgttcctcagtgtccctgcgcgtgagacgggctagctaactcctgtggccaccttgagggtaagatgcttcctgcaggtgcttggaccagttctggcacggggcaggtgctcagcgaaagttccttattaatccctgtacctttcactgtggaagtaactcaggacattggcttggtggttacacaagcactgtgggagaaggtggtgttctgttcaccctgggtcccagtggctgaggcagagccagccatgcaggaggcaggcgtcagtatgtatattggatggaaggttgaattgcataataaaatatattaaagatttccagatggaggggtgaggaggtcaacaaaccctctctccaaaatgtacctgtaaatctaaacaaagtcagaaacaaccatgtcagtgctttggaatttaaccaaaggcaaacagcaaaccaagagtgtttattcatcaaagagccacgcgctgtggtcccagccactcaggaagctgaggcagagggtcactggagcccaggagctggaagctgcagtgaattacgatggcacctgctctcagcctgggtgacagagagagaccccatctctaaaaagaataaaaccctggacttaggataaatccaaaattacttggcataactgaaccaggaaaatctcaacttaaatggaaaacgagccgggcacggtggctcacgcctgtaatcccagcactttgagaggccgaggtgggcggacacgaggtcaggagatcgagaccatcctggctaacatggtgaaaacccatctccactaaaaattacaaaaaaattagccgggcgtggtggcgggcgcctgtagtcccagctacctgggggctgaggcaggagaatggtgtgaacccaggaggtggagcttgcggtgagccaagatcggccactgcactccagcctgggtgacagagcgagactccgcctcaaaaaaaaaaaaaaaaaaagaataaaaccctacactttaggataaaatccaaaattacttggcataagtgaaccagaaaatctcagttgctgggcatggtggctcatgcctgtaatcccagcactttgggaggcgaggcaggcagatcacctgaagtcaggagtttgagaccagcctgaccaatatggcaaaacccatctctactaaaaatacaaaaattagccgggcatggtgtcgggcacctgtaatcccgctacttgggaggctgaggcaggagaatctcttgaacctgggaggtggaggttgcagtggctgagatcacaccattccagcctgggcgacagagcaagactccatctccaaaaaaaatataataataatacaaaattagccaggcgtggtggtgcatgcctgtaatcccaactactcggaggctgaggcgggagaattgcttgaaacctggaggtggaggttgcagtgagctgagatgcgccattgcactccagcctgggcaacaagagtgaactccatctcaaaaaaaccccgaaaaacaaataaatggaaaaaaacagtcagcaaatgctaacactgagatggcacaggtgcgggatttgtaaaaatgcaccaacctgcagttgtaagccccttacatcaagcgatggacatgagcgagcattggacaacatttagtgtgcgttcacggtgaacatctcggcaaagcaggacagaaaacaacttcaatctaagaaagagctctgatgaagtatttacagccagtgctgtctgaggtgagagaatccttttcccaggactgagagcaggacgagcgcatccactcctaccctattatcaacatttaccggccgggcgcggtggctcacaactgtaatcccagcactttggaggccaaggcgggtggatcactggaagtcatgagttcaagacccgcctggccaaggtgtgaaaccccatctgtactaaaaaacaaacaaacaaacaaaaaacatgctaggtgtggtgtgcgtgccagtagtcccagctactcaggagacttaggcaggattgcttgaacccaggagtggaggttgcagtgagccgagatcatgccactgcactccagcctgggtgacacagtgaaccctgtctcaaaaaacaaaaacaataacaacaacaaaaaagccatctattggaagtctagtcagtaaaatacaagagaagcaaagtacaggcatacagattgaaaatgaagaaataacctctcccgattcccagacaacatgattgtctatgtagaaaatcccaaggaatctacaaaaagcaaactcagtgaataagtggggttagcaagatggcaatatacaaagtcaacatgcaaaatccattgtatttgacatgatttggctgtgagtccccaactgcatgttgaattgtgtccccagtgttggaggtggagcctggtgggaggtgattgggtcatgagggtggtttctatttctttctttcttttttttttttttttttgagacagagtctcgctttgtcccccaggcggagtgcagtggcccgatttcagctcactgcaacctccgcgtcctgggttcaagcaatttcctgcctcagcctcccgagtagctgggactataggcgcccgccaccatgcctggctaattttttttttttttgtatttttagtggagacggggtttcaccatattggccaggctggttcaaactcctgaccttgtgatccgcccgcctcggcctcccaaagtgctggggtgtcagggtgagccactgcgcccggcctcatgttggtggtttctaatggtttggcaccattcccgatgctgtctggttatagagttctcacgagacctggtggtttgaaagtgtgtagcaactccccttcactctcttcctgctgccacgtgaagatgtgcttgcttcccctttgcctttcacctgattgtaagttccctgaggcctcctgtacagcctgcagaactgtgagtcaattaaacccttttctttataaattacccagtcttaggtagttctttatagcagtgcaaggacaaactatacagtatttctacctgcaatgtacagttagaatcagaaatttaaaaaaatgaaatgtaatgaaagtatcaagacccaggcaaacggagagacatgctgtgttcctgggttttggaccaacagtagagatactgatttttgccatgttgatttatacattaaatgcaattccagtaaaatctcagccacattttctgaagatatagacaagcagttcccacaattaaaatggaaaatgaactagaacaactacaacaattttggaaaataatgatacagaggccgggtgcggagctcacgcctataatcccagcactttgggaggccgaggcaggcggatcacttgaggtcagagttcaagaccagcctggccaacatggtgaaaccccgtctctacaaaaaatacaaaaatagccaggcctggtggtgcacacctgtaatcccagctactcaggaggctgaggcagaagattgcttgaacctggaaggtggaggttgcggtgagccaagatcacaccactgcactccagctgggtgacagagcgagactctatctcaaagataatgatatagagaaattatgctacctaataatttttgttgaggtaaaattcccatatcataaaattaagcattttaaaatatgcattcagtagcatcatggaacactcgcaatgcagtgcacccatcacctctgactagttccaaacatttcatctccccaaaaggaaactacacccattaaacagtctcttcccctgtcccctccccagcccctggcaaccactaatatgctttctgtgtctctgaatttacctattctgacacatcatacaaatggaatcatacgagttgtgccttttgtttctggtttcttcacccactttctagattcattttttgtggctgaatagcattcctttgtatggatagaccacatttcctctccatccatttatggacgtcagttgtttccaccttttggatattataaatagtgctttgcaaacattccatgtacaagtttttgtttgaatacctgttttcaactcttttgggtcgtacttaggagtggaattgctggctcacacatcgctgtctatgtttaacttactgaggactgccagactgttttccgcagtggctggaacattttatgttgctaccaacaatggaagagcttcccatttttccacatttttgccaaccttgatatttttcatatttctgattatagcacctcagagagtgtgaagtggtgtcttactgtggttttgatttgcattttcctaatgacaatgatattgagtgtctttgtattgttgagttgtaagagtcctttgtatattcggaatgtggacccttatctgctgtgattcacaaatattttcccccattctatagattctcttttcttctcttgacagtgtcctttgatgctcaaaagtttttaattttggcaaagtccagttactaccttttcttactttgcttgtggttttagtgtcttatctaagaaggtcatgaacaattacctatttttctttttttttttcgagacacagtcttcctctgttgcccaggctggagagaatggcacattctcggctcactgcagccttgacctccaacgctcaagggatccttccattcagcctccctggtagctgggactacaggggcacacaaccactctcagctaatttcttattttttgtagagatgtggtctttctgtgttgcccaagctggtcttgaactcctgggctcagtgatcctcccatcttagcctcccaaacagctgggggattataggcatgagccactgttccagcctacacctatggtttcttcaaatagtagtatatttttattagatcacatattgtatataggtgagggaagagcccggcttcattatattgattgacaggtgagggaggagccgcttcatgatattgatagacaggtgagggaagagccggcttcatgatattgatagacagtgagggaagagccggcttcatgatattgatagacaggtgagggaagagccggcttcatgtattgatagacaggtgagggaagagccggcttcatcatattgatagacgggtgagggaaaggtggtttcattgtattgatagacgggtgagggaagaggtggtttcatgatattgataacagatgagggaagagccggcttcatgatattgattgacaggtgagggaagagcgggttcattatattgcaggtggatatgcagattttctaacgtcatttgttgaaaagactattcttccatatacgacctcattttattttattttactttttattttattttatatttttgagaggagtctcactctgttgcccaggctggagtgcggtggtgcaatcttggctcactgcatctcctgggttcaagcgattctcgtgcctcagcctcccgagtagttgggattacagggatgaccaccacgccccgctaatttttgtagttttagtagagacggggtttcaccatgttggcagcctggtctcgaactcctgggctcagggatctgcccgcctcaggctcccgaagtgctggattaatggcgtgagccactgcacccggccatgatcttattttagaaattgctacaaaacgcaatattgaacacagtgtgcgataacaagatgtcttagaaaaacaaaaataacagaaaaaacaaaacaagacagtgagggccgggagtggtggctcacacctgtaatcccagcacttgggaggccaaggcgggtggatcacgaggtcaggagattgagaccatcctgcccaacatgtgaaaccccgtctctactaaaaatacaaaaattagctgggcatggtggcgtgtgcctgaatcccagctacttgggaggctgaggcgggagaatcgcttgaacccaggaggcggaggtgcagtgagctgagatcgtgccactgcactccagcctggcgacatagtgagactctgtctaaaaaaaaaaaaaaaaaaaaaaaacaagacagtgaggtcttggtgaggagacagatacaacatcagtgtaacaggatggagtccagagacagcctcacacaaatgtgaccaaatgttccggagaaaggcactacagtgatttgacagagcaagtatcatcttttctgccgggcacagggctcacgcatgcaatcccagcgctttgggagactgaggcgggcggatcacttgagcccggggttagagaccagcaggggcaacatggtgagaacttgtctctacaaaaaatagctggcttcgtggcacgtgcctacagtcccggctactcaggaagctgtggtgggaggatcgcttagcccgagaggcagaggttgcagtgagctgagatcatgccactgcactccaccctgggcacagagtgagtccttgtttcaaaaaaaaagagtataatcttttcaacaaatggtgctggagaatttgacattcacatgcaaaaaaaaaaaaaaaaacaaaacaacaacaacaaaaaacaccaaccaaacaaaaaccttgacctaaatctcacatattatacaaagattaactatacaatggataatgtatctaaatataaaatgtaaactataaaacatctagaagaaagtacaaggataatctttgtgacctgagcagccaatattaaaagcatgatccacttaagaaaaatatgataaactgggcttcactgaaataaaaaacttgtattgtgaatgatcctgttaagagatagaaagacaagccacagacttggagaaaatatgtgcaagtcacagaactgacaaaggactgtatccacaatacatagaaaactctcaagactcaacaccaaaaaataaaaataaacaatcaattgaaaacttggccaaggggctgggcgccgtggctcacgcctgtaatcccagcacttgggaggcctaggcgggcggatcaggaggtcaggaattcgaaaccagcctgaccaacaggcgaaaccctgtctctacaaaaaaatacaaaatttagctgggcatgatggtgcgtgccgtagtcccatctactcggggggctgaggcaggagaatcacttgaacctgggaggcagagttgcagtgagccgagattgcaccactgcactccagcctggacaacagagtgagactccactcaaaaaaaaaaaaaaaaaagtcaaggatttgaatagacatttctgcaaaaaagacatcaaatggctaaaaggtacatgaaaagatccatagggttagtcattagggaaatgcaaatcaaaccccaatgagacaacacttcacacccagcagagctctgataaaaagacacacaatataaaagcagaggaatggaaaccctgctacacagctgctgggaatgtgaaatagtgtaacactttggaaaacattttggcatttcctcaaaaggttaaatatagtcacaggattttgccttcaatatctacccgggataaatgaaaacgtgtccacacacaaaaaacttgtaccacctagagcattattcatgttagctaaaaagtggaaacaggctgggcgcggtggctcatgccgtaatcccagcactttgggaggccgaggtgggcggatcacctgaggtcaggagttcgagccagcctggctaacatggcgaaaccctgtctctactaaaaatacaaaaattagtcgagttggtagcaggtgcctgtaatcccagctacttgggaggctgaggcaggagaatcacttgacccgggaggcagaggttgcagtgagccgagattgcaccactgcactctagcctggaccaagagcaagactctgtctcaaaaaaaagtggaaacaacccaaatgtccatcaactgatgatgatgaacaaaatgtggcccgtccctacagcagaggattgtttggcaataagaaagaagaagcactgacgcaggctgcgacgcagagaaaccaaacccagaagcagccagtcagcaaaaccacacactgcgcacggttccattcatacaaaatgcccagaacaggcaaatgcatggaccagaaggcagatgagtggttgcccagggcttggttagaggtggaggaggaatggggacgattactaaatggtacaaggtttcttttcggggtgatgaaatgttctaaaattagattaggtgatggttgctcggctttgtaaatatgctaagagccattgcatcatgcactttaaatggcgaatattatggcatgtaaatgatatctcaataaagctgttttaaaaaaaggataaaggatgggtgcagtggttcacgcctataatcccagcactttgggaggccgaggcaggcggtcacctgaggtcaggagttcgagaccagcctgggcaacatggagaaaccctgtctctataaaaaaaaaaaaaaaaaaattagccagggtggtggtgcatgcctgtaatcccagctactaggaggctgaggcaggagaatcgcttcaacctgggaggcagaggttacagtgagccgagtcgcaccactgcactccagcctgggcgacaagagcaaaactccatctcaaaaaaaaaaaaaaaaaaaaaaaaggataaaagacttaatgggagcttcaccaaagaccgtgtactaactgcccatgaaatgttcttcagcaacattagggaaatgcaaattaaaagcaccatgagaggcacctatgagagcagctgaaaaaaaaaaaaaaatttccaaacaccaaggacaccaagtgtgcagcggccgtgaggctccgggaactcccctgggggtgcagacggcgcgggtttccctccgaagccaggtcggcagcttctggtgaagggaaacctgcgcctgacgtatgacccagcattccgcttctgagcatttatccaagacaaattcaaacaggtttacgttaaaggacggtcacagatgtttatgggagctctattcatagctgcccaacctggaaacattgcaggtgttttctgcgggtgaacagagactgtggtgtgtcgtgtacgagatactgctgagtgatagaagaacgagccgtcgatccgtgaaaccccctgggtgggtgtccacagcgatgtgccaagtcgaaaagccagacctcaacgcaacccggtgcgtctacgtcctgggcctcatctgacattctagaacaaatggggtttccagggggaagaggatgggtgaccgcaaacggtatgtctgggagatttccgagtcgtgggatgtcctgcttcctgagtgcggcggtggcaatacgtgtgtggaatattcacagagtcgtacatcttccaaaaaagtcaacttactgtgtgacaattcaaaaaataatgacagataaaacaatgatttaagacgcacagccatcatagtaaacactgatcatgaatcatccacgaatgctaagtccagagatggattctgatgagggacaggacatttactaacccaaagtgagacaggactacgacagggtggccgcaggagaacagatgattccagtagcagtttcatggctatcaaaagagagctgttgaaaaagctgcagaggccagggggtgccagacactgaagaccaggacatgggccaagctggccgagacgactggacccactgggcgacctgggccgagacgactggacccactgggctgagctgggccaagacgactggacccatgggccgagctgggccaagaggactggacccactgggccacgctgagccgagacaactgacccactgggccacgctggccgagacgactggacccactgggccgagctgagccgagacactggacccactgggccgagctggacaagatgactggacccactgggccacgctggccggacgactggacccactgggccgagctgggccgagactactggacccactgggccgagctgacaagatgactggacccactgggccacgctggccgagacgactggacccacatggcagggacttgacctgggtttcaccggtgacctaattatatgctcatcaacacacaaatcacatcggcagtgccatgacagttccaggaacacacatatttggtgtaaaaaagggtggcacccagttcctagaaatcttcacctttttccagaaatctttatgaatattccactccttggtaaagaaacccattaaaggtaggggccccaaaccctgcctcacgactcactttcttgagacacccatactcccctttcttctttgacttttttttctatttgcttgtttatttttatgagcagggtctcactatgttgcccaggctgatctcgaactcctgcctcagcctcccaatgtttaggattacaggcgtgagccttcacacccagccacactctgctttctggagggtgtacttttgctttgcaataaatctctactttcattattttttaactcatccttgaattcgtttgtgatggtgttaagaggcaggacactggcctgggtcaaggtcccattcgcatttggggactcccctggccaccagtatcaaaagtacttccttgttaattttcagggttttttttgagcagattctcactcactctgtcacccaggctggagtgcagtggcatgatcttggctactgaacctctgcctcccgggatccagcgattctcgtgactcagcctcctgagtagctgggaaaccggcatgtgccaccatacctggctaatttttgaatttttagtagggatggggtttcacattttggccgggctggtcttgaactcctgggctcaagtgatccacccgccttggcctccaaagtgctgggattacaggtgtcagccaccgtgcccggcttacttatcagttacaaaggcaaagtggtaactttactgtgagaagcttgtggatgccagtttaaccagaggatcaaagtaccgttgccgctggtgggcagccagcgtcccgagtgctgggaaggatgcctggctctggtgccaatctgttcatgcagaaatgtcaggaacgctcaatgcggggacaatctacaaacaaccggtttgcattcttcaaaagtttcagtgtcataaaagatttttaaaaagacaggccaatgtatataccgtgaaaatagtaaaacaataaaatataaaagtaaaaagactgaagtaccttgtctttgtattgatgtggagtcaaccgctgcttccagttgcgggggagtagctgtgccaggtacgtctccctccagaaacgactctgagaccagacaaaattcgtgcgctgcttcttcaggcagtggggtgaggacagcacaagaccgagagggtgcttggaggcgcccacatcccggctctccttggccataaccccacaagcagggctccaggcagagcacggcagtcccctgggatgagaggcagagactggagtgaggggcttaggtgtgcatgttgctggtgggggtgcttgggacctctgcaagcctgtggctgagggtgaggaggtgccggaggctcaccaggagcagtgactataggccctgtgctgttatccgtcactgcataaccaatcaacaccgattagtagctttaaaaaacatgcatttattctcagttttggggggtcaggagcccacacacattccgctgggtggctcggggtttcaagagtgccaccaaggtgttggtatttctttctgagcttgaggtcctctttgaaggccacgtggttgttggcagaattcagttccttgtggcttaggactgaggtccctgctttcttgttggctggcagcctggggccactcactggttcccgatacgaggcccctcccatgccttccaacagccatatcttcacagacagcaggggtgtctgctgctccgtcccccaggacagagcctggaatgatgcagccaatcacagagtgacttacacctttctgtgttctatgggctggacacaaaccgtagtgtttctcggaggaaagtactaaggctgcgactcaccagggattacctgaggttgtatccacccaggttagagcagaacaagatagtagaggacaagctgtgtcgggcagtattttggcatttggcatttggacctggcagagtggagagacttgggcggcattggcatttggcatttggacctggctagagtggagaaccttactttttttttttttttttgaggagaaaggactacaatgtacaataatgcctacccacactcacctaacgaaagttcagaccaagccccacagagatctgcaggggagactgaattgagggttgagtcttaccaaggtagcaggacttgggaaacactttgggctttcgacacgacactgacaaagcatgagaacaagtccacagggcccagcagtgaaccaacctgcaaacaaacaccgacagcttcagaggaggaagcagagtagactctccacatgatgttcagtatcagtcaaaaatcactagacacacgaagaaacaggacaatgcaacccacgctcaaggggtaaagccaattatcaattgatttatttccagctgcaaattcaccctttattgccttcctcaaaaagtgaatctcagctgggtgcagtggttcgcgtctgtaatcccagggctttgggagcgaaggcgggtggatcacttgagcccatgagttggagaccagcctaggcaacatggcaaaccctatctctataaaaaatacaaaaattagctgggcgtggtggtgtgtacctgtagtccaaatacttgggaggctgaggtgggaggatcgcttgagcctgggaggccgaagctgtgggaaccatgattgtgccactactctacagcctgggggacagagtgagaccctgtctcagaaaaaagaaaagaaaaaaaatgaatctgcccagtgtaaaggagaaatgcttaaagtaatttgtccactgctgtggagcaggtattgaaggttaaatttcgagccaaaagacaataaactgtggttggcataatgcacctatcatgtggctgaaacatcctggggtgtgtactgagcagtacacccgcacaagagagacgcacacaagtgttcgtagcagctttatttgtagtcgttcgaactggaagtggaatgcagtacagtgatgaaaatgaacaaatgcctgctgcacgggacgcatggaggcatctcacagacacggtcgtgtgtgaaagaagccacacaaaaggatacacctgtgcattgtgttccctttatataaagtttaaaaacaggcaaacgtgatctgtgctgtagaagtcacctttaccgaggggcaggagggaatgttgtttcttggtctgggtgtgttttctggtgataactcatcaggcacatttgcagtgtgtcacttttctctatgtatgctcaaatcacgtctttaaaaaggcagacgtcccctctgtgttctccctgcccttcctcctgccctgcccagctgctcggttcctggccgtgtggggaggtccctccaggggtggggaggctctgatctctgtgggaggcgatggtgggcggcagcccctgggaggctcatccccagggtgcagcagggtcctgttattcccttcataagattcccagctgcctaattgagggaagggctattaaagaggtgaaaacagggcctccagagctgctaatgaacttcaggttccccagggcaattcccaccttgagagatcccccttgaacctggtgccggctacataggagaggagatgggacttgggtggggcccaggaagggagctctgctttagtgggcccttgagggggccctgacccagacactggaccccccattctctccagacctgaccacagacactggaccccccattcttccagacctgaccacagacactggaccccccattctctccagacctgaccacagacgttgaccccccattctctctggaccagctgcagaatgagacacaattgatggccccctcttctccagggcccagaggaggcagctgtagggtcaatggtctgcagaccctacccaggctctccctctgcctctgggcactggagggcacagcgcccctgtgctggcaccaggggctgccctcttgggtccaagaggtgaccccaccctggtcggtgaccccggcctcctgtttagcctccagcctgcaatgggctgtaatggccaggggccgggaggggctagcggggactgcagctgaagcccagaagcccagaaagtgctgcttgcggcaggagcacgtgctgtctgctccccacagggtgggtgctgggctcccgggcagcagggcctggagggagggcatcctgctgctgctcctctcaccatggcaacgctccctgctggggcctgcaggtgggggtggcaggccaggcccccttccccctggcggaggggctgcatccctcctgggcctccctggtagactcaggtctcctcaggcacacccagataccgggttggagggtgggctgtcggggccgtggctggccctgtctgtggcctgacctgcaggcatgtttgcccgctgccagcccagccccagcttctctgtctggggggacatgagctgctcctctaagggaggctccagaggcaggagctcctctgctccatggagactgtttaattcgctgcctcaagggcatgctcagtcccctgggagccagcccaaggcatggccgcgggggtgggccttgtcctggtggccgtccagggggcccaggtgggcagcagacgagatgctccgtgaccggaaaatgaatccacacctgctctggggccaggccgggctgaggtcatcctgtgacactgggggccagagagcggccttggccttgctccccacctgcctccaagcccctgtctgcctctgggctgccagcctccacctgcctgcgacggtggcccggggtgatggcctggctgtgccccatgcacaggtggttcgttaggcactcggcggcattattaacccagcagtgacgtcaccggcagccaatgggaggcaggtttatttccagggtgacagcttgatagcggttaattttagctgcatcttctttcccgaggctcgtgaaacccagccagccaaagaaggggttgcctgtgtctccccaaacagctcagggatgggtcctggggctctgggaggcggcaaggaggggcggggcctgggggctctgggaggggtcgaggagggcggggcctgcccccagggaagccctgattggctggtgccctcttgactcgccatttccctccccccaccccccccaggttgttggtgaggacggcactgtgaccagggactcagatgcagaagaggggcccaagtcctgacctgggggagggcagggaaagcacaggccacaggccccttacttgctgtgtgtccttggacaggaatcttggcctttctgtgcccagttgcctcacggttctcaaggtcctccagccagccttgtggggcctaccttgtagcctctgtccccgcacccccatccccgcacactgtgcacgtgcacggccccctgtcccccgtcccccacactgtaactcacacagctgggcgacttggctgtgactaattaggatgcttggtacttgaagtcattggtgctacccggccattgacaagtgttttgcctgcttgttgtgctatgacagaatactgagactgggtaattatacattacttaaatttaaacatttataaagtttgctttataaattataaattattataagtaaacagaagtttatttctcagtctggaggccaggaagtccagatcaaggtgctgccatctggtagggccttcttgctgtgtcctcacatgggagaaggcgaagagcaagagagaacccactgccatgagtcctgtttatagggcacaaatccattcggagggcaaaccctttatgacccagactccttcccgaaagcgccagcccccaacactgttgcttggggattaagttacaactcgtgcactttggggacgtggtcaggccactgccgttattagcagttagcattccgtagttagtagccattcagtcctgttcagtctccgcggtggctcgaaccatcagtgtgttagtgtttagccttgtgaccgcagccccgttagctgtgtgttccagtgtctgcggaactgagtcggtggctcccaggaccccgaggggccacaccgtggaccaacgtgtcctggcgcctgggagaccctttggagcagccaccgacacccttgcccagagtcgcacacaggtgctttggggaggttgccacattccactctcaggggccactcctgtgggtgcaaggccccacggcacatgtgagcccctggcactgctatgggtgagccgggagccgaggggaaggggtgtctggaaaaggtagcccagagtcctggtgatcccttgggggagtgggggggcatccccgggaccccggcctgggccactcgagcacctgcagcaagcccacttccaatccctgcctaaccttcaggctgcaggggaggcgttaaatatagagaccagctgggtgggtggggcgggccttgctttctcgccaggcggttatttttattcctggctcctgtttgacgcatcggcagcactcggaagtgccggggcacctagcaggccctccctgcctcctctcctgctgtggcccaggagcccaagtccctggactcctatggggcagacgcagccacagaccaggtcctcctgagaggccctctccacaggctggggagaactgtttggccccgaccctgggccccacctttccttcctcctcacacctgccagcaggccaggtaggggtccagtcgctgggatccccatggatttgcccagtcgcagctgctgggcccgacccggggcctccatgtcaaccccagtgggcactcagggctgagaggacaggtgccagggctctgcccccactcagcacaacctcccgagaccccgctggcaggaagatccgagtgcgtgggggtgggggggcagcgtggagggaagacctgaatacctgggtgagacgacaggatcttggggtctggagaaagccccaaccttggtcttcacacaacacatggctgccacatccccttcctcacaacccacgttggcattacccgcgtgtgccaggacctcagggactccccacttcctacagagcgtggcccggctttggcttggcatcctgaccccatatgagcatcagctacaaggcgctgaggtgcagcgggtggggcgctgggcgggggggcctgggtctgtctggatctgactcgcccttggctggcctgtttcccagcagcagccggaggtcggcgcacccggaggggagggtccctggaagatgcagtgggtctgggagcgggcttccggcgttccctgcaccgtgggagaccagcctctcaggggagggtggttctgcgctggatcctcggggcctgtcatggtgcgcccaggagggcaggacgtgaggacagggactggaaaccagcagattccggggttccaccctgaggcctgcaccccgggcctcattagggagagcccctcagagccgggcttcgttggttctggggcgtccccatgagcagggccggggaggggccggtagacccaggctcgtctcccaggctgcagcccactgctcccctcccccgcctgccggctccggtcctcggcgtctgccctgtccccggggacccttttcgcggctcaagcgtgttcctgccctgagccggctctcgccccgtctcccgggccgccgcgctctccccgcgccgtctccgtcccggtccctccctcccgccgcctccctgcccgccccccgccccgcccccgccgcggcgcgtttctcccccgcctcccgcgtccgtctttgagcccgcgcctcccgcatgcccctcgcgtccccgtggcgcccgcccgcgcgcgtccgcgcccgccccctcccgcgcggttccgcattggcgtgctgcagggcgcggtgcactgcgccgcaccgtcaataggtggaccccctcccggagataaaaccgccggcgccggcgccgccagtcctctggctgagacctcggctccgggtaaggacgctcggcccccgggcctccgcccccgccccgtcttccgaagagggacccccggggccggtcctggggggcagagggtggccgggcccgcacccgcccccgcgcgcgcccggagtccggcttccgggggtccccgcgtcggccggctgggcccggggtggggggcggcgcggggcgcggggccgggtcctgggcggcgatcgcccgtagccgtgaccttggggccgcggggactgcgggcgggggctgatgggggtcgggcttggggcgctgggccagaggacgctgagggaggtggtgagatctgggggccctggcctcccacccccacccgtgttcccaccccagggtggcttctgtcctctttccctcccccagccactgtccgcgaggagcagcgtgggtttctccactgacctctgtgatgggacagggctgtgaccagggtcctgagtcacagggagggggggagggagggtgccccctatacccccacgggcgagggcatctccacctggcacttgctgggctcggcaggggcggtcctccttcctcaggcggaacagggacccccacctcctggccgctgtctgtccctgtgagagtccggaggggggtcctagagctattctgggttcctaatctgggcagcgcatctccgtcgggctctggcccagctgccgggcagggatgaggggaagatggcgccgtccctgcctgaggaggggagtggggacagtggccatctctccccggtggcagcgggtgggggtggggcgccgtgtccctggccctccgccgggggaggggagtgcgcgtgcaggacagggccctggagcgctgggcaggtgactatcacccggctctgctggtcacggacgtacccagcctggcgctgcgtggtctctccaaaggtggctaaccccttcccaaggagcagcccgcgggctccaacgcccagttatttacagcgatggggctgtttgggctcaagtgtggggtgggggcagtgcacagcctctgcttgccctgccaggcccagctgtgggtgggggcccttccctccccaccaaacatgggggcttggttttgggcagggatgcctgtccagcctgtgccaggacagtctctgctggtgtctccccctgggctccccatcaccggtctccccaccaccactggccccacagaatcactgcagcccccctgccctgagccagagcaccccgggtcccgccagcccctcacactcccagcaaaatgggcaggagaagacccacatcaacatcgtggtcatcggccacgtggactccggaaagtccaccacacgggccacctcatctacaaatgcggaggtattgacaaaaggaccattgagaagttcggaaggaggcggctgaggtgagctccccaggctatggtcttggccccctgagaaggaaccccaactcccgtggtggccaggcttggcatctcccagccccagggcatggggctcaggtgcctcctccagggcaggagggacccccgctgtggggcactcaggcctcagagggtctggtgggcagcctctctcttagggggagcttggtgggggaggggtggccatcgagctgccggattgccctgtggtgagggaggtgacctgggagggtctgcagaaggctctggaactctgcctgttgagctggggctggagggcgctggagccttacccccttccccccagggccaaggctgggctggggatggtactgccctcacttgtcctagggccctgccagggcacacgctactataatagctgattgatgggcagccggcccgtctgctccattttcttgtgctgggctgtgggggctgctgtccagggcagccctggggtgggggtcctggatgaggtgacctcctagctgccttttgaagcgattcctctttggtggctgagacggtggtggggagcggtcatgagacgggtctgctctctgatccccatcccccacccaggactctggggagaagcccactcctggggggcctgtgggagctctcacctggatgatgagggcggaggccagggcccaaggtgggggactcgctgtcctgggctgagcctctgccctggcggggttgggggtgctctgagctgcaccctgagtttgggctgcatcaccctttacctggccttgtcaggaggaggcgggggtttcaagggccgctgtttcaggccccagctgggtcccatctgggtctgctccagactgggcagctcctggagggcagagtcctgtctgtgcgaggccctggcgaggagttctgcccagctgggagtgaccgccgctgctgccctgactgaagcccgtccccttctgtgggggtctcactggcgaggccccccagcttcccgtgtccggcagagcgaggaaggggaggagaagcctcagaggatggggaggctggagcagcgggaaggagctgcgtggccaggccctcctcctgacctcatcagttttcctttctccttaccttaaaaaaacacacacacacagagggttatttatctgaagccccaaacacggtggtattattggcctctggttgaggaagggatctgggggcgtccgagcttcagataaaggggagccctcgcccgggaggggtttatcccatctggcggcttcgccgtagagcgagcgactcccaggcccttgcgccacctgctggtggacctgcgtagccgcgccatttcggagcaggtgcggaggccggccctggggggcagggtctgggtgtggggtcccacggagggggccggcgtcccaggaccccgacggagagcaagggggtgctggagcccatccccgcctctcgcggccactctgctgtaacaagcagctcgcaccaccagggactcctgggcccgggtcccgccctcagccgtgaccctcacccgctccagatggggaagggatccttcagtatgcctgggtgctggacaagctgaaggcggagcgtgagcgcggcatcaccatcgacactccctctggaagttcgagaccaccaagtactacatcaccatcatcgatgcccccggccccgcgacttcatcaagaacatgatcacgggtacatcccaggtgagcagggcacagcaggggggctgggggagaggccgctgcacccttcaagggacactgggggcccctggggtcactggatggtggggtctcctgtgcttcctgtgagggcaggggacccctcacctgggccaccccacccagtctggctcagagcccccctaaggatgaatccagtgctctggcatctgaaccatgcctgtgaaggcatccagccagtgtcagagtccccagatagatgggggcagatggggagtggacacaccttcatacatggaggggttggaggccaggatggggagagtgagcagtggcagaggtgccacccgccaggtgtagactgtatgacatttcagggcactcacagagacgccggacaccccagacacagcaccctgcagacagcaggacacatgccaccacctccaaactctttgataactgtgacttctatccgtcctcaagtgaggaacaggagcagataggctgaggacttgtccagggacacacagcccactggtggtggagccagggctgaacctcggtccccgacccagggcctggcgatgagcccccatgctgcccttgaagtggggacccccatgcctcctccccaaggccccagtgggctgctcaggccccagcccgctgcctggagaggcctggaatgaggtggggccaggctcgctctgtcccctgccaggcaggcggggcagggctcactgtgcccctgccgggcaggcggactgcgcagtgctgatcgtggcggcgggcgtgggcgagttcaggcgggcatctccaagaatgggcagacgcgggagcatgccctgctggcctacacgctggtgtgaagcagctcatcgtgggcgtgaacaaaatggactccacagagccggcctacagcagaagcgctacgacgagatcgtcaaggaagtcagcgcctacatcaagaagatcggctacacccggccaccgtgccctttgtgcccatctccggctggcacggcgacaacatgctggagcctcccccaacgtgagtggcggctagggcggggcgggccacgggagctggctggacccctggcccagagcgaggcaccggcaggtggcacggggaggtcgagggcctgtccccgggaatgcaggttcccctcgaaacctgctgggtttccctaactggctcagggcccggcggggagcccatgcccctcagcaccgggctttgctcctacactcagcctcccacgcggctggccgggccagggcccatctacgatgtcaacacagcaggggcagcggcctccagcaccaggcccagtgcttggtctccagagccctgccatgggggcggtcggtttcatctctgccaggccatttcctggtcctggacaccgtgcaggggctttgggctgggccgtgggggcctccttggctgctcccctgggatcttggagcagggttgggctttgggaagtgtgcatgcttctgggcttgtgggatggccaagggttggctcttggccggtcacctgggagctcaacgtgcgaacagtcgtagcccagggactctgccttggctggaggtgacgcgtggagacacttgcagaacctgaactgttcccagggttctccaagccagaggagaccccagaatggccaccactaggctctgcagcactgtcgctgcccacagtgagggtgcaggtgtggagtctagagacagcagggagaagaccagcagcactgagcctggagctgaggtctggggacagaactgagagggactccccagctccgcctccatctcacgaggctcggtgttgtttacctgtgatggcgttttcctcatgggtatcatgtggcgaacgccactctcccctccccagggaggcctccagccatcagggacctgcactcccctctggcctgagctgctaggtggcccgtgcttacacaggccctgggggctggggcactgtgctgccggccccctcccctgctccctgtttgtggcaggtggcccagaggaggcttcatgggatgggagtgggggccacactaggagaagctccggacaaggctgggcaagctcggaggcagcacggtgtccagaagctagggtggggcgaggctcctccagctcttccctggcctggcccttggccagactcagcatcctcctagtcaagtcatctgccctgccggagctgatggtcaggggcccggggtttcggggacttggggctggactggggatttgttacagtgtcagcaactcctgagcagcctgggctgggaagggtgctttccctctttgtcctctccttttaagagggatctccttcccagagtccctgtgatgctggggctatgggctgggaggagcagggtggggaaattcctcatctcaaagggcacgaggcaagtttagcctgaacacagtactcctggaagcaccctggggaggcctgagggtggggaggccaccaatgtctcttacggattgattttctccctttggtccagatgccgtggttcaagggctggaaggtggagctaaggagggcaacgcaagcggcgtgtccctgctggaggccctggacaccatcctgcccccacgcgccccacggacaagcccctgcgcctgccgctgcaggacgtgtacaagattggcgtgagcaagggcgctgtgctggagctcctgcctggccagctctgcctgccctagaccagggcccctacaaggcatctcaagactgggctgtctccaatctctccccttaccacacacttctgtgggacagtccatcccacatccatccatccatccacccacctccccacccatccatctctgtccatccatccacccatccatctatccacctctccatccatctatctatccatcatccatccatcgatccatccatctccccacccatccatccttcactccatccatccatcatccattgtcccatccatccttctctctatcgaaccatccctccatctctccatctatcacctccccacccatccatccttctgtccatcaatccatccatccatccatccatccaccctccatccatccatccatctccccacccatccatccttctctctatccatccatccatcatccatccattgattgtcccacccatccatccttctctctatccctccatccatccatcatgcatccatccatccattgtcccacccatccatccttctctctatccatccatccatcttccatccatccatccacctccccacccatccatccttctgtccatccatccatccatcatctctccatccatccatccatccatccattgtctcaaccatccatccttctctctatcatccatccatccatccatccatctacccacccatccatccttctctctatccatccatcattgacccacccatccatccttctatctatccatccatccattcatccactcacccaccacccacccatccatccttctgtacatccatccatccatccatccacccacctacctatcatccatccttccatccatccatttatccatccatccatccatccatctatccacccaccacccacccatacatccatccatccacctccccatccatccacttccccatccatccatcatccatccatctccccatccacccatccacctctctatccatccatctccccacccagcatccttccctccatcatccatccatccatctcatccatccgttcatctcctcatccatcatccatccatccatccatccatccatccatccatccacctccccatccgtccgtccatcatccatccatccatctatccccccatccatccatccatccatccatccatccatccatcatccatccacctccccatccatccattcatccacccaccttcctacccatccatccttcgtccatccactcatctacctcctcatccatccatccatccatccatccaccaatccatcatccatctccctactcatccatctccccacccatccttctgtccatccacctccccatcatctaccaccccattcatacatccatccatccatccacccacctccccatccatccgtcatccatccatccatcccaccaagaagagaaaccataaacaaatctgagaccctagagaaggcactgataggagacccccagccagtgggctgcagccaaagatgttgcaggcatctcttgtgcactgtgggggcatcatgctcaccccagcacagagcacagccactggcctcagtgagttggctggaggctacaacaggcctccctcacagccctgggaggtgagggtggagaccagtagcctggggggggacaagacccccatgtggcagctgcacaattggtttaagtagatcatgagaaatgccagggacgctcatgtgccgctgtgcctgtgctgcatctggctgagagcccctttagtgatagagacctgcagcatccaagtggggcccagagagcctgcagggagcgggagcagggcctgcagggagcagggagcagggccaccaggccccaggcagaagcagtcgtcgccccgcccacactcacagggaggagtcctcagacaaaggaggggtcccatagtgctcctttgagggaaagtgctctccgggggcaaggatgggaccccaggttcagacagccccctctgcccatcctcccgcttctctgtccctgtggcttttccgtgggttcctgggagctcgctgctcagcctcttatttccccagctgggtgggagagcccccacttcccttggaatcttgtgtctgcccttgtccctggcctcccttcccctgcactccgcccatgtggccccaaccccaggcctgtcggggggatccagtcccaggctttgttggtttccaggctctgtccccgatatcctgccccagcatcccctcgggccccaccttcccctcacaccccctcccctctgcagcattggcacggtgcccgtgggccgggtggagaccggcatcctgcggccgggcatggtgtgacctttgcgccagtgaacatcaccactgaggtgaagtcagtggagatgcaccacgagctctgagcgaagctctgcccggcgacaacgtcggcttcaatgtgaagaacgtgtcggtgaggacatccggcggggcaacgtgtgtggggacagcaagtctgacccgccgcaggaggctctcagttcacctcccaggtggggggctgcgctgggtccagggggctggcgcctgctggaagcagcaggactgtcctgggtgaggctgctgtcggcaggtggcctggcgtggggagaaaccggaccctcaggctgggcgcagtggctcacgcctgtaatcccagcactttgagaggccaggcgggcagatcacgaggtcaagagatcaagtccatcctggtcaacatggtgaaacccgtctctactaaaaatacaaaaattagccaggcgtggtggcacgtgcctgtagtcccagcatcaggaagctgaggcaggagaatcgcttgaacctgggaggcggaggttgcagtgagccagattgcgccactgcactccagcctgcgtgacagagcgagacttcgtctcaaaagaaaaaaaaaaaagaaaagggacccgcataccaccgagggggccaccgagcactcaacgaggggtcaatcagttctgggaggggtgcaggccctgtggctcccagcctgtgtgcaatcccgggctgtcttccacgctgcactgctgggatgcccagcctttgaggtcctacattcgtcctagaaaacgcttttgttaacttactgtctgagacatctctgtcatacttttattctctacagcttcattgcccctctttgctggcctcttcatatgatttatttatttattttttgagacgagtctcgctctgttgcccaggctggagtgcagtggtgcgatctcggctcactgcaacctcgcctcccgggttcaagtgattctcctgcctcagcctcccaagtaggtaagattacaggatgtgccaccacgcctggctaatttttgtattattagtagatacggggtttcaccatgtagccaggctggtctcgaactcctgacctcaagtgatccacgtgcgtcagcctcccaaagactgggatgacaggtgtgagccaccgtgcctggcctcttcatatgatttttaaaagtggtttattgagatacaactgaaacacaggaattgaggtccagttttgtcacccccccgcctagttccagctggggttggccgtgtaagtgctgcccctgccccttcgaaacaatgaatctagttgtttatcttttgcttaatgaggatgttgaggttcaggtctgggggctgggtcctcgagcctgagccccctccagtcagcactccgggcccaggagcccgtgcaggggcgccggtactgggcctcccagccccgctctggcgccctcccggtgcccaccgccgatgtgcctgatgccgcctgtggctccgctcgcaggtcatcatcctgaaccacccggggcagattagcgccgctactccccggtcatcgactgccacacagcccacatcgcctgcaagtttgcggagctgaggagaagattgaccggcgctctggcaagaagctggaggacaaccccaagtccctgaagctggagacgcggccatcgtggagatggtgccgggaaagcccatgtgtgtggagagcttccccagtacccgcctctcggtgagccggggtggtccggggaggtgcagcccccaggctgtgctgatccaggctgagggcagaggactgcggggatggggcgctggggacagcagtgggcccctttcctgcggagcttggcccagagcatggcaggagagccacggcctccgtgtcactagtgcaggtgaccctgcccagacgagctggggtgggccctgtgtgcagacgaggccccgaagtgagggaggccccgcgagtgaggaaggcccgcggtcgcccagtggcagcgttagggtgcccccgccccgtggccgccccgcagaccgtggagcagccgcccaggcaggactcccggaggccggccgtcttcacaggggcgcgctctgcgctaagcgtgttccgaggacattcccacgcggttgcgcccccgcccggccagagccctggggttggggggggtcaagtcctccggcccgcccacacgccgccccccgccccccaggccgcttcgccgtgcgcgacatgaggcagcggtggccgtaggcgtcatcaagaacgtggagaagaagagcggcggcgccggcaaggtcccaagtcggcgcagaaggcgcagaaggcgggcaagtgaagcgcgggcgcccgcggcgcgccctccccggcggtgccgcgctccgaaccccgggcccgggcccccgccccgcccccgcccgcgcgccggtccggcgccccgcacccccgccaggcgcatgtctgcacctccgcttgccgaggccctcggtcagcgactggatgctcgccatcaaggtccagtggaagttcttcaagagaaaggcgcccccgccccaggcttccgcgcccagcgctcgccacgctcagtgcccgtttaccaataaactgagcgaccccagagccgtgtgcgcctgctgctggggggtgggccccgcccccccggaccccctccctgcccaagtggccggcccagcatccttcactccctgcccgggaccccagggtgggcggtgggcctgcaagagtggtcccctgcgctgcacagggtgagcgtgagcgctcgctgaggagggcctggtgtcccccaggccgtggcccagcagcaagacccctccgaaggccaggtggcctgggtggctgtgaggggcttctccatggctactcagggcaggaatggtgccttcagatccacagaaccaggctgcgggttttgggatctctgggggccgctgagagctgagggctcctccaccgcgagtgactgtcacacacacactcattcttcccctgccccgcacacctggtctcactctcctgctaagccggtcacctgtggctgcagcctgtactatccatcctgctcccaggtccaggccctctgtacgtggttgtaggaactccagccccgaacccgggaggctggtgacttcagtcagtgggctgggggctttgggtcttccctagtcctctgggctagaacctgccccgaccttggctgggaagagtggaggggtggggagaggggggacagctcctttccacccctccctgctctgggaaagcggccccggcccacagccagtctgctgcagcaggtgaaggtcggggtggagggtgagcaggttccctgaggatgcagaggaggtcagggtggagggtgggcagcttccttgaggatgcagaggagggtcagggtggaggggggcagcttccctgaggatgcggaggagggtggggtggagggtgggcaggttccctgagatgcagaggagggtggggtggaggatgggcaggttccctgaggatgcagaggagggtgggtggaggatgggcaggttccctgaggatgcagaggagggtggggtggaggttgggcagctccctgaggatgcagaggagggtctgggtggagggtgggcaggctccctgaggatgcggggagggtggggtggagggtgggcaggttccctgaggatgcagaggagggttgggtggagatgggcaggttccctgaggatgcagaggagggtggggtggaggatgggcaggttccctgggatgcagaggagggtggggtggaggttgggcagcttccctgaggatgcagaggagggttgggtggagggtgggcaggctccctgaggatgcggaggagggtggggtggagggtgggcggttccctgaggatgcggaggagggtggggtggagggtgggcaggttccctgaggatgcggtgaggtcagggtggaggatgggcaggttccctgaggatgcagggagggtggggtggaggtgggcaggttccctgaccctgtacacagcactgaggcaggcctctctgtcgcccagccccagctcccagcctgcagccgggtacctgactcggggggttccgcagagcaggcaggcgaccgcagggcctcatagcgcgttagtctcttagggatgctgcgaccaatgacggcaaaggcgaggcctcctggggtcaggccaaaaccagcctccctgccgaaatcaaggtgtcgatgggctctgctcctctggaggccccaggagagtcggttccctgcttcaccccttgccgtgctgccgacaccccttggcttgtggctgcgtcactccagtctctgcctctgtcgccacacgctctctcctcctctgtgtcaaatctccttctcatgaggatgcgagtgactgcacttaggcccacctgggataatctgggattgcccccatctcaacatcctcaaccaaatcttcaagtcctttcctgccacatggagtcagccacagattccagggttgaggtcctgatacccttgggcatgttggacccactgtgctaggtgaggacggaaacgaggcagcccaggtgacaggcgtggtgatgggggcactgtctaggggcgcccttggagggcctgctcatgtctccctccatcccaaagtggggtccctcaaacccacacaaaagggaggtagaatgggaggaagagtgggcaaccagggagtttgggcccccaggtggtgctggcagcccacggccccagatggggagatttgaacccacgaacatcagagccacgaggcctccaaggaggggatacaggacccagtacgtcgggactttggatatatatcaaataattgtttactgtaaaatatttggggcatattacacaaaaatggtactccttatttatctaaaattctgatctgactgggtgtcctgtgtttatctggtggccctacccaaggacacaggtgttcctgatggaccctggcccatcctggcctctgtggggccacatagatgggaggggcctagtgggacctgcagggcctgtctggaagaagttgtcctttcacacgtgacctggctagaactggggccaaatgggagaaatttgccgcctgagatgggacaaaagtgaaaaacagcccccagctggagttgcaggaatcccccttggtggtccctgaggtgctcaggggtcccctcacccccatgtcccagttgcagttgctaatctggatgactctggcagccttggtcaccaggcactgctggtggggggcaagcccagccgcctgccatggtctgtgctggggccacagggccccctccaggtgggtgtgtttctggggggggaggagcacagggagggcagagagatgggagcactccctgttcccactggggtcccagcagatgagagtcctggccgtggtagcctggagggtgggtctcctgggagggtctctgcctcggctccccttctggggtaatgaaggcaggcccaagtccttgggtctgatgcctggagggctccgggccttgctgcgcccctcgtgctcaggtggggggctgtggggtggggaccgcagtggctggaggaggccaggatctgggactgggctcctggtgtccatcgtgggtggggcagcacccacagggtgccaggattgccctgctggatgccggacaggggataccctgtgccagcccactgtcagctctggggagggcaggggcttggccaaagccgccctggggtcccagccctcggtctctggggagttctggtgccacccacaccgagggcagaggagcttctggaggtgagagacccaccgagggcaggaggagcttctggcgggtgagagacccagggaagcagctgtgctcgttaatcaggaaggggggctggggggacaccaggcagagctctgcgttgctccaggacagtaatgctcagagctttcgtgttaggacccttgcacagtgttaaatgtcgggaggttgcatctgccactgtttagtatgctagaaactaaacgtgtggatatttaagaacgagaaagcaggggagtgtcacacctcttatggcctctgagaactccactgtccaagcaggacgggagagagaagccttggcattattgtgaaaacagattttgaccttggggcttttcgaaggttctcgggagccccggggggcctggaccgtgctttgtgaaccgaggctttagcggcggagcagtggggaaggcgaggggtggggtcccagctctggcacctgaggccaggcatggggccagagacgccgcggtgccccttctccatcggtgaaagggggttgtgtggcactgccctgagggtcgggccaggatgaaaggaaaccacggcctcacgcggcctctgcggctcctctccagctccctgaacaggggctgcagtggaggtgtgagctctagctgctccctgggcccagaggagggtgggtttttccccatagcaggtgggggtaggggggtggggaggggcgagctcactggggttggggtcaggacagaacgctccgtgggtgtcggcttggggagcctaggacagctggagggcggtggccggggtgagggcaggggaccacaggcagacagtgcccggagccctgcaagggtgggaccgtgcagcctcagggccccagcggggtgttgatggatgttgcagctggctggacacctgggctgctgtctggctgaagggggcgccaaggcccagaggtggctctgactggcggccactgggactcagggtcagtcctggggccgctgaggccccaagcaggtcctgaagtcagggagggcatgggtggcggaaggagctccaccctacttgggtggtgaataatttttttttttttttttgagtctcgctctgtcgcccaggctggagtgcggggcgcgatctccgctcaccgcaagctccgcctcccgggttcacgccattctcctgcctcgcctcccgagtagctgggactacaggcgcccgccaccacgcccggctaagttttgtatcttggtagagacgaagtttcactgtgttagccaggatggtctcgatctcctgacctcgggtccgcccgcctcggcctcccaggtgctgggatgacaggcgtgggcccccgcgcccggccggttggtgaataatttaaaacagagtccgccaagacgccctgttggcggctttggtctgactttgcacgtcaccgaaaaattcctgaggcctcgagaggctgtggggccctgctgagtgccgaatgccatctgtcccttgcccttgtctctcccgggctcccggtgccctcctgtaaccaggcgggaaggaccttcccaccccgtgcaggttcccagcgtggctggaagggcctggtgcccctggcagtcctgggtttgagcagcggcttctgggctccctgccaaggggctgggtttgcggcagccggtcaggcctccacaatgggaccccggggatttcccatgtgctgtgatgtgggaatgactgtccttgtgggtgacttagtgtgtcccggagtggggctgcaggcacgggttacatccataccctggtgcgtgtgtgtgacctgggtgagctgtgcatacctgtggtggctgtgtggggtgcaggggagaacttggcggggtgtcctggagcccctggaaacggtaggatgtatgtgctcgtgcgtctgttcatttgtgcctgcatgtctgtgtgtcgggcatcggctgtacctgtgctgccggctggccgcctggagtcagggctgagtctctgggggtgccaccaggtggctggactcaggaagcactgggcaacggtccctatccagaagccagggaggagaaggcagcccgggggacaggctggactggcaggtgcatgggccttgaggcagctcctgctctgctgaggggagagaagccccgtccccatgagagggtcaaccaggagcgtcagggtctttggaggagctgtggggtctggcttatttcctggcttcatgccgctctggcatcttctttgggggtcggctgggggaggtggggaagaccctgaggaggatgtgtgaggctgagacagctccaggatggagagcagatgcaggtggggtcagcggccccaaatcagggccctggttggtctgtgggggctccgaggcaggggcaggaggcaccaacacccagaggaggggagaagggtctgggccctggatggtgtggggtgggagcaggaaggaagccgttgcccctggacccctgcccagacgtggggcctggttgcaggcctcctgctgcaggacagcagttcctaaggcctgcgggcctcctgcagggacaggactggagccgtgggtgtggcaggaggcagagctccaggcaggaccagcctggaggggttggaggggcagaaacccacgccccctgccctgccactccctgaacatctaggggga

SEQ ID NO: 5042 - DNA, 27936 bp, Homo sapiens
tcaacctggagacaccgtctattcatagacattgttgttaacctggagacattgttgtcacctggagacaccatcaattcatagacattgttgtctacctggagacaccgtcttttcaagacattgttgttaacctggagacattgttgtctacctggagacactgttgtcaacctgagacaccatcaattcatagacattgttgtcaacctggagacaccatcaattcatagacatgttgtctacctggagacattgttgttaacctggagacattgttgttaacctggagacatgttgttaacctggagacaccgcaattcatagacgttgttgtctacctggagacaccattagctggagacgccatctgtccttagacatcctcatctacctggagatgtccacacaagctgctgcccactccccatgccaatctcaagccccgggtgcttcagaccaattggctataattgaggttcctaacccccatatttgggtcagattaatttcctagagcagctcacagaatcagggaaacatgtttacccatttattataaaggacgttacaaaggacgcagatgaagaatgcgtaaggggaggggcgcagagctttcaccccacaagggcaccccgtccaggaacctcacggctctctgagccctgtccttttgcgacttcatggaggcttcattacccaggcatgttgattacgtcactggccactggtgaggaccgccttcagccgcctctcccctcccctgctggaggttggggcaaggctgcaagtaccaccctctactcctgctgaggcctttctgaggccagccccatcctgaggctgcctccaggctgccagccttcggtcaatatcagcacaaaaggcacttgccactttggctactccagggattttaggggtttttgccaggaaacgggacggaccaaatatgttaatgtatatttcacaatgtcacacgcacatggctgtgtgtgcagagccaggcagggagagaggacagagcagctgggaggccccggggggcgtagacccatcctggactaaacccccatcagatccttctggcacccctgcaaggagaaggtgtggtccccctgctttctccccaggggctcatctcgaaggaggcctcccggctgcacggctcccacaaggcaagaggaggagatctgaaatcggctccactccctcccactgcagaccctatcacctcctcactaggggtgtgagcttttggctggtgggagggcgcccgggagggtctctggaaagatggaaccgggtgttaaagacctgcttaagcgagttatacccagaggccgtcagttcctgccgagagcacatggcccacagtcacaggtaaactgaggcctggccctaagccctggggactccacctgcttcgtgacgctggggacagtgtgtacgttttcctgcagggttcaggtgatgcagacggcagagggcagcagacggcaggctggcactggggggccatggaacccactggagggacgctgggtgaggaggacctagggaccgggatgagacaagctgagggtgttgggcgacatttcttactttgtattttgatatagtaatttaaacaaacgtacacaaatgttgcaaaatagaacaaaggactccctgtgctctacgcggactcaccagtcgctttgttctggccatttgccggttctgtagaagcctgtagttccaggcaattgagactaagacacgatacccttcacctttcagatacgataccccttcacccttcacccttcacccttcaccctttacccatcacttcaaggtgtgtttcctcagaacgtggaagctgtctgttacaaagtcaggaagcgacgtggatacaataatattactaatactcagcccgtgtgagcgtgttgttggccgtgtctgtgtgtacgtggaactctctcccgtggtctcacactcagcccgtgtgagcgtgttgtggccgtgtgctgtgtgtacgtggaactctgtcccgtggtctcacactcagcccgtgtgacgtgttgttggccgtgtgctgtgtgtacgtggaactctgtcccgtggtgtcacactcagccgtgtgagcgtgttggccgtgtgctgtgtgtacgtggaactctctcccgtggtctcacctcagcccgtgttaggggtcactgtggcctgagcacagctggacgggagccagagagcttccacggcaacctgcaggttttcaatgctctgtggactcgaggtggcactttttgttttgttttgagttaagaagacgtgcacagatgtgaaaggtgggcggaaacaggacgtctccccctgtcctggccgcacagtcctgatctgtctcccaggctggagtgcactggcaccatcaagcttactgaggtcttgaactcctgggctcaagtgatcctcccgcctcagcctaccaaatgctgggatcacaggtgtgagccaccgtgcctggccaacctcatttttaatggccttaggtcttccatggcacagggtggagactgcccattacatagaccctgagcgaggggccctggcattcccggtccattgggtgtagaaggagctgccgggagctgttggtgggcacagatgccctctgtgcaggagcctctgcggagccacgtggaaggcgcgtgtcctgtgctcccgggctggctggtttccagagcggtgctgccagtttagactctggccgagtgcctgcaatgtcgaggggtggacgggttgtctggggctggtttgcgtttcccttacgccgaggttgaacactcactccatttacagcaatttcactttccacgttttgtgaagtattgatttgcatccttgcctatttttcttttaaattatacatctttttcttaatttataagatctttaaaatattgagagatcagggccaggcgcggtggctcacgcctgtaatctcagcactttgggaggccgggtgggtggatcacgaggtcaggagatcgagaccatcctagctaacacggtgaaacccctctctactaaaaatgcaaaaaattagccaggcgtggtggtgggcgcctgtagtcccagcacttgggagactgaggcaggagaatggcgtgaacccgggaggtggagcttgccgagatttgccactgcactccagcctgggtgacaagagtgagactccgtctcaagaaaaaaaaataatatcagagcgatcagacttttcactgtgacataagctgcaattttgttttctgttcattttggtttttgactcctttgatggtggtgtttttttccatgtgaaattgttttgtgtcatgaatttatcactgttgtgctggtagatgtttaattcgttctctaagaagaaaaaaacatgcttcaggagacaggttttgtggatttctggggtgtatgcttgcccctcacggcatgttgaagccaccagccctgtccttgagcctggctgggggcgagtggcgcagggctggatttacctagaaaggcctttcacatcccaagagtcctgagaatcagacactttcagccctggttctcctagtgcctctgtggttggcttttccttccgtgagagtgtttgattatttcatatgtgtaagatgctacgtagagaccgtccctcccatttttgtttccagatgctgctaatcattgttctaataatttgtggaatgcatcaatgaattgtttttccctgaggtgtgagagccagctttcttttcttttcttttctttcttttttttttttttttgagacagagtctcgttcgtctcccaggctggagtgcaatggtgtgatctcagcttactgcaacctccgcctcgcccccccgaccccaggttcaagggattctcctgcctcagcctcctgagtagctgggactacagcacctgccaccacgcccagctatttttttttttttttttgtatttttagaagagatgggtttcactatgttggccaggctggtctcgaactcctgacctcaggtgatctgcccacctggcctcccaaagtgctgggattacaggcgtgagccagtgcgcctggccgagagccaatcttcatcccaccccagactcctgagtgtgactctatttctggactctctgttctgccttgaactgtgtgtccacaccgggttcagtggctttgcagtgtgttatgtgtttagtaagtcagccagcacccgctgggaatcctttttagtcatcatcctgggctgggtgttgggattcaacctgtaatctaatcccggcactcaaggaggccgaggtggggggtttgcttgagcccagggttcaagagcagcctgggcaacattgagaaaccccatctctgaaaaacatagaaaaaacccaaaatagttaactgtggtggtgtgcacctgtactgtggtggtgtgtgcctgtagtccagcgactcaggaggctgaggggggaagactgtctgagccagaggtcgaggctgcagtgactgtgattgcatcactgcactcccgccggggcaatggaaggagactcagtctcaaaaaaaaaaaagccctgtccagcctttcttggtgatgtgatgcttttccaaatggacttgaaagcagtgtgtccaccatgcgactgcaggttagtttaggaggaactcacgtctttgtgtggtttgagcctctccatccaggaacacagcgttccacacaaattctcccagcgttccacgcaatggaccctgctcagcgcccggcccctggggctgctattgtcgagggcctgccctctccaggagctccaacgtgattggtctgcggagaggctccctggtggttgacggcccacccagcgacctcccgaggtcgctgtgagcccccagcctggccctccccacgaggtgctggccttggtggcagccttgcttccttgtttcaggggcagcatcactgtccgttatctactgctgcgaacagatcgccccaaagctcaggggcttaaaacaacacagatgtttattttatttattatttgttttgagatggagtcttgctctgttgcccaggctggagtgcagtggcgcaatctggcgcactgcaacctccacttccttggttcaagcaatgcttctgcctcagcctcccgagaactgggactacaggcgcccgcccccacccctggctaatgggacgtttattttaaacatgacatctaacagctgggcgtggtctaggtgggagggttaggcctggggtctccctgagaggcagtaaggctggggctgggactcgagctgcaagtgggctggaggcctcagctcctcttggggcctccccacagggctgctgagggcccagagccagtccagagagccaagagccagcgtgctgactctgggacccggcggccacttagccattcctgccatatcctggttggtgaagaagggacttggggtcccagcagcaccagggccacgggcaggtcctgcctgtcaggggcccaggcttccaggtcagctgtgcctggatttctccaggggctgatggtggagtcaccaaccatcctgccgtccagggccgggcagggtctcaccccttccgcctggcacatcatcgggcgtctctggtgtgtgaagggctggacggggcgtggggccctggaggggtgcgggaaagacccccacccccagccgcctccgccttcgacggcgctggcccttcagggaggggcgtccctgctcgctggcgcttcccgaggttccctcgcagcgggggccgagctgtcgctggaggcgggcagggcggggcggggcggggggcggtgaggtaatttccgcgatcagcgtcagtgccgggccagaatcgaaactgagagctcctgggcaggctcggcagggcaggcagctccaggaggtgagcgcgggggtcccagggtggaggggcgggggcgcgggggtccaggggcggctccggagggtgagcgcgggggtcccagggtggcggggccgggggcggaggggggggtccggggggtgagtgcagccgggggcgcggagtcccgggagccacagacccagcccggggcagtgagcccgtccaggaccagcaccctccgcagcaagacccagcgctgtggtctctgcacccatggagcgcaggattttggggtctcggctcccgtcctttctggatggcagactcggatgtttctcagaggggtccgcggggagtgccgggttctcatactgaagtctgcctccagtctgtgcttttaaacttactcttcttgtagcatcccagctgcggtggggacccggggacccattcttcctggcaccctgagctctggtgggcactgtaccctcctctccgtgaggcccctcccaggtgcagatgtggagtcctcttttcctgggggccagtggtcattcaatagaaaaggagtgctgtgtccttagaagagtcaggagcctgaggccctggggtgcacaggacccctggcggggcagaggggtgcggcctcctgggggcggcactgtgccgagggctctgccccctccaggctccacaagcagtcaccttggctccttctaggtggggcctgagacccttcaggaggggggtctggctgtgtccgggtcagtgagccctgtactccctgacaggacacagctactgcaaggcctccacttgggcgtcagggtggggagagtcccaactccttgcttggtggagaggctctgcttgggcatcaggataggcagatccccagctccttgcctggtggagaggccgtgttctgagctgggcctggaccagatgtcctctggcctcagtctcacctgctccttctgtccaggcttcgaaccgtggccaacagttccagtggactgcgtggacccgtgagctcaggagctcagacgcctccctggagagccaagctggtgttcgaggtggcgcctccagggtccacctgctgcccaacagccccgcggccaccagagggccgtccctggcccggctgtgtgccctgtggacctgtgtctgggctgctcccgctgcacccagcggctcaatgaaagcacctacgtctccgtagggtggagcatgactgctcccgcgagatcctgctggcccgctttaagcaggccccaagagcaaggtctggcgcgtggtgggctgccggcccaccttcccaaggcccctgtgcaccaagtctgccactactacagccctgggctcggctgccggcgccaccgaaaccggtgccctttgcccgcagtcgcgaggaggccctggtctggaccttcgagcgtcagcacaacctcagcgcctatggctgaaggcggaggtgcagggcagcggggcccagggaggggcaggccggcggccgacgccatccttacggagtttggcggccgcttcgagctgctttgctccctctgctcaggcgctgtcccccatgcatctgtcgcgtggacccccaggggcagtgccctgagcacgagcctgcccctccctcctggcccacgtgagcgccgagggccgccgcaagcaacagttttggtggtgaggccgcggccccgggccggccagcctcctgcctactgcaggtttgtgggggtgggcagccgtgctggcgtggggagtcccgctgccagtttgcacacagcgccgtggagtggctgtgtgggaggccgagcagctgggtggcctccagcggggggacctgctcacacccctgcccctgatggcgacgggcgcacggccccccttggccagccccctggggcccagctgactgcccggcctgcttggtcacctgccactctcaggaggccttcgagaaccactgcgcacctcggagcacgcacagatggtggccttcgaccaggccctgccctgggagcaccgttcccacccccgggactctccaagttcgagctctgcccaaagtaaggatactcgaggcaggagttggagtagggcaggagcccaccataggcagaaccagaggttcccaggagcttggagtgggcaggagcccaccacaggcagagccagaggctcccaggagcttggagtagggcaggagccaccgtaggcagagccagaggctcccaggagcttggagtagcgcaggagcccaccacagcagagccagaggctcccaggagcttggagcagggcaggagcccaccgtaggcagagccgaggttcccaggagcttggagtggggcaggagcccaccgtaggcagagccagaggctccaggagcttggagcggggcaggagcccaccacaggcagagccagaggctcccaggagcttgagcggggcaggagcccaccgtaggcagagccagaggttcccaggagcttggagcggggaggagcccactgtaggcagagccagagactcccaggagcttggagcggggcaggagcccccacaggcagagccagaggctcccaggagcttggagcagggcaggagcccaccgtaggcgagccagaggttcccaggagcttggagcggggcaggagcccaccacaggcagagccagagttcccaggagcttggagtagggcaggagcccaccgtaggcagagccagaggttcccagagcttggagtggggcaggagcccaccacaggcagagccagaggttcccaggagcttggacagggcaggagcccaccacaggcagagccagaggttcccaggagcttggagcagggcagagcccaccacaggcagagccagaggctcccaggagcttggagcggggcaggagcccacctaggcagagccagaggttcccaggagcttggagcggggcaggagcccactgtaggcagaccagaggctcccaggagcttggagcggggcaggagcccaccacaggcagagccagaggccccaggagcttggagcagggcaggagcccaccgtaggcagagccagaggttcccaggagttggagcagggcaggagcccaccacaggcagagccagaggctcccaggagcttggagcaggcaggagcccaccgtaggcagagccagaggttcccaggagcttggagcggggcaggagccaccgtaggcagagccagaggctcccaggagcttggagcggggcaggagcccaccacagcagagccagaggttcccaggagcttggagcggggcaggagcccaccgcaggcagagccgaggctcccaggttcagtggacgggggcctccctgccacctgctgagggctaaagccattggcctctgaggacccggataagggaggttcatgtttgggaactgcttgagccaggcctgtcccgggagcacaggagtgggtgggacgaataaagcccctgctccctacagaggccagattgggctgaggggtcccggcctttgaactcagcacggcggctgtgcctctgtgtagcctgccgacctccctgtcccccaggcctgacctctgtgagtatggggacgcctgcaccaagcacactcagcacaggagctgcaggagtgggtccggcgcacgcaggctgtggagctgcggggcaggcggcctggcaggacgggctggtgccctaccaggagcggctgctggccgagtacagcgcagcagcagtgaggtccttgtggtaagtgggccctgggagtgggtggggtggggtgggtccaggcctcttgctgaaggctagacttccacgcagctggcagagacccttgatgggtgcgtgtcacctgcaaccagcccctgatgtaccaggcccaggagaggaagacccagtaagctggacgtttgccgtccactctgaggtgagcggagaacagctccgactgggcggaggagccctggggaagtggtgacttcagcccgggcagacgtcaacagcctgggtcatggagcaataccgaggcactgccgctcagcacctgcgtgacctgcagcaggtcccttagcctctcgcctcagtctcctcacctagagacagggggccaggacagtcccaccttggcagggttatctatggagtatatgggttaaaacaaggatttggccaggtgcggtggttcacgcctgtaacccagcactttgggagaccgaggcaggtggatcacctgaggtcgggagttcgagatcagctggccaatagggtgaaactccgtctctactgaaaaaaaaaaaaaaaaaaaaaaattagcaggcatggtggtgggtgcctgtgatcccatcttctcgggaggctgaggcaggaaaatccttgaacccaggaggcggaggttgtagtgagttgagatcgcgccattgcactccagcctgcgacaagagtgaaactccgtctcaaaaaccaaaacaaaaacaaggattcaccagggtcggcacctggagagtgggtggtgaggcctcaagctgcccacactgccccacgggacatcccaggggccccaggagggttcagccacccccatgtagcacaggaagaaactgaggatggcgaggccgggtggcctgcttgcgttctatccaggaagtggcagggccaggacctgaacccgcacttgggctacgctggccaggctgcctctcgggagggttggggggagccctgggccccctcaccgtctggcctcctctccaggagcccctgctacacgtggccctgctgaagcagggccaggagccgacttctctctggtggctcccggcctcccgccaggccggctctacgcacgggtgagcgcttccgtgtgcccagctccactgccgacttccaggtgggagtgcgtgtgcggccgcctcgttcggcacctttgagcaatgggtggtcttcgactttggccgccggccgggctgctacaaaagctggggctgcagctgggccaggggcgtcgcccaggaccctgcaggatctggcgctcggccaccctgaggagatggagcgctggcacactggcaaccgccacgtgggcctggcgtggagcggacggccgagcagacggccctgatggccaagtacaagggccctgcctggccctggagttcaaccgcagcagcgtggcctcgggccccatctcgccaaccaacttcggcagaggatgcaccagtttctctatgaggaggaggcggctcagcagcagctggtggcaagtgagctgggggcaacaggagcagctggggtagcaggagcagctggggcaatgggacggctggggcaacgggagcggatgggggcgtggacttggcagcggggctggcagctgtgccccatgagctgacccaggccatcctgccaggctgaccctgcggggccaggtgttcctgagacggcattgcagacgccagcgctgaacatgctcttcgcgcctccgggagcactgtaccagaggtccccgtcccctcctccctgatgccagacacagaccagggcttcctgctgggcgggcggtcagcacagccctggtggcccctgtacctgcacccgacaatacggtgttcgagtgcggctggagaggcgggccagctcagagcaggcgctgtggctgctgcttccggcccgcgctgcttggccctggggctgcagcctgaggcccgcctggtcctggaggtgcagttccagttgacccgatgaccttccgcctctggcaccaggcagtggacacactgcctgaggagcagtggtggtgcccgacttgcccacctgcgccctgcccagaccttggtctgtcccacccttgggcgtggcaaccgcaagcaggagctggccgtggcgctcatcgcgggctggggccctgggatgggaggcgtgtccccccgctactcatctatggcccctttggcaccggcaagacctaccgctggccatggcctccctggaggtcatccggaggcctgaaaccaaggtgctcatctgccacacaccaacaggtaagcccgagcctggcctgcccccacctcacctgacgcccggcccagtctacaccgggcaggcggtcaccccctggatgtgctccagtcctctgattctgcactcctgtagccgaccagctttgggctttggctttatcaggcccagctcagggcaccgagggggccgggtctgctgtcaggtgaggagctgggtgcctctgccggggccctggcccaaggaagtgtcacggggaaggctgcagcatggcccacccagcacttctggggatgagtcttgttttcgtttttatagaaacacagatctttgtcctaaccacaaggttcccctttggtttatgggtttcctctggttcctgccaccaccacctccccaggccggggccttcccatccctgccagtggggagtgggaggaagagcctgggacagtggccatacgtcccgggctgatttctggttgggggttctggggaccagggaggtgcaggtgtctgcagtgtcagaggagccgctgggtcgcccaggtgttgcctgaagccctccgtggcctcttgccccttggactcctgacagcaggacaccagtgtttgctgctcacctctgacagccagacaagggctgtgctcaggggcagtcggctgggcacacagtaggtgctttagcggacagcactgaggcccccagcaagaagccatgagctcctccccctcccgcagtgccgccgacatctacatccgggagtatttccacagcacgtcagcggcggccaccccgaggccactcctctccgtgtgatgtacacggaccggccctgagccagacggacccagtcacgctgcagtactgttgcctgaccgacgaccgccaggcttccgcccgcccacacgggcagagctggcgcggcaccgcgtggtggtcaccaccacctccaggcccgtgagctcagggtgccggtcggcttcttctcccacattctcatcgatgaggcgcccagatgctggagtgcgaggccctcaccccgctggcctacgcctcgcacggcacccgctcgtgctggcgggcgaccacatgcaggtcacaccccggctgttcagtgtggccagggccgggcggccgagcacacgctgctgcaccgcctcttcctgtgctaccagcaggagactcagaggtggcgcggcagagccgcctggtcttccacgagaactaccgctgcacggacgccatgtcagcttcatctcgcggcacttctacgtggccaagggcaaccccatccacgccaggggaaggttccgccccacccccggcactacccgctcatgttctgccacgtggcgggcaacccgaccgggacatgtccatggcgtcctggctgaatctggctgagattgcgcaggtcgtcgaaaggtgcaggaggcctacaacacctggcccagctgctggggcggccgcgagcagaggtgatctgtgtcgtttcccacggtgcccaggtgagcccggccagcccgggacagcccccgacgcacccctgctgggggagggggagctctccggctgatggacgagcccccgcctcagtttcccatctgtaagagggggctgcagtatttgcctcccagggctgaggtggggctcggccctgaggtgtctggagcttggtgggggtgccgtctccttgtcgggggtggcccagtcctcatgcgtcctgcgctcatccccgagcttggtgggggtgccgtctccttgtcgggggtggccagtcctcactgcgtcctgcgctcatccccgagcttggtgggggtgccctctccttgtcggggtggccgagtcctcactgcgtccagcactcatccccggccctgctgcgtcttcaggtagtgcactgaggcaggagctgaggaggcgggacctaggccaggtgtctgtcggcagtttgagatcctgccaggtgggtgaccagcggggccaggtgctgccagctgccccaggatacccgggtggctcggcccactcctcagcctggcatcggcaggggtggggctggtcccaccgtttgcgcacccagcctgacctgactgcgtgccccctgcagggcggcagttccgggtcgtgtgctcagcactgtgcacacctgccagagcctgctcagccctggggcactggcccctgagtcttcaccgacgcccgcgtgctcaacaccgtcctgacccgcgcccagtcccagctggtgtagtgggggacgccgtggccctctgctccttcggggcctgcggcaagctctgggagagctcatccgtgagtgcgtggagcggcacagtgtctgccccgagggcctgtccatggagcagtcgagcagggtgtggcgcagagacggcgctggcctccccgaggcacacaggctggggcacggggaactgggaggctgccccagagccagtaggggacctggccgaggagcaggcggcttggtgacggccatggtgaaggcagagccgggagatgaggctctgagcccagcatcccgtacatcacggcaaccacagcgcagacggaggctgcggcagcaccagcaggagacgcagtgaggaagacgtggtgcccggggcctgtgcggcaggagcggctgctgcagcgggcgtggagccacggaggctgaggatgcagaggctgacttctggccgtgggacggggagctcaacgctacgacgccatcctacgggagcttctggacgagagccagaaggtgatggtgaccgtcgggaggacgggctgctggacaccgtcgccaggcccgagtccctgcagcaggcccggctgtacagaacctgcccccggctgcgctacggaagctgctgcgcgcggagcccgagcggtaccgcactgctctttcgtgccagagaccttcgagcgggcgtcagccatcccgctggacgatgcccctcgggccccatccaggtcaggggccgcctggactgtgggatggccttcgccggggataggtgctggtgcagctcctttcgggagacaaggcgcccgaggggcggcttcggggccgctgctgggcgtgctgaagaggaagaggcacgagctggcgtttgtgtgccgcatggacacggggacccgcgcatcatggtccccatcaatggctccgtgaccaagatcttcgtggccgagtgaaggacccatcgcaggtccccatctacagcctccggaagggccggctgcagcgtgtgggcttgagaggctcaccgccgaggcccggcacagccggctcttctgggtccaaattgtctgtggcggcaaggcttctactacccgctgggcatcgtccgggaggtgctgcctgaggccgcacctgggagcagggcctccgcatcctcggcctggagtacagcttgagggtgcccccgcggaccaggccaccatcaccaaggtgctgcagaaataccacacggagcttggccgggttccggccgccgagaggactgccgcgccttcttgaccttcactgtggacccccagggcgccgcaacctcgatgatgccctcagtgtccgagacctgggtcccaggtgcgaggtggctgtgacatcactgatgtggccagcttcgtgcccagggacggggtgctggacgtggaggcgcgaggcagggcgctgcgttctatgcccccggcagggagccagtgcccatgctgccggccagctctgccaggacgtcctcagcctcctgcctggccgggaccgcctggccatctccctgttctcaccatggagaaggccagtggccagctgaagagcctgcgctttgcaccctccgtggtcagtctgaccgccagctgtcctacgaggaggcggaggaggtgatcaggcagcacccgggtccggccgtgagctgccggcccgcctggactccgtggacgcctgcgtcgtggccgcgtgcacttctctcggctgctgcgccggcaccgcctgcggtccgactgcttctatgagcagccgacgaggacggcaccctgggcttccgcgcggcccacatcatggtgaaggagtacatgattagtttaataggctcgtggctgagttcctggtgggcagcgagtgcacgcggacggtcacgctctgcggtggcagccagcaccccgcagccagcagctcaaggccctgtgtgagaagcatgggaccgggtgcccctgtcactgcacctcggccaccacctgcacggcggcgggggcagtcccccgacacgcggctgcacctcctggcctccctctggaagcaggtccagtttgctgccgcacccaggactacgaacagatggtggacttggtcaccacggacgacatgcacccattctggctcctgcaggccgcgacctccgcaaggccctggagcgctcggcgttcggccgctgccccggggccaccagcagcagggcggccactactcgctgcaggtggactggtacacgtggccacctcgcccatccgcaggtacctggacgtggtgttgcagcggcagatcctgctggcgtgggccatgggggctctgcctactctgccagggacatcgatgggctctgccaggccttcgcctccagcacgcacttgcccagagctatcagcggcgggcgcgcagcctgcacctggcctgcagctcaaggcccagcctctggacaagctgggcttcgtggtggacgtggaggcgggccccgctgcttccggctgctcttccccagcaaccgggagacgctgcctgacccctgcccctcccctacggctccctgcagctggccgagcacccccacgccctggcaggccggccgggctgcggctcctgtggcggcgccgtgtctactcagcgcagggatccagcccgcccctgccatgcctggcactgtgccggacccacacaccctggccgtggagacggccctgtggaagcagtgctggagctggtggagctgcagcgctggccggaggcggctgctctcatccaggagaaggcgaggcgtcccagcggcgggagctggtgcaggtgcagcggagccactgtggccatttctggaggtggcccgggagctgggcagtggggacaccctgcaggtgcagctcggcaccagctgcagcacggcttcctggtaccgagccctcagctctggacggtggcaccgggcttcagctctgcctggagcacgtggagcggcccggagactgcttctcaggccgtgtgtaccgggcccgagggaccggtaccgcgacgtggatgagtacgcctgcgtgtgggaaccattctgcgcctggagtcggccaccggcgcggttgccgagaatgactccgtcacacttcagcacctgagttctcctgggaggcgtcacggacgccgcaggggcagctgcagggcgccttccgcctggagccgccttcctcgaggagaactgtgccgacatcaacttcagctgctgctacctctgcatcggctcgaggggctgccggctcccacggccagcccacgccctgggcccagcagcctcggcctggcctgaatgttgaccccggcacgtatacctgggtggcccacgggcagacgcaggacgggaccaggagcgccgggcagaccggcaggaggctcccagacgggtgcacctcttcgtcaccacatgggcatggagaaggttccggaagaggtgctgaggccgggcaccctgttcaccttgagctgctgcccaagcagcttcctgatctgtgagtggcttccaccagcagaggctggctgggggaccgccccgggcccctcacttgcaggaggggggagctcgtggggcagcagccctttcctgggagtcctgttggttttccagtgtctgccttcacccccagccgcaaggaggagccgtgcgtggactagaggaggcgtccccgctggtcaccagcatcgcactgggccggctgtcccgcagcccctctgcagaggtaggtctgccccacccctccagcttcccctctggccccagccccaccctgcatgagtgctcagggaggctgccccctctcagtgatccccagcagttcctggagcggcagacctacaacatccccggaggccgccacaagctgaaccccagccgaacgtggcggtcagggaggctctggagaagcctttcacggtcattcagggcccaccagtagggcccacgccgggggagccgcaggctgccttgggccacagggacccacagggtgggtacaatctcctattctctggctgcaggtacagggaagacgatcgtgggcctccacatcgattctggtttcataaatcaaaccaggagcaggtgcagcccggaggccccccccgtgggggaagcggctggggggtccctgcatcttgtactgcggcccctccaacaagtcggtggatgcctggcaggtgcgccggggtcggcggtgggggcctttggggagctggcacgcggggcagactcacgtcccccaactaccctcaggactgctcctgagaaggatggagctgaagcccctcgtgtgtacagtgagcaggctgaggccagcgagttcccagtgccgcgtgtgggcagcagaagctgctcaggaagagcccccgggaggggaggccgaaccagagcctcaggtgtgcctgtgtctttggggcttgggcggagtggggccgagctgtccagacagtcctgtgtaggtgggctcactgagctctgcccccgtgatggccctgcgtggacagggctcactgtgtcctgtccccaggagcatcaccctgcaccaccggatccggcaggcccccaacccttactcgtcggaatcaaggcctttgacacccggctgcagagaggggagctcttctccagggaggacctggtcggtaagtggcaggggccagggggtggagctgcctgcagcatgggggccctggggtgacagcagtgtccccggcaggtacaagaaggtcttgtgggaggctcggaagttcgagctggacggcatgaggtcatcctctgcacctgctcctgtgcagcctctgccagcctcaaaatcctgacgtgaggcagatccttgttgacgaggcaggcatggccacggaacctgaaaccctcatcccctggtgcagttcccacaggccgagaaggttggtcggcggggggtgtgggcagcatgacaggcgtccctggcacagtctcccacctggggtgccctgtgtgtgcagacgcgggtgtctgtggggctggggtccctctgggtctaggggtgtcagggccaggcctgcctattcctccggtggttcttctcggagaccacaagcagctgcggcctgtggtcaagaatgagcggctgcaaacctgggtctggaccggtctctgttcgagcggtaccacgaggacgcacatatgctggcactcagtaccgcatggtgagcccgccccactcagcccccagcccacctgcagcccctgggggccacaaccccgcgtggcagcctctgaccagcgcacatccttgcctgcagcatgaggcatctgtgccttcccctctgtggcgttctacaagagcaagctgaagacgtggcagggctgaggaggccgcccagtgtcctgggccacgctggcaaggagagctgccctgtcatctttgccacgtgcagggccacgagcggagcctgctggtgtccacggacgaagggaatgagaacccaaggccaacctggaggaggtggctgaggtggtgagtgtctggtgcctgtgagtcaggagggctttctggaggaggtggctgaggtggtgagtgtctggtgcttgtgagtcagggaggcttcctggaggagggcaggagagacaccagggtccgctccacctgccccctcggctcccaggtccgtatcaccaagcagctgaccctggggaggaccgtagagccccaggacatcgcgtcctcacgccctacaacgcgcaggcctctgagatcagcaaggcccttcggcgagagggatcgccggggtggccgtgtcctccatcaccaagagccagggtgaggctgggggctcgtggtggggccgggagggtgggcgcagcggcagcagggcctcacctcccatcccgcagggaggagtggcgctatgtgctggtgagcaccgtccgcacctgtgccaagagcgacctggaccacggcccaccaagagctggctcaagaagtttctgggcttcgttgtggaccccaaccaagtaatgtggctgtcacgcgggcccaggaggggctctgcctgatcggtgagggcggggctggctcttccagggtgggaacacaggtgaggccagggctgggctagggagctgccgactcctcctgaccctgactccgacctgaccctgactcctcccacctgaccctgactcctcccaccgactctgactgactcccatctgaccctgactcctcccacctgaccctgactcctcccactgaccctgactgactcccacctgaccctgactcctcccacctgaccctgactccgacctaccctgactcctcccacctgaccctgactcctcccacctgactctgactgactcccatcgaccctgactcctcccacctgaccctgactcctcccacctgaccctgactcctcccaccgaccctgactcctcccacctgactctgactgactcccatctgaccctgactcctcccactgaccctgactcctcccacctgaccctgactgactcccacctgaccctgactcctcccactgaccctgactcctcccacctgaccctgactgactcccatctgactcccaccctcacagagaccacctccttctgcgctgctgccccctctggcgtagcctcctggacttctgcgagctcagcagaccctcgtgcctgccggccaggtgcgcgtctgcaggaggccaactatgcctcctgaagagccctctccacctgcaaggtgccaggactgggagggaaagtccagggccccccaccctccccaccaccctccgccatcagcctgcctgggccagcctgcctcctggcctcggatctccctggggcaggaagtgggtggacttggaggaggaacggcaagggccggtcccacactcttgctcctcctgggcatctggggacaggaacacctctcagggtggccaagagggcttccttgggaccagtgtaaggaagttctgctgtccctgggaagtctcagaaccaggaggaaaccctgtggaggctgccctttgacctttggacgccacctgtaatcactctggatgtgtctgtggagttcaggtttattttctatttaaatgaactaaaagccagcatcctgccggcgtggtggctcacgcccataatccagcactttgggaagccgaggcgggcagatcacctaggtcaggagttcgagaccatcctggccaacatggtgaaaccccgtctccactaaaaatcaaaattagctgggcgtggtggcgggcgcctgtaatcccagctacttgggaggctgaggaggagaatcgcttgactccaggaggcgcaggctgcagtgagctctgatggtaccactgcctccagcctgggtgacagagcgagaccctgtcttaaaaaaaaaaacaaaacaaaaccagatctgttactggaacagagacctcagcccaagctcaggacaaggaggcctccctgggaggggggcctttctcccaccatcaccgcctgtgtccttcaggggctgctggagggcagcccaagccaggggcccaccccgccccaccccaccccaccccaccctctgaaatgtgaaaagctgcactcttcctgtgggctgcgcagtgggctcgggggttggggggtgccggggcgatgctccaccctggactgagtgttcggggcagcctgctcggctgtatgtttctcgcacgctcaccgcttcagtgcggctctgtccctgctgccgcctccagtcctgagggaggggcttgcccaccttctacattccaatttttatatctttgaattatgtgattagatattaatttaatgaaaaaccactctgaaagctcttctcacttctgggtgtttgaggtctggctggggggcaaagtggatggtcactgtgcttggtacgcagttgtggaggctgtcgagggcctactgcagaggctgggcgcaggggcgtggggagggcggttttgggacgcggccgtggaggccgtcgaggcccactgcagagcgctgggcgcaggggcgtggggagggcggttttgggacgcggccgtgaggccgtcgagggcccactgcagagcgctgggcgcaggagcgtggggagggcagcgacccccctgcagggccggtgtctccggctgcctgtgtggggaggggagggccgtgcctggtgggtggggacaagccacagctccagagctgctccggtgtcaccaggctggccaagtccaagtccctgaggccaccagccttgactgtcctgctggtcccacttttaaagctgctccccagaccccctggccgctgtggactggggtccctccgcacctggcccatttgtggctgcgtcacaggggctcctgtggcctcccagagccagctcgggggtcagatggtcgcgggggctatgtcactgtgggaaaagaggttctgggcatctgtggagggaggggtggagcatggagtctcaggactgtggccccgttggtgtgctggacgggccctgccttgaagaccatgtctattctggaccgtcatgaaataagagtagttctgcaatagcttgagaagtgcctgcagagaggagagaaggcgcctctaggaagggggacttggggacctcaccagcctgcagccagggaaggttctgggaggaaggggcagctgcggccctgaaggtgagcggtggggggacgcaggggctgacgcctagcaaaagcagctgatcctggaggagagagggagctcagggccgggaaggccttgaggaacaaaaggtggggcggggcatggaggggcacggctgagctgctcacagccaggatccccggtggtgctgctgcctcctcgggcgggcgtgctgatgagcactcgaggctggcaggggatggtgggaggcatcacggcctaggagtgtcattccctgagggagccccacaaccagggaggtgggtaaggaaggccggagcccggtcacggtgatgggggtggtgaggagggcgggggctaggaccgcagaggccccgtggagcagcttttgtcgtcgtcgttggacccgaggtgtcaggggctggtacttcttgctccaggctcagctgtcttgggaggtccggcctgggctccccctgggaaagagcaggagcagaaggcctggggcttggcatgttttgagccagaaaaacactggtggctgctgcctttaaaacataaataggtttgcttctttaattccatagtgcatttacactcttctttattagtggataaatattagaaaatcatctctcagacagatggctgagggcgggcccctccaggggctccggcttggtgtgcagggtgaggctgtccctcagggctcgtacaccagcgtggaggtctcggccctcttgatggtgaacttataggatcgttgggcagcaggtttcggacgtcgaaggtgcaggcagccacggggatgacgccacactggcgcactcctgctgtgtccgcgggtccagcagcctgaagcgcaactcatactgctccgagtggctggctggatggtgacgaaccagcgcagccgggcccagtcctggtgagccgccgagcctttcggtcaaacacgacaggcatcttggtgctcagcatgagccagatgtgcgggatttggtggcactgacatcagacaccaggcggtgcttgacgtgtagccgccccggcaccatatggtcaggaagctgtccatgacggccgacacgtccgccagccgccgctccaccagcgccagtcggccaggaagggccgtgggtctggcgaccggagcagggcatccagctcagcacgccatggtcgagctgttccaacaggtccccgagcagcaggagctggatcttggtctgagcgtgcccaccttcttcatgcgctggaacttccaggggtcgatgagctggaacaaggcgctggcagcaccagcgggttctggtcgcccagggccaggtgcttgggcaggacctcgatgtataggagcacttacgcagcagctgcatgcgggcgtggtggcgcttgagcaggtgcggactaggtccgaggtcaggaactcacgcagggcattgcggcgctcggtgtaggtcttccacgctctggttccagcagctgctggtcatctgcctcctcctggtccaggaaggactggggattcccagcttcatcttgtccaggcccaggcctgccacatgggtgctcattatccgggagctgggggagggctgggtgtcagctgccaggcaggctggcctcccctgggctgtggcatgttgggggatggattcagcccactgaccccatgctggacctctgtccttcttcgggggcacactcgatgggaagaggctgcctggagggctggatgggcagcctacagatctggacacagttatactgaggggcaaaaacctctactgacaaccagtggcctgtgggacaggacagggaaaactaggactgcggacttctggccagaaccgcctgacctgtggccttgcaagggccccattcctaaccctgctgctgaaaggggttgctggcacccctcggggccgtggagaggggacgcgtggtcctaagcagcacaggatccccctcggggacattcgcgggccatcctcccgctcggttctccctggggacgctccacgcctcaccgcagttgtagggcacagagacaggcctaccaaagacgaggccagctggctggtcagcatgggaggagggcgcccaggcctgggcccgaggagcagccctcctcccacgctgtgggccctcgctgtggacccgggatcctgtccctgtgagctcatggactccacaagtgacactccatttcccagatggagcctgaggctaagagcttggttcttgttctcatccagggcttgagcccagtgctgagccgagtctgaccctcttccgtgggtgcaccggctgagtgcagctgtggccccaggctctgccgcagctccctggaagcaagccgcacccctggttgctgccccggctcccagcaaccctggagatctcaggttgcacagccacttgggccttggacgacccacaaatgagagctaagcagttgctgagttcccagggccacacaggtacgtggtgaagtcatatctgcccgggaagggttgcccttttgggctgaggcagatatgacttcacgagcgcactcctcgggaatccctcgagaacaggcccctggggcagcagggagtgtgtctggggtgaggtgccagctgagagcaggaccccaggaccccggcctaagccctgctcttgctggaggctggggcggatttcaccgctggagggaaaccgtcctctgtgacgtgtgagggatgttttctagtctccagcagctgcccaggtggaacacccgagaggctggtcgtgaacccggaaaggtggttctgagcccctcgctgcttcctacacgcccggtcccaggcccgcttccctgagaccaccaggtgcccgcactctaccccctccaccaactccccttggctcccctggcccgggcccacctccccggccgctctgcctgccccttacttctcgagacccccagccctcctctcccggcccccgccgccgccccaggaccgcgcccattgccctgcctctgaagcggagccgcgcgcggacttcccagagcccagcctccctccgcctccgcgggttgccctggggaccagcggcctttgtgacgctgcggcccgggggcggggcggggtggggacccgggaccccgagccgagtaatcttccatccgcttcgcttcctggagaccccagacttctgggggcccgcgtccccgactgaggggccacggcgggtggctggtccagagccaggctccaaggggggttcccgtcccggagcccttccgcgggcgcaccactcccccgcacccccggcttcgggcggggcgcaggagcctcgggtgactgggagggagttcctgccaaccccccagtccgagcgcactcctcgggaatccctcggaggaatttgggagagaggcgtggccggtgaccaggcggatggaccacccagcgcctggacagaggagaggggcggcttccccgccgcgggctctgcccagcaaggccccgcccattacagatgccacccattacaggtcctcccaccgcaggctccccccaccgcaggctcctcaaccacaggctcctcccaccatggctcccccctcccccgcaacggcccctcccatcataggctcctcccaccgcgggctcccccaccacggcccctcccaccacaggctcctcccagagcaggctcctcccaccgcgggccccctactacggcccctcccaccacagggtcttcccaccacaggctcctcccagcgcagctcctcccaccgcgggctccccccaccacggcccctcccatcataggctcctcccactaaggctcctcccactacaggctcctcccaccatgggctccttccacctggggctgcccaactcaggcaccgacctgactctggataaatggggtctccatagctccagggagccccgcagggagctctgaggccatctggtcccgtctgtatctgttcagttgggctcagggcctctggatccccccgttcccccacagcacaccccagctagctgggggtctcctggggtcacaatttagacaccccaaggtgcccctccttcaccttcaggaagatgctggaggaagacacccttccatcctcctcatctccacccccacggaggtcagtgctggggcctcttccaggatggggtctttgagcccctaccaggctgttctgtaacttgagcctcccccctcctcccggtgacccaccctggaagagctttcccttggtgcatggaggccccaggggttaggcctggcaggagtgggtggatgtgggtggttttttttttgagatagcgtcttgctctgtcacccatgcggagtcttcacccccggggctcaagtgatcctcccacctgggtctttctgatccttccggatacaggtgtgagccttgcacccagtcctgttgggtgctgtttctgccctgccctccctgctgggctggaactcaataaatgccagctattgttattgttatttagggctccaggggacaagccggggttgtttggagaagggggtgctgtctgacgcggagggttgggaagcagtagagttagaccccttacccccggccctgcagcccactgacggagaagcggggtgggggcaggcagcctccccttctcttttggggccaggcaggtcctggatgtctcccctctcctgggcccaccctaccccctttctttcaatttctgatttctaatctaattttttaaagttaaactttggccaggctcggtggcgcaggcccataacctcagcactttgagaggccaaggtgagagatcccttgaggccagaagtttgagaccagcctcggcaacacagggagacccctgtctcacaaataatttgaaaaattagctgggtgtggtggtgtgcacctgtggtctcagctacttgaaagctgaggccggaggatcacctgagcctgggaggatgaggctgcagtgagccaagaggtgccactgcactccagcctgggtgaca

SEQ ID NO: 5043 - DNA, 100000 bp, Homo sapiens
  misc_feature 30282, 30283, 30284, 30285, 30286, 30287, 30288, 30289, 30290,30291, 30292, 30293, 30294, 30295, 30296, 30297, 30298,30299, 30300, 30301, 30302, 30303, 30304, 30305, 30306,30307, 30308, 30309, 30310, 30311, 30312, 30313, 30314: n = A,T,C or G
  misc_feature 30315, 30316, 30317, 30318, 30319, 30320, 30321, 30322, 30323,30324, 30325, 30326, 30327, 30328, 30329, 30330, 30331,30332, 30333, 30334, 30335, 30336, 30337, 30338, 30339,30340, 30341, 30342, 30343, 30344, 30345, 30346, 30347: n = A,T,C or G
  misc_feature 30348, 30349, 30350, 30351, 30352, 30353, 30354, 30355, 30356,30357, 30358, 30359, 30360, 30361, 30362, 30363, 30364,30365, 30366, 30367, 30368, 30369, 30370, 30371, 30372,30373, 30374, 30375, 30376, 30377, 30378, 30379, 30380: n = A,T,C or G
  misc_feature 30381, 30382, 30383, 30384, 30385, 30386, 30387, 30388, 30389,30390, 30391, 30392, 30393, 30394, 30395, 30396, 30397,30398, 30399, 30400, 30401, 30402, 30403, 30404, 30405,30406, 30407, 30408, 30409, 30410, 30411, 30412, 30413: n = A,T,C or G
  misc_feature 30414, 30415, 30416, 30417, 30418, 30419, 30420, 30421, 30422,30423, 30424, 30425, 30426, 30427, 30428, 30429, 30430,30431, 30432, 30433, 30434, 30435, 30436, 30437, 30438,30439, 30440, 30441, 30442, 30443, 30444, 30445, 30446: n = A,T,C or G
  misc_feature 30447, 30448, 30449, 30450, 30451, 30452, 30453, 30454, 30455,30456, 30457, 30458, 30459, 30460, 30461, 30462, 30463,30464, 30465, 30466, 30467, 30468, 30469, 30470, 30471,30472, 30473, 30474, 30475, 30476, 30477, 30478, 30479: n = A,T,C or G
cgccatcccatctaggaagtgaggagcgtctctgcccggccgcccatcgtctgagatgtgggagcgcctttgccctgccgccccgtctgggatgtgaggagtgcctctgcccggccgcaccctgtctgggaggtgaggagcatctctgcccagccaccccatctgagaagggaggagccctccgcccggcaaccgccccgtctgagaagtgaggagcccctccgcccggcagccgcccgtctgagaagtgaggagcccctccgcccggcagccaccccgtctgggaagtgaggagctctccgcccggcagccgacccgtccgggagggaggtggggggtcagcccccgccaggcagccgccccgtccgggagggaggtgggggggtcagccccccgcccggccagccaccccgccgggagggaggtggggggtcagccccccgcccggccagccgtcctgtctgggagatgagggcgcctctgcccggccactcctactgggaagtgaggggcctctctgcccggccagccccccgtccaggagggaggttggggggtcagcctcccgcccggccagccgccccgtctggagggaggtggaggggtcagcccccccgcccggccagccgcctcgtccaggaggtgagggcgcctctgcccggccgcccctactgggaagtgaggagcccctctgcccggccagccgcccgtcgggaggtgtgcccaacagctcattgagaatgggccatgatgacaatggtggtttttggaatagaaagcggggaaaggtggggaaaagattgagaaatcggatggttgccgtgtcgtgtggaaagaagtagacatgggagacttttcattttgttctgtactaagaaaaattctctgccttgggatcctgttgatctgtgaccttaccccgcaaccctgtgctctctgaaacagtgctgtgtccactcagggttaaatggattaagggcagtgcaagatgtgctttgttaaaagatgcttgaaggcagcatgctcgttaagagtcatcaccactccctaatctcaagtaccagggacacaaacactgaggaaggcctcagggtcctctgcctaggaaaaccagagaccttgttcacttgtttatctgctgaccttccctccactattgtcctatgaccctgccaaatcccctctgtgagaaacacccaagaatgatcaataaaaaaaaaaaaaaaaaaaaaaaaattgtattttccatatcattgtgaagaaggtcgattttcaacaattctccaatagaaacaaagacaactgatagagactaaggtcctgtgataggttactgagcacaagaattgaacttataagtatcaaaacccaataaatcactttgcacacttacaagttatttgtataatacttgatctccctgaaagatctgcagagcaaagcttacacatactttttacttctaacaataaaattgtgtagccaaaaattagccggcatggcggcgaacacctgtaaacccagctacatggcagctgaggcaggagaatcgcttaaatccgggaggcggaggttgtagtgagcggaggtcgcccactgcactccagcctgggcgacagagcgagacttcgtctcaaaaaaaaaaaaaaaaaaaaaatttctgtgtagccaaattttatctttttcaataaacaatacattgaccactttttggttttcacagtggccatttacactgttctgattgaaaagtgtatgtagattcctaaaggaatgtatcttaaatccctagccttctcaggctagagggggattttacgttttctatggctgttgataatcgatacatgcatgacagcatagctgacacaatggacacacaaagataacacagctctctgttctaaattgttctttaaagtagtgcttttctttctcaatttgaaatgctttttagctctacagcaactactaagtgataaaaggataaagaaaacctttaatcctattaattcgataaaaaagtcactatcatgtgagatattccacttaaaaggcaaaacactaaaatacggcctttcctcccatataaaatttaaacacaaagaaatgttttaacactgatgtaatttaaaccaggcaattcagtttggaggcttgatactctctatgtagtttctactatgtgaggaattttaaaaagatgatttatgttaattctttatcagaacagaggggggacgtacattttctatgagctgttgataactgatgcatgtagtaaaataccatatgtgttctaactctccatctttttgtttagtccaatcaaggactatatagttacttaaatggtttggttgtatgagtataagaaatactttaaattaaaagtagtcagtgatcaaagttcataacttaataaataacagctggccataccttgtaaccctcccattccaaagaggtttagacctgatctttcacaggcaagtctcctgcagtctcatcagttggaccagacatggcctagctgtgaaaaaagaaaattcaaataaactctttccaaattattacattaactatgcaatggaataaccaaataaaacgaaaaagggactagaactttaatgggcatcttattgtccacatgtgtgcttggagaagatgaaagcttctattctaatagtactactacattcagtcatggagacgtgttcctttcaacagtgtatttcctatagtttgcttaggaaatgaagtaagattatcattaagaaatacctcctctccatccctttcctctccccagcctccaaaagaaagcagatacttggaaaaaactcaggtcaggaacttgattcaaatggttgctctatcattaacaaactgtcaagccacctaaactctctgagtttcagtctctcagttttaaaaatggagaaaataaacctatctcagagagttattctaagggtaaatgggatgagtaaattaaaagcactgatccatgtgcctgggatgtcaatattactcaaatattgtctgcttgatgtacaaatgagtggcagttctgtgcattttgtgagttttgtgaaagaggtttcgttgcataaatttaccaactggtttgtgtttttttgtgtgtgtgtcttgcctttgttgccatgaggcctaggtctcaccagggttcaactacttcaacatataggctctctagctaattctagtatttttgtagtttcattctttacagaaatacaccatagtaactctattttgagtatggatgtgagtggtccaccaatatctagtatgcaaaaataaaggattttatattttcatttcaatctacctagtaagtacatgcaaactgtgaatgaagatactctaaagggcagagttcttaagctctaggatatggttctagaatgtaaagaccaagacagtagcaagcttcattgtcttgttcagctctgtatcttggaggctagcatagagcgtggtgcattctgagagcaggcattcattaaatagttgtgagtgagtgaatggagtccatggggtttcagggtctgtgaacccagagatggtttaccaattttgtatgtatatgtatatatgcaatatcttttaaagagggttcataacttttattcaactcgcaaatggtggagaaccattgcattttgcttttacagaaacagctaacagacaatccttgggagatcatctacttcttttggaagtactcctatagaaaaggtcaatttttagatcctgttgacacataggcccgtgtatgaaaatgattagttttccatgacagagttaagtcactttaaaaataataatgatgatgatgatgatgatggtgttaacattcattgaacgttactatgtgccaggtactgttctaagtgttctgttataggaatgaagtgtctcaccattccttgtgaggctgttactcaaatgattcctgctttacaaatgaggaagctgagacacaattagttaactcacttaaggtggtagttgaaagtattaatagttgtgtctggtgatattttggttgtcacaacaaggaagcgggatgctactggcatctagtgagtagaggccatggagatgctaaatatcttacagtgcttaggagacataataatgaattatccagcccaaaatgtaataatagtgtagaagctgaaaaaccctgcacaatgctgcaatgcctctccaacaccacttatgttatccttctttgctcactatgcttcacttacattattctttactttcctcgaccccccatacccttgtcttgctcaaggcctttgtattagctggttccttaatctttggactcagttcacttcctcagacaggttttccctgaccatcctatgttagagtagtcttcctacatttcttcactgtttatttcttttcttttcttttttttttttttgagacagggtcttctatgttgcccgggctggccttgaattcatgggttcaagtgatcctcccacctcagcctccgagtagctggaactacatgtgcgtgccaccaagcatggcttgtatctcttatagcaatgcctctatctgaagttatcagataaaattattgtttgtctccactaaaaaaggataaaatcttgagacgggtattagtcttgttcacaactgttcaggaacagtgcctggtacaggggggaaccaacattaatatttattgaatgattggctgtgcgtggtggctcacacctgtaacccagcactttgcgaggccgagacgggcggctgacttcaggccaggagttcgagaccagctggccaacatgatgaaaccctgtctctactaaaaatacaaaaattagctgggtgtggtgcacacgcctgtaatcccagctactcgggaggctgaggcagaagaatcgcttgaacctggaggaggagtttgcagtaagctgaggtcttaccactgcactccagcctgggcaacggagaagaacctgtcacacacacaaaaaaaagaataaagaaaaaatatttattgaatgaataatgaatatcaggtactgagattaaaatggcaagcaaaacccccgcctttatgaagctagcagttatggaggtaatcacatgataaacaaataatatataattaagcaaacaatagaccatcaggaggtttagggtctaccaaccaactcctaatccagggcaaatgagcaaactgtgtagggacctacaacttgcaggatctggatagagatggcaattagcagcatcaactctcacttcatggctgggatataacatttcaaattggtcctggacgtggggataaagggcggccttgattcaggcctgaggatgtggaggtgtcttgggctgggctgctttcacgccagcagaatccagggccaactccagggccttctccaggcggcagagcggaccctaggaccccggccccgctgcagtggggagggtcagcaacctccacccaccctcatcctcccccatcctcccggtactcaccgtgccactggccctgcagctagctaccgttgctatagcgccgacagcgtgggggcggctggccgagaggagcacgggagaaacatggcaggctcccgtagcctcctgggaatgtagttctccttggactctagcctgtttgctcgcggggtagcggactacgctcttccgctgtcggacctgggaaattctcctgtgctaaatcccgtggcgctcgcgggtgtcgccgggtgcatcctgggagttgtagttttttctactcagagggagaatagctccagacgggagaggacgctgagagaactacatgcaggaggcggggtccagggcgagggatctacgcagctgcggtggcgaaggcggctttagtggcagcatgaagcgcaccccgactgccgaggaacgaagcgcgaagctaaggtatgtcgggctcccggggcctggagatcttcgtgcgctgtgagcaggatcagggaaccggaagggcttggtttgatggcgagcggatgcgcggtgttaaactagggatgacagggccttgtcagcaagggacctggagatattagaggggatgttacaaattgtgctcttcaggatgcaggccgagtcttgttggatcggctcaaaaatgagaagcaagatcccatttccttgtccttcttctgcatctattccttggttaaatttgtcgccatccctgtcctcagtttaccggattctcagatgactgtgatcataccagctgtgctttctcataatgtctctgaggactgagatcggcttagatgaaatatctgtgcagtcagctgtgtttctttgaacaattgtctccgtgaccggctgataacagtttgtgtcttttagcgctgtggatatgatctttaactacattgctcctctctacctttgatgttcagcttctggtagttgccattcctgggatgaccataataatggcaacagagattttaaaaagcatttattgtgggtcaggcatgtattaagtgcataatatttaaattatttcatatcattgtcacagcagattgcaagatgatattatacagatggagtataaataacagcccagcttcacagatgaagaactgaggctagaagcattgagtgttttcctttctctcattcccaaactcagatcctgttgatttgtctcgtatattgggaatatgcccactttttttttttttcatctccactaccttggaccaagcaccattatctttttaatagactgttggaatagcctattgattggcctacactcactctaaccctaacttaactcttcttccaccttctctcccttccctcaactaccattctcttctgacaccatagagtaagatcttcgtgaaatgcaaatataattatgtccctttcctttctcctactctgccaaccacctgtttaaaaatattccatggctttctgttgctcttaggataaagcaaaacttcacattgcctacaagatcctgcatgatctggaccctacctgctttcacaacccattggatatgacactctgctctctgcctaccagtcactttggccttcttaaaagtcctcttcactatactttatcgggcttcagggcctttgcacatgtcatttgctgcctactcatgttaggcaaatattggcagtgaataacagtgttaaataacgtagacacagttcttgcttcatagaatttcatcttacacgtgagtctgtttagggcaatacacctaaggatttaaatataaaatctgctctatattgacctgagttattgcagtatttcgtaagggaccagaagtttcatgcttgagtctgcatatgatgtggataatatattaaagataagcacaaagagggcacccttctgctttagtctacacagtgcaaagaaacaaatgtcacctcatggtgttgtgctgatgtctttctcatctttcaggtttatttttaaagtatttcatttattctgtgaagattgttgagcacctattatttgccataagttgggattataattttggctgaaatagaatcatgcaccaaagaagctcttactctattgaaaccataaccattgcctgtgagggagttactgtgtcatccatattttagagatttagaaactgagacttgtaggtaaatcgtgacttgccaaggccacttggttgctaggtgaaactagtgctctgagccaggtcttctgactccaaatcaaggcttttcccattttctgcttgtgaaacatgttgaattagtagagcaaattgtcttcttttttctttaaaaaattggctgttcatttaaaatttgtttgcttaatattatttgttgaacaaagtataagtagttgttttaaatcttaaatgtaaagtgtccaatggctcatgaatatcttctctttttctaatcaattttattgaggtataatttacatacagtcatttgcaacatttttgtgtacaatttgatgccttttgacaaatgtatatacctgcaaaaccaccacattggcatagcgaacatttctctcctaagttccctctcgttaatttgtggttagtctgtcctccaccttggcccccaaacaaccactgatatgttttttgtctctgtagatgcatctgtttttctagatttcatataaatggaagcatacagtgtatacttttgggtctttttttcatcagcgtaatgatttttttttcaaaatagagatggtgtcttgctgtgttgcccaagttggctggaactcctgggctgaagccgtcctcctgcctctgctacccaaagtactgggattatggcgtgagccactgtgcctggccagcataatggtttttgagattaatccatgttgttgttgtatccataatttgttcctttttatcgcaaattagtggcccactgtatggagataccaatgttgtttattcattcacttgttgctggacattaggattgtttctggttttggactctatgaaaaaagctgtttttaccattcatgtatgagtctttccattttcatttctgtcaaaaaagctgctatgaccattcacctaagagtctttacatttttatttctgtcgggtaatgccaggagtagaattgcttagttataggggagttctttgtttaaccttatgaagaaattacagttttccgaagtgatttgaccatttgttttagtttcttatggctgctgcaacaagttacacaaacttggtggcttaaaacaacagaaatttattatcttacagttctggagatgaggattgaaatcaaggcatcaatagggccatactccctttgaaggactctaggggaaactcctccttgcctcttccagcttctagtgtccctggtgttccttggcttgtggtagcatcactcataacttctctgcttccatcttcacatggccttctctctgtttctgtgtctcaaatcttctctcctttctgttaaaaggatgccagtcattggattaggacccgtcctaaatccaggtgatcctgagatccttaagagcctcaacttaattacatttgcaaggacactttttccaataaggttacattcacacgtgccgggtttttggattcggacatatctttttggggaacaaattcaaatgcactgcacccttttacattcctaccaactgttagtaggaatgtaaaatgaagttctacttgtttcatatcttttcatcgcttgtcagtcttttacattttaaccattctgtaggtgtgcagtgatatttgattttaatttgcatttcagtgatgactaatgaggttgctatctctctttttgtaaatctttattgagtgaggtataatttacataccataaaattcactgttttcagtgtaggactcaatggttggtagcatatttgcagagtcgtgtaactgtcacaccgtcttattttagaacagttccattccagaagaaactttgtattcatttgcagttattctcaattctacttcctccctagggaaccacgaatctactctgttctttagatttgcctttctggacatttttatatagatggactcatacaatatgtggtcttctttcacccaggagtttttgaggttcatccatgttgtagcatatattggtactttgttcctttttattacacgtggatagaattccagtgtcaggccgagcatggtggctcatgcctgtaatcccagcacttgggaggccaaggcaggtggatcacctgaggtcaggataacttagatcaagaccagcctgccaacatggtgaaaccctgtctctactaaaaatactaaaattagccaggagtggtggccatgcctgtaattctagctactcgggaggctgaggcatgagaatcacctaacctggaagcagaggttgcagagagcccagattgtgccactgcattccagcctgggtgacagagtgagctgtgtctcaaaaaaaaaaaaagaattccagtgtcaggatataccatattttgtttatcgttcaccagttgatggacatttgatttgtttctacattttgactattatggaaaatgctctgtgaacatttgcaccctagtttttgtgtggacgtgttttcattcctctttggtagatcttaggagtggaattacaggacttatggtaaatctatgtttaacattttaagaaactgaaaactgtttacttgtgtggctacaccattttacatttcccatcagccattttgagggttcaattttgtcacatccttgtcaacacttgttgttgtctgtcttttctattgtagccgtttagtgggtgtgaagtagtatctcattgtggtttgatttgcatttctctgatgggtaatatgttatgcatcttctcatgtgcttattggacatgtgtatatcttcttttgtgaagtgtcgttcaaaatctttgcccatttttttgttggattgtttgtgttcctattattaagttttagagttctttatattttctagatataaatcctttgtttactatgtgtgttgcaaacattacttccattcatctaggttacttaatagtttttaagaaaggtccactttatcaatgtttattttatgattcatgctttttgtgtcatatctatgcagtctttatcccaaagtcacaaagtttcttttttgctttttaaattaaactttgtcatccccataatgggcacttagtttttattttcttttctctttgaaataacttagatcatattttctctcttgtgattgcttatgcttggacttttatgctgtttccaagtctggagggtgaataagaaggttggaccacatagcttctacgattaacatttatttaatttgtgttaagcacatgagaatactatacggtattcagcatttttaaaatgaacttttcttctaaggcatataatagaacagtccagataagtattgatggtttgagttagaaccatggcgtctactatttccttactgtagggataggggattctaccccgtgcctcagtttctccagtcattaatgaggttaagaatagctgcttctgtgggtggtgtgaggacccagtgtgatgaggtctagctactattccaggggtagagtagcatgccttgattgagtttggtggcctgaggggtcctctgctggggtggggctggccctatgcatttttcccagatgttataatttattattttgaaatgatttaaaacttattgaagagcaaggtagaacctagagctctcatagacctgtttgtccatattcacaggttaacatcttgctggttcactttattgctctctttctcgccatatatatccacatgaacaatttttttaatgaccattgcagagtaagtcggagacatcagtcctctttacccctaaatagttcagcatatattcctaagaacatggacattctcttgcatacaaatataaacacaatcaattgttaatttagaaaaagttaacattgatataatgctattatttcatccaaagtccatattcaaattttctaattgtcctaataatgaattttatagcatttttttcctggtccaggttccatctggatgcatattacctttcattgtcaggtccctttggtctcttctcctttaatctggtgtccttcatgtcctttaaattggttcctcatcctttttctttcaagacattgacatttgtgatggtgcaagctatcttttatttatttatttatttatttatttaatttttttgtagaatggcctgtattcttatttgtcttatgtttccttatgattagattcagattttgccttttttttttttttttgagaccaagtctcgctctgttgcccaggctggagtgcagtggcgcgatctcgctcactgcaacctccacctcccgagttcaagcgattcttctgcctcagcctcctgagtgctcagactacagacacgtgccaccacacccagctaatttttgtatttttagtagagatggtttcaccatgttggccagcctgatctcgaactcctgacctcgtgattcacctgcctcgcctcccaaagcgttgggattacaggcgtgagccaccgtgcgcagcccagattttgcattttgcatgtatatttttgaggaaagatggggcctctagaggtcacatatttataatccaatatgcctcctggctgtaggtaagttttatttggcccaaacaaactaaaagttgtttcaaattattttctaatatttaaaagttgagggatttcacataaagatctgggtgtctgacttcttgaaaaacttaagtatctggtaacagtgggcatgcattttcctaactagaattgaaagtggcttcccttttaggtgggaaatgtgctttccattttgctgtcatccagttttgcccttaagttacaatatagtggtgtagtgtggagctttagatgcagactcctgagattgaatctgctccctcatttacttgcgcaagcaatttaacttctctgagcctccatttcctcattatcaaataggagtgatatggttctggtagggattgagatattatatagcacataaaacttgctggcatacagtaaaaataaacattgttatcatcatcattatcaccatcatcaccacaccttcactactgcctatctgaccccagtagatatatattctgtatgtatatatatattatgtattctgatcccaggacgtttattctgtaaacttatgttgagtgtctagtcaagtgattttctcaaatggggttccattaacttatttcccatgcagccagaatggtactagtttgtaccacctttcagaaaattgagaatatagtcactcaaaccattttctgtgttctgtgttcagataaggaacctgattaagtgtcgagtagtgtactcagcaccagggtaaagatggagacacagtcccatggaactggctggctgtccatggaagataagtaagtaccaacagcaagtggtgagttttatcacgggaggacacggtagcaaagaggatctaacatggcctagtatcatggaattccttccttagaagatctgtttaaaggtgtatccttatgagaggcctgggttccttacggggtttttcagaaacattaaaactgtttcattagtcatggaataaaaagcatggatgttgaaatccaagttagcttcaaagactcttatgctggcttaggttagataatttttaaactattaaaaatagaactagtttattatggaaatggttatatacctaagaacattaataattttgtttgagtaatgtacatttttatcaatgaaggaaaatatccagaatattaacctaccgttttaagtaacatgatttaaaaactcttctgcttttggtgatagttgtctatcaactttaaatgataaggtttattgagttataaaaataataacttggccaaatgcatggcttatacctgtaatcccaatgctttgtgaggccaaggtggaggaggctcacttgagccaggagttggaggttacagtgagctgtgattatgccactgcactccaggctgggcaacgagtgagaccctgtctctaaataataataacaataactcaacaaaagaaagtttgttattatgtttttactgactgggtatttttaccttattttatatttcaaatttggcattttatgaggtcctgagaaggttcttttggagtctacttttattatgggccattctagattatgtaccagtttatctaaagtggacactaaatataggacagttttggtgttaggccaaagaccggggacttgaaaaatgaaaacctcacctgacagattctactctgttttttttccttcttccgaaatccattattattttttgcttaatctctccttcaatatatgggtaagcctttaacactgtttcggaggtttagttgacttctgtaaatagaagaagagttagtgtatttgatctagtttccaaaccacttttaatactgtaccttacttgaaaattaaccagctaaactatcagtaacagtgagttcttgttgctttctgttatttccaggctgtttcctaaccctcctagactggttttgaaaactaaattagccattcaaaaaaactcttagacactttgagcaaacatagcttccttgaagatagcatttgtgtctaattcatcttttcatctctccattgtacctgcaggatgtcttccacaaaggagacattaataagtatctggtgaagaaagattaaatggtgagagagtccagcatctgttatgtgatatatgtgacccttcataattatgattctggaccttggctgctaatgagatttactgtggctgagtttagtgatacagattttggcatgtaatgatagtctccaaaaaagtagagatcatgtttttttttttttttccgttttgtcattcccattttatccctagcccttaagattttgccagacacatggtagatattccatacttgtaaacaatgaatgaatgaattcccaagagcatcacttgttattggtcagtagactttctatagtgagagatggaaccggaatttgaaagaagtaatggaaaatggttaagtaccttatgattttaaattaatataccataggtgtgggcattaattttgagaaacaagactcttctgtcaacacatactttagcaactgtcaacacttgttttcaagtgttctcttccaattttaaatgccagtttacctttcagatttagagtattttgttgttgttagtttattatggcagtttcttgctaaagttatatttaaagtgtgactttctaacttctagaggagaggaacttttgtaaggtggtacttttggaaccttaatgaaaaacacaccttagagaaggtgaatttagagtctgctaagcacattcatttactcttctattataaactggttttgtaatattttataaaatgtctcactggttgatttcacaatgtaaactgggaggattcttaggattccttgggttgattagaacaggttcaagagatgaagatttgtgttggtaggggcttgtttccaaacgttttccttggcatgctctttgttaagccatcacatgtttgaaagttaaaccttgaattggtgcatggtttgcatttaaaaaaatgtattttattatggtaagaacacaacataagatctacctcttaccacatttttaagtgtacaataaagtattgtaaactgtaggtacaatgttgtaagcagatctctggcactgattcatcttgtataattgaaactttatgccgcttgattagcctttcccatcctcccagccctggtcatcatctttctactctctgattctatgagtttgatattagacgtacatttttgtttttgctataagcatctgtcctgttgctatgctgatcattatttactctgtagttttggaaatgacctgcttacaagataaccatgcctccccttatgtaaaaaactgccatatggataaagggcagttaagacctttacaactggtagaaaccaagagaaaattcagtttgaaggaccaaattatgttgcagctgctctgaggaggagatttgttccagagcatgagtgttttcataattgtttgtgatcagaaaattcagagctctgatttctcattagccctaagtctgccctttggcaccttcatttagtgattggatcattcaaggctggcctcaagggccagcatttctccagtaataatataaaatgggctgatgttgcaaccttactcactctgctgaattgggcatgattaaagtctcaaggctgcattaatatggattttcttttctatgtacagccgtccattatctcactattttccagtttgccattttttgaaaacaagatggaaaattctgctgatgaaattttttttttgtctgtcagcacaacagcattttttggcttaagaatatgagaatagcaccgggcaaatgaatgcaaacattacagtttatgtggctctagcctgttgtcatgtcaatcttgttatttaggtaaatagtgtgcaatttttcaccaatcagcagccaatatgctgcgagccatttttgttttagttacattattggctggtaacctattaatgagacaataattgggaaatagtagtcattgttctcataaaacacgatcctttgttggaaccacagccaggcagaggagttgcatatgcagactgcaagggaggaaaggatagtagccagtgttcccagcttttaaaatcatcagacccctgctgcttaaattgccccagtgttaatgctggaaccattacagtaatggactcagcaaatgaaggagaacgaagacacgacactttattaccagaggggcaattttctcttcatatgtaatagcagcggtgcctcatatgatcagaccatcaagatactaatcctctgtaaaattactttttataactgaaaatgtgtaatccaaatcagtctgtgtcctgactgtctacttactattgaatacggactattagatctttatttttcatgatttaaaggctttgccctgaaaatggttggcttttcccttgcaacctgagtgcttaatcttagctatagcccagggttgtctttttgttttaaacagaacatcaccacttaattaaggagtgagtgtctgtcttgctgagttatgctggtgttttatgttccttggatttattaagcatcttgttttacattcagtctgcggtttgtgctgtaaataaaaatggcccatcttgcacatattagaaatttgcaggtagcaaatgtcaataagtaccagggattaaggttctttgatttatacttcaggcaccaggttgtggtttgtcgattgaacccatagcaggatgcatcttggtgtcttctgtggagcagatgtgtttttgcatcgttgtctgagaagtttatgtttatttctgcatccttggttcagtagattgcttttcagacaatgaggcataccgctccgcctcttatgtcttgtgagaaatgactacagctaaacattattatgagaagaccattaaaaactgatttctatcttcctgaatatttggaattttgggaactttgtaaaatcccatttttttcattataatctctttccacataccttatatgtttatttgtatatagaccaggtgccctcttggcagtatatttattctaatatgttgttatagctgaaagcatttgttgacattctctgtagagttcattcagaaatacttaattagtgtaccctttgtgtaccagacttggattacaggctggagacttgaggaagtgtaagatataatctttgctattgaggactcagtttaggaggaagacaggcatgtaaacaaataattataataatgcagtatagtaatactagtctactgtgaatgtgtacttcttgggagcatgggcgcaatagtaaaatcagcccattggttttttttgctgtgttatcaaaagcagaattctgacatccactttgagacttgttctgaatgactcgtagctgtttgaaagaaatctcttccttcctcactggagacatgttaccaccctagggggatagtcaaaggaaagttttccaaaaatgttttgatcaatgatcactctttggatatgtatagagtttcccaaggaggctacttgaaaggagatagtgcttatgtgtttatgttctggcatttatgtataaatcagtcttattgctttagagtatagtttatgagagaaactgtagcctgtggtggttaagaacgtggaatcctttagctctatttactggctagtgatcttgggcaagtcacctattctccttgagcctcaatcttcatctgtaaaatgggatcataatagttgtgaagattaaatgatttaatatatgtaaagcatttagaatattgttgggtaagtgctatataaggttattattattatgcgtgtgactattaatgaaattattttcatatgtagcttatgaaagtcagcttcgtaaatatagaaccacactgtatatataagtaatggtatgtgagatagagaagcatttcttaaatttcttaatgaaattttttttctgattcataataattttttattttagaaaaactaacaaatatggaaaaatatgaggcagaaaaagtctcatactcttcagagataaatactgttactttatattagtgtattgcttagaatatgttattatgcttatatataatatatacagtatgactaattttaaatatatttatgatcttatttatataagatatattttaaacaaaaattagaaagataacttgcatattttttacttgcttttttttaccatccagtatattatatttttttcatataattccaattgtatagtatttatggatttttttccatcctatcataggttatcctttagtgaacattcttgtacataatctctgcaaatctttggaatgtttcatagggtaaattaaaaggagaattgtatgggctacttttgttaagatttttggttctcattgtcaagttgccacctggggaggtaatgccagttccaatttaaagaagcaatatgtcagaatgcttattggtacatccactctaacactggaattatcagaaaacaaaaatgtttgctgatttggaggagaagtaggaacttgtagaactatttgtattttcctaattattatatttggttgaatttcctcccaccatttatattggccaatatagttcttttgtgatttgtttattcatataggctttgttcattttgctaacgtgtcgtcttttcttactgatttggaaaaatattttgtagattagggatgttatttactaatctgtgatagaaatatttttccagtttgtttattgcctgacttttatatttttgttattcaaagttttcctttgtttttaattagaaaaacattttccctgtcagtattagattaacagtatgcattcttctggttattaatattttatgtttttttcatgtaattgttaaaatgtgtcagaatttagttggtgttatggtatggagtagatgtggaaatttttcttccccaaggccatcagatatcgctgcctgcatttattgacttatcttttacgtactgatttgaatgcttaataatcagatctgctttttatcctgtttgtttttactttgacacatcattttaattgccacgatttataatatctttctaaatttggcagcatgaggcccctataattagtctttacttcaaaaattctgtggctcatctcttgctttgagaagacaacctaaattttttcccaggtaatttaaaaatcaccttttcaaggtcccccatgtgccccaccagtcttttggtattttaatgttattgcattaaatttatacattaatttggaaataactgaaatatttgtggtaaatctttttctcattcaataattatctgtctctacatttatttaagttttatgatcttcagaagctttgtaattttgttcaattgggcaccatttattactttatgtaaaatacgtgggtatttatatttttgattactattttttggttactattgaaaatgggatatttaaaaattgtgtttttaaatgatacttaagaaagttttttatgtgtttgctatttttgtatttggccacatacagaatgcattcttatcattctaatagttttggatgattttcttgggttttctggattttacgaggttgataatctacttatctgcaaatataatttgttttttcctctttcagtattatactctcctctcctttttttttcttctattattaccttgtctagaacctccagttgtagtggttatagcagatagtcatgtcttcaacagttatacttcgggattctagtattaataaagtggtagttgttggcagttatctttgattcttactttgtttttttcagggactgagttgaattttattgaattttaggaacattttttggacatctctttagatggtagtatcttacttctactgataaaatgtaatttattagactttctaataatggttccttgggataaacctacttggttatattatataggtcttttaatatattgctgaattcaacattttagtattttcaattaggaaagtaagatgggtcagtatcagggattcttatggaaaccgcagagtgtactccaggggttgagggtatatcagaatctttgaatggggcatatataacatacatgtgaacataattcaagctacagtttgtaaagcctaataaagcatttttggctgatggggatagatcacagtagaagaaggtaaagtgaataaaaatattgagaaactcctttttgtgcttcttttgtcaaatttggtatcgtattatgctagtatcataaaatgacttgcagagttttctcctccctgtcttcttgggaaccatttacaaagcattaggattatttgcctgttggaagttgaactttacttcttcttcttctttttcttcttcttcttttttttgagcagagtcttgtgtgtcacccaggctcactgcagcctctgcctcccgggctcaaacagttctcctgcttcgccccccgagtagctgggattacaggcgtgcaccaccatgcctggctattgtctatttattttcttcttgagtaaattttggtcattatatcttagaatgggagagttttacatttatgacatggcattgagcataacattctctggtttactagggtagaattgtgtatagttttaaatttaaaaaattccatattcactttttccatcttcttttaaattataactttgtacatcttgtcttctctttaaaaattgactatatttgctggtagtctgtttttttttttttttttaaacaagctcttgaatttgtttatgctctaattcattaatttctacctttgtttttatgttttctttgtcctgcattgcctaagcttcttttggcaacatcttgagatgaatgcttattattcatttttattcttttttgtttaatatggaaagtatttcaaaatcttaaaatagtttatctttttggtttctgtagcaatttgtgcatgtttttgtagcacttattcagtattcaatgatttttttcattttctttctcataccttagttatatagactatactttatttttcttgtaccccaatgtccgcagagtcttgaacacaataggtactgaactaatgtttcctaatgaataccctgaattcccccattcccctttcactccacacaaatagtaagtagcctgcttagttagtggaagtttagctctccaactaccagtgcacatcactggtggttggagggctaacttgtagtctcacattccaactaccagtgcacatcactagtagttggaaggctaaactggagtttcacatatgccacttactacgtattaccttgtatgagtcctccaatctctgtatgtttcatctgtaaaatggggataataactcccttccctgcttcatctgagatgtcataataagataataaatgtaaaagaactttgaatactaacaatgttatgtagatataaatagatttaaaataggtttttagcattcttatctcatccaccacttctccccctccccaccagtagaaattatcaagttcttaggaacagaaacttattttgaaatagacaatattgtacaattcatggagtacatagtgatgttttgatacatatcgtgtatagtgataagatcaggatattagcattttaatcatctcaaacatttattatttctttgtattaggaacacagaaactaaaaagatatatatatatcttttatatatataaaatatatatatatcttttatatatattaaaagatatatatatatctgtgtcttccgaagtatctagcacagaactttgttgacagtatacagtaaatatttgttgactggatgttttctgagatgtacttttctttttcttttttttttttctttgagacagagtcctgggtcctgctctgtcacccaggctggagtacagtgcacagtcataacttactgcagcctcgacctcctaggctcaagcagtcctcccaccccagctcctcagtagctgagactacaggtttgtgccaccaagcctggctaatttttgtacatttgtagagactgggtctcactatgttgctcaggctggtttcaaacccttgggctcaagcttctgcctgccttggtctcccaaagtcctaggattacaggtatgagccactgcacctggctgagacctacttttcaaacatgaagtactaagtgatcctcaattggaccaagacttagggccctgccccaatcacgttgcttctcccagtttactcggggtgacctagacagctacataacacacagtctggtgaaatgcacatgcgtaacttgaggatgtcaaccttttggcacagctcatttcctctgcagaagagcggctagagacattatactctgttcccgaagtatatagctaataaaatagtggagttgatttagattgataacaaattataaaattgataaaaaatatttctatttttataccatttagaacagctattaatatttttaaaatttttttctcaattgatgaaaaataaatgtatgattattccttccctttcaattgcagttacattacattttcttgtttctcttgcactgagatttattttttatttttagtttattttgttcattgctatgaagggtgataattgtatcaagtaagtctcttttacttacctgagagttcccatgttcttggggaaataaatgtcatcatataagtcagtcttaggttaacaggttgttttaaaattgcaaccactatccaaatgcagagtgatagtattttctgggtaggtatttcatactctctttcgaatattggtcaccgaaggatttcacaaaccactgacatttcagcattatgacagtgcatgtgctcctgtcaccctctgaccccatattttttttaaaccattcatttcaatcggaaaagtataattttttgaaaaaacagagatacttaccctttgcgctgcttttaaagattacgggagacttcatatctcagataattgatggtaaattctgcttggttgtttataagctcaactttggagatctacaaaaagagtttcatctgagaaataaaaactattttaatgattgttgatccaccagactgtgaggtcttttcttcagtccctcctctttcatgaagcgtttgagattattccattcatctctttccttaccgactttatttcctgtgtcaaaaagtatgatacaacggtaagtttgtgtatggtacatttactggtgtatggtaccgtatgtggttgacgttggtcatattaaattttacattttgagattgcttatacatagtagtgttttatacacagtattctcttttccctatggggattataagatccctctggctgacaacactgctataaattgttttttgtgtctagtaagatgctacaaatgtggttgactctcagcatttcttgtcaaaggaaacatgtatagattggaagttaagctttttgttttttgtttttttttactttactgacagttatttaaccttaactcttaatctgctctccatcaccagtagaaaatattttgttagaaaatgttttgtgtaggctaggtgtggtgactcacgcctgtagtcccagcactttggaggacgaggcaggtggatcacaagatcatgagtttgagaccagcctggccaacatggtgaaccccgtctctactaaagatacaaaaaattagccgggtgtggtggtgtgtgcttataaaccagctactcgggaagctgaggcgggagaatcgcttgaacccgggaggcggaggttgtgtgagctgaggttgcaccactgcactccagcctggatgacagggtgagacgccacctcaaaaaaaaaaaaaatgttttgtgtaaaaccatatgacagaatagatctgaggaaactgcattgtagccataggagaaatcatagattttggtggctctttacctatcactgtgttttttaaagagttatgtctgaaccacctatgtgtcccgattcattttgccatttcatctactgccttcctcctgtttttatttaagactatgaagttactttagtgtaactgctgctgtcaccttgcccttagctaatcaaatagtttaccttgagggaagcatttatctcccactttcattttattatttttgtagctgtaaagatatatattttatgtctgcagaaggctgtaacagtgaacgaggtattgatctgctgtatttagcaatttctttccaccttgccatcaatagcatgcagcatctgtctgtaccgtggttgacctcacaaatagctctttatgctcccattggattaaatgatatagtatgctgaaaactaaatcaatgaatgattataaagtttttagtattattcatgacctggaggcaactggtactccttgcactgacagttcagtgtacaatgaatatgtaaaatgagtgtgtctggcctttgttctactgaaaggaggaaaacgggtcacctggttggtcagctcatacttctaatgatctcaaagcacttaggcacttcagttaaacatctcacttacagaatcaggcagagagaagagcaagactcctatttaactttattccccatgcctcacacaagtatgtagcaaatgtttctaaaattatttgagctataatcatataggcttttgcttcatttataaaagaaagacaaaaacccaaaactagatgctttgtcactgtcaccaaggcctaacgaaaaggcacatggtggaaggagggagagtggtaacctaggtttaggtctaagggactcttgcttgctgtcagcacctggtacaaataccaagatagggtttttggggccacttttccatttgagggagttcctactcacctccactgatctgtggaacactgaaatagcagagtcactaatttgcctgcttttggatgttgctgaattcagcatcgtcttgaaaagttctgccgaatcatacattcagatgaaagatgttttagatattaaacttgacatttgggataatggaaagatagaaccaggtgatggtgggtgaacagggaaagtagaacccagcagttgtatcctgatcttttgaggatatgaatcaaatctatttatttctaagaaatgccatcctgagtactcctttgtccatcagcccagtaggaagtttgacaaggagtattggggagttcacaactaattcattccccagacatttgttggatgaataatgtctgaaaaatagggtatcttgctgtattccttacagatgacgggttatctcctttccccagggtcacttaaggaagagtgatgatagtgatcagagcttaaaggtgttggtctacaccagtgctgccacgaagtcaggatttgagaccagtctatagtgctggtgtagaccaacacctgtatataatgtttattttcagttcatttgtaccactaaatactgtctctgatgggggccactagggctctatttgtgatagaaatcctattgttgagaattattactgtgtcctgggttagagagaatagatatgaggctagctcctcctcttgaatgttcatgggaaactgtcatgcttggctttagcaaatccagatgtgtctacctgccttttttggccaattgccattattccccccagtaagatatttgaaaggggaaataatgggtggattttatgaccatttcatgtctggtcagtttcttttcctactgaaaggatgaagtggggactcttcatgtaaagccacagagtcggaagccccgaggaagaattcagcttggtcctctgaatctgggattgagaacaacaaactgaggcaccatacccttatttcctgtagtataggaaattgctgataattaataattttagcattgaacttattcagtccagtaaaattttcttaggatctgctcagggatctgcctctcctaaattcttgggttcttttgttattcattatggatatgtgactgattaatcagctaagctgtttttgaagtcatttaacttttgttctgtattatcctttaggaatatgagtaccattagtactttgtgatgctacaggagtacttccttttcatttgtcctgtggtgtctgaaggagaactttcttttattttcctgtattagttcacgttatactgtgaggtttgcaactcaggtctaaatacaggattgggaaagatgttcctgtctctcaattcagtctttgtgattttatgtacatatatgcctaatattagataaggaattttcccactcagattatgctgctggaaagagaagtcacttcaattcaaatctttctcaagtcttttgtattgtagaatgatcttcattgtgaacggcattattggtcagctatccaaatagtatgtgagtgtgtacttatggcttggaatatttttctggtcaaaactatatgtagtaatctggatttatgcaccataatttctattttttgcctaagatggaaggttgctacatgctcatatagtacttaaaataatttatgttttgctgtctgcagtatatattagaaactagctatattcttgttggtagagaatagggcaattagttgaccttgttcatataagctttgatagtgggatgtcttggctttgttccttgtagatgatgggttattcctctccccaggctcacttaaggatgggtgggtggtagtgatcaggaattaaagagtactagtgttgcctctggtgtagacccacacttttatataaaatcattttcaagttcaaactctaaaggctgtgtctgatgagggccacttaaggctctgtttcttagaaatcctattgtgatgaaaaggctgtaagaagacctgtccaacttaattcttgatcctagctagtcacttatgacaatcatgtggcctgtaaatgagataagacatttctttttactcaattaagataagaagaaacctctttacaggttatatgttaatgcacacacatcttaatacaatcatgtattctactacatagaaaagcaataagagcccgaacttagaattgtataaggaggtatttgttcatatactggactctgaatcatttgtggactacgattttataaacactctaaaaaaattaaaacgtgtcgatgaactactgtgtacctaaagttacattatttttcattaaataaaatctatatacacacactaatattcacagttctcataatagtatggttatattatgttgaactcgtccttcttaaagattattttgttttgtagacatgtaggaactttcctagaaaatcgtatccagtttttttctgtgccattttgaattagaaactccctaaagaagaataaattactttgcattttctttcatttttttaggatctgagaatgtgtatgtgtctgaggctaccttgtgtctaaaagcagagcatgcttaaaaccatggctgaggagttatgcttaacggtatatttgcatgcatttgtgatttgaaataggaaaaaaagtcaaatttgagacagcttgaatgcatgctgtcagtttggagcttcatgaattggcaatggtctcatttaggaccttcagatggtctctgcctggacagaatgagaacattttgcatgttcagaaggagacagccactccttctgcttcacaataggcagtggtgcatgacagttgcccttcattgctggcttcttggagctaacctctgaccctccacttagtcactgtgcagcagttggagcaggttggagatgttgggaatgacaggcattggcctgcaacatgcttgtcattatttgactgtcaaaaggagcctgcattggtttccatcaaggtttgaaacctctgtgcagcagtccatattacttaacttccaggctgtcaacaggatgatcaaatgtgcataaaaaaatcagagtgctgaatatatcttcatcaggagaaagaagtttcccctcttcttttctttctttctttctctctttctctttttattttcttttggctaaatatattcagatgactttcacagggccaagaggttgaatctgttctccagtgagaaaagtgaactgttgtctcaagtggtctaagtttcaaatagcacaatttaatctgagcagctctgctggctaaattctctgacttgtctggcatattctatcagctttagctgttagtttaagggactagatgctagtccagtggtgcctggtgttagctcacaggaaaaacgtttactttggtctctatgtagtgttgcaaagggatgcagacgtctgtgtatgtactgcgaatgaaagggatgattttggatgtatgattactatctcatttaagactctttttccacatggtagggttcaaactggaattttaagtgatctgatcaagtcttagaaacttacaggtcagtcttatgcaatttattttttagacatagaaaaatatgacagcaaaagccatttttttcttgtaaatttgaaactttggtttgaaaagcatcttgaagtggaagaggatgacctaacagtattctggaagtgtatggaaagtgttggtttgcttctaacattgtgcagtgatggtgtgggagtcacgagacctgagttttagttttgcttctgccattttccagcagtgcactgtgtgtaagtcactgaaccccttagtctcagttcttcatatggaaaaatagagatctaatatggtgaggatggaaggaggtactgtttgtaaagtacttgcttttgttaagtacgtagtcactcagtaggcattccctgatctcctttttatccttttcttttacatccagtgtagcaggaaagacatcaaacagtagtaaggggccaggtacagtggttcatgcctgtaatccagtgctttggggggctgaggtgggaggatttgaggctggaagttctacaccagcctggtaacatagtgagaccctgtctctacatgaaattaaaaaattagtcaggtgtggtggtggcacctgtagtcctagctacttgggaggctgaggcagggggatcccttgagcccaggagttgaggttacagtgagctatgatcacgccattgcactccagcctgggcaacagtgctagccctgtctcttaaaaaaaaaagtcagaagacaatacttgagctgaataaacattccagacctgacacagtcaatcgttgtgttccaactcttttcttctcccatagttctgattcttgttatgacatcacgttttagtcaagcactcaaactaccaatctgagtaggctgcctgcctccttttttctccttcccttccttccattcattcattcactcaacagatatttatagagccctactatgtgccaggccctggtctaagttctaggatacagccatgaactagataggtacatttggctatcattaggtatctggagagagagacaaaaaataaacaaacaaataatgatttttgatagttctaaatactattaaaaaattagtgtaagaggataaagagttattttgttggtcacagaagagctttcactgtagagttctttccagcagagaactgtttgaaggaagagagggccctgggaagatggggacagtcttccagacaaaaggggaccatacttctttttttttttttttgtcagggagtctcgctctgtcacccagactgaagtgcagtggtgtgatttggcttatagcaacatctgcctcctgggttcaagtgattctcctgcctcagcctccaatagctgggactacagatgcccaccatcatgactggtttttttttttgtatttttagtaggacagggtctcaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatacaaaaattagctgggcttggtggtgcgtgcctgtattccagctactcgggaggcagaggcggcttgaacctgggaggtggagatctcgccactgcactccagcctgcgtgacagactgaactccgtatcggggggaaaaaaaaagtaaaatgaccgtgtcactccactgttcacaattcgtggagatttgccactggctgcatgttaaaattcagactcctgggcttgctgtataggtcctgttttttcagccttatttattgtcagctggtaaccacgcccccaacccccagcttcacccccataatttataccttatactcctactgttggaaagtggtgacccctgaacatagcctctgtccttttctctttctagactcttctcctcccttctcattggcacctagagaagatgtatctttcaacaatgtccacaaatgccacctcttctgagacttctgtgattctgcatcctcaatgttgtgtacacttccttagctttcccctcactatagctgtttgtccattatttctcagtccctgagctctttgaaggcaagaactgcgcttttattcctctcttgtaatgcaatatctggctgagtgtctggcatacaacaagcactttataaactgtcacctgtgatgcctaatctttagaaatatttagggatagatttatcatggacttcaaatgtagatataacagattggacagtatacattttgaagagctcttcagtcaaaatattccatgattgataggagacttctttccttaggcctaatttaaataaatatcatattgaaaggagagtgatgcagaaaacattagaaactaatagaaatattatatatactaacttcccaagaacaccaggattagtgtcactgagcaagttagcttcagataaacttttatgttgctttttttttctataaccaacatgtgatgtatcttttttcaaagaagatagtattaaattttgtatttcaattcataagtaaatttcatattttttctatccatccatttatctctacatttttccaattatacgtatagcattgtcatgattttttttgtagttttcattattttagaaggcttttttttttagacagggtctcactctccttgcctaggctgaagtgcagtggcacgatcatggctcactcagcctcaacttcccaggctcaggtgatcctcccaacacagcctcgtgagtagctgggatacaggtgtgcaccaccatgcccggctaattttttgtatttttagtagagacttggtttgctattattgcccaggttggtcttgaactcctgggctcaagcgatctgcctgccttggctcccaaagtgcttggattacaggcatgagccaccgagcccagcctattagaagcaatttatgccaaaccacagtagatttgtcatatgaatagaataatttatttaaatagtttcctcattgttgaccaattagcttgtttcatttattttatcagcataaataatgctgtgttgagcagtgggtttaaacatttgtatgtgcatttttaaatgaataaattcctagaaacagaacacggagttaaagatagggattttttaaggctcttgatgcatattgccaagttgccttatgaaaaggtgtccagatgtttgtagagataggttgtaaaaaggatcctgcattagaatgttttcttagattacttgtatgtgaatttgggatctaactgggaattttatatttgagaggcattggagagttcagtaatgggcataaagagaagaaagagatagaaggaaaggaagaacaaatctagttttgaacttctcaaatggtgtgtaggctgtggtttagtgattttcagacttgtcctggctacctatagggatctgcttctccaggtgggggcctgagaacagcttagctctgttgatgtatttgtttatacttttggataaaagttccttcatattaatacttccaaattgaaaagtttgaaagccacttggtaggtctctatgtttactactatcattttcagacaatgattcaaaagggaattatcttgttcatgcctctgttgtttgagatgtcagcctcctattcattgttaccttctttttttaaaatttaatttaatttaatttaaattttttgacatgagtctcactctgtagcccaggctggagtgcggtggcatatcggctcactgcaacctccgctgccgggttcaagtgattctcatgcctcagcctcccgagtagctgggactacaggactcaggcctgcgccaccacgcccaactaatgtttgtactttttttttttttttttgagacgagtctccctcttttgcccaggctggactgcagtggcactatctcggctcactgcaagctctcctcctgggttcacgccattctcctgcctcagcctcccgagtagctgggactacaggtgtttgtactttttgtagagacagggtttcaccatgttggcccggctggtctcaaactctaaccttagataaaccgcccacctcggcctcccaaagtgctgggattacaggcgtgagcaccgcgccccagccctcattgtggccttatttttttttttttttttttttttttgagacgagtctcgctctgtcgcccaggctggagtgcagtggtgcgatcccggctcactgcaagcctgcctccgggcttcatgccattctcctgcctcagcctcctgagtagctgggactacagcgcccgccaccacgcccggctaatttctttttgtatttttagtagagacagggtttcacatgttagccagcatggtctcgatctcctgacctcgtgatccacctgtgttggcctcccaagtgctgggattacaagcatgagccaccatgcctggcccattgtggtcttcttaaaggaccatgttgctaacccgaatgagagaggagtaacctcctgaattaggagttgttactgcatttacaaatatcctgttacctccttcacctctgtatggttaaggaaatgtggtatcaagcactttccagttcctacttcagtgtgggaactgtgaagtatcttttaggcaaagtagagttaaggcaccttaagggcaggaacttcttatcttgcttttattagcagtcgtgtcaacagcactaaaatgtgatgacccactttcccttctgataaaaggagaatgacctgcttggcaggatggagagaggtgcctgaggcagattacattgttaccgctcataataacagtaggcaaaaggaggggggtggtggaaaggccagcagatttctgtttacccatggaaatgtttgactttttggcttctgatgaaatgtgctaagaagagggggaaaaaggagcattgtagcagggaaggaatgaatgagtaaggaaaagaaggaatctggcatcagggaaggaatgaatgagtaggaaaaaagggaatctggtgtcatgtgagacatgtgaagccacgaagggccttaaatccagccctgtagccatctattggcagagccttaagacctcaaaccatagagggagcccccctttctgtctttttaaatttaacctatatttgtttagagccaagatctctgacatggcttgctgacttttctaaagatgaactgaggccaggcacagtggctcacgcctgttatcccagactttgggaggccgaggcgggaggatcacctgaggtcaggagttcgagactagcctgccaacatggcgaaacccctgtctctactaaagatacgaaaaattagccaggtgtggtggtggtgcctgtaatctcagctactcgggaggttgaggcatgagaatcacttgaacctgagagcggaggttgcagtgagccgagatcgcacaactgcattccagcctgggtaacaagagcaaactccgtctccaaaaaaagaaaaaataaaaaagaagaagaagatgagctgaatacaggggacctgtacagttgataggctctgaggagatatcaacacggaaaattagggacgtaattcccactcctcaatgaaggaggattcttctcagttaagtttatttacttacttggctttggaccagagtctgataactctgggaaaaagttgtagttattttgagatggtcgatataattaaggcttttttaagagagtaattgtgtggtttaacctgtcatcttgaaatatgaattaacagagataacattaaaaaaggttatatgtgacatttctaggtgtctcagaaaaagattgagtttgtctcatgtctaccatggcaacactcttgagttattataaagaacattatataggatttcctctagaatttttaaatcttaaaatgtaacttactttagccagaataaaaagggtttaaattaatggaaaactgactggaaggaagatataaaacaagaaacaataacacacaaaacttcactaaagtacacaattctacaaattatgcacacaagcacacacattttacaattgagggtatttgtagaaattcaactctcatttgaatcaactcatgacaaaacgtattacaaagtaagtagaatggaaaagtaccaaaaaagcatttcttgggttaatggtattaccaggtcaaatccattaaggaaattctctgccagaccttttcttttttcttaagacatgagttttgcacttgttagtataatttgggagtggtcaagaagctaggtgatagaacaacttagattctggatttctggtctattatttggttttttttatgaataagagattcactctttctttaaaggaagtaatttagattcctagcactgtcatttctgttctgaatgttataaacctctgtacaaaatttgaaaggaacagacatgctctgatgatgtacagaatcttaatgttcaaaaacgatagttctcttcccctagaatagaaaagtatagcgttcacctgattgcagacccaaatgtctacatctgtggttgggtggccaatatcacatgaaagagttttgtgccttttgctcaatatataagtttgaaaaatgttggctgcaagtaacagaatttccatgtaacatggattaaacagtaatgacatgacttttcccacatcataagctgtctggaaggaggaagtctcatggaacagtggcttaatgatacagtcaaatgcaggtactttccagttttctgcttgccattcttcagcacgttggctttttcgtcttttgacttgtaacctagtgatcactggttataacagtgccaggtatcatgtcctcatgtaactgtgttcagggtaggaagaagaggtgggaagataaaagagagtttttatattaggagggaaatccttcctgtaagtcccctagacactccttattatgtcctattggccagatctggatttgttggtcattcctagttgcaaggagactgggaaaagaagtgtctggcaaaagggaatgcgattcctacgcttggcttagaagctcatgatccattccttggaactgggctcatggctgcccctgttagcagggaagcagatgaatagctgttgagtaggcagccaatggcttctgccatactcaattaatgtgtgactgaaatgagatttttatcttttgttccacactggccaagggatatggcctctgttaccattaatataaccctttgagacaaatacatttaagaccagaattggaactttgaattatccaccaatacatttaattagcactgacagtgttctaggttattgctagacacaggagatactcagtgaataagatggacagtctctgaactcatagggttgatagtctagtaggactgagaattaggaagtagtttcagtagatatggggaaggcacagtttgctgtgcggtgaatgcaatcagctaacatggactcggagagtcagggagggcctcttggaggaggctacatcctcgcgactccagagacacaggattcagctaatctcagaaaatgatgagttgatcaccctcctttttaggtattcttggaaatccaagcaaaaacaaatctgctcttaatgtggaaactgtggaacttgagaattttatgtgcttcacggagtgagtaattccagcagcagctcaggaagcacatagcagagtgtaaatggcattgtctttgaagcctagttggataagctttctgcctcatctatctgtgtaaggaacagggtttctctgaaggtatctttgaaatactctaccatcagtcatatttctactttcacctaagtcaatattgaatcctctttggaaatcttggggtcatcttcctttctgtcaccttctatcttcagtcaccaagtctttctgtctgttagcagctctaaatctgacccttccttctccttcttactgcctctgctttagtttcttactctataaaaggagataatatatcactgtgtagatgccataatacaaatagcaagctcttatggcactataattttttaatacatgttaaccatatgaataggtcttattattattatgtccattttaggatggagaggttaagtaatgtgttcaaactgctccagctagcagctggtagagttgaggtttgaatataggctgaacatctggctcctgaatctgtcctctgcattgtactgagaacctgtatcgtaccgaggtacgtcatctgtgttcttctgtactctcctattttgggctaaacaggtcaaactcctatcttagtgtctttgaaatgctcaaacctgcacgttgtgcacatgaccctaggacttaaagtataattaaaaaaaaaaaaaaagctccaccatcaatctgtagttctgccctcacccaagtcaatatcgagttctctctggaaatctcggggtcatccttccttctgtcacctatcttctgtcactcaccaagtctttcaatctgtcagcagatctgaaatcgacccctccttctcatttccactgcctctgcttaagtttagggtgtctcaaaatacctcttccagcacagttgcaatagtctcagaactaatgttcttgcctctatttttcccttctcccaacatcctctctttttgccaatttctgtttcacattgctgacaagtggtttttcttatatttaactctggtttgactttgattcaatgtaggtcttaaatgtatcccttttggctgaggataaaaggccaagtgccacaggtttccagagcactatctgacgtaaccagcgtctctcccagttctgacactttccatctccccgctaccagctccatctatttgctgtgtagttgtcagggatgctgtcttccatactcattcccctcccccagatttatgtgggggaactccttttaagatttagctctaaagtttctgcctctgcaaatccttcccttccattgtgcccattatcacttcagcttctggtcactttgtacttggccattgcgttggtatacttggtgtcctttgatggtgagtccttggaaggcaggaaccctgtgtgcgcctgtttctgcagagcacgtgcagtttctgctaacagagggcctatcataatacttatggaagggttgattgatgtctgagagtatgtttttaattttgcatggtggacacattttatatatttatctgtgggaagagattcatgaataagtgtgtatatatctctatatacatacacacatatacaatcatgcatgcttaatgacaaggatacattctgagaaatgcattgttaggcagtttcatcatgtgaagtcatagagtgcacttacacaaacctagatatggtatagcctattctctactgcatcagacagttgctgtttcgtacagtaacttgctatacaagtaacttgctatacattactgtacgaatactgtaggcaattgtagcacaatggtaagtatttgtgtatctaaacatataaaagtgcagtcaaaatacattattgtaatcttatggaagtactgttgtatatgcggtccgttgtgtctgaaataccattctgcaatgcaagactgtgcatatgtggatgtaagaaggatgctcttgtcacccagcagtaatatgagccatcacttattttgcctgtatagtgccctcttggaaacatgtttattggctcccttagattaactttatgacgagagagtatgtacccttcacctactcctccccccagcctacccaattaaagatgactagtcttttaaaaatagcgttatgagatataacttacatcatataaatggaatcataccgtgtgtggtctttgtgactggctcttccacttagcatgatgttttcaaggttcatctatgttgtagaatgtataagttcttttttcttttttttcttttttgagacaaggtttcgctctgtcacccaggttagaatgcagtgcacaatcgtagctttttttttttttttttgagatggagttttgctcttgttgcccaggtggagtgcaatggcgtgatctcagctcacagcaacctccgcctcctgggttcaagcgatctgcctcagccttccgggtagctgggattacaagcatgcgccaccacgcccagctaatttgtatttttagtagagacggggtttctccatgttggtcaggctggtctcgaactccccactcaggtgatctgcccacctcagcttcccaaagtgttgggattacagacatgaatttctttaactttttatagagatgaggtctggctatgttgcctaggctgttcttgaactcctgggtcaggcagtcctccctcctcggcctcccaaagtgcacggattacaggcaatactttattatttttatggctgaataatattccattatatggacacatcccacgttatctcattcatagttgatggacattgggttgtttccactttttggctattatgaaaaacgcttctataaaatttgtaaggaggtttttgtgtggccatatgttttcatttctcttgagcatatacctggagtggaattgctgggtcatatggtaagtctatgtttggcagtttttgaggaactgccaactgttttccagagtgacattcccactagaaatgtattagagttccattttctctacaccttgccaacacttgttattgtctatataacaccatgtcacattcccactggcagtgtattgagttccagtttctctacatctttgccaatacttgttattgcctatttaaaaaaaatttttttttgagatagggtctcactctgtcacccaggctggagtgcagtggcaagatcatgatcactggagcctcaacctccggggctcaagcagtctttccacctcagcctcctgagtagtgtaaccacaggtgtgcttttaaaaaattttttgtagagatagggtctccccatatgttcccaaactggtctcaaactcctgggctcaagtgatcctccagcctcggctgcccaaactctgggattacaagtgtgagccatcgcaatctggcccttgtctgtctttttaatctttctatttgattcttataattctattagccaaagaaaaatattcttactattactatttattttttatttatttgagacggagtctcgctctgtcgcccaggctggagtgcaatggcacgattcggctcactgcaagctctgcctcctgggttcacaccattctcctgcttcagcctccccgtagctgggactataggcgcccgccaccacacctggctgttttttttttttttttctattttagtagagatggggttttaccgtgttagccaggatggtcttgatctcctgaccttgtatccgcccgccttggcctcccaaagtgctgggattacaggtgtgagccactgtgcctggctactattactttttagatgaaaaccccaaggcaacagacagattaaatgagatgcctctatatgtgtgaatggaaagaaagaagtggtgtggataattcaaaaccacagattatccaaagtaatttaaaagtttttgaatcaaacactaaagtatgtttgatgttggagatcatattcccactcccacgttaaaagacaattagtatgattgtatcttttttgtctgtgttttttttaatcattgaggtataattctcctaatataaaatgaaccattttaaagtgtttgaaatattactctgaggatgcctattttttagtgattgtaatagttatattgtcttcaaaaatattgcatgtacttaaaaacacttaaaaaatagaagcagtataaagtttgatctcccaagggccatcatagatctatagagggaacaagaatagaagtaccacgaggcaaactggaagtccttgttttaaagtaattaagataaccatgttgacttttatccatactttatgtatagcctttcaaaattagaaggctgtgtcttccttgttattctgacatgaatatttagcagtgcctctgtaaccctaggatcatatggtaaatgttaacaagaagcaccagaacttgtgttttcctgtcctattgtttttctacaagaatgctgacagctagagtggctttgtgacattgtgccacaaagctgaatattacatgtgtagttacctgggtaggtgtagagtgtattttttttaagagcaggacatagtgactggatgtcatcagttacatctgttttatcgtactaaaaatttacgtatattttgaaaacagttgcaaattagaattttctaacttgtatcttcatgttacttcctgctaagtgaagaaaatattttctgaaaatatgaaacttgtaatgtgcatacaggttgaaaatgtgctgatagaatattttctggtttttcttgcctttctgctcagtgtgtcaaatcttattttttgagggaaaacatgcacattttacagtaggttctccccatctgtttcattcttcatcttgtaatgcttcctttcaaatagctacatgattaccttccagtttagggcactgaaaatgttatctctggctcagttgacagtttttattgatgatctggtgggaaccggtctgtggctttttcagcacatttcaatgtcccaataccacacaagaagcttttctcttcccctgcacaccccagatgaatacaactttactgtatattctaataataaaatacataccataaattaagacaaggctgaaaggtttaaagaagaaagtaaaagtcaaccttaatttactttccaaacaacataatcactccggacattttggcctgtaacaggggtcagcaaactttgtctgtgggccacatctggcctgccacttgttttttaatcgaccttgagctgagaatgtatttacatttttgaatagttgaaaaacattaaagtaacagtaacattttgtcacatggaaaattgatatgaaatttaaaattgtttccccaaataaagttttattgaaacatagcctgctcattcatttacatattatctagactgctttcatgctaaaatggcaggtttagtagtagttataggccttcaaagcctgacgtgttcattattactatctggacctttatagaaaaaaatctgctgacccttggtctatacccttcaagactttttctgtgcatttgcgtgtgttgtttacattttgaaacaatgaggttattctatgtgcttttgtaatttaccctttttgcgaatagtgtttacaagtaacttctattgcattgtttgtttattccattggattataatcgtgaaccactctgttgctcttttatttgtattgtacaaacccattagatgttacctaggacagtaataataatagtagtagtagtagtacttactatatgaattaaaattgattttaatgtttaatgaaataaaactttatttttttcacataatctgaatcatgacctaggtagtgtcaagctgcccaagaaggtcattgaggaaccaggatctttccagtgtcctcttctgccatctcagcatgcaatttcatagagagagggtgactaaactctgttattgttgtgtatcaattaccacaagtcttagcaatctgaaacgacaaatattaattaccttacaatttctatggtcatgagtccagatacagcttagctagttgtctctggctcagggtctcacaaagctgttgctgggaaatcgcttatttcaagacttgactggggtggaggggatctgattccaagctcctcatgtaggttttgggaagtgacagacccatactggctgttggctggagaatcaattcttgccacgtttctgtctccatagggcagctcacaacatgtttgttagtttctcccagagatctggggagagtggggggtaggttacagactttttgtaacctactctgggaagtaatatccataacttctgcggtattctgtttgttagaagtgaatttctaggtccagcctatactaaggggaggaattccaggagggtgggaatatcaggaggcagggattattgagggtcttctggaggctgctttactatgtggtttcatttaaatgtggtgggtagaccttcaggcattgcctggcaggaagggtcaataccagcccttccagtttttcaattagaactatgccatatgccacccctagctgcaagaaagtctgggaaggcaagttttttttggtgacacattgttgccaggtcaaaatcaggattttgttgataagaaaaatttcgataatagacactgggtggacacagaaggtatctactatccctgccttctaaggtggttataaaggttcagtgaggcaatcagcactggtctggcttataatattcactcagttaaacaggagctatgattattgctgtacttaaaatcacataatatagctttgtaaattagcttgtgacaaaacaggatccctatggttgatactaaaagaagtagcataaaaggaagaaaaaaatacattgattgggtgcatagatgtaccaggcattttatttacatgcagtatctgagttaatcttcatcataaacctaacgggtattgtttgccacactttatagataaagaaaagaaagcccaataagattaactaggtgttgaaggagcgctttccactagtgtgccttgagtgggttatagtttgtggagatattgttcctttagttcttggaatgggcagatggggacaggggtaactggagcccctggtctctcatctctaactctgggcagcctcttctgattactccagtgtgccttaaaaaatataatttctgcacactccatgatgtggaaaaggttagagtgtataactctatccatgagtaagtaatccaggtatgtataattccagctgcctgtctcctttccactgtcaggctctcaacaactatagaagccttgaattttcgttagcctaaaatttgaaatgccccttcatttgctacaaaatattatatttctacattttcttggattataaagtgatttaagttaacatgatttgagcttcactgtggtcggaatgaaagcttgcttggccactaggtggctccttttggttcttctcccagtcgatggttgtggctttgtcctgtgccacctcttagaaggaacctaaattggcataaggaagcctagacaacaaggagatctgaaatgaatgggacatgcactctgatgatgcagttaccttttcatcctttactttccactcctgttcctcctgtgctcatacgctgattttaggtaacagatctagtccctggagcctcagatgagtctttgatatctctttctcactataaaagtgggaaagtggggtaaagaacttttgtcctcatctagtatgttaggtaataaataattgtaacatgtttgcagataattttaggcacaatttttaatacagcttattatctgggaatacttgtgttactacgcagataatgattgcactattaatattaatttccctatctttaatttaataatacaagctttaacttacatgtattatctcctataatcctcataggaccctgcctagttaccatttttttccccctgattttagagatgaggcaattgaagcttaagagataggttaatttgctccaagtttaatagagtttggttgctttcagattttttccttccgtttggaagttgttaattcattatagttgtgggcagagttttgacttaagtcaataatttaaaattcctatgaaataattcagtagaaagtacttctggaaccatagtttggttgaagtacagacatcattttctccagtcgtcttgtagaagtgagcagtagctggaagtgggtcccttcaggaaggctacaggctctttgcagaattacaaattgtatacactcagggatccttcctttctcttgcctacaaatgcagcacccattatcatagaaactgcagggcatttgcagcttaggttcagactcggagctcatagaatggaacattcttcttcttcaattagagaacactaaaaagatgggaaggcacctaggcctagggttttctttgagactgctgactgattgttctcttttacccaaatttagattctgcattaatttccaaatttctctggttgccttaaaaaataaatcggctcatgctaggttttctttagtcacgaataatttaactgtgcttatatctctagttgactccccagttgtggtggtgatttctgcagaccataggaaaatgtatacaaatgtgagatgagagagccttgtcaggcagggggcacttactctgggaagtcagagtggcagtgggagcagtccccagcactaacaggtacacccacaagatctgcctcctacacgtcacttctacctctttgttccccttcctgactcacttcctgccagtgatttgtgacattttcgtagctgatcaaatgagcccctgacacctgattgccgagtgcttcttgtttacagtgctttccaaggacacctagacaagatggaaagcttaacgtgaagtaattaaatttgcactgctctgtgacaggactctaaggacttttcttccccccccctcatatatgaatctcatgtagagctcctaccgtctttgaccatacaacatctaaaaaagggaggatgtggacaggtaacaaacattggttcagtctactgcctgtcattatcatgataaatattaaataagatcatgatatccctttcttatttggctttctactctttacctacttgttttgccagattggtactgattttcaacataagaactgtagcttggaggtgatttaaaaagatatttttaaaggaaacaaatattgccaaacaatctggtttggtttaacaccctttggattgtacatttctcaaaatgcttatgaataattcagcaaagccaaatgcaatctgctggtggtatctagtgttatcacacttgctaatgaataattccctttggcttttatagggcggctctaaggaatgactctgagactcagatgagttattattgggctatttgtcagtgtccttggggcattgcgagcaaagcccaacttggctacccactccacataccttctgcaattcttctgggaaacatgcactctctctgtcccagctttttagccccagaacgttgctatgaaagagactctaacagaaaggaaataaaaatgacagaattcagctccactgtgattgcattggttcagttccttcatgtttcattcatataaagaaatgtttattgagcaccttaaaagcattgtatgtccacaaaataagatagatttttatgtgcaatgtcctcaaataaactagaaagtgtagggtgtatagagaggcataggatcccagaggaggatggtcagggtcttttgtcaaagtgatcagttaccttttctcatcatgttctcaggtatgcacttaaatgcatatttgccatttgtggtgttggtgagggttccgttgctttggataaacctaagatttgactaatcttgaaactgcttaaagataagccctataatgtgatcccagatatgactaagtggccgttgttcatttctgttgcttgaagtcaggaatgtggtatgacctggctttaccagcctgggcaatctaaggatggtgacgtggatttatttatgcttgggtggtctatatacttataccttagcaatcatactgcatatgtataaccctgaggtcagtgagtgcattcagccttggtgaggttgtttctggcagccgtatccatttcagttttctctatgcaactcctaagttttcctctagaggagtgtaatctcctctgagcacactggaagattacagttcccagcttccttgcagttaggtaggatcatggattagttctagccaatgatgtggaagtgatgggtattatttcctggtcaagacattagagctagtgtgccacttgcattctttccctttccctgccacagtgactttgggggccttggtttcagatggtggggtctccattgggctgatccaggaaggactgagtggagtagagtcattcccttcccccatcaacatattagacaggtaacttgagcaagacaaagacctttgttcattaagtccctgagatttgggggtttatttattaccacagtgtagcctggaccattgtactaatatagagggattagtacaggaatagctgtgtgcttgttattcaacatgatttagcagctttagagaatgtagtttcttttttttaaatcattttttattgtaaattgccaaatatagttgtaaatattatgggatgcaaagtgatgttataatttatgaaaacaatgtggaaaattaacatatatatcaggtcaaatacttaccattcctttgtggttagaacattttaaagaactcttggtgattttgaaatatataatatgttattatttactatattcatcacactgagtatatctaaagtagaaaaaacctcccaaacttactcctcctgtctaattgaggcttttaccttttggccatcatctccccaatcttctaacactcctagccttgggtacccaccatctattctttgcttctttgagttcagttgtttttgattccacatgtaagtgagaatatgcgtatttgtccttctgtacctggcttatttcacttagcataatgttctctcattccatccatgttgctgcaaatgacaaaatttctttctttttaaaggctgagtggtatttacgggcttgtatatatgtcacattttctttgtccattcatctgttgatgaacactttggttgattcataagttgaatagtgcatagtgctgcagtgaacatgggagtgcagacatctctttgacaaccaatttcaagtatcctgggtaaatatccagaagtgaaattgctggatcatatggtaatctattgttagtttttttgagaactccataattgctgtactgattcacattcccaccaaagattgcaggggttcccttttctcaacatcctcactaaaacttatttttatctctttgaagtagtccttctggctggtgtgaggggatatctcattgtggttttaatttgcatttcttaatgattagtaatgttgagcatttttttcatgtatctggtggccatttgtcttcttttggaaatgtctattcaggtaccttccccattttttaactgggttattaaatttttaatgtaaagtatttgagtttagatattaatcagatgtatagcttataaatgttttctcccaatcttaggttgtctcttcacttttttaattgtttcctttcttgtgcagaagctttttattttgtgtaatcccatttgtctattttgcttttgttgcctttgtttttaggggtcagatataaaataattgctcagacgaatgtcctgtagtttatctactatgttgtcttctagtagttttgagtttcaggtcttatgtttaagtctgtagtccatttgagttgattttagtatatggtgtagataagggttcaattttattcttttgcatatggatatccagttttctcaacaccgtttttgaagtgactgtcctttccccaaagtatatacttggcacgtttgtcaaacccacatactgcatgggttcatttctgggctctattctgttcattggttgatgagcccatttttcactgtaccatgctgttttaattactattgctttgtaatatggttggaaataaggtagtgtgagcctccagctttgttctttttgtgcatgattatcttggatattcagggttttttcttgttgtgtggttccatatgaattttaggattatattttctatttgtatgaaaaatgacattgaatgttgatagggattgaattgaatgtgtagattgctttgggtagtatggacattttaaaatattaattcttctagtctatgacatgggatatcatttacttagttgtatcatcttcatatctttcattaatgttttattgttttcagtgtataggtcttttacctccttggtattaatttattcctaagtattattttttcacaactcactcttcatagaactattttttatagcattttatttatttatttatttagagacagagtctttctctgtcacccaggcaggagtgcgtgatgtgatcttggctcactgcagcttccacctcctaggttcaagcaattctcgtgcccagcctcctgagtagctgggcctacaggtgtgcaccaccatgcctggctaattttttgttatttagtacagacagggtatcgccatgttggccaggctggtcttgaactcctgacgtcggtgatccacccaccttggctgggattacaggtgtgagccactgtgcctggcctgtagcattttattttattattttattttatttttttgaaacggattcttgctctgttgcccaggtggagtgcagtggtgcgatttcagcttactgcaacctccgtctcctgagttccagcaatctccagcctcagcctccccagtagctgggactacaggtacatgccaccgtgcccggccacttttttgtatttttagtagagacgaggtttcaccatgtgggccaggctggtctcaaaccctgacctcaggtgatccacccgcctcggcttcccaaagtgctgggattacaggcatgaccaccgtgcccagccttgtagctattttaaatgggattgttttcttgatttcttttttaatagttcactgttagcatatagaaagactactgatttttgtgtgttgattttgtatcctcagcttaattgtattcatttattagttctaacagtattttggtggaatttgtagggttttaatatgtagtgtaagagcatatcatcagcaaacagcaatagttttacttcttcctttctatttggatgctttttttctctttttcttgcctgattgctctggcaatactctaatacttattccacttctgtactgaatagaagtggcaagagtgggtatctttgtcttattctgaacttggaggaaaagattttaattctttttttcttttttttttttttgagacgaagtcttcctctgtggcccacgcgggagtgcagtggcgcaatctcgggtcactgcaagctccgcctccgggttcatgccattctcctgcctcagcctcccgagtagctgggactacaggcgcccgcatcacgcccggccaatttttttgtatttttagtagagacggggtttcaccgtgttagccggatggtctcgatctcctgacctcgtgatccgcccgcctcggcctcccaaagtgctgggtcacaagcgtgagccactgcgcccggccaagattttaattctttaccattgagtataatgtagctgtgggcttatgtatggcctttattgtgttgaggcacattccttttatacctaagtattgagtgtttttatcatgagaggatattgaattctctcaaatgctttttctgcatcaatgagatgaccatctggtttttgtccttcatgtagaatgtaatttcaattgggaatcaatggcagatctaatttaggggcagaaagagagtttgtttcatcagttatcaaagaatcttgcaagaaataacattggtgaaaacagagtcatggaagtaaaagaataagtagtaagaaagacagagttgaattgaggctatcataactgatattaatgaattttaaattgcatttggatgtttaattggtaagattatgaacctgtaatttttctctttgcttataacttatatcaagtctggcccttgagctaagaatggcttttttctttttctttttcttttcttttctttttttttgaggcagagtctcactctgtttcccaggctggagtgcagtggtgcgatcttggccactgcaacctctgcctcccaggttcaagcaattctcctgcctcagcctcctgagtaacgggattacaggtgcacgccaccacacctggcgaattttttgtatttttagtagagatgggttttgccatgttggtcaggctgttctcaaactcctgacctcaggtcatctgccctcctggcctcccaaagtgctgggattacaggcatgagccactgtgctcggccaataatggctttaaatttttaaaagattataaagaaaaacaaagaagaagaagaatatttaataggggcctatgtggcctgcaaagcctgaaatgttactagttagtcctttacagaagaagtttgctgccttggtaagtttgcttaccatctctacaaactattatcaaaaaggatcacacttaaccaaatgtgagttcctggagaattgggaactcattgcttttattaatctctgtgtctttcatctagcatggtacatggcaacacagtagaagatcacagcaattttacttgattgaattgacacagaacatgggcaatatggaagacagtttagaggatgaaaaccaaaaacaaattacaaggttgtaggtctaaagaaatagaactgttcttcctctgtgcttgtgggtggtgacatcctggtttgtttaaacctaagtatggacgtttatttaattttcatattcatcttcaaataaaggaaggttttaaaacagatgtgtccaatcttttggcttccctgggccacaatggaaaattgtcctgggccacacataaaatacactaacactggtcaggagtggtggctcacaccgtaatcccagcactttgggaggccaaggcgagagatcacttgagctcaggagttcgagacagcccaggcaacatagtgagaccctctctctattaaaaaaaaatttaccatcctggctacacggtgaaaccccgtctctactaaaaatacaaaaaattagccgggcgtggtggccgggcctgtagtcccagctatttgggaggctgaggcaggagaatggcatgaacccgggaggcaagcttgcagtgagctgagatcatgccactgcactccagcctgggctacagagcgagacccatctcaaaaaaaaaaatttaaaaagaatgaagtattggcacatgctacaccatggacaatgttgaaaacattattctaagtgaaagccagatatggaagactaatattatatggttcatttatataaaatgtctataacaggcaaatctatgaagatgggaagtaggtgagtgatgcccaggggtggggtgagaatcaggagtgagggctgatcggtgcaggggtttctttttgagtgataacaaagttctaaacttagaatatggtgattgttgaacaactctgtggatatataaaaaccattgaatcatatactataagttggtgaattttatgttacgtgaattacatccaaagatactaacaaaaataatgatgcagtggattgcctatttcctagtgatgttgctgttatttttctctctgattcaagctgcagtcaggatttgaatcgcttacattttaccttctgaagtaagatcttctaaaaacaaaattgacttatagtcaaatcctctttgacccagcttgttctacttacatgaatttgctccattttttgtactggcacatgggcacaaagacatagtataagaatattcattgtggcattatttgtagtggcagaacacgagcaatctaagtatcatcagtagggaacagtttaaatacattaagggagatgaagctagtgaagatgaaactgcttcaagacaattaaaagaacaaggtgtagaatactgttactatttgtgtaaaatgcttcatatagacagaatatgttgtaaagattcaacagtggctacctctttgggaggcaaagatgggctgatctagtaataggagagggacagcctattgcagggttgcactttaaaaaaaattatactttcttttcatggaagcattattcataattaaaaagtggaaccaatgcaaatgccaccagctgatgaatggataaaccaaatatggtatagccatccagtcacgtaagtaggtcaaaggggatttgaatataaatcaatttcattttgaggaaatcttaattcaaaagggtgtgctcaaatattatctttaaaattaaaaaagttgactcctagactatatctcagcaataatcttgcatatctttttgcatacttcttttcaatccatatggaataatttgtcttaagctcatcccttcaattcaccctccaaccactaatgatgcagcaattatgtggttccactgaattttaacactgtcttctaacccagctgtgtggcagcagtgtatctgcagggcaagaagtggcttgcaagggtcaatatcacactgcccacaattattttaatgtctcctctgaaatataaatgaactttatagttataataaaaagtaaacccattccccctaaggtataaaggggtacaatttacatagtcagatatgactgcctttttttttttttttaaagaatccttcgtgagggctttaaaaaaaaacagggttagggataggaataggtggctcatgcctgtagttcagcactttgggaggctgaggcaagtggatcacttgagcccaggagtttgagaccagcctggcaacatggtgaaaccttgtctctacaaaatatttgctgtgcatgatggcgtgcacattagtcccagctactcaggaggctgaggtgggaggatcacctgagcctagggagttgaggtgcagtgagccgtgatcgcatcactgcattccagcatgggcaacagagagagaccctgttcaaaaaaaaaaaaaaaacaaaacaaaacaaaatgcaaaaccagaaaaaccagggatggttttcagtgtgggcatttatttgatccagcccaataaacatgattaaaatatgaaaatgtataggatttatagctgctcctctaggaacttacactttttttttttttgctgttgttgcataattggaagaaattcttccaagttttgcatctgcattgcttgtcttataacactaattcatgtaacttacaaaatatttgctggaagttttcctggccctaggaggacccataattataactcctgctttttattatttggtgccacttgtggctcgtgtccttcctaattattcaaatcctctagcctgcccccacattcactcagtaagactgccaccttgagacatgagcgttggtgtttgcagtatttaacatagcatctactaccatcatttagctatctctgacaagagctcattgggccctcttgcaccatttcctcagctgggaagtgtgggattgtagaagcgcttcccttctccccacatctgaagctttgtcctatcacatgaagctaggatttccacgtttctttctagctgcaggagaactggctgctcaggggtgctgcgttttctaccttctgaccacagccagaggcagctcccactgcactttttcatttgcattagatggcactttgcttatacaattgacgtctccatttaatttttatatcttgcctgtatcgttagagaacggggttggaggtgttcatgacttatagaagccccacagttagcccttttatgatccctcttttactaggccctatttacaaattttgtaaatttagatggcttcttattaaatgatgtaaaccatccatttgtactgttaaagctgtcatgaatggtatggcatttttgagtcaggccgtccatagcacagctgaagcacactgaggcccagagagtttattggcttcttcaagattacaagctacttaattacagagctgaatttggaatttagaattccaggtccagaactttttccaaaactgaactgaagtaaaagctccaggctgggcgcggtggctcacgcctgtaatcccagactttgggaggctaaggtgggtggattacttgagcttaggagttcaagatcagtctggcaacctggcgaaaccccatctctactaaaaatgcaaaaattggccgggcacggtggcggagcctataatcccagctattcgggaggctgagtcaggagaatcacttgaacccggaaggtgcagttgcagtgagctgagatcgcaccactgcactccagcctggatgacagagcgagactcgtctcaaaaaaaaaagctccatgataccttgaatttaagggaaaattaatggtgagtaggaaaggcatgatacacaatgcaccaaacaacactccatgaaaatacctcaacaacgagtactttggaaagagatgacgctgaggtatttaaaattttatttactttcatgattatcaagaagtaacaaatctttttttagattatttctgatagtctttacatgttcttccaggtcttctgtagcaacttaacagatcgtatgacaatatgctgatagtgattcttccttttgaaacggtattagagaagacagacagtgctaggacaactgtacaaacaccatttctcatcgtataggcaagccagaagccacatgtttcctagggaaaagggctgacctgttaccattgcagttgtgtgtaaaacatgtgttagaagaagtaattatgtttagctgactgactatgaccagattaatagctcttgaaagggctgtaatgaaaggctgccccaactggcttccacattatctttatttatcccgctctcatccctgtcacctttgggcaccagccaaatgtcatttattgagatttgccccttggatgtgaaaggcctctctttcttaatgatgggaggcgattgggtgcagggctggagagcttggacggttgacatgacccagaggagatgctccaggtctgtggagtcagaggcctaggactctccctcctgagggagaaagaacatgaggatattcagctgctgatcccgtccattgaggtgtacttgagggattacagggagtacttcaaacactctgtgtcaagtccatatatttcggtggctcttcagtttggagcacttggaagtttcttattttaagaccatttgtttgaatgaaatcatcaatcatttctagtttcgtaaaacttggaagtcccttgtggtagagactgcacagatcccttcttgcttctttgagtcatggacttttcaggtggactgctgcccaaaatgcagattgcatttccccagcctcccctgcaacggggtgtggcatgtgactgagagaaggtgtactatgggagtctctgaggtgtttctttaagagaaagcggtgtatgccctttgccctttgcttcttaggcccttgcttctgtcccgctgcctggaattacatgctggacttggatcttgaaggtgaagcccaagccttatgggctaaaaggggccggcctctgagaacttcaggagaaccactgtcccagcctggttaagccactgttattttggttttttgtcacttgtaggcaaatctaaacttagataatacactgtttctacacttgcagagatgaaaacgccaaacccttggattgccttttcccttcctaagtattaatatcaaaactaaacaggttcctttccccttctttcaactcctctaaattaaaacaacctacaaaaagacatgcagtaatttatttaaaaactaaagacatgagagagatctcagtaagagagatatagagagggagattaacaagaaggctagaaaggaaaataacacatttaggaaaatgataacaggactggtcttcatggccttctgtaataggtcagggagctctcactcccttccagtgtggtggcagcaacagcttcttttcttagattattagaggccctagggattcgatttcaccgctttgttaaggccataggaagctttttaaaatttcagatttcaaatgtcaagtctctatcagtgcttttgggccccttgcatcagagtgtttatattttgcctgactctttggtttcggccataaagtttgcatgttgtcatcttttctctaacattatgtgtattagataacatgactacaatagctatagtgggttacaaaagattcttaacacaacccttttaaaagagttgagagatgcgtaattatttttcatgattttcaaaacttttgaaagagaaaagcagctgttggttcactgttctcattagcatttatatagtaaactaagagagaggttttctgtgcagttttttccttgctgtttcttgccttttaatttgaagaatagcaggatcttgtcttttgttacatgagtagaagtccattcagctggaaaaagaacagtgcactctttgtgtactcagagatttgaatgcttttggtcacacactagttgctgtttaactacaataaaattgtgaccaaggagataaacatttaaaggataaatgacaggcctgttaatctgaaagcaagttttgtaggttgttgtttttagctaataggtgtatagccaggagtcacggtgatgacttttaaatctaaactgagtgaagtctgtgttttcaaccagtttaaaaaatgttgccactggacctttttaaaaaatatttttaaaaatacgacaaaaattttatgtatttatggtatatactatgatatttgacatgtatacattgtagaatggctagatcaacctaattaacatatgcattatctccatacttttttgtggtgagaacacttaaaatctactttcttagcaattttcaagtatatatacattgttattaactgtagtcaccatgttgtacaagagatctcttgaacatcactgacatatttatggctgatcattttgtgttttaacaatcatttgaacatgtctaaactgtcttagaaactggtagggatttccttgctgtgtttgctaagcttggccatgtcatccacataatatctgaatatattcatatatgaatacatactgtatataatatgtgtgtatatatgaaacataatacctatatttatatataatatgtgtgtatatatgaatacataatacctatattatatatataatatgtgcatatataaaatgcccaagtatattatctaagaaaagagccatggggcttttataagtctatgatttcagaactatgtccatctttacacctctaaagcgtatgatttacctgatttggtggaggaaaggtatttttggtaattttctgtccctatgggattcaaaggataaatttcaatctctttttctttctttctctctctgtccatcttatgcagtgaaaactggcatatgactctttgagaagagctcaaacagttgtggtaagggtgcttagtgttgagtgctatctgttttctggggtgtgaaacatacagggttttaccagtctgttgtgcagagtgctgggtgtattttgctttagctgactgttccgttggagtattcagcctttcttaggataacaaaaaataaaattaatcaaaggcataatcaaggacgttttccttttgtaagtcacatctcattatacaacattagtcttaagctttgcccacctgccagataggtgtagatgattaatgaaagctgaaactctcagtctagaggagacagcagggactggtggtgctgtggtgaagtaagaagtacatatgctgcctaaagggactctggttcagtgtgtgaatgtagcccagtgttgcaaatattctgacttttcaaaagaagcaggacatctagatttttattgaaatctctttattttaataagccatcgactaattgaaatttaaaacctgtgtagtccaatagaccatatctacaggctggaaggaatagagggcctgccttttgtgacctctgttgttggggaggttatgtaaccattgtaaccagggaaggatacatgaggattcctcttcagggagctgaccagcccaataaaaaatatataggttgacatttggagatatcttaaaagacggcaggtttccatcatatcgctctgtagtgaggcccaccagttgacaaactaagcttctgccattcagcttctgatctgtttcatattccctcactggaaattatgaactgatgggcaaaatcattgaacatccaggaatgcctcaaataggaatgacaaaatacagagcacagaaacaaagaaaaggaacccagaggaacaggaaaatgtggagagcagaaaacaatttcaaaacaattataattaatattcccagagagatgagagaaaatacacgaaacaggaacaagatgctataaaaaggaaccttcacactgttaattttgttagttgtgataatgtattgttatacattttaaaaatcttatacatttaaaaaaaagttgtccttagttattagagatttatgctaaaaattacaatttgaatattgtgatgtctgggatgtgatttgaaataattcagaaaaaaggtagagtcgtgtgggagatagataaaatgagattggcaaaatgttggtaattgttgaagctgctgcgtaatgggcgcataggggttcattatattattatttgtacttttgtgtgtttgaattttccattatacaaccttaaagaaaggatcatttagaaagcaagaaagagcttgcaattgaaaatatgatagcagaaattaaattttcaacagaagtattagaaaatacagttgagacatttgtccagaaattagcccaaaacaaagcaatggaaagtaagaaaggaaaaatataaattagaggatcagtccaggtggtccagtatttaactctgggagttacagaatgagaacaaaatatcagaaggaaagagattatcaaagaaataatacaggctgggcacagtggctctgcctgtaatcccagcactttgggaggcccaggcaggaggatcagctgaggtcaagagtcgagaccagcctggccaacatggcaaaaccccatctctattaaaagtacaaaaattagcgggcatggtggtgggcacctgtaatcccagctgcttgggaggctgaggcaggagaatcattgaacccaggaggtggaggctgcagtgagccgagatcgtgccactgcactccagcctggtgaccgaaaaagactcctctcaaaaaaaaaaaaaaaaaaaaaaagaaaaaagaaataaacagggtcatttccttgacctaaaagacatgagtttccagatcaaaagagcccagtgacgcccagcacaacagatgaaaaatgatcccactatggcattttatcatgaaatttcctaacccagaggaaaagagaagattctaagagctctcatttgcatcctgagctggtctaggatcagggtttccttgggccaatgcttcagatagttaaactcatcttttgcttggtcagggagtggtggttgcctggctgttgggattgagagaaagaatctagggtctaacctctgctctgacttccaactagtcttcctgttttcagcttcatggttgaaatgcaccttccttcagaattcctggttattgtattcctgagcctttctgtagatggtggcatgggagctcacttcttttggtcttccccttttctccctcaatcctgtctaccagttagtcttcagctttggtgtggtgtgtgtgtgtgtgtgtgtgtgtgtgtgtgtgtgtgtgtgtgtgtgtgttttttggagcagggtctcactttgtcacccaggctggtgcagtggtgcgatcttgggtcactgcagcctgacctctgaggttcaaaatcctcctgcctcagcctcccaaatagctgggactacaggttgtaccaccatgcccagctgatttttgtattttttgtagggatggggttttgccatgttcccaggttggtctcaaactcctggactcaagccgtctgcccgcactggcctcccaaagtctgggattacaggcgtgagccaccacacctggctttaggattcaggttttgctgttacatacttgccattcctttttcatcttttaacatctctcatctgcttgctttctttttttttttttttttttcctgagactgagtctggctctgttgcccagactggagtgtagtggcatgtctcagctcactgcaacctccgcctcccaggttcaagcgattctcctgcctcagcctccaaatagctaggattacaggtatgcaccgctatgcccagctagtttttgtatttttagtaagacagggtttcaccatgttggccaggctggtctgaaactcctgacctcaagtgatccactgccttggcctcccaaagtgctgggattacaggcgtgagccactgcgcctcatctgctttatctttcacattgactttgacgatttatttttattgttgttattgttgtctccttttttttttcttttcttttctttcctttctttccctttccctttccttctcccttcctccctcctcccttcctttcttccttcctcggttccttttcttccttttctttcttttcttttttctggagacagggtcttgctctgttgcccagtctggtgtgcagtggcacaatcatagctcctgcagcataaaactcctgggctgaagggatcctcctgcctcagcttcccaagtaactggacatcaggcgcacaccaccacacccagctcattttttttttttcagttttgtagagatgcaccttattatgtttcccaggcttgtttccaactcctgggctcaagagattctcccacttggcctcccaaagtgctgggattgcaggtgtgaaccactgcacccagtatattgttttatttctttacaggcgttccagtgaggttttgggaaggagccaagtgcatgttttgaatcaccatgttagaatggaagttaatttgttgtgttaatcattaatttgtatgtcagagtttttttcctgaggtttatttgaaaatcaacgtaagaaaacaaaatttaatatggagaaaatatttcctccttcttaaagtctcctttgactatcctcacggaaattggtttgtttctacttctctgaaatactgtggccctgggagactcctgctcagtttagcaaagaattctctactttttgggtcttaatctaagcactggatgtgtgcttttcacccaactagattatggagtcctgtgaacctagggagatatcttagtctgctcattgattaccttacggctccttatggaatgaattgaataaatactttgctgatcaaagtatactactcaaatttgtattactttattttatatgtgttatatgtgattcttttaatgccttctcagcctgttgctcagagattaggggaaggaataaatgtaacaagtagactttgggggtaatactgataagttaaaaatgtcttggtttatagcttcaagggtattttactgaaattgcaaatgttctattatatttagaagagaaggaatggaaacctgactagtcattatactgaggttgggaaatctggaacttgagtctgaatcagttttctgtagatagcctgtttcacagtggatttgcttaatgttttaccgtaaacaggcactcctgtttattttcagctcttgcctttcagcacaggatagctacaattttcagagtatgcctctcttgtataaataacaatactgtcattttctctaaagtcatccttttattaaagaaaccctttaatagtcccacatattctgtagttatgcatttctgtgagtcttactgaccccagcacagtgtttaataaattattgaactttgaagaacctttgagaagaagggctttatgtgactgagcagcagacatgaaaaaacgttatcctccagagtatctaaagacagaaatagaggcttgatcagacaatataagcaccgagtgaatgatggtaataccagaaatatttacacccatagagcatgcgagggtggggaggagagtgtgggtttttatcctttgggttgaacctgatgccatacaactcaccactctatgatcttaaaagcaaaacagaagagaatgagagaaagaaaggaagaaaggaaaaggaaaataaagaaatgatgaatattgattggtgatattttgttgtttgcattatcttatcacaaaagcaaggctccttttgtagacggaaccttactaagagtcaagttttaatcagtccttaacagaaactgaagatatctgaatgatttcttgccactacaagtttaaagttttaatttaatcaatatctcatgatttaccagcctcaaaagctgtcattttattatctgtaataaatagagatttgaagagtaaagaactaatatagcctgatacgatcttacttttaaacagaagatgcaatttatttattttttcatggatgctattttaaagtgacttgtgatttctttaataatgatccacagagaaaattaactaaaggaagaagtgtctaattatttaggaaaggtttggaagatgtttatcccggctaattagatagagagtgtctaatatcttacagcatagaaaggggctaaaacaaatgtgccaacaatttgttttgcccctgtgcccagtattttatatatccatttttttaaataaggatgaacttttaagatttcatggtgtcatctaacattattaaaagtaattattgttgatgataaaaaaggttgacaatgatgtgctttattgaatttaattttactcgtggtttattttaaaaaccgcagattgtgtttgggagatattttaatgtagtatgtctgttttttgctttctagtttggaagaaagaatcaaattatgtattaataaggaggctcagattgaccatagacattggctttcaaggggatcatctggttttagaggctttagtctcctttgagtaccctggatgttgctatgtattatgctaaactaacgcatgattacattgaccctatgattatagtgacctaattggcaagtttctgtcacttataaagtcaaggtagtaatgttggaagggaaactgtaggagactctcctttgcaactgtaatgttttgtctgtagattgcaaatgagggaattttataaggctttattatttgtaatgtaggaacccattgcatacaaagaaatttttagtctaagacccagtattagtgaaatgtgacatagatctatttgtgaaagggtgtacccagttgaaaagcaggggcaagattttatttgtatgtttattatttttgttaccaaagcgatgccctggaagaatcgggatttttgagtgagtgatgtgatgtggatttaaatcctgtctttgccactagttctttcacttccagcaagtcctgaacctaagactcaattttttctctcaaaatgggctcatgatgatttacttcgcagatttgttaaagcttgtaagcattcagcacggcacccaagtgtgggaggcactcaatgaatattagctcctttctccttccttttcagctaaaccaaaaggctttatctaggaggtgagacttgtagaaactcttgattgatggaaggaatgagtcgtgaactagaagaagggtattcgaggcctgtggataaccatgtgagaaggtgagaagtggtgtgtagtgatgggagagtgtggctggacagatggacagataaagaaaagagggtgtgctgggcgcggtggctcatgcctgtaatcccagcactttgggaggccgaggcgggcggatactaggtcaggagatcaaaaccatcctggctaacatggtgaaaccccatctctactaaaatacaaaaaaaaaaaaaaaagaaaagaggggctgaattaactgacttgtagaggcaaattgatattggtgttgggacacatcatctgaacttccactgtcattatctgcttctcaaaatggagttgagagcatgtgcgaacttgagaatttattcttcttgtctacttgaacatctccttttaaaaaatgcaaaatgttagaaatgtttgatccaatatagggcaaataaaaattgtctgttctttttttttaaatttttttttgagacacagtttcactgtagcccaggctggatacagtggcatgatcttggttcactgcaacctctgcctccagggttcaagcaattcttggcctcagcctcccgaatagctgggattacaggcgcatgtcaccatgcctggctaattttgtatttttagtagagacagggtttcaccatgttggccaggctggtctcgatttcctgactcaaatgatctgcccgcttcggcctcccaaagtgctgggattacaggcatgagccaccagcccaacctgtctgttgttaaattctacctctgatcgtaatacttcgatggagaatacatgctattacttttagcatgatgggtaccaatatgagatttccagttgcttcccgcatgtcattttgcagattttaactgaggcttatatatgctcagggctgtactgtactctggggatcagtagtaacagacgagagtccctcttctcatggagattaatattctattagaggaagatgctagtaaataagtaaacagtggctgggcatggtggctcatgcctgtaatcctagcatttggaaggccaaggcaggtggatcacctgaggtcaggagttcgagaccagcctgggcatatggtgaaacccggtctactaaaaatacaaaaattagctgggggtggtggcaggtgccgtaatcccagctactcgggaggctgaagcaggagaatcgcttgatcctgggaggcagagttgcagtgagccgagagatcacgccattgcactccagcctgggcaacaagagcgaaactcgtctcaaaaaaaaaaaaaaagaaagtaaacatatttaaggtcgtaaataaggccatgttaatagtgataaacagtatgttgtgttaatgactgaggggaggggactgctttagatacgtggtctgaggtcacctttgatgtgaactccaaaggatgacaagggcatacatttcagctcagagacaaagctctgaggtgctaaagagcttagcatgtagaaggaacagaggtggtcgtggccagaacttaaagagaaggaaacgaaagggcaaaggaatgaggccagatcatgaggtagggactttagactgcggtagatttcgattttattccaagtcccattggaaatcactgagtgttttaaggtagggagcgtgtgtgtggagtgacttactctgatttgatttctataagatcactgtggctctgcgtgaggaatattggaaggccagagtagaattagggagaaatttgggaaaggaatgttctgatggcttggcccagttggtgactgtgcagatagactgaagggaaggatttaagatacattttgtaggcaaagctgccaggatttacttttagacagcatagaagtttgaaagaaaagaacaatcaaggaaaatttccaggcttttagcttgagtaactgattggttttgtttgcttgttgtttctttttggagatggggtctcactctgttgcccagccggagtgcagtggcgcgatcgtggctcactgcagccttgacctcccaggcttcagcgacctctcaccttagtctcctgagtagctgtgactacaggcgtacatcactactcctggctattttttcgttatccgtgaagatgcctcactgcattgcccaggctggtctccaactcctggctcaagtgatttacccatttcagtgctccaaagtgctgggattacaggtgtgagccttgccctggcctgagcaactagattgtgaccatttactgagataagaaaactgaggacgagcaggtctggggtgaatcaggtgctatccctttggacagtcacatgactggtgtctgttagcacccaagggaccatcaaagaggctgttgtggagagggaatccgaaggtcagggccaagatagaaatctggggagtcatccactatataggtgatgggttaaagccttagaactctcttttcatgaatcattgttgttctttaggttgtaatgaagttttaggcctcagcttcccgaactggagtgtttttccttcaccttttccggtctctgggttgcatcgccagactgtcttaagcccaacaaacgcgttccttccaggcaaaagcaggagatgacacacaccatgagccgattttccatggcagacttgtaaggaacaagataatctcattgttcctcctgctacttaaataaaggtaatattgattttatagtagcagttcaggtcctaaggcatgatattgattagtgtctgatgagaatttgtagggtagtctcccagacctgcagctacagggcatctccccctgggccaggcctctgtgctgacctccactgttataagtggtgtttttcttaggaatcctagccctgtttagtctacgcactgtccagaagcatttatttaacctgatggatggctcatccaacccatcaccttaatctgaccttaaagatgggaacctaatgtttttgttcttagtaatgtgaagactaattttgacactgtttagaattattttcttattagtagcagtagattcatgaattttctgctgtgaaatttcctattaaaatactataatctaatgttaaatgacggttaatgggtgcagcacaccagcatggcacatgtatacatatgtaactaacctgcacgtgtgcacatgtaccctaaaacttaaagtataataaaaaaaataaaaaataaataaaatacataatctgacttttttatttttacttttttactttggagcctggctttatgaatttttttttaaacaggggaaggtacctcttttcaaggtgtcattattaagcccatgggactcttcattttaatgttatatcaaagagagtaaatttcttgtgattattgtgatatgatgcattcacttgcaggtcaggttttatatcatttatagatcagattctgaagatatcttcagtcaatttaataacaatcaaggaatatattattcaccggcctgaagtatagaaagagttcccagaatcatctaaaaataactgtttcatataaaacattttgactttctattgtaataagattatatatttttctcccatgtctaattctggctggattgttcatggggttgatgtgaggatcagtgagttaatataggctaaggtgcataatataatgcctgacacatagtagatgctcatttatgttaactactgttagctgctttagcctgttgttaactgcaaactccttttacatacctagcacaggcctgggcacaagtatgatatttaagtagatgcttagtgactgattgagtctccaaacatttgggatttccttccacatttgccatagcacagcttgttttatgtctttctaaaatggtctaggtacctgacatcctttgatccttcatatggttacactcaaaagagccatatgaattttgaccatttgcacatctgcctgtctttttggttagctgccagataagctcaggttttaaatcctttgcagttaaaagagataataaatgttaacattcctagtaagtgcctggcacagaatgtgtaaatatcatttgattcggaaacatgactgctggtcaatcggcctccagggagacaaaactaaggggtggggttgtggctttttttgaggtaggggatgaatagatatttcttacccgagtagaagatgatgccgggggatctaatgcttcttttaatttcccttttgatgcacaaaggggcaactccgtgtagcaggaccttggtgggatggatagcagctttgtaagtggagaaatggcctctgtttagcttatgagcacagagtcattttggggtggtttatgagtcatctgaaatatgcatttaatctagatttgtggcctgcttggtgagctgctgcttttttatgatctcaagtgtcttgtccatgtcaaaacttgccttgttttttgtttactttgaatcagaaaaatgttcacaaccacccttggaattcctcctcaagtgtgctttggtcacatcacccctggctaccaccagtacatgactgtttattttggatgtcctttctgatgttcagctaatttaacccacaatgaagttaatccttgcttctttggaaaagtacgatttacttattagctgccttccagagacatttgcattttcatgaaagcgagtatataatacattgacttttggactcatctacccacatatgtggtgggcgccttttgaaagtcaggttcagagtaaatcagaactgtcttgagttagctgaagttctctttaaggttaacaataatgtatctatgacaaacatggggatgtggtattgcatattcgattatgtccatttatcttccttcttctgggtgagaggggagatgaaaatggagctaccttggagttcatgttttcacttgattctccgcatttatagcatactgattgaaagcatggctgccagaaccatattactgggcttgagtactagctctgtcacttactcattgtttaactttgggcggggtacttaattctctgtacctcagtttcataatctgtcaagtggggataattatggtaaccaccactgacattgttatgaagatcaaataagttaattcatgtaaaatatttagagcagaacttagtaatagcaactgcgatacaagtgttagatatcatttttattagggtttagtaattgcataataaaagagatgaaagtctaaattattaatcagggccatttatctatgagacactacaggattgtgtctagccctgtgggtttacattagttagggtaggttattgctgcaacgtacccaacttgatatgatttttgctgcaaaaatcatatcaaaatagtctataatggcttaaacaaataaaatgcatttcttgtttatgtaacagtaatgagtaggtaaacagggtggtaggacttttcctctctgtattcatttagggatctaagctgaaggaggctctgccatcttccacaaaggtttctaaggtcaccttaggttatctctattccagccagcaagaaggggaaaagagtgcagaaatgtgtttaggggttttttatgggccagacctggaagtggcactcatcactttgttcacattccattggccagaactcagcaggaagaggaggaaaacagctgccactcattcagccacagagtttttcaggggtctctaaaaatgtatgagacttgaaaaaaatgtattactccaaactccagacataaaattgcagaattgaaatgaataaatgtttaactaaatgctataaaatggagccttatatcagcttccaaagttgttacagtttgtatggaaaaaaatgaatttcttcctaacgaacctccttgcttctttccctgccttctctactatatttgaaaaattttgtaagttggaatttggaatttccaagaattcccaagtactatccagtgattgctagaaattataattagtcataaatgagtttctcaaggccaaataaattcaaacgaaaaatttctcaaattattttgcattgcagagaaaccttttaatgtgaaatatgaatacaatttatatgtttattttgatgttgagtgaggccttcaaaagtagcaggatcatggcctacagagtcttaacattcctattgtatgcagacacatttcaattgctttgaaaaggtgtatgttgaggtaactaaacacattttgcatttcaagctcagaaaatttcccctttagattcccttttttttctccttttattttctaataaaatatttactgctgtgatatccaagaacatgaatgtactgcattgaataacccaggtgcttggtctggtggatgccagtgccagagaagaaaaggccctattttttcagttatcatgtttgaaggcgaggctttggtctgccttctgagtcatcttggcttcttggatgatagatttcttaaattcttctattctcctaactcaaggcactttgaatgggtgtttgcgagacgttgtttgaaaaaccacttatcgtgatggatttttgttctctattttttgctctcttacacactttgctgttgtcctgccaattggaatttgatttgtaattacaaaagcaaactatccaggatggctctaaagggacttcgctataggttggggcttgatagagactttcgcgaaagggattggcaattaagaaatatagcaactgcttctgatgttaaacatttcaagcaactctgaaggtagaatgtggggaatctccagagaaggaaggaatagagagggaactaatatttatagttactcctatagtcatctccatctcagtacaggactcttcatccttccagttgttcagaccaaaaaccctggaaacatccttgacttcgtctttccattccacatttcacccatcagcaaattctgttgcatctgtcttcagaatatattcagatccaaccacttcttacaacgtctccttctgccatccttctccaagccactagcatcacctcctggatcatcgcaatttcttcctatctagtctccttgcttctttccttgcctttcctacatagcaatcaaagtttagtcttcaaaacacaacaaaacaaatctcttttctgttcaactcttttatgtttcctcaaaatgttatacgtagagttaccatataacccggcaattccctcctagttacccaagagaaatgacaatgtatgtccacacaaaacctgtacatgaatgtcacagcagcgttattcatgatagccaaaagtggaaaaaacccaaacgcccatcaatgataatgtacaattaaaatgtggcataaccatacaatggaatattatttgtcaataaaaagatgaagtactggtaccatgctataaaatggttgaactttgaaaccatatgctccgtaaaaaagccagtgacaaaaggccacatattacatgattccatgtacagaatagacaaatccatgagactggaaatagattagtgattgccaggagctggggagagaggaatggggagtgactctaatggatgcagggtttctttttcttttgtggtagtgaaaatgttctgaaattaagtatggtgacgattgcataactctatgaatatactttctggcttgtatacttttttgaagggaaaattgtgtggtatgttaacgatatctcaataaagctgctattacaacaaaaacaactctttggctttctttctgatctttttccctgaatcgtttctgacctcttcccctactcttttctctttctttttaacccacccagactggcccctattttgttcctctaacagggcaaggcttcctgccatgggcctttgtattttctcttctctctttttgtagaactttcttccccaggtatctgcgtggctggttcacttgcttcctttagctctctatttaaacatcctattccaggagactttctctgattacccgaaaatagtactccctacttcatggcctgctggcgtctctgtttctttcatcctgttttatttttctctgtatcatcaacatgtgatacactgtttcttgtttgttttttatctgtcttccaacattaaaatgtaaactccatgaggcagtaacaggctttgtttgtgactgtatctgcagtaatacataccacacctcttttcactagaccatagcttgaggaagacatggatttccttggcactggtgttgaattgggactaactgtattgcaggaggaatattcagtgtgtctattagatgctacattagaaatcatcagcttggaagagtctccatgggaaaagtaattttgattcaaagggtagaatggaactactcaggttacaggtcttttattgtcatataaatctttgtacagagttcctactttttaaaccattagcatatgctaatatacaaagtttgctacttttcatatttgtcttacagattcaaagcctttagtcttttcagtcttaatttaccacctgtctgctctctccttttctcccttggaatgttctaagatttaattttgaaggaactttctgtcagatgattattggtaaagtaaaatgtattttgggaagcagctgattacttgggcctttgatttatttatttatttttttttttgaggagtcatattgcgatatacctatttggtggttatttagaaaggccaaggtagggagaaaaagaaagaataaaatatatgtatgctttaaaaaaaagcaagcatttagtttggggagccctcaaatgtgatttcttctactcctgttttcctgcttccaagcataggtggaagatattgtcgtttctctgaactcctaagttgaaatgtgcaagtcactaggtggcactgaagtatcatttccacacagccacgccatagaacacttttgttatcttgctccagctgactggatttctagtgtcagggaaattgttttattggtacagggcatagtgtaatatattcctctccaccctggcagctacttaacgccctgaaacatgcacctcttgtggtcatggcctgttaactatgctatttggtgtaataattagcagaatttctcactaacaggggtacttaccaacacctcactcttcactgtgtttttgtacgtgatggattgtacattctgtggagaaagttgggaaggtaaagcttaacctctgcctaacaggactagttttcgcacatttgttcagaataggtttatttaactggcttttgagcttcttcagaccagaattgtgtgtaacgtaaacatatttgagctttatgtaaggacctagtgaaggtttgtaaacacaacactgttaattttccaactcataaatgacagaaaaataaatgaatagctgctggaataattggacgacacttgttactcagactgtgagtgttggaagcgtgtcataggaacagtgggcctgccacaagcaccacattttagttaaaatcggagaagaaaattacacatggaattttaattttttccatggtcgtaagttggccccatttaattctttgtggtttttacaagccctcttaggctcctaatatttctatacaacaatttcaacgtttattttagaatgtggtcagaattaaccgacagaagaccaaacagataaaataggtttaaagcaggaaatactttagctggaccactaacttaccctctatgacttaggcaaactgtttgccgtctctgtgctttgattctctcatttcttaaaatggagatataatacgcacccttgtgtgtctcctccaccaggtaaaagtgaaacaataacttctcaaatacctttgcttatattcaaagctccaggtaaatataagatgttgctataattacctaaaaagctaggaagatttttctttgttgattccaaggtgagttgtagaaattccagaagatgattaatgtagtctgagggctcagacttctgcatctgtgtagatagtacctattttcattactgtggcctggctctgtttctggcctggctctgtttccaaggtttaagttccattctttaactgtgtatcaactattttcacttggttgttctacttttacttaaaccctttatattgtctggatttagttgtaggaaacagaaactatgtgagatagggaaataggttgatataagtcatcaggaggaccagagaaatgggctgaaggtggagcctccagagatgggcttctgaacaatattacagattggcttgccagggtagccgctcatctgtcacactcgggaagggcaagaatcaggagtcattcctagaactgttgatttgtaagaacacacaaccatagttgtattgggatcaggaaggtaccaccattacaactggcatttgagaactacaaagtgaatggcagattctggaatgttattgcctcatgactatgttgcctgcagaaaaagttgaaacagcaggtgatggcctccattttatttttgacttctgattctcacatgccgccattaaattggtaagcttatttctcatccagaactcctagctgcaaaagggtctgagaaataatagtgtttccttttcatcctctgcaccataggaaggcacaataagaggagattggaagggtgctgaggccaccatatctacctcttcccccagcatgtttaaaataaaatatctttacctccaactatattgcattttctgtccagcacagcaactagcttagtgggccctcagtagatgtgttatgacattgacttccttatttcttatatggccccacctttcctagtcacgtgtcttggtatatgtgagatttcagatccacctgcctacctgtaactcttgattccttttcatttccatgctgtctccttgttcaggtccagctcctgtctgcctgggcttttgcagtagtctccttactggcttttggtttctttcaccgtaaccatattataagtagattggtgtttaaaaatcaaacaacaaataacaaacatccttccactgtgctcctgtccttctcaaaagctttctgagctcctcattacatgcaggatagaatccagactccttagcttgactttcaggaccttccaaatcagggtgcaatctatcattccaggcttatctttcattttccccctgctggaactgattttagccaaaaggtctaatcactgatgtcagagtgtcttgtcctttactaacttttcactctgctatccttttgcctgcttttaatagtctgttttctttctcatttgtttattccttgatcacttaggcacagagtttttttctcctttcttcatacttatagcatggtttactaggcattttaattttattacctatatcgttagttttctttttatgactatatactctccgtcctttttatgtcgacaatgtaaatatttgttgtggattgatttgttgatttttcatggttagacatctacttgcttgggaaaaaggggatggtggagggtcaatctgggggctgaagggtactctagctgtgtgattttgtctttttgattactactgaaattaactatttgctttagcaaactaatgctgagttttgtggatttagtgtttgaaaagggccctgagagggaaaacctggagttgagctccttatccccgtttgccaggctggatgagctccatgtccataccatgcattgcagtttgctgaagtgtgtgttgtgaaatagcaatggaatttgtctgtggtttttgccagcgaggaggaggaagaaggattctgagtaaatcagacatgtaaattagtaaggccatgggccttaagcgaattacacaataaagcccaaagaaattcactttggcttctttcgctttttgtgtgtgtgagaaggcagctattatgtgtttgctttaggccagaggttcacaattttttggcttcagaacccttttatactcctaaaaattgttgaggactcaaaaagctttgtttatatgggttaaacctatcaatatttactgtactgggaactaaaacaggaactttaaaagcctttattgatttaaaaatagcaaaaccccttcattacaagttaatgtaacatttttatgaaaaataactcttttccaatgtaaaaaattagcaagaagtgtgccattgttttcttttctgcacatctctttactgtctagcttgatgcttgattcttatacttttttgtttgttgttgaaatatgttgttttggttgaagtatatgaacaaaatctggcctcagacattatggaaaaagggagtattttaattgcttcttcagctattaaatgtagatattcttctttgtattattccaaaacttgtcaagtgatagcttctattttaaaacatttttgtttttaattacaataattatctatatttatggggcatgctgtgatgttccatgtacacattgtggcatattaaatcaagctaattaacatatctgtcaccacacatacttattatttctttgtggtggaatacttaaaatctactattttagcaaatttgaaatatacattactgtttactagtcacatgctgtgcaacagatcactagaacttaggtctcctgtcaaactgaattttttacccttgactaacatctcccctttctctgctctatcccaccaaactctggcaattactgttctgtctctacttctatgagtttgacttttttagattccatattttagggagatctgtacctgcttatttcacttagcataatgccctctagattcaagattcatccatgttgtcacagatgcagaatttccttttgtaaggctgaatattattccattttctttagacaagtgataatatttaaagcttacttgcagtgtggaatccgaagctatctcaattaacttttcttactttgtatattaaaatctgttgatctcttttgcactttgaatgcatcttttacattcaaatgatttgtaacattacgttttgatcatttggaaaattatcatgtcactgagttatacagatcttcaaatgttgatgcatttcattatacagtgtaaaaaaaggtcacactcatcagtatcaccctgatcttatacaagtttttaagtattgaaaagccccaagctcaaggtagcaaatacaattttctaaatttctgatttttcttgacaacctgaagtttatcattggcagcaaatatggcagttgtttttcttgaagtggcaagctcacttgattaattgttgagaaaaagtctgccaatactcaagtccgattaaccagaaaaatgtcagtcagctattttttcaagtaaaaatgggttccatggggcaaattcagcccagaactcaaatcacacatgtacttttgtttgagacaccattttactttagtatttatcagaagtactttatgtatgtttactattttgtcacacatatagtaaaaagatagctacttaaagctcaagatttaatagaattaataatttttcctgttcaccaaggacatgcttaagtgaaactaacttcctttttctttctcttttaaatggaagcatggtaaagaacatagcaactagtaagtttttgaggtctattaaaacagcctgctcatatagttaataataatgtatatttcaaaattgctaaaatggtagattttaaatgctttcccacaaagtatgtgaggtgatggataagttaattagcttgatttaatcattccacaatgatacaaatgtcaaaacatcacattgtactccataaatatgtattacttgtcaattaaaatagatgttaaaaaaactgaatactagtttagtttggtaccgctggcttgattagtgacaggcacctgcagttttacccagcattctttaaaccgtcagtggaaatgtccacacggtgaaaaagcaagtaatagtattattctgaaaatagtattgatcttgtggaacctttgccaattactgcactatgccaattaggaagatttgagtagctaaaaattccaagagtggaataatgttttattagttatatcttgaaggccaatttccttttttaccctggaacttaggctaaggaggcaacctggaggagaaaatttctctcctgtcctgagattgctgttagcccagggtcgaattcctggggcctgattttttgagtttaagaagcacagggaggatttttttttaaccgcctttggtgataataaatgtttaacctaaatcaatgtgattgtggatttttttttttttttgaattgttgtttctgttagaaaaataatgaatgacaagtgccgcagagatcagttgttgtgagatgactgagaaggtaataggacctcctatttgggacattaaggaaagccttcctaaaaaaagaacccattttgagcaacatgcgaaaattctttgagtcagttggcctcattgtaagcctttgattgctttatttgtttgtttgcttgcttgtttatttatttatatttgaaggcaatctttctgcttcctgactggctgtcagatctcccaaataacatcatccctttctggtgtgaatatagcctagacttgaggcagcaattaactgatcatgtaatagaagaatccaatcttccagtttctttttttaacttcttgggtggttggggcacatcattgcaacaatattacatttactcaagagtttgtcttttctattaaaaaaaaaattccatctaagtgcctacggtgaagaggaggagattgtgtaactggagtctccccttaactggtctttattgttaagaagagtgatccctttgtgtttcagcttggcacacagaaactgttttaatttaacagccagctcctttaatagatcaattctctattgtggtttgaatttggtgcactcccaatttctctaaacttctacgggcttccttggagaaactggggcagagatgccgaagactcatttgggtacaatttagagtttgtttatttatataaatgtaaggggtaccagtgcagttttgtacatggatatattgtgtagtggtaaagtctgggtcagcttttagtgtaactcatctgaaaatgcacattatatccattaatttatagttttatctcaaacctcttattaattaatgctgccatggaagctagctagcgcttgtaaatgcctgctgtgtgttagatgctctagtaggtttttagacaccctcatctaatcttcatggtgattttctgatatatcctgaacctgtacattttctccacttctgtcactactactacaggccaagccaccatcatttcttgcacagactctgcaccctcaatgtggcctccctacttcaagttttaacagtcttctccctctcataaccactttccagacataagttggatttattttaaaaatatatatcaagtgatgtcacctcctgcctataagactcttcagtgacttaatgacaaacagaatgagatccttctcctgctcggctgacaagaccagaacaacctgggttctatagctctgagagctcaccagccactctgccttgctcgttcactgtgctccagactcactggcttgctttctgtccctggaagccaccgactggttcttccttagggcctttgtaccagctgttcttcctgcttgggacactctctcccagatctttagtctgggcctggcttcttgtgatttgtgtcttgcctaaaatgacacccctcaatgtgccttccctgaccagctgagctacagcggtttccctctaccgcatcactagttttactttctttctttttgtttgagatggagttttgctcttgttgcccaggctggagtcagtggcatgatctgggctcactgtaaccacctcctgggttcaagcgattttcccaccttagagacggggttttgccatattggtcaggctggtcttgaactcctgacctcaggtgatcacccacctcggcctcccaaagtgctaggattacaggcaggagccactgagccaccacatcagcctagattttattttcattaaatcgcttgatgcagtgcagagtgagtttctgctatagactgtctggatttcaatcatggcctcgtcatttactggctgtgtgattttggagaattacttaacttttcaggactttcatcttcttctttataaaatggaaatattattatatcctccattgtaagaattgaataaggtagtacttagcatcttttatggtttctgacacatttacataatcaaaaaatgttaaatattgctattttaatgtaatgttattaaaatcattgctattttatagcttatttatttggctatttttctgtctcttctaccaggaatataagcttatgagggaaagaatcttatgtgtcacattcccaactgtgcccctagagcttagaacagtcttagcacatagtaggcattcactaaatctttgctgattattaaaatctgagatataatatccctatttttccaattgagtaatcagggttcagagaggtaaagtaacttacccaaggtacgcagctactaaatgctagtagttcctggtatttgtactgaatgctgattacaaagacatgttctttctgttatgccacaatacataagtggatctttatttcagattctgtcattatagcagatgattttcaggttgcctttttatgtaaatgtaacatgactcatgaaatgtaacagccatttgtgtgaacatgaaaggtcagagccaagagttaggccacaggcaagttagaaagtgagatatagcacacccaccacattcagtggtggaagaaaagttacctgattcctccttggagatgtgtagggtagtgaccttggggttgggctgcctgaggaggttcctatgcttgatttctgaatggacaggatccctaaagtcatcgaccctagtttgggctcttgtactcttctatcatcttattctagttggtggaggcagaggttgaaaaatcaaaatgttggctcttcagcctctaaaaagtaataggcttgaatttgcttttgtcactaacatgattatggtgttggtctgtgggggcttcactgatgcattctttttaacagccctgtttgtttgtttgttgtttgtttataagtgagcatagcacagaggaaaaaatataggttttggagactggcacacagggttcagatttctgctgtgctacttcttggctgtgttttggcacgtgaacttctctcacctcagtttctttgtttatgtaatggggattcatatgacaattaaagagagagcttgctaaagtgtcttatgtagtagtatccccagtttgacccttttgagaatctgatgacagtatggaaccctctccccagacaagtgcccgtatacccagaactttgtatttaatttcatgggttcatgaagcctctgaaactcagcttaagagtccataccaaccaaggtccttataggagagcttgtgtttttgttttgttttggctttctgcagtctcttaataatgtttattgaagagagaatttaactaatttccggtttccataatcactttaaactcggtatttgatttcctttccctgggacctgtgacagtgccagcttcatagcctagtctaggcatgccagttgccactgtggcaatcaatatctgagcctgtggtttttgccttaggtaaactgtagagatggatcatggaatgcttggaaaatttttcagtttatgataatgtgtaaatgtcgagagccaatattgaggaatggcacctcaaagtatttgggtactctagatcagacatgaccatcttggttgtgaaattttgctaatgcatctttcctaatagaatatacaatctcagggctagaaagtttagagatcatttaatttaattcctccagattgattaagtggtttgtccaaggtcattcactggtatagtggcagagctcaggctgtacaaatcaggtgagtattcttcagctcctcaaagccagtaacttccactcacttgtgtgtgtctgaaattcattaaaccttcgacacaaatgcagccattttaatgctgaatgatattcatcactgtctgaaatgggcttatttatgtagaatgtttattcctatctcttcctccattctcccaaaatgtaaaccccataagaacaggatcttgtctgtcttagtcacactcagtatccttagagccttgtgtgtagtaggtgtgtatgaattttggttgaatgagtggcagttctaataatgtcagaagaattggaatttctttaagaaatctttatcagtaatttaacaaacatcgattgaacctattatgtatcaggcactaaccaggcacaggtacgaatgagatatggtgctcagcttcaaggagttacagtctaaatacaaaataacagaatcaagagcagcagactaaattgggcccactgtattttttaaaaattaatttgactgctgggtgcggtggctcactcctgtaatcccagcacttcgggagcctgagtgggtgaatcatgaggtcaggagtccgagaccaacccggccaagttggtgaaacactgttctactaaaaaaaaatacaggccaggtgtggtggctcacgcctataatcccagcgctttggaggccgaggcgggcgggtcacgaggagatcgaggccatcctggctaacacggtgaaacccgtctctactaaaaatacaaaaaattagccagggcgtggtggcgggcgcctgtagtccagctactcgagaggctgaggcaagagaatggcgtgaacccgggaggcggagcttgcaggaaacgaggttgcgccacggcactccagcctgggtgacagagcaagactccataaaaaaaaaaaaaaaaaaaaaagtaaaagaaaattagccgggcgtggtggcacgtgcctataatccagctactcgggaggctgaggcaggagaatcacttgaacccgaaaggtggaggttgcaggagctgagatcgcgccactgcactccggcctgggtgacagagtgagactttgtctcggaaaaaaaaaaattaatttgaatgcatgctccattatatcctatgtcttttaccttcctgcttgctcatttaactgcctgatttctgatgacatttaagttcaggtcttaggttctgtagtcagtggtttctaaacctggttgatcatcacctcacctcactggccttagaaacaatacgaccctacttctggagattctaaaccagggctgagatgggcccttggaaactgtattgaaaacagtaactctatagtcacttacaatgagcagccaaatctagctagatgcccctgcttatgggtgagtgttgagcatgagggtttcgtcttaaaacctggacttgatattctatatcatagcatctttcatatccttaaagattctatgtacttttcagcacattgttctgtttcaggggctctgcaaagtatacttgctgtctgtacatttccactgtgaaaactccttgaaacatgtagacaaatgaaagctaaacatcaaataaataacctaaactggtaatactcccattggctctccttgtgtcttttcatgtgggttagctcttcaaccagattcagcatataaatgagtatgtatggttatatggtgactttcaaaagtaaatactttttctgtggaacaaaaggatggatttgtggttttccaggattccttttccctgacttggtagaaagatagccaggctagctcagcagacctgaaaataggtgagctgtcaaggtgttggcagggagaggctcctcgggtgggacttggggcatcctaccagcgaaaaagagactaagtttaagtgatttcacattgggctttacttactataattgctgaagtgctaaattgagtgtgacaaatctaacaggtattgccaagtaggtttcattaccagtcattgcatagataaatgatgttccttatgttaaaaataaaaccaaactaaagaaaaaaaattggactatatttggaggtagaattcagatatgcagatatgttcatatacatcaaagctgtttcaatgtgtcaacgaactcagttcatttactctgccaaggtggtatagtgtatgtgggagtgcagagtgggggaaagtgaggaggggtgtgatttatgagaaactgtaaaagaggttagaattgggaaacaagtttttttcttagagagtggcaaatagtaagtagcatttggacctcactcagctctaatagttaaagctaagcttttgacattatcattatatattaataatatatatgtgtgaccagcctcaatagattttatcattagtaacttggttgatttaatgaaaatagttttaaaaggcatactgaagcacagtaaacctaaggctcacatcactgtctggggagtcagtgaggaacagggcagagtgccagtcatatgaagagggatttttttgccttcttggttcactgcatattcccagtaattggaacatgcctgacatgaagtagacataaaataattactgaatgaaagtggaaaggaaagtatattagtctctgctttcatggagcttatatgctagtgggagagagacaaaaattaagtacaataaataaacagaatatatgatagcaactagggtgagagtgctgtttttgataggatggagggattgggccatttggggaatgaattgatgagaaagagaaagttgtgcaaagctggggaggaaacatcatttgaaggacagaaagaaggcctacatgatttgagaatggtggagaggagatttgagggacagacttgctatgattaagaaagatagctgggcgcggtggctcatgctgtaatcccagcactttgggaggatgaggcgggtggatcatgaggtcaagagatcaagccatcctgaccaacatggtgaaacccggtctctactaaaaatacaaaaattagctgggctggtgacatgcgcctgtagtcccagctactcgggaggctgaggcaggagaattgcttgacccgggaggcggaggttgcagttagccgagattccgccgctgcactccagcctggtgacgagcgagactccatctcaaaaagaaaaaaaaaaaaaaaagaaagtcatgataaagagtgggattttattttacgcaaagtgggagctcattaagaaggtaaaagtttttaagcaagggatgacatgatttgacctactttttaaaggaggttgctctgacggctgtagaggatagacataggcaggggacaatagagagaccaggaggaggctgttggagtgtgttaggcgagataggtgagtggtttcagaggcttgtgtgagaaagttgatacactgcccctaccccatgcaacacacactttcttttcttatgatgacctttctttaaaagcatttgttggaatatgagatataggccataagtgagaaaacaactctttttgagctgtgaggaatactaggagaggagaagtgagctgtgtgtgctgcccatggtggtacgctgctatggttctacagttccagtcattttgacagcatggattcaatgcaaaatggcaacacacactctgtatcttttggcagatcgaacataatgaaaataaaataaaaaaattcaaaactggctcttgaatgaaataggattcgaagagatgatctcaaatctactttatgagataatgtcctttttaaaaataaacactaaatcagttatgcatttagaatgtctgaattattattctaggttccttgcgactgctgtgattttgtgatgcacttggatagtctctgttactctaaagttttaataggtaacagtcagaatggagtgggagagcataaaagcaaactgaaatgcaaatagctggtaccctgaagccataactttaagctggttattcctgacctactgtttggacataagatggtagagaggctgaggtgacttgaacatttgttccttagaaacaccatccttgggctgggcgcagtggctcacgctgtgtttccaggactttgggaggctgaggcgggcagatcatgaggtcaatagatcgaactatcctggctaacacggtgaaatcccatctctactaaaaatacaaaaaattagccagggtggtggcgggtgcctgtagtcccagctactcgggaggctgaggcaggagaattgcttgacccaggaggcagaggttgcagtgagccaaggtcgcaccactgcactctagcctgggcacagagtgagactccttctcaaaaaaaaaaaaaaaaaaaaaaaaaaaaaaaggaaaaagaacaccatccttgtaaagagagcgcatacaccttcaatttctagggcagcagcgtttgcttacaacttctatgtcttggtgggagtagcactatctatcaccttatgggccaaagggaaaagtccagtgaaaatggctctgatgttgttggaagtgggaaagcaggttaataggttctcttaatggaaaatgcagccaatattggccaacttactttgatttcggtagtcataacacaccctggaaggcaccctagatagaggtcacttgctaccactcattttacagatcaggatctaaggattttcctgattttaagcattaagtatggatatccctgttggttgaagttaaatggtcaactagaatttaaaagcaaaaattaaaaaaaaattattttgtattaggtttcaaggaattgttgtcagtaggagaagcctgattgttccttttacgctgactcatacagtttcgcagattacatttgaggcctaatgttgaaatctcatctgtaagtctggtatatctaactatcatataaacatctttcatcttagactgtgtagcatgtccctagtagaccaggtgggcaaatgacattatagttaaatcaagccaataaatatatgagaaagaaggcaaatgagcgtgactccatagtgaatgatggaggttccgacgagtcaaagacactgaactattcattgctttggtttatggaagagcaaacccagatatgtgttatgctgattctgtgtgattggctactccaggattgaccctgttctcctgtcctgctcaagtctccttccttcacttaaccatatttgtgggtactcagaaatgccatgcttttgtttagagtagcaggattggtgttgaagataacaagaaaaagcaaaatgggcttgtctgtcccatcaagtgatgtgctgtcaacatatgagaatatgtgccctgaattaggagaaaaaagtagagattcctgagtttaggaaattatatctgatgcatcttcttcagactcaagccttacctaaagtttgtaaattctttctctttctctttattctttctctactcttaacatttttttcccccacctctttggctatatgctgtctgcttttgatacagaattgaccttatttggccagatggggtggctcatgcctgtaatccagcactttgggacgctgaggtgggcggctcacttgaggccaggagtacgagaccagccggccaacatggtgaaactccgtctctactaaaaatacaaaaattagccggacatggtgggggcgcctgtaatcccatctactaaggaggctgaggcaggagaattgcttgaacccgggggtggaaattgcagtgagctgagatcaggccactgcactccagcctgggcgacagagctgactctgtctcaaaaaaaaaaaaaaaaaaaaaattgacctttttcatgcccaacctctactccattatctcctagctttttggaaaatatttagtactggcatttcttcttcactgattttcattctacctgtctttagtatcataggggtagttacctcagcgggggtagggagacttgggtgtctcttacttgtacatactctgtcctctataagtaagtgtgtaaatacactgattttcccattcagacatattgtgtaagtaataggaaccaggtgtttgaataaattaacaagtgccaaatttcattttggaaatgaaatattttagtttaagactctaggacatttataagctgaaatacattgcaaagtgatgaaagctttcttaaattctgttatagtcatgcacttaaaattattcattgttacttatagttattatctgtctgtatatgctcatctacatattaaaacatgaagatattctctcaagtgaggacttcatgtgccagatttttcagcctggatgaattttatggatgagagagataccctggaaatggaaccattggcataaccttgtgtcaatataataacagagctctaatgaactgcaacatgagctcagatctgcaaaatattcagggatataggcaaagagcagttttttcctccttatgagctaggttgttctccaaaagcaaaagtactacttgtcttttcagagcgctgtcatggagctgtaagtctctttgtggtttagcttaatgtgagtaagattcctctgcattctcagcctagaaaaacttgaccgttctcttgaatttggtgaaagtttcctaactttgaagctagagaatactctcatttcagattaggcattattaacatttttttctgttctaatttcatgatgccaaaaaatcatgtatggttgatcatttggagaacaatatgtagcctcagacacttaagatcatatgtagtttagaaataatgcaattgcatatgaatgttttgatgtttttcccccagcctttctgaattttttgatttctcaaattgtacctggttttttatttttgtttctgtttttgtttttgactttcacataaacgtttatagtgtctggaacatacatatatatatatatacacacacacacacatatatgtagtatgtatacatgtgtacatgtatataaacatgtatatgtatgtatattccagacaaatatataaatgtatgtatatatatacaaattatatatacatatacgtatatatatacaaatatatatatacatatacgtatatacacaaaaattataacacaaattatatatacatatatttgtacatatacaaatatataatatgtttgtgtatgtatagttatatatacacataaatttttgtattttgtatatatgtatacatatacattttgtaatatatacgtatatattacttatgtatttttaattgtaaaatacacataggataaaatttataattttagtccttagccttttttttaaccatttaacaagtggtattaagttcatcctcattattgtggaacccatcccactatccatcttcaaaacttttccagcagcccatactgaaactgtaccaattaaacataactccttgtttctagcttcccccagcccctggcaaccaccattctattttctgtctcacaaattcaactatttcaggtaacacatataagtagaatcatacagtatttgtcctttttggctggctagtgacgacattaagattaaaatcaggagaaacagggtgggcatgttggccacacctgtaatcccagcactttgggagcctgaggcaggaggattgcttgagcctaggatttgagaccagcctgggcaacagagtaagacccccatctctataaagaaaacaaaaccaaataaagcaaaaaaaaaaaaaaaaaaaaaggagaaacagatttaagacagtcaggaaagaaaatattgactttgattttggtcttattgaatcttaggtgctggcaggtgaggactttatgttgtaatatcctgaagacagtttcaaatataggtttggaatggagatgaggacttcgagttatcggtaatgaactcattttaagaagatgagattgcctaaaggaagaatgtttttagagttagaagagtgggatttacctgatgatcttaggaattctggacatttatcttaattgctctttaggaagtttagtagaaaaagaaaggatgcagatagtgtctgctattaaagcagaggaagaaagacctgaaacagagacagagaagaagggagcttaggttataggaataaagggagaggatgtcatagaaacgaagggaaatgaggattttgagaaagagatgcaagtactgtgcccagtgtttccctaatgaccaagaggatagttctgggttttagcaagtatgattggccattggccttgggaagaatagtttcagcagaatggtagtggttgaagccagatctcataggggttagggccaaaagaaacagtaggaattctaggcatttatctgaaattgcttttaggaagtttggtggggaaagaaaggatgcagatagggaatctcaggcacatagaggtaagtaacttgctcaaggtcacacagtaaccttaagtaggcaggataagctctggttctgagctggtgctcttcatcattattttaggctgtactctcccacctttttttctttgtggtgtaggtggttgtaggctacttaaagagatacctatacacctgcagttaaaatccaagtactcagtggagagcctggtccttcgttattatgtctcagattgaagttttatattttacgcatgatgaaattacatatatgatggttaggttaggttgcaagtcttggaatatatgcaaggaataactttattacaatgactatttactttttataagacaatccagcaatggtaattttcattagtgatataattgcaagaggaaacttgagaacagaaaatggacatattgaaaaagattaaatacatgctgatgaagttacagagttttatgcaacgtttcaatcaagaaagatgataataaagcgtgtataggccgggcgcggtggctcacgcttgtaatcccagcacttgggaggccgaggcgggcggatcacgaggtcaggagatcgagaccatcctggctaacacgtgaaaaccccgtctctactaaaaatacaaaaaaaattatccgggcgtgatggcgggcgctgtagtcccagctactcgggaggctgaggcaggagaatggcgtgaaccctggaggcggacttgcagtgagccgagattgcgccactgcactcccgcctgggccacagagcgagacttctctcaaaaaaaaaaaaaaaaaataaaaataaaaaaaataaagcgtgtatattgactttcagaatcttgagaatggataaatggaaacaaagagaaatacctattttgtattataaaccctaaaatagttactaaataagttattcttttaggtatttttctttcacttttcatcgctttaggcaaaactgatagtcgatgtagctgtgtcagtagctaagggatttttgttgttgtgttaaactaacatgtcatatcttgtataattcagctgtgactatacaggggaaagtattaatgtctgatgattatacagcctgtgctttggaaacagccgaaagccagacagcgacagagagggcaaaggattattaaatggatagtcactgaggtcacttatagtgactttactgcacaccgtgtgcatctcctttcccatggcaggttgtttgatcatggcttaatggctaaagtttgtaaaattataaaaaaagccagaaatcctgctgatctcaagtgttatttacagttgatgcttggcaggaaagtgctaagtctgatcatactaatgctaagtcaggcagaacacgtgtgaaatctcatggagctctatcctctgaaccttgagaagactaccaaagtataagattcagggtggaaagtatgctgcaatatgattgagagaatttggctttttcatctgaacagggtggccaagtggaggagtttctcctcttggaaatgtcaaggggtgtatcattaggtcctggagctagaatgtaggtagaatggcaaggaaggaattttaattagttctgttatctttctttatggtttggaatggtattttctttggtcatctattcacttacaaaattatggacagatttgattgtgaggaagaatcttgggtaagtgttatctttgttttcagtagaattacttgagctggctcaaggaaattatattagtagtttgcaagtgagttacagctaatggagtcaaagaagtttgaaaagggtcaaaagaagttagaattgttccatctgagtctttggcccttgtaaaggatccagcattttgttttgtttttgcttatgtctttgatattaatatatttttagaatattataaaccacccttccccaaagttttatttccgcaatcactccctaatcttttttcttttttgcttcgcatcatatacatttttctcttcaggacaccttcttttccctttgaaacttggactatgttcttaaaattgacgattataggtaagaagaccaagtttgtgagcaaatagaatttgatattcaaattatctgaagaactgaagtacattattttgtacttgttttatttattaaaaaaaatttcccttggaaaagaaattggtgagattaaggaatgctatgctaactttgtaggatatttggaaaactatgagttatagtgaaaggtgctgtcttaggggtacattttaaaagtgctagaaaatataatattacagcttgaatcaagagaagtgaacttgctagggactaagtactttgttagaaaggtgctcataatagaatggcgtgaacgcggggacggagctttcagtgagccgagagcgagactccgtctcaaaacaaacaaacaaacaaaaaacaaaaataaaatagaaaggtgctcataataaaatgagaaataaaaaaaattctaacgatcaaatgggacaaaacccagattcacggtctttatatgcaaataaagtatagattctagattcagaacagtaaaagaaaaatacctagaaaacaataaacaaaaggcatgaacaggatttcacaaaagagctactgcaaagtcacaaacatattaaaagttactcatcctaactacaatcaaataaatgtaaattagagcaagcaaacttgtttttccatttatgaacttgccaagatttaaaagtttgataataatgaatgtttgagtatatgaagaactgggtattatttgtgatggacatgtaccatagcatttttctggagcgtaatttcacaatgtgaatcagaagtttaatagtgcatacgttttgacctagtgaatctcctgctaagactttttatcctaaagagtcatctgtgccttcttgtcaagatggtactgtaagctcacagtttgtacataccttctctctaaattcataggaatggcagatataatgcattaaaagaattaaagaaaaaagtcgtgctgggcttacagacaagatagtgttgtagacccgaaagctaactaaacataaagggctgtaagctggattgaagggatggtgctgcagaggctctggatggagaaacagaaagctagtttagctcccatagagtgctaggactgaaagtttaccacttgaaatgggaccataactagctcactgcttaaagccaggggcagggatgaagttgtcaatcctataaaaggaaactaataaaggctccacatggaggctccagtttatatggagctgtgggtcttgaggggcaggagagatagattcaatttcaagaatagcaactgaatcaggctgactgtgaggagacaataatagaaaatgtggtgttccatgttacaattatgaggtttggtcctggacagtagcacagggtcctggtggaggcagctgcagaaacactatggagggaaaggtgagcacaggtggagagaaggggagtaagagaagcaaagaagaaaagcctttcacttagaattagccttcaaaatgcataccaaaatactggaagaaaataaataccaagaaagatagctaacaaaatcaacaatggaacaaaaatttatcccagatgagatgaatttttacagaaaagtcagtcaaaaattaaagaatcatgttcagaatactcaaggggataaataaaggcattacattgatgaaaaatgattttaaaaatactcccaagatatgcagaaatggaagaggaacaacgacatgaaaaagaacagttacaaattttggaaatgaaaaatatggtcatagaaataataaacttaatagaggggtggactttagacctcacacaattaaaaagagaattgatgaattagaagagaatactaagaattcattcagaatgtatcataaagagacaaaagattttttaaaaggcatttaggagattgaaggatagatggagttccaacatatgtctaataagagaacacagccttgaacttttgcctcaagtgatcttcctgcctcagcctcctgagtagctgggactacaggcacatgacacagaccctgctaatacatttgtgtgtgtgtgtgtgtgcgtgcgtgtgtgtgtgtgtagagccagattctcgcgatgttgcccaggctggtctcaaactcctaggctcaagccatccaccgaggtctcagcctcccacaagtgttgggattacaggcatgagcctctatacctggccaaaagcaaaatgtaaagagccaagaattgagaattttcctatttaaagaatgatgagtttaatatattgagtagtatcatcatgttgacgttgtagaatttaagggatatagaggaaaaacatttttgagatacaaaacaaaaaaatgccaattacctacgaaagaaagattagcaacatagatgctagaagacaggagaataatatactaatatattcaaaatgctaaggggaagtttagttaattttgatttttaaacccagttagtctttgattcaaaagtgaaggaaaaatacgatactttcagatataaagaaagaccaagagagttaccatccatggaatctcaccagggaactgttaaatgctgctctttagcaagaagaaaagtgaaaccagaagtaaggttttgtttttttctttctttctttcttttttttttttttttggagacggagtctcactctgttgtgaggctggagtgcaatggcgcaatgctgactgcaacctccgcctcccaggttcaagtgatctcctgcctcagcctcccgagtagctgggattacagacatgtgccaccatgcccagctattttgaatttttagtagagatggggttttgcaatgtcggccaggctaatctggaactccgacctcaggtgatcggcccgcattggcctcccaaagtgccgggactgtaggagcgagccctgctcctggcctagtttttaattaaaacaagtgaacaaacaaaggtgggcatagagatgataaagtgtattggaaaattcactaagttattggtttaaatactactttttgttctaaatgaatataaagctaaaactctggagaatgatgagaatgtaagaagggagaagtaaatttgtgtgatccaatattagggacacaaaaagggacatactacatgaattactaatatctagaaaatatgatacatttgagaacttagatgaagttgatacatacctagaaagataggcatacttaaattgcttcaagaagtagaaaatctgaataaaacaatgaacgaaattgaatgaaatgaaaagtccatctgtcaaatgacagcaggcccagttttataggcacgttaaaccaatttaagtaatccttacttactcttcttccctttttaaagagttttattggggtataattatatagaataaactgcacatatttaaagttttgacatacgtatatactggttaaaccacaaaatcaagattaggagacatgttcattatcactcctaatttgtgtccctcagaaatcctttctccttctctcccctagtggttctgggcagctactaatctgctttctgtcactattactagttggcattttctcgaattttgcataaatggaatcaatcaaacagtatgtgctttgcactcgctctctctttctctctcccttttaaaaaatagattctggttttttagagtagtttaggttctggcaaaattgtgagacaggcacagagatttcccatatactccctacctcacacatgctctgttacacacactccactattatcaatatctgccattagagtggtacattgctacacatcattatcacctaatgtccataagtttaataaaccattagggtttactttggtggtatatattgttgcttgggacaaatgtatagtgacatgtacttaccactgtgttaagtatcacacaaagcagtttcactgccctaaagattctctgcactgtgtgctcttttttgaggtttagggggaggcctgtcttccgtcactcagcattgtgattttgagatccatcatttgttgtatgcttcactaattcattcctttttattgctgattggtgagttattatatggtataccataatttctttttctttttttcaatatactgcgatttctttatctgtgcacttttgatggacatttgggttgtttccagttttgggtaattacaaatgaagctgctgtgaacttcatgtgcagatttttatgtagacatgtgcaatcatgttgtaggtgtttaatatatattttttatgaaagttccagattgtcttccaaagtagttgaccattttgttttcatgagagagtgtataagagttctagttttgagagcagattttcttaaatttcatgaagtttatccttttttcttttatggattttacttctgggttcatttctctgaaatctctgccttgtgtaattaaatactaaaagagtttcgtatgttttctaatactagttttatagttttaaggtttttattaggttttatattgatgtatttattaattttgagatatttttgtgtatgcacaagggtggattggagttctttaaaagatatagatatctaattcttcaagtactatttgttaggctcttctttctccatttgaatctttgtcaaaaatcaatgaaacataaatatctgggtctttgtggacctctattttgttccatttatctgtttgtttagtattatatcaatacagcacgtcttgatttctgtagttttatactaagtcttgaagttaggtagtgaagtccttcaacttattttactttttcaaagatgttttgtcactttaagtctttgcgtttctaagtgaatttagaaatagaatgtcaatttttacaaaaaaaacctgcagggatcttagtttgagattgcacaatttggggacagtgaaatattttatcgagtcttccagtccactaacatggcatatcttttgtttaatttcggtagtgttttttaaattttctttgtataagtgtggaaaacctttttccagtttatctctgagtactttataatttttgttaaggtacatggtatttaaaaaaactcaatttcagattgttggttgctagcatataaaaataatttttgtatattgatattgcatgtagctaaacttatttattagctctaatagctgttttgcaaattctgtagaattttctcatagatgcttatgtcgtatttaaataatgacatttttaccttttaaaaatttattctcatccggatacttttcacttctttttcttgccttgttgcacgggctagaaccttcagtacatctggcatagagggggtgatgggaaacatccttggcttttttcctcattttagggtaaatcattcactcttttaccactaggtagggtttcattgattcctttattaagatgaagaattccgtagtttaccgagtgtgtttatcagggtcattgttgggtattgtctaatgctcttcatctattcaggtgaccctctagtttttctttcttagcctgataatatgatggatttattagatttttgaatgttaaaccaacctggcgttctgggggtaacacttggttattatatatgtcctttttatgtgttgttggattcagtctgctaacattttgttaatactttttacattatatgcatgagggatattggtctgtagttttcttgtaatatttctgcttgcctttgggttgaaagccattaattttctggattaatttatgtagaattattattatttctttcttaatgctttgtagactttatcagtgaaggctttggatttggagttttgtttgtgggaagttttgaaatacaaattcaatttcattaatagatataggactatctatgtctactaaaaagggctatccttttctttttcttttttttctttgagagcaaggcctatgtcttgatcaccatttgttccaagcatatccctggcatatagtgggtcaggagtaaatgtttggtgaatggatgatgaatgaggcaaactcagggagaggaagtggggactgtgtctgttcttggccccagtgggggttgtttgtggatgacatctcattctcatcctgtagtagagggataacacaaaagttggagtctcagggctccagagtcctcatcctctgagctacatctcctacttagccgaggcttttcactctctgggcaagtctcctcactttgctgaaatggcagcgttcctggtacatcccggtttagcctaggctaacctcttcttgagtgaacctaggtaatttgtgtctttcaagaatttgtctattttatctaagttctagaatttattagcataaagtttataacatcccctattatccttttaattggtatgttgaaacttctgtgtgtatttttaaatcattctggctgggattttaaattttcttttctcaaagaactagcttttggcttcattttttttt

SEQ ID NO: 5044 - DNA, 100000 bp, Homo sapiens
gggctttcccctcttcattctgcacttctatttcctgctgccatgtgaagaatgtttgcttcccttctgccatgattataagtttcctgaggcctccccagccatgaggaactgtgatctattaaacctctttcctttataaattacccagtctcaggtatttcttcatagcagtgtataacatacaccctttctcctgagtccccaaagtccattacatcattcttatgcctttaatcctcatagcttagctcccacttatgagtgagaacatacaatgttgggttttccattctgagttacttcagttaaaataatggtctctaattccatccaggttgctgtgaatgccaaatctcattcctctttatggctaaatagtattccatggtgtacacatacaatacaggcaccacacatacacacacacacaccccacaatttctttatccactccttaattgatcggcatcgggctggttccatattttcacaattgtgaattgtgctgctatcttgtgaattgtgtgttacaagtatctttttcctataatgggttctttttctctgggtggatacccagtagtgcactggtggatcaaatggtagttctatttttagttctttaaggattctccatactgttttcatagtggttgtattagtttacattcccatctgcagtttaaaagtggtcctttttccacccatccatagcaacagctattattttttgatcatggccatttttgtaggagtagggtggcctgcattgtggttttgatttgcatttccctgattattagtgatgttgagattttttcatggtttgttggccatttgtacattttcttttgagaattgtctattcatgtcgttagcccatttttgatgggattgtgtttttcttgctgatttgagttccttgtagattctggatattatcctttgttagatgtatagattgcgaagattttctcccactctaggggttgtctgtttatctgctgactgttcctttcgccatgcaaaagctctttagtttaagtctcacctatttattttgttttgttgtgtttgcttttgggttcttggtcatgaagtctttgcttaagccaacactagaagggtttttcccaatgttatattctagaatctttattgtttcaggtcttaaagttttgatccatcttgagttaattatttgtataaggtgagagatgacgatccagtttaattttctacatgtgttttgccaattatcccagcaccatttgttgaatagtgtcctttccccatttgtttttgtttgcattgtcgaagatcagttggctgtaagtatttggcttcatttctggttctctattctgttccactggtctatgtgcctatttttatacaagtaccatgctgtttggtgactatggccttatagtatagtttgaagtcacgtaatatgatgcttccagatttgtctttttgcttagtcttgctttggctatgtgggctcttttttggttccgtatgaattttagattgttttttctacttctgtgaagaatgatggtgatgttttgatgggaattgcattcatttgtagattgcttttagcagtatggtcattttcacaacattgattctgcccatccttggcatgggatgtgtttccattactttgtgttgtctatgatttctttcaccagtgttttgtgttttccttgtagaggtctttcacttccttggttaggtgtactcctaagtattttatattttttgtagctcttgtaaaaggggttgagttcttgatttgattctcagcttggtcactgtggtgtatggcagacctactgatttgtgtacattaattttgtatcctaaaacttgctgattcatttatcaattccaggaactttttggagaaacctttagggttttctaggcctatgacatatcatcaacaaatagtaacagtttgacttcctcttgaccaatttggagccctttattctttctcttgtctgattgctctgcctagggccattttcttaataaatggccttttattatattgataccacttgatattgtcttgttgcactggggcccatagtttcaggtggttcctctttcatttcactaccatgtctccaagagatagattcaccttctaaaagcccccttttcttccagaagtgcctttccaaagctgccacctctggtcctaatctatctttcaatcccctccttttacttcccctgtagctaatgctctggtccaccagccctcagatcagttctcagatttccccactcagagtggcccttctccttctgtgggcaccttagttgatattatttgtttctgccataactagaatgctgccacactctccccttatgctcaatccttaccttgcctcccatctggtgtgggcttctgagctgatgtgtatttcccccacttacacataacgcttaagaattttgtctcctagttatgttgtaggagagggctatttcttgtcctattaggacccgaatagtaataatacatccataaatatatataatttttatcaactaagaatataaaacaaaatatttttaacttttaggcatgattgttttagctatcctcttttgctattgatttctattttgttgcattttgcttagagaaatatatattgtaagatttcaattctttggaaattagacttcctctgtggctgaatacatagttgattttttctttccatgttccatgtgcatccatattcattttagtaatcatgttaagcaaatctagactttttcttacatttttgatctccactgacagtgaaaagctattactaaaatggatgtagccgtagtatttttccatagtttgtcagttgttgcttcatgtattttgaggctatactgtttggtgtatataagtttacatcatatatctttaacttgttcttccctctaacagcataaaatatccttctttgtcacttttttgaccttgagttttgtctgacattaaaatggttaccctgtcttaatctttacatagtaatatgcctttgctttaaagctgtctttcctctctgttagtaaagtcttcccaacctctggttgtatgtacagtctcttacattttcttctaaaatttctcttttttttccaccaaccgatgaacaaaattaaaaaataagtaaaaaatttctcttattttcattgtcgttaatgatatatgtgtaactatgacaaaacatttgcatcaaatctagctggattttaatgacatataccttgaatttttaaaaaacttccttatgcttcagttccttaccagtgattcctgagagcttctgagttccagcctctgttacttcactataaaaacgtataagaagcaaagatacaaaattagcttgctgtttcctcagtttcataatggctaagagtgcccctgtcatgttaaattagacaaatcttaacacaaaggaacgttttgggaaggccactggtcacagatgtcggtattcaagaagtggctgtctcaccaagaaaagaaacagtaaagagaaaggaaaaaaacagcaagaggaaggaaaaaaaatgtgctttgactagataaaaataagcaggagaatagacagatggaggagatgttcagttgaatatagatgtgaacaaattagatagtaggaatataaaaataagatgttaaattttatttaaaaagaaaacaaatggtgcacagtgaagacagaggtaatctgttctagggatgaaaaaggtgactctcaatagagtgagaagaggcaaaaagcagaaagtcaaacagcatctacctcagaaaacaggtcatgatcgaagtctaagagtaccagattgacttccaaaagcctgaaggaaaaacatagcttgatatattagtgaatgtcatatggaaatgaaagggcaagaacaaaaggtataagaataccagtaatatgggtccaattttccaggcgtcaggctggagggtgcagtccactggtggcactttgaaatggaagtgaaaattctacctgtaagataaaagagattaggatgaggagatgttttctaattctatatttttagttttaaaacacttgtttctcttgctttgatattttctagctttctggttgacctagaggttgttttgttctgaacaaaggggatgtaaatctgtttgttcccattcatggatttaattaggcagttgcccaatctctaataaatcacgggtttagtttttctttgttaaggtagtcagaggcttcaggcatgagtgacttattaaaatgtactctgatagttggggatgaattatcatcctatattgtcaatcacttgataatttttatcccaaaatctctctcctggttgttttgtcctcacaaagatgacattttattctcatatttgttcacagacatgattcacatttttctatcagtgcataaggaaatcattctacattcagcaatagtgccagtttgactaaaaaaaaaatttccatatccacaaaaatgttaatcagattcttgttagaacatgtgtaagaactggtttcattttcacagctcttgatgtcagattactaaaataatttatgttttgttgtgggaacagagtgcacgcaaaacctctccaatcacatgaccacttctcagcccacatgtcttcataaacatagaaattatttgtgttttgtggtaacgaatgaatggcaggaacagcagaatttcatgtggcctttctttatttgattaaacatattctttatgtatttttaaaaaaactaatttagttaaatggcagtaaaccatgataatttagaaaacatggtgaaactgagagtgaagagaatgttctttacgtaaaccacactgtaaaccataaaacttatttttgtcaactgcttttatgacagtggctgggaatttgacatttctactacagtaggcaaaaatacatgtaaaataactctcccacataccacatcacatctctatttgtatttccaaactaaaagcattacagccaaaaaagtgctgcgtgcactggtctagttacaccaagaagtgtatgttcacaccagcacaccttaagctggtatctgtgtggcaaggccactgctggtggcccctgacgccaagccccttcaatggatccagtttggctcaccaagagaaatccactgctctttaacccaaaaggtgtaagcttttcaatggcctccagttaccacaagataaaacaaacaaaattctcaaacagttatgaaacccaactgaagtatccacatgacagcgttcaatactacctcgccacttcaaatgtgtcagcagcaattagctatgaaaatgagtgttgtgaaaattcgcaatagtttgaactgaatattttaaaactagatatctttaatatgacagtaaacaatgtgacagaaacatgctgtttctctcatcttgtctgagatatacattccatacaggtgactgggtcccataagtttctaagaaaaacttttcctttccacttaatgatcctaagaagtcagtgcaatctggttttctccctgcagaagggttatttagtttgggatgtaacattttacaacaataatacaaactcctgggagaataccacaataaatgtctcaaaaaccactcagttaatcccagggtatatctggctgttttaaattactgcagggaatattatgggccttaatgacactgtaactgcaaaagccaaagaaagctagaaaaaggggccaaaaaaatgagctcagagccagccgaagtgcaacaaacatgtggttgtttactaggactggagaggtttagtctgcagatgtttgtggttccagaaggttccagaggaacgagttgttatgaagatttgcagagttggatgagagcaaattcttctcggagatggcaggccccaggacagggaggcccagtggtatagacagaattttagatttctgtggtcagatcatactctactggtcccacaatgtacatcaacaaattaatttgtacggatgtcatttcaaagccttctaaagacgagagtcattattgaagccattagacacagatggttcaaactatatgcagatattcatacttgcatttttgcattatagctgcttttttttctattgaactgtaatgaattgtctcataatctattccatcttcttgccattacaggctttgaatgttcacaaataggagcaaagaactcattttccagagctttaatcacaaaagagggaatgcctaattctctaaatgaaatggtctgtgatcactgaagcagagatttatatatcacggcaaattaggtagattttaataaattacttatctccctgaatactttactatgcttaagaaggaacatagcctgtttgcaaacagtgaaaacccacagcctataaaaacctttgaagaaaatgacaaataaaaaagtaaattaaaaaatgaaatgcattatatcctaacctctagagacaattcctttgcagcattgattcacagctccattaaaaatatcaattaatccttcagtgagattgggtaaaagctagaaaattaactttcagagctgcttttcgaggtctggttacccagatacaccctggcactgtactggcttgatgtaaatttaaaaaatgataaaagatactcctttcacgtctaactaagcatatcagaatttgagttatacttttcatatttctttctgtgtcatatactaagttttcaacgtgtaaatttcacatctatctatataatatctcctttttatatatacatccctgggtcaccattacaaatgtatgaaaataatacaatagaatgaacttttaagaaagaaagacaaaaaacttgcagtcattgaataagttggtgtaagtttcattctttatatttaattgatagaaactgcatgcatcaaagaaaatgcatacgagctttaatgtgcataaaatggatattagcattttaaagaggaagattaacacattaaccaagtaattttcatatattgcttctaataaaatcttcacagtataaaactcttaatgagctaatcataggcattccatttagtgggacgattagggataacataaaagtatttcttttcataggttttctaagatttatgcttttgcttattaaaaataaaaatgggaattgcattcggttcttcctaagaaaatgttgaaaatgcaaatagactttctcacgctatcacgtaggataaattattgagaaggtactgcccattatggagaacttaagtcctgaggggtggcagtatgagaaggagggaatagagaaataaacaaatgaaaaagtatacaaaacttcaacacttaaacccaggtctccccgctcccagcttcccatgaattatagattatatacaccagagtattacaaaaatctcatgtaggaactttcatgtgagcatttactgaggagtaggagatgccctggagcatttgctttcaagcctccaagtcatctctgtattgcttgtagacagactggaggcatggagagcttcgactgttaccctgagcttgccaataccttcaccatctgctcgtgatcaaaaactagggagaaaagagcaggaaagtgttaatatcattcaacagatttttcttggaaaggctcgcagacagaaacagtagttgaaaagatgaaaatagttctacagaagtccaagttcactggcatcttgggtatctaaagaataaaccttgtcacgtgtgcatggagatggcatttgagacgtaccgcatggacctgtacatattgtttgtggagctaaaactaataagtaatcctgaagtttacctagtgaaagcgtctaggataatgaccctcacacacaatcagatttttaagctactggacgggcatggtggctcatgcctgtaatctcagcactttgggaggcgaggtgaggtgatcacctgaggttgagagtttgaaactagcctgaccaacatggagaaccctgtctctactaaaaatacaaaattagccgagcatggtggtgcatgcctgtagtcccgctactcagaggctgaggcaggagaatcgcctgaactcgggaggtggaggttgcggtgaccgagatcatgccactgcacgccagcctgagagacaagagcgagactcctcaaagaaaaaaaaaaaaagaatttttaagctagtaaggagtaagtctaaagggaatttatgataatcttacagtgtttcagaatggcaaaccactgtacagatgttacatgatcatagcttgaattattatttaactttctgaggaaaacatttcatttaaaatagattttatgtgaaattagaaagattaaaatggcagacccaagaatcttaagatctgtgggtttgagtatatgtaggatttcttggaagagggaccactactttcagtggtgtcccaaaggtagatcttgggctcaagtgttcccccactgtggcctccccaagtgttaggattagaggcctgagccactgcacccagcccgaaggtagactatttggctggagccatgggcattctctgagctcagtggtggaagccaatgggatgccgattcaatacctgagactccatccctctgtggacaatgataatggctatgactcaaggccagaaacctggatttttgtaagtctgatagcacttatcacttatgagtttcatatagtttctgtttttttcttttagacagtatctggctctgtcacccaggctggatgcagtggtgcaatctgggctcgctgaaacctctgcctccaagggtcaagccaaccaccatcttagcctcctgagtagctgggactacagttgggcaccatcatgcccagctaacttaatattttcttgtagagatggggtttcaccatgttgcccaggttggtcttaaaactcctggctcaagcagtccacctgccttggtctcccaaagtgctgggattacaggtgtaagccacacacctggcttagtttccaatttataattccttatggttttccttgaactttaatgtgttgtgtgtgtgtgtgtgtgtgtgtgtgtgtgtttaattccaagaaaatttgttagaaagcttaaaacttgatacacaaagagttaggtgcagaaactgagcattgggtaagtgaaaatgcatgagtggtccccagctcattccctggagctgtcatctctgctttgggacttctcactctatggttgctgcagaacaaagcattaaaatcccaacctcacttatacctaatcttttgctctttcccaaaacatggccacaatagctgattatgtcagatcagtgggtcatatgcggctctcagaagaagatgggttgctaaacagccatttggaaaaaatacgaagaatataaagaaagataattttggtatttttgtcagactttcttggtcctggtagtctttaaaagggttaggttaatatttcaatcctctcatctttttctctgtgccaaagttgtgaccaactgccagtggttagaaatgtatagtttataaagatttcccagaagaagtttttaatttggttattggtctaatttggttaattatctggcttgagcctgacttttcagcacttgacacatacctggacaagcagcttgacaatgaaccagggctgaactacagcgtaagcagaatgcctggcaataagaggtgctcccttcagtgtttgttgaatgcacaagtgaatatgtaaacaagtcatcacatttttccaaagatggctctgctaacttaacaaatgggactaggaatcagccttattctctatttactacataaagcctaggccatccctgattatgatttttaaaagtctgattataaaacaatttagcacgttctaaatacagaagaatagagagtagaaattaagcattgtgggaatcacaactagtaagttaaaaatccaggacagcacatttgtcaggaacagatcaatgtcattactcctcacaaaatcctggtgggaaataaaggatcaaagctacttccttgcttgactgtatcactacattgcaacactgaattaaagagaagccttgagaaagacattatcggatcactcagaataacatgcttaaggttaagtaccttaacagaaataaggcttccataacattaacagaataacatcctgaaggttaagtcttagctgaaatgtggcttccataaacaccctagaaaaacatgtggccaggcgtggtggctcacgcctgtagtccgggcattttggaggcctaggtgggcagatcacttgagcccaggagttcgagaccagcctgggcaacatgagaaaccctgtctctataaaaaataccaaaaaaattagccgggcgtggtgatgcacgccttagtcccagatacctgggaggctgaggtgggagaattgcttgagcctaggaagtcgaggtgcagtgagccaagactgcactccaacttgggtgacagagcaaaactctgtctcagaaaaaaaaaaatccaatggccaactttttttcacgccttcactcaatactaacaaatgaatattccttgtgaagctaaattaattattttacaattgctgttgattcaaaggaaagcagggggaggacaggaaaaggatataggaagacgcttcagcttcaccaaagcgtcaacttgagtgtaaaggattcaagtaacgtgtgactcagcacccttggagccagcaaaaagaaggttttataaagagtttggagttcagcaattgttggttgcacaaactgagcaacactttcacccaaccatcgatattttgctcaatgaggtccctcccttcctgaaacatgtcggcaaggtcgagtgagccacgccaatgtcctcacactccaggtcctgctcgtcctctggagggtcactgacacggtgaagcgaaggctggtaaggcagagatcagagaaagtcaccaccaagtgagaagaatcaccacgagacaaaactcccaaatggggtgttatcactaggtataaaatgttaaagttccaattatcccaataaaaagaaaggtacactaggctagataagttattatatgaactttagaattgttataaaacacccaaccttcaaatgaacactaatccactttctaagcactattaacatttatctctataatctgagaaaattactaggcaaagagaaggaccagatgttactcaattacatactatctgattatattttgacacctctacttttaaggctaaaaggataagtgaataaagaccatggaggttaaatggtcagcattttccatagaaacgtaacatttctatagaaacacacaactctggagttgctactaaggaatttaacaaaactgtatgtgtttacaaaatgcagagatcatgctcccagggtaacattttgaatcatgttagataaatgtttaactctgcccaacagctatatcaaatgtttgtattacttgagcaatctttaacttacatcatagcatccaagttttattttactttaagacatataattgtagggttctgatggaacgatttgaattagtggcttgtgcggaggccaaatgcacttggattgaccaaatgacaggatttacagttaagtactcttttgatatgtcttggcagcatagcttaaaccatagatgctttaaactttaccattttaaacttttcaaaatgtatccatcccaaatcagaaacaaaacaaaaacataaaaatctacatctctgagaaatcatgccttgaaaaacacaaataaaatccttccaaatgcttataggtaaacatgacaatacatttaaccaacttgctgaaagtaagtatttatattgaattcctttactaagtctctgtttttagctagcaataagaatttttttgtttttgtgttttttttgagatggagtctcgctctgtcacccaggctggagtgaagtggcgcatcttggctcactgcaacctctgcctcctgggttcaagcaattctcctgcctcagcctccgagtagctgggattacaggtgcccgccaccacatctggctaatttttgtatttttagtaagatgaggtttcactacgttggccaggctggtctccaactcctgatttcaggtgatctgccacctcggcctcccaaagtaatgggattacaggcgtgagtcactgcgcccagcctgcataaatttttattagaaaatagaaatcctttaggtcaaaatcaaagttaacgcctactcaaaaataattataaagagtacagatcttggccttcaaggtggtacgaaggaatttttatacatgtataagatggagggattaagatggagtggttaagggcattcattctgggctcaaatcctgctttcctactgcttagctgtgtgaccttagacaagttactttaacctctctcattcagtttccttaccagtggaatggggataattatacttatcttacagggctcttgtgagatcaaatgagatgatacaagtgaacagttgcctggaacacagtaagcactgagtaaatgttgctcttctttttagtagtatttttaatatagatagagttgcttatgcttctacattttaaggggagagaaaaacttggcatcggaaaagcttgtttcaattgaaaatttagttagatcccaaattatacattgactatatcattcaattaagtaagaggaatgattatgaaagaattttcctaaaatgaattaggaaaagaggaagaattaaaactgcttggaagaggaggaataaaagtaacatataatgcacatattataacacaagacttacagaaaagactgaggctatcagactgtaataataatgttaagtgttatcttcatacagtgtctcatatctaaggatcagtctgtatcactttacaaatgcagacaattacctccactgaatatatgagaattctgtgcaaaagaaagccttctaaatgccagagaaagaactcgaaatttaaaaatgcaatatttcggctttaaattctatatagagaaaaatgagatgtcaaaaacaaaattaagaaaccagaagttaagctgaaaagggaggaaaagtacactaaaatcatttaagaattaaaagtaattttaaaaaataacgaaaagacacacacacaaatcttttatcttactttcaacactgccaaaaaaaaaggccaactttgtcccatgtctggaagaacgcttacagtctagtctgaggacctgatggacacagggggcagatgtcaagcactcaggtggaaggaagaacaggaagtgctaccgagctactcctgcctcctcttcccacctctttctcctgccactctctacttctcagtgaaccagccttgctaaccacctctgcctggtcctggaacacatctctctatactccttcatcctggagttccctttgcccgaaatgatcttctctgagctttttgtgacttgactgagtctcttatccttcatgaaccagcttacgtgtcacctcctcagattcactactgaggattcatgaatttgattcagctttcactgttactttctattttggcatttaactttttgattttccttagtctttgtagatgtaattcatttatctgtctattatcatcatctgtcttcctcagggtggatctgttcaacagaacactgttaacaagaaaaaactgaatccaaaaaaggacctaagtcagtgttaaactatgacttcaaataaatactgtttgaaggcacatttcaatatgtacctcccttttaaagtgacacgtgtatatttgcaaatatagcatggggtggcatgcaaagtactatatataatttattatacaatgtctataactttagacatgtcggggaagatacacaaacttctctaactgtcgctttgtaggttatcaccaatattcaacagggttgctgtctagaaaatggattctcataaactaggagctactttaaataatgtgacctctgagtatttaaaaaggtgagaacatttgctggaataacaattggcttttggctgtggaaaaacatacattaaacgcctctttcccttaggacaatgatactgttgagggagaacagtcaatggggccaccactcccatggttgttcgaggagtgcatggccagcactgaaacactcatccatggttgaagccctgagccagtcacttggcacctgcaatacctctctatctttctcaaaaatgacagaacatttgtttctttggggggtgtttgcagaaacaaccatgggagagtgggagtcatttagttactgtggacttttctctttttttgagacagggtcttgctctctcacccaggttgagtacagtggcacaaccattgctcactgcaagctcgaactcctgggctcaagcggtcctcctcctcaaccttcatagtagctgggactactggtgcatgccaccatgcctggctaatttttcttttttaatttttagtagagatggggagtctcactatgttgctcaggccagtctcaacttctgggcaccagggatccttttgccttggcctcccaaagtgctgggattacaggttgagccaccacacctggcctttttaaatttcttaatctattctggtacaaataagtgggcctctgaggaaaggcaggtctaacacaaaagcagaacttgattttaaattttttaaataacacttttggggtaaaaaaatgttgtctcccaatatgatctcacatttcagaaacaaaggaacacagaggcagacaaataagactgaataggctactgaatcgcagcccaggacttgtcatgggaactgagctccatcctagacagccatggcgcagcttgctgactggagggaagcgatgccatggccagtgctgtttattccctcgtcactcatgacctgggataaccctggggactggtggctttgaagggggccctgaaagaagctgaagcaagtcaaacctgagtgattacatcctgggaaaagtagagcctcagaaagctagtgaaagaatagtgataaagctatatttcagatcctgagagctaagcattccagtctctcttcttcaaacagaagataaaatgctatttggaagctcttttgaaaaatatgtctttaacattcactttatggccctctggaaaggaagaacttgagtctcctaaggcggcagagtcagcactgtttttgaggcagtgagaggcttgtcatcagtaggtcataaggcaaggagaagtgggcaatggagacagaaaaggggtactaagccgagggaggacggccagcaaggggcactggagaaaccagtttgcggttaataagcgcacagaggtaactcctcaaactctgcggcagaagctcacacagaagcactaactttttagatcagtttttttttctttcttctgaaaattatatacatgtattttctctactgaaccgaattgcaaggtatcctatttaaattagaaaaaaaatgccttcaaaaaataataatgaatgatggcttattaaacagtgatagtaagatacaaattagtctgaaaggctgatgagccatacaaacaataatattaatgtcactacttacaatgattgcaattaacactcactgtgtgtatgtgtcaggtactatactatctgtgttacatatattatctcatttaatcctcacaccaccctctatggtgttatcatctccattttaaagttgaaggaagagaggtgcaagaaggtaggtaacttgtctgaggtcagtcagctagtaagcaataagacaagaatttatacccaagcatgtgactccagagtgtacccacctttcaacctgttacagtctttacaactacaggagggcaataggatactttatacatgttgtccagtctttggtgttccaagtcctataggatcttacaattactttgtatagtaggaaggaccattaaatttctaggaggaaggcgatctacgagatcccgtactcattcgagggtacagagtgagtcagagaaccccgatgttcggcttctcatcttgtgccttttattttaaccatgtcctgctacagagatctactttatgtaaaccttagattatttggactgccaaaacataccttctattaggcatctcttgtttttgtagtaagcttttaagatgtctctctttgctttgttgttttctttatccacgtagatcactatacaaaagaaaaaaaaatgccaaaaaggaagtcactcaggaataggctacattagtaccatttgtatttttaaaaatacctgtttttaaagacacaagtcatgccacctcacttgcatgccgggaaaagaaaacagctccagaaaccagaatcaaatctgagtagtcatgtgatctaatgcatgtcactggcaggtttatgtgcacactgtcagaaaagatacaagcaacatctaagaggccacatcaccgtcactgcctgttaatggcactggcagtcatgacagtaaaagtcaacgtctttattgctttgtatttgagggatttactgcattttctttcacccaagaagcaagtgtaatgataatgtatggcagactgcttgtccttcctgacagcctcagtaatttaatcctttcttctgccacaacatgcaataaaagaggcatctagtgtattgggttgaggaaatccgcggctgacgcctgctggggaggggtatgggagagaaacgtgcagggagagaaaggcttttagggtgtgaggtttttggttttaaaggcacatgctggcatcgaggaatgtggccagactcactgggctgaagcatgagattagataactgacctcaagtctcaacagaaagaagacgggaacacttgacattgtaagtaagcatctgcactttgggaaaatggcatttcaatgtgcgacagtacaattttcatcctgattatttgttctcagttcggcagactttcagccatgcatagcttctgaagacatttctttttcataggccattttggatgtaaaggctcccctgtgacagatctcaacttagagattattcctggccaaaagcatgcaatgggtgaaagatatcacgtagttctaaagccagttctccttaggctctgccaggaacaaacatcttttatgttgaaatgtttccctgaacaattttagttcaattccaaattatgatgctatcaactcatttgtttgctcagttgagcaaatattaactgagggccaaaggcactgagtaggcacaaggcgggaggacataaaggtggcgggagagacataaaggtaccggtataggggtgggttagtggtttcgagaagaatcatccaagacataataaccaagttaataatcaactctggatagccaaagtaaacaccagctcctagcttactgctctttgcatgaaaccatattagtaaatgtggctagtatataggttactgaagtttatagaaatcaatacagattcaaaggttcagagtatttttttaatttatcaatgccaaaaagtcatgctaacagatcactggaagatagacttcgtttttagaggctgccagtacacaacgctaaaggggaactttttttccaaatgggatttttttttttttttttgctgttaattaccaattcaagatgtggcacaccatattgtttttgacttcgagttgtaaagcttttatgtcgtactggcttccatagtttgaagacaagggtaatctcatggttaaaaaaaaaagactgaatttcaaatgccagcatccaaataaagggtcttccaataaacctagaccagatttgataaatttcaatagcttaaatcatttttttattgtggtaaatacacataacataaaatttaccatcctaaattaacaattaatatttaagtattcagtttgtggcattaaatatctacatattgtggtacaatgatcaccactatccatttccagaactcttcatcttcccaaactgaaactccatactcattaatcaataactttccattcttccctttctcagcccctggtaaccaccattccattttttgtctgtatgaatctgactccccgaatatgtcatataagtggaatcatacagtatttgtccttttgtgtccagtttatttcatttgcattggtgttctcaagattcatacatcttgtagcatatgtcaaatttcattccttcttaggctgtataatatttcatcatatgtatataccacattttgtttatccacttatcctgtatagacatttggattgtttccacctttgactattatggataatgctgctctaaacatggcatacaaatatctgagttcttgatttcaattctttttggtatatacccagaagtgaaatgctagaccatacgggtcattctaaatttaccttttttttttttcttagagatggggggcttgctctgttacccaggctggagtgcagtggtgtgatcatagctcactgcagcctcgaatcctgggctcaactgatcctcccaccttagcccttagcctccccctggtagctgggactcaggtgagcaccactatgtccacctaatttttagtttttgtagagatggagtctcactagttgcccaggctgatcttgaactcctggcctcaagtgatcctactgtcttggcttcccaagtgctggaattacaggagtaagccaccatgactggcccaatcttttctttttctttttaaacatccttaccattgaaattggttttaaaaagtggtgtcgttggggattccctgtgctctgctttatcgagttggccaacatgctatatttcctattctcttaataaagacaaaaagattgccactatttactgggtactatttatgtgctaggtactacactaaatacttttacgtcatcatgcaggttaagtacctgacccacattttacagatgattaaatagatccagagaggttaggagtttgcccaagaccacctacttagaatgtggcagagccagaatttgaatcagcaatgttagcctcaagagtctgctctcttaacctccatgttacataacctctcctcctccatatgaagccaaagttttcctgtttaagctgtagttattttgttaacacaagaccaaaggtaagagaatgttccataacaatatcaagggaagtcacctcattttcttttgtttctaaaggaataattgcttagatatacctagtctaggtgtgtcaaatcatatttcttggcaaaaactttcaaaatactctttttgaaaatactccagctacttaccaataagcttagttcccaaaagtgtaccaagttggaactatggctctcctgcttccacaaacaaggcctagattggcatctttatctagcccagtggttctcagtctttattgtgtatcacaaccccttaaaagcttgttaaaatgcagattattgagttgtattcccagagtttctggttcagtagctctggttagggcctgagaatttgtaattctaacatgtttccagttgatattgctgctggtggtggggttctacacattgagaaacattgtttggcccaacattcatttgccaaatttttaaagggatcaggagctagtgaacacttttgggttgaataccgtgggaaacaggaacactttgctgcctctgattatgtcatgatatcctatgactaaccatggttcatttagtattctaaaccctagatggttaaaaaaactcacaatttcaaaacttgaaatacatcctataaaaagtgctctagtgattattaaaagtatcagaactctccaaaagttaaggtatttacctttcatttcctcagaaatcacatttgtttaggacttgtatgattttgacataaacttactgaaagctatgtctcaaaaaggatacaaactggtagtccaaatactttagttgatcttcagtcatcaccattaaaaacatatcctttacttctgcaagctggataaatccttatattctgttatcatgtcatatggcagaagaaatgcagatggcttaattataaggagtcgataaccctgaattcagataatgtttgtattaaagagtaatcatctgtatcatccttatctttgccaaattttcctcctattagtcacaaaatctgatgtttcacatcatcttcatcttttgaattaaactcaattgttccaaaagacagactgttccatccctagaggctaagggtccagacatgtatagtctcataaaaactttggatgatttcattaatctttttccttccactgtcaattccacttaggctttattcagcccagacaacattcttcagacctaccattaatcttattttttcccaactattttcttgctttctcagcattctctgagcaaaattttcaggcccaataaaatacaatgttttgttcctgctaccactgtctggcaagtaaattcaattttagtttttcagtgtggtatttctaagaatatatatatatatatatatatattttttttttttttttttgagatgagtctcgctctgtcacccagtctggagtgcagtggcgcgatcttggctcgctgcaaccccgcctcctgggttcaagcgattctcctgcctcagcctcctgagtagctgggattacagcgcctgccaccatgcccatctaatttttgtatttttagtagagatggggtttcaccatgtggtcaggctggtctcaaactcatgatctgcccacctccgcctcccaaagtgctgggattcaggtgtgagccactatgccaggacgacttttgtatttttagtagaggtggggtttcacatgttggccaggctggtctcaaactcccaacctcaggatctgtccacctcagcctcccaagtgctgggattacaggtgtgagccaccacgcccagccaggagatatatatttttgtgatgtaggttatactggttttaacacctcttaataaagactgaattcaattatgaataattagggaatcactagtctgcatctctcattttatgtacctaatttgggcctgaacatacagtctcttttgtacagattcaagtcacaatgcagggtaaaatcattgctaggttcagctacctctctactgcatgctgttcaaacaggagacagcatgtactaattgtcctctaaattaccatttgaattaaaaagtcagtttggaaataaaattacttccattaatatttaatgagattggaagatgtaagtctacattatattgaccttctgtatcaggtaacgagtgaatggtaatcattacaataatatacaagagatagttacttattaaccaaagactcaaggagatcccctgcaatggagatgcaaatataataattttaaaataaacattttcattatgtcatacttaatgaaaaatgaagcattcaaccaggttaatattaattatttctcaaatttgctgatgactaggagctcattttttcagatataacagatataaaacaacattagtttgcttctaagccggagtacattcctttcccctcctcccagaaaaatatccttaaaattattttcaattaacttgaaaattctacacagtcaaatttcattagataggaagagaagctaaaaaaagtatataaacagttttactgaattcatttctaatagattactggttttcttgctgctatcaaatattgattcattaaaaacataactgttaacataccaattagacaataaaataccctgcagaaagggaaaaaacaaaccaaaatgcacaaccaggctgggcatggtggctcgcacctgtataccagcactttgggaggctgaggcaggtggatcacttgaggtcaggagtttgagaccacctcggcaacatggtgaaatctcgtctctaccaaaaatacaaaaattagctgggtgtggtgcgtgtccctgtaatcccagctacttggggggctgaggtgaaaggatcgcttaaacccggaagtggaggttgcagtaagccaagattgtgccactgcactccagcctgggcaatagcccagaccttgcatcacaaaaaaaaaaaaaaaaaaaaaaaaaagcacaactaacaaaacacccaaacagacctagaggtaaccatgtgagaatgcacaaaatttgggccacttgagcattatcacagtttgagctaaagaaagatttgtattgctcttcaagcaaatggaaacatctatccttgacatggccaagtttctcaatagacaattaatctctaaaaaacaatgttgttgcagtccaaccaaatattctactcctgacctttacaaagaataatacaaaagccaaagagttgtcatttttcttggggtatctttcttaaaattagttgaatgcaactattaataatatttgatatggttttcttttctggtactctgcaactgatgatttccaagaagcctgagaaaaacttttggaaatgttttctttataccaagtgcatgaaatgaaggaggaatcagattctttcctgtccacactacttatttcacatgtgatttcttaacacacctgttattgtagaattaagctgaagtagatcttagaaagcaccttacttttcaaataagaaaacaaggaatcatgaatttaaacatcttgccttagttcacataacagtaaaaattggggataaagggaggactgaccactaggccagatctctggatacttaagattactgtcttgaggaatgaacgtattttaaaaatgccagatgggggaaaaaaaaggtaactgtgagcatttgtaatcctgctgataaacagcatggttatacatgttgattaaaatgcaatttctaagattagtgaggaaaaaaaagtagtgatgaactagcatgagatggcccattttgctaaaaataacacaacactccattttatggtttgttttaatgtagagctctaggagaacatactaagctgttttagcttagggcatggtagcctgatattattttttattcctctccaattatatactaacaatcacacaataagttgattgatctcagaatttatagggtgtctattgggtctgtgctggtccagtaaactacatgtcaactggctgctagatcaagccctaagacagaaaacctgcctgctgctatgatggatgtgtgtgctatatgatgaaaggtgtagtaagaacttatgcttcactcaattaaatcttgaacatctagacactgagagagatatatacacgtattgtaaaaacatccatgtgagacattgatcagaaaggtagacaataaatagaacattgaaagcttcgaatcatatgattaaaaatgacttctttgaaagatatttctttgaaatatcatatatttaaattaaattcctattatagacctagctgacatttttctgttgaactatgacatagcaggaccatcttagaatattttttcacattgttttgttttctcttaactgtggtattacttcaactttctcttctttttgagacagggtctcactttgccactcaagcaagagtgcggtggcaagatcagagctactgcaggctcaccctcccaggctcaagcaatcctcctgcctcagcctcctgagtagctggactacaggagcgcaacaccatgcccggctaatttttgtatttttttttgtagagacgggttttgccgtgtagcccaggctggtctggaactccagagctcaagcgatccacccgtccggtctcccaaagtgctaggattacaggtgtgagccactgtgcctggcccaactttatttcttaatctttatgctactggtttgacttttattaatcaattctgacaagacttccatgatttatgtgaatattagagaaataaactttctctctgttctttccacttctttcataaaaaaaaagacaaacataaaagtctatattacaaatgaatcatacataccattgctatagtatagtagacccactgcccactcttgggttttggaagtgacacgggtgtctcttcagcagaagactgtagaatcgacactcaacaaacagccgttggatagtgtcatccatggttacttagaatcattaaggcttagagctatgatctcaatccgaattttttctgatggctgtttaagagcaaaaacaaaaaacaacaaagaaataaaataattgaacaaaaagatccactattacttccactatcaattttaaataaaacacgaaggccaatgggcttcttttcttgaatgcaagtacactactgtatgttacacatgatagattattcatgacagagacacagaatgagatgtaatgccccagggtttgaagttaacagtgtcatggcaatagtctcctgatttacatttgggctataaataccccactagtagtctatcaggagtgaagattatgagatcttcatctccattgctttcagaatgacaagttggccttgtttcaaactatgtaatgaagtacatgtttacactgcctttacttaatctacagtacctgagaaagtttcagttattcggagatcaaagctgttgaacactttataggtattatgctaatatatgtagctatatgaatcaatattaactgagcagaaactacagttcattctcttatattctgtcataatatactttgttgaataaatatacattttcaagcaaaagaaacaattttatgtctaatttgaacattttctcataattttctttaattttatttttacaaaattaacaactaaaatggtgtttgtttaattttcacctaatccttgcttaatagattttggtgtcatagacattatcacaggaattacaaatgtttcttgagtaatgatttcaaataattaatagactaggattagaaattatatcacaccaaggtactcctcagttaaatctgttttttacaatttaaagtttgtcctttagtatcaaaatcctttttactaaattcagagacatgctataaattatataacttcaaataataattagaaaaactgaaaataagacctgtttatatgaccagcttttaggaattcattgttaaatttaaatcgtgtgtaaattcaccatagtggttacttagatatttcaaagcatataatataattaatcaattgaaaagcataagtatcctattgtaaaaatattcccataaagaacaatttccattgtgtcaaaccctctcaatatttgatgaagtaattttacccccttctttcaaaagacatttcttttattatgtattctaagacactttaactaaaaacccaaatctgaatatttcaataagttattttattattcagtagattcatggaaattttactaggatgacagagaaaattccaaccattctgtctccactaatacaggtacaaggctgcagctggcaatattactaggattacatagtatgatgaaatatttaaaggaaaattttttctaaaacctaataaatcaaatgacgccaaatgtcattaaagtgatggtctttgacttgaatatgcttttcatattcaaatttgaaagaaagagatgaaagcctggaaaggttactcggtttcaactaataacctcaagcccttccgttcacgtgcataaaaaatgaagttggctctattgtctaatctcacttcagaaaacccttctctgctcgctgaagactacatggtaaagaaaatattttaaatgatattttttttcttaaaatgtatcgtggtagtgaaaatactgtaatacatatattttataattctgctccactgtagcataatgtatagttaagtcttctacataagttggaatttgacaaacttagaatatagcaataacatcttatacaacatttatgtttctgcacaaaagaattaaaggaaaatgctataaaaagaaaaaagtgctatacatacttatttctactctgtgaaaagaggaatttaaattgtttatcacagaacctaatgaagaagtaaatgaacttgtaaatagcaggggaataaatttatctaagtggttattttattaataatatattagctctacaatccccatatgaaacttgcattattgtaagaaccaatttagactgtcaaatatgactacatgcaactctttaagtttaaaatacaatcctagataaaactattcacttggatcctagccaaaacacagaaaaaaataacaaaaccccaaacaccaaaacaacaaaaaagaaaactcactgtattatcaaaaaataaaataactttaaaattctttttatgatgtctatcttatttctggtcaatttttttttttttttttggatctctacactactgccattacttcgatcaaatgtcctttttaatttctgaccaatacacctggcagaaatgatcagttattgtttcttcattcatttaatgctaatgaatcaacttgaaataaatcctaaaaggggtacattttaagcagcttttatctaagaagtaagctctaaataaagaattttccaaacataaattttgacaaatgatgctagacaattatttttcaatgctggaacaattctggttgtgttcaagcccctctgattaaaaagttcactaggccgggcgcagtggctcacgcctgtaatcccagcactttgggaggctgaggtgggggatcacgaggtcaggagatcgagaccatcctggctaaatatggtgaaaccccgtctctctaaaaatacaaaaaatcaatcgggtgtggtggcgggcacctgtagtcccagctactcggaggctgaggcaggggaatggcgtgaacccggggggcggagcttgcagtgagccgagatgcgttactgcactccagcctggcagacagagcaagactccgtctcaaaaaaaaaaaaaaaaaaaaaaaaagttcaactagattttgtataaagatctgaagattggcccggcgcagtgctcatgcctgtaatcccagcactttgggaggcagaggtgggcggatcatgaggtcgggatttgagaccagcatggccaacatagtgaaaccccgtctctgctaaaattacaaaaaattcctgggtgtggtggcaggcacctgtaatcccatctacttgggaggctgaggcaggaaaacgctggaacccgggaggcggaagttgcagtgagctgagatcgcgctactgcaccccagccgggagacaatgcgagactctgtctcaaaaaaaaaaaaaaaatcttaagattaagaagccattaaatgcataatagacaacttcatctcagcatgtcagaaatgaactcattccctctctctcccccaatcctattcatactgtgttatttcctatctcagccgatgacatcaccatcacctagtcccctacaaccagaagacatagcagcatccttgcctttccatttttttcaccccactatatcctaaaggtcacccattcctgctcattttacttcctaaatatcgccacattggccaggtgcagtggctcatgcttgtaaattccagcactttgggaggctgaggagggcagattgcttaagcccaggagcccaagagcccaggagttggagaccagcctgagcaacaggtgaaaacacgtctctccaaaaaataaaacaaaacaaaaaccacacacacacacacaccacacacacacacacacacacacaaatagccaggccttggagtggcatgtgcctgtggtccagctacctgggaggctgaggttggaggattgcttgagcctgagaggttggggctgtaggagccatgatcttgccactgcactctatgcactgtagcctgggtgacagggtgagacctgtctcaaaacaaagaaacaaacaaaaaaaccactcaatgattcactgaattgttgaaacatatatttcagacattgttttaactgttggggagataaagaaaaataagatgttgtttttttccattttttatctctagagaaaatactaagttctcatgggggtaactaatacaatgcttcctagttatcagaaggtagcaatttgacagaacaaggagggagaaaatagaaggactgacgtaagagatttgagagcgaactggtagccgattgatgagcgttatgagactgtagctcagtgacagtagggactattagattgctcattgcgttatgtagtacacaataaatggtggatctactctcatgacagagagaggtgaggcactcatctctaatctcttgtctgcatcccaaccattctccttattgtagcagaattctcttcctaaaaaccaatcaaatatcattttccgcctgaaaatattcctattgccttacactctagccactcctttaaactcatggttgctgttttatattgctcagtttttgcatctgttatttattgtgtgaaatcttttccatagaattccactcctgtgaggccctgaaccacacatcctctcctttatgacagcaatactatctctaagagcaagttggttgtttcctcctctgggcctttactgcacttctccatcacttgtactacatggaactgttcacatatttgcctctgtctatagactctgggcttcaggaggcaggaccaatatcttactcattttttgctacttcacatcctccccaacatagactgtaataaatatttaatgaaatagtggagactgtgtatcttttatatattcagaatatcttttttatttttcttcaggttcttgctttgttgtccaggctgaagtgcagtggcaagatgacactcactgcagcctcaatctcccaggctcgagtgatcctcccatctcagccccctgagtgctgggactagaggagcatgccaacatacccagatattttttaaattttttgtagagacgggtttcactatgttgcccggactggtctcaaactcctggcctcaagcaatcctcccactcgacctctcaaagtgccaggatcacaggtgtgaaccacagtgcccagcctagaatatctttatttattgccagaactatgtgaagctgcaggtattattgccttctcatttaaaaaaatttattatggctgggcgcactggctcatgcctgtaatcccagcactttgggaggcagagcaggcagatcatgaggtcaggagatcgagaccatcctggctaacacggtgaaaccctgttctattaaaaatacaaaaaaattagccgggcgtggtggcacgcgcctggtactcgggagctgaggcagaagaatcacttgaacccggcaggtggaggttgcagtgagctgagattgcccactgcactccagtctaggtgacagagcgagactccacctaaaaaaaaaaaaggaaatatgtgctactaagttttggggagtggttattattaactgccgagaaatatatagaactctgctgttatagattttaatgaaataagactatctcaagacaggtgaatattgttgaatcaggtggtagggtactattatttctacttttctgcatgtttgaaatttttcatcataagaaatgggagtccctccccctccccctccccctccccctcgtctcagtctcctgctttccaggtctccctctgttgcccaggctggactgtactgccgcgatctcggctcgctgcaacctcctgcctgattctcctgcctcagcctgccgagtgcctgggattgcaggcgtgcgccacccgcctgactggtttttgtatttttggtggagacagggtttggccgtgttggccaggctgtatccagctcctgacctcgagtgatctgcccaccttggcctccccaggtgccgggattgagacggagtctcgctcactcagtgctcaatgttgcccaggctggagtgcagtggcgtgacttggctcgctacaacctccacctcccagccgcctgccttggcctcccaaagtgccgagctgcagcctctgcccggccgccaccccgtctaggaagtgaggagcgtctctgcctggcccccattgtctgggaagtgaggagcccctctgcccggcagcccagtctgggaagtgaggacgtctctgccagccgcccatcgtctgggatgtggggagcgcctccgcggctgccccatcgggtggtggggagcgcctccgcccggccgccaccccgtctgggaactggggggggcgcccagcctggcggccgccccgtctggggggtggggtggggggtgcctccacccggcagccgcccatctgggggctggggggggcgcgcctccgcccagcggccgccccgtctagggggtgggggggggcgcctccgcccggcagccaccccgtcttgggggtgggggggcccctctgccagccgccatgtctgggaagtgaggagcccctctgcccagccgccaccccgtctgggacggtacccaacggctcattgagaacgggccatgatgaggatggcggttttgtcgaatagaaagggggaaatgtggggaaaagaaagagagatcagattgttactgtgtctgtgcagaaagagaagacataggagactccattttgttctgtactaagaaaaattcttctgccttgggatctgttaatctataacctcacccccaaccccgtgctctctgaaacatgtgctgtgtcaaccagggttaaatggattaagggcggtgcaagatgtgctttgttaaacagatgcttgaaggagcatgctcgttaagagtcatcaccactccctaatctcaagtacccagggacacaaacatgcggaaggctgcagggtcctctgcctaggaaaaccagagacctttgttcacgggtttactgctgaccttctctccactattgtcctatgaccctgtcaaatccccctctccgagaaaaaccaagaatgatcaataaatactaaaaaaaaaaaaaaaaaaaaaaagaaaatgggaaaagtctcaatcaggtgaattggaagatgtcctaaataatatactgattcaaatgacagtattgaagcaaaggcttttaaagagatgaataataattgttcagaattactagagcaacataccggtcattcctctgcaggctaccagcatcctttgatacaggaaattggccagacagccaggctttagacttttcctgttttgtttcccctctacgtgtatgaatttttgttaccagtaagatgcttcttctcagttctttttttcttgttcaccaattaccctattagcatcctcgtatcaccatgtaaaaagaacatttataaattttgattgtgggctggccgtggggactccgcctgtaatcccagcactttgggaggccgaggcaagtggatcacttgagaccatgactcaagaccagcctggccaacatggtgaaaccccttctctactaaagatacaaaaattagcaggtgtggtggtgtgtgactgtaatcccggctactcgggaggctgaggcaggagaatcgttgaacatgggaggcagaggtttcagtgaggtgagactgcactactacactccaccctggtgacagagtgagaccctgtctctcaaaaaaaaaaaaaaaaaaaattttttttgtggtgacagaagtcattcaaatcagaactccatgcaacttatttttagttgtctgtatagatggcactatgtgttatgtgattaaatgatctagaaatgtgatgacagcttgtattgctctaaaaaataaattatagctctcgtgattttggctcaattccactattgcttcctgactgatgtaattcatactttggatcatatttttctatgtgatctaaagtgtttacttaggcttattttggcatgcttaaaattttcacatcctacttcacaggattgtgctgaattcttcctctgtttcagccactacacgcagccatactggagttgaattgttgggcttctgaaaactaattaacctgacaacccttaaaaatagtactgcataattgagaatggcctatgataaaggtctgcaacttgtttcagtcagttacatttaaatctaattatggtgagattacaggtgagcttattttattccaagtttctaaaatgaataggcatttctttaattttttattataaaacattcaaacatgataaagtacagaaaataatttggcatattcaattcaactagtcagccatccaaacagatgttaccatttttctataaccaacttaagtctttttattgttgtttttgaaaaataaaatatttcagatacaggtaaaactaccagctgccaaatcctttcccctcccttctcattcccccatggttaccactatcttgaagttggttgtatcattcccaaacatgccttatattttctactgcatgtgtgtatatctataaacaacatacagtattattttctgtttttggttttatatttgtggtatcatattcttattaatcattctgcaatttctgttttttttactcaatactatatttttgagatttatcacatttatttttcaaatccaatttattcatttaactgttgtacagaatcctatttatattgcatatataatctatagtacatttatttactgctgatgaacaattatgttgtttaccattttttgctattacaatgctgcattaaataccttttatgttacattgtttacaattttttgctattgcaaacaatgttgcattaaatatcttttatgttttcttgtatacatgcatgattcccttaggagcagaactgctgggtaatagtaagagaatttcaaccataaagtattatcaaattaatctccagataattataaattggattatttataaaaatactgtgtgtgtgtgtgtgtgtgtgtgtgtacatagatacaaataagcctacctgtaggagccacagtatgtagaacttgttactttgtaacaaaacaacagagcaaaatggaaatagaaggccaagatctatgtcaatgcttttgaagagtacaaattttaatggggtgagctctaagacaagctcaaaacagttggttaaaacaatcagactcaaccactgtattgacagagccatatgtaagtagggtaggaatgcatattaattaatggtgattcttcaagttcccttcttcaggctgggcatgggcagagacatcctctcaaagactcaaaaaaaccccttcagtccttcacatcaggctccaaagcttcctcttacattgtgcatcaaatccatcctcatacaagttctgattaaagcattttgattgtttaataactgtttaactgtttatttaacaactgttgattatttaaaataataataataagtacatacaaaggtgatgtctccgaatctcaagctgtcaaggtaataaggtttttaacaaacaaaagaaaaccacccagtttcgtccgtggcagtaatctatcttttctaacatgttctgttaaaatgtactatattaaacaataaggtaaacgttgcaaacttcagtgatggggatcaaaacagtgctagctttaacagacttatttttagaacattgtcacggtgtccttatatgccctataaattactatgtccttcagtgatttggattatttttttcctgccctaatatcaaattaatctccaaataattatgcaaataattataaattggtattatttcatcaccatagaaatggtgtgtgtgtgtgtataatgtgtataaatagatacaaacctgagggatatgacacattgcagcaatgtgaagcaagagaattttaaaaatcaccctcaatttcaggtgattttgatatgctactctcctttcacctcactgagaacagatgttgcagtgcagtggttcttgattttggctgcacattagaatcacaggggagctataaacaaaattctgacttaatttatctaggtggagcctgggccctggctttaacaatgctccccagacgattctcatgtgcagccaagggtgaaaagtaccactttttctaaagctatggttcttgcattttagcataccccagaatcacttgataaaacacggatggtggactccatagaacttctaattcattaggtctctggtggggccaaggatttgcatccttacaaattctcaggtgatgcagatgctgatgctgaactctggggatcacactttgagaatattgctctaaaccaaaaaagattcatcttccatccatggagacttctaacatcttttagaaaagctttcacaatattcatgttaaacagttcttttgctattattcaacattttatacagaattagctaactacttccttttttgagtcaatcgatgctcaccattaaaaataaccaacaatataaattaccaaatgtcaaatatgaaagttccttgtttcattctaccacctactcatgagttggcaatttttttttctgtaaaaggatgaatacaaatgtttttggcattcagctatatggtattcaactgtgcccttgtggagtgaaagcagcaatagataatatgtaacgaacgggtggctgggttccaataacagtagagggctggatttggcacaggggccatttttgctgactcctgccctagagatattcactgctaacgctgtcagatgtacattttcccaacattttctttgcttacataaacctaaatgtcatgtctgtatgtgcaaataaaaatattatatagacctttttgtatttcttttgtgtgtgtgtgtgttgcagcgacaggttctccttgtcacacaggctggagtgcagtggtatgatcccagctctgcagccctgaactcctgggtcaagcgatcctccaacctcagccttcagagtagctaggactacaagcatgtgtcaccagcttggccaatgtaaaaaaattgtttttgtagagatgggggtcttgttacattgcccagctggtcctgaactgctatcctcaaacaatcctcttgccttggacttcctcaagtgttagattacagctgtcagccaccacatctggccccatttgtttctttttaaatgaaatcatcataaggcaaaatttattcattagtttggcaaagagtgtaataggagaaaacatgaattttaaacattgttatatataataatgttcatcttaagcagatatatttgtattagcaaaaaacatagaaacacttaagggtccatcaaaaggggcttatttaaataaatatagtatagccaataatggaatattataggtatgttgaaagaaatagagtatactgttatggaaaaatgttatggtatattagtaagagttagttaaattgcaaagcataaaaaatagttttaaaagcaattctactaggagagtatgtcaacatttccagtttgacataaaatatattttatttttattatttatttttgtgacagagtcttgctctgttgcccaggctggagtgcagtggtgcaattcgactcactgcaacctctgcctcccaggctcaaggactgtcttgcctcccctcccgagagctggaattacaggtgcccgccaacacgcccggctaatttttgtatttttagtagagaagggtttcaccatgttggttgggctggtctagaactcctgacctcaggtaatctgcccactcagcctcccaaagtgctgggattacaggtgtgagccaccgcacccggccaagtaaaaatattttaaaacctactctctatctagcttaagcttccacatgtaaaacattgagagtgcttattttatccactgataagatatcatatttgattcctaagtgatttaataatttttctatgcgaattctaaagcgagtgaattgatttctgcattgtgcctttcaaagttttaaactactttgctgaacatcgttattgtaatcacctgggaatgccagctcattgttcagagaactagtttccaggtggaactgcaatttagtccaattgaatatggcagttttcacacaactctaggagtaggaacagagaaagagaatgatgtaaatatgcactgcacagaagagtccatgctctttcagcctgtaatttcccattctcacctgtgggcacattttaagacagctgtgattcatggcaatacattttgttgtgaaaaatgaaagctgcactattgaatgataaaattaaaataatgcaaaagatggattgttaattttttttaatgccatggcagatgcaaatgttcgttttgatgtctgttttgaggacctgaaacaaggcttttaatcaatgtattatacatcaatttatactgttaacttctgattattcaaattaatattcatagagaaatgtccaaagtttacatctctcagaattctgtccccccacactcgccattaattatcatgcctagaagcttttagtaaaagcagcagttgtcaggctgacggaatctgacaggccagcaaggcccaattaacttgcgctatgtggcactttgatgtccgggaaacgaagaaagataggggcaaattgggggcacattatgttaatgacttgatttaatccagccactaaactttatgtagcctgttaaaaagatgctaacactaattacgccactttggaaaggaaaggaggggacaagcatttcatctgacaaagtgaagctcataaatgttgtaaatgaaatgaaacaaaatgaagtaatctatattaattatacatcacagacatgaagaaaagagaaagaaccaagtaatacgtagaagtatgggaaatctgttagattccttttaaggatcaacatttctaagaaataactaggaactgcagattctgtaacatgaagaaaagaaactgatcttaaattgcttacacagtatatcagaaattcaaattcacagtgtaactggcataaatgatacttatctaggacactacttctagtctaattttgtgacattataaaatagaggcaattttttaaaaagtagggataactatagatagggttatctaattcctttctaactagtttgtgcctctaatctgttttttacattattacagcatgatctttcaaaatgtgatcaagcatgcaaactccttaagatcaggagcttaatttttgtattcgtggatctattcccagtccctagaacaaggctaggaacacagcaaatgccactacatatatatctgtttaatgaatgggtgatcttctatccccattccttaaaaattcagaggcctcaacgctctggattatgcctcccttttcagcctattctcctgggctcccaagcataccataataggcttggcccatcctgaaaccattctgaattccagaacaagccagcactacgttctctcagattctcatgcttttcattcctttggcctatgattttctcaccttttcatgaactcctaatcatcttcaacactggctccagctttactgactctaggaagtatccttgatgaagggaagacccctcatgctgacttagggaccccttctgaatgctcccaagcaccccatgcattccattctcctggtgcagaccactatgcattttaattgtgtttccctacagactatgaattctttgagggaaagaactgcttcttttatgcctgcctgacacacatggatgctaataaataaagaattgttgtgaggaaatattaacataggatgtacttagccataacaggcattcagtaatacattccttcctatgaaagctatgtttcactgttctgagtttttaccagaagcagttcttagagaagacaaaagaaaaaactaatgaaccacaagtattttaagcttacaaaaggatttatgaaacaacacttcaaccaaagttaacaccatcaatattaggcaaaatgacattttctacctcctgatatgatgcaatgaagagcacacagtatcgttctgtattcctaccaaaatgcataactggaatctgatcttgaggaaacaccagacaaaccaatgaagaatatgttacaatgtaaatggcctgtattaaagagtatcactgttataaacactacaagaaagcctgaagaagcattacagattaatgcaggctaaagaggcatgaaaagaaatgcaatgtgtgatctggattggatcttggaccatatgaataagatgctataaatgtattactaggacaactggcaaaattctaatgaaaaccgtagattagataacaatattattaattgttctgaagtgtttagaattaaaggggcatgatttctgcaacactcaaatggttataacaattatgtatgaaagaatgtatgtttataagtaaatacctaagtatgtgcactaatgcatatataggagagagactagaaatgataaaacaaatagagtaaagacttaaaatcatgaatccaggtaaggaatatacagaagttctttgtaccacttttgcaatctttaaagaaaaggttctattattcatattaaatgatttgctaaagtagtacacacaaaaactggtaaatcaatagaaaatcctgtatttcactgtcttagtccatttgtgctgctacaacaaagtacacagactgggtaatttatgaataatagaaatttatttctcagagttctggagactgggagtccaagatcaaggtgtcagcaggtttggtgtttagtgagggctgctctctgtttccagatggtgccttgttgctgcatcctcttcagaggaggaatgctgtgttcttacatggcagagagcaagataacttctcttcaatatcaagccctttcaaaagggtgctaatcccattcagagagctctgtcctcatgacttaatcaactcctgaaggccatatttcttaataatgttgattggggattaagtttcaacataaattttggaggggacaccttcattcaaattacatcatagccattatgatttcttgagttttgttcccaggctttcagatgataccattttactaatttggtatataatttaccaagattaaatttcacctgttaacaatatgctatggtatgaaatggtttgttcgtctccaccaaggtcatgttaaaatttaatccgcagtgtggcagtgtgggaggtggagtctattgggaggtgtttgggtcatgggagcaaatcccacacgaatagataatgccctcactctgttagttcccttgagagctgattgttataaagaacctggcaactccacctctctctctcctccttcctctcttgccatgtgatctacacatgctctagctcccctatccttatgccatgagtggaagcagcttgaggccctcaccaaatgcagatgccagtgcatgcttcttgtacagcctgcagaactgtgagccaaataaaccacttttctttgtaaattcccagcctcaggtatacctttatagtaacacaaaacaaactaaggaaacataggatgctgtcagtgactgctgctgaaaatagaattttttaaagcccatgggagctgaagcatgaagactgcttgctttaaatgatgttcacatttgagatagcatctgaaaccattataggaaataaattttggaatggtagtgaagaccgtatcaggctgtagcaaagtaagacaaattatttcccttaggtaatgagaaaaaaatccagtttattagaaagaaaaaatatatatgtacattgaattattggaatatttagagaaacagttatttattttgctaaacttctttgttaaattaagtttattctaccttagttaagagcaatgtacaacttcactgagatgctagccacgttccaacatacacatggttctattgcaggtctaagtaggagttttcatagattggatgctgtattgtaattaataaatatataataataatgataaaactttggacagataaaatgttcttttgtatttatcaagaacagaaacgatgggtatctctatttcatggaggaatctgtgacacaactgaaatgttctgttctattgttttgctttatttctttattttttgagagacagatctcactctgtcacccagactgcagtgcagtggtgcagtcatagctcactgcagccttgactcctgtgctcacatgatcctcctgccttggcttcccagagtgttgggatttcaggtggaagcactgtgcctggtctgtggttttgttttaaagagagattaaactaagaatgtgtgaggaagagttaaaagaaatattccaattcttatcaataaactaaaaattctacaaaagtcaattaatcacttaagaaaaattaacatagatgaatagaaaaagctagagctttttacttacttacatttactttataaaaactttttccctcttacaataaaaaatgctctggtaaaagtatacttcccatatatattttaaaaaatataattttcttctcaaaatttcaatttactactacttttcagccatgtgctctaagaaaagcaaagtataccggcacaagattaattgtttctaagaaggcttcacttgttttggcagaaatgaaataactgtaacatattatcagtgatatatctaggtaagagtagtctatgaattcacataggcaaactattatagtttcaaaagcatctcacattttgaattctttaaagttcaaatcttcttcaacacatcttggtatgcagtcttgaaaaggagtcaagaagtcagctagtttcagcaagtagctattggaggtacagtttaaggtactctttgtgaaaataatacttacatgttatagtccattacataatgaaacatacataaaaatttcttgtagtagatgactacttggttaagattatgataaacattaaatttttccagaaatagttttccttaagatttttatatatgaagactacatatgtactgtgatgaaaggcagccttatttcagaacatttctagttggcatcaagttactgacctgtttgtattcttggagataggacctggaataatacagtcatcactgtcagaagctgacatgtcccttcaactgtttaaaaaataaaagggtaacatttacacaagttaaaccaattctacttaaccctgtaaaataaagagaaacaagcacacaccataagataaccttaagaaacatggtattatacctagatcttttttagtagcaaatttgtttacagacacattacattttagggaaaaaaagactaaaaatttcaaggttaattttggtagaagcaaaggaaatgccaataaaaaacagcttattgtgaaatttaagaaaaaaattttaaaaagagaaccatagggtaatagatttttttaacagtctgaccagtaatgttatgtaagtcaatgctattcttattattttaaattttaaaatttttattgctttgttgaaataaaactgacagacaataaactacacacaataaactgcaatatttgacacacacacacacacacacacacacacacacacacacacacacctctttaattacttttagagacagggtcttgctatgttacccaggctggggtacagtggtattcacaggcaccatcatagcacactgcagcctcgaagtcctgggctcaagtaatcttccttctcagcctcccaagtagctgggaccacagatgtgcaacactatgcctggctaaaatagatgttttgacgtaagtgtaactgtgaaaccaacaccacagttaagacagtgaacattccatcacctcaaaaaatctcctcaggtccctctgtaatctcttcccttctgcccctcccattcctattcttacagattgtttgcttttaccagattttaaaaaatacagtaagtggtatttttggctggatttcaatttttaaaaagtcaagacctctacgctaatgcaaataatatactgaactcaaagagaacacaaaactgtttaaaacataaattgggaacatggtcagcataacacttgtattctattgtggagctccaagttgaaataagaagagatacaacaattcccctaactacaactaagaagatggaactatattctatcatttctgtcaagaaacaggtatgtgaagtagacgctaccattaaatgaagatgttctatgatgcatactctaacagataaacaaagcacagggttaactaaacaatgttagtttaaataagaaagtcaccttctggttccagtcctctgttatttctgtttcatcttcagaagatgccaagctttgttctgcaagctgacttcagatagtaaagacacatcatcttttccttgctgcattttctcagtattctcttttcctcatctacactgccttcttgtgaaacctgaagaaatcaaagcacactggtatatttaaattgcttagatcacattttatagcattattgctggaacagttgaataataaagcatgtaatttgagacttaaatatacagatatgtaatatgtatgagactcagaaaacaaccacttaatttgtacaaatgataatatatagataaatggaaatctgaatatgtactaagaataaaaatgtattaatctcaaaatgaattttacattaagactttaattcaaatattcatatattcctgtcaatagcagtataattatggctgttacccttgtcatatttttgactttctattcaaggaagtcatatataaaaataggggaaatgctatgacttcctgagtcatgtcaaaactataagacaaagtatttaagaaccaaattaaaccttccaaaataattttaacacaaatgctaccttgggaacatgtggaacagtcagcatattaatttctatttctggtatatgctctactctggtgaaatttccttcctatcttcaggaggaggagaagtctccttatattaatgtgaaacacgcatgtatgtcattttttatttattactaaatcccaaatcattctatcatataatattgaactactaaaaattggcagcaaatgtaacagttactcatatgacactgaatttcttagtatatttcaataaaatggtatttatattctttaaaatataaatatatatgtaattaagaactgcaagtttagttcattgaagcactgtttacaatagcaaaaaaaaactgagacaatgcaaatgttcaacagggcattagttaaataaaatatgctatatccaaatacctgattctgtgtaactgtgaaaaaaaaatgatgtagacctgtgtttattaacattacagagaaacataacatagtgttgagtaaaaaagctacttatagaactatatatatagttgtattattttgattaaaatacaaacaagcaagcaaacacacatatgtgtgtatttccatgggaaaagtatgaaaggaaattcatccaaacagtatctctgagttttagatttgggaacattaactttattttcactgttttttttttcttctttgtattttctaatatttctatgatgattataactactcatgtgattttaaaaatgtcatatgctagcataggtatgtattccttaaaatcatgtcatctttttatttcatcaaatatgaatttatagttagctattattcctgggttaaaaacgaatgtttagttttaaaatacagcttatgacttttactatttttaaaagtaaacaggccaatataggaaatgtaaaagataaatataaaataaatcaatataaatctagtactcatggtaatacctattaaacttcttagatttctatttctttaaaactaatttttgatggaataaaaattttggttacacaataataactgcattataaatacaatatatcctgttgcattaaaaaatttaatatcataacataaatattttctcctgatatgaaacttagaaaaacatattttaaatgacaatagaatattatattcatgggtgtgccatggcttaatgaaccatttactattgttggacatttaactagttcacagtttttaggtatcatgactaacattgcaacaacacctctatgtttatgtctttttaatgttagtggtcatttacttaggaatcaggctatgtgttcaaatcccagttctaatacttgggccatgaacaagttacttaacctctctaaaatcactttccctatctttaaacgggaataattctagtatcaactacatagggttgttgtaggattaaatgagtccaatgtatataaagcacataacaagcactccataaatactagtgtaaaacatctactgaattataattattgaattcattatttatcacatacatattaaatgtctgtatgtgccaggtattattttaagctctggagagacagaatattttgatgtgggtgtagttacacaggtgtatacatatttaaaaatccattgagctctatgcttaagattgatgcctttactatgtaagttatatgtgaattacaaagaagatatattttctaaaaagtccacacagagaatggtaaaaatctgaatacagtatatatttttaaagtacagctgacacctttgtggatgacctgggtgtaggggtgagaaaaaagaggagtcaagaggatgcctccaaaattcatgcctgtgcaatcaagtgaatgattatgtcatttacagagaatgggaaacagtgaagaggcaaaaattttggaagagggttggtataatcaggagtttggtttctgacatgttaatttaaattcccattaaacattcattgcacattaaataggtagtaagaaaatgaatatgaattcagcagtgaggtctagactaaagattataaatatgaaagtgtcagcgtatagatgctttttaaagccatgtgactgtataaggtctcttaatgtagatatggattgagaagacgttgaggattgactgcagaggcacgacgatatttaaacatatgatcaaggagcatgagaagataacagtaaagttggaggcaagctaggaaggcatggtgtcccagaggccaagagaagaaggcccatatttcactgtcaaatgctcctgggagatgaagacaggcactgagaattgacactgtatatggcagagagaaagtcgctgtgaccttagtaagagtagttttatgaggataaagcttgaatgaagtgagtccaagaaacaatgtgaagtgaaggagacagaatttagacattttttgaagacttaaaaaaaaaataggagcagaggattggggcagaagctagagagagtaagggcccaaaaaagggtttagataaaaaatttgaacagttaacacttatatatagtgcgaaacacaaagcaatcactttaatgggaaaagacatactttattcacctgtttccattaaatcaggtagggaataatatgcctatataatttatttcaaatatttgttatgaaaaaacagtattttcagtgtctactacttacatcactctgatgtggcatgatatccacgaaagaaccttcttatctacaggtgttaaacgttgtcttggtttaggtcttggtgcctaagacaaccaaccaatgtgtcagactgagtatgatgaccattagatttcagataagactttagctatattattatttttttttggtgggggtggcagcttagttcttaagctttatattcaaaatttatacttgtaaaaaaattaaaagtcactgatactcactaaaactagtgtgctaacagagatgctggaggaagtctttgaacaacttctggctcttcgctgcgaatgaaatttcctaatcttcagttgttattgatccacttggtggaaggtaagcaaatttccatttcaatataactggatggtgccagcaggatgcttttgatggtctgttaactcaaatattcctgtcaaattcaataattttaattaatgctagagtgaagttttattactgtaagaattaaagaacaaagactactccctactttaagagactcatgctctaccatgtgaactagccaggtggttgtacccctactttaaaaataattttggctttcactcagaattcagatggcttagagagtaaaaaaagacaaaatgatctatgacaggctcatctctcaagtagatctccttcagaagttaagcctcaaagataatactgattcaaagatgagacaattaatttataaataacttaattcacgaaattaaattcagacattattcagaattcttagccttccttcgtgaaggctcaagtatctccattttgacttgaaagtttttgtaagtcttttggcttgtctctaaagaaaaatatataatactttaaaatttcaaataatttacacatttaaaggaaactgtatgttaccatatattctattataattttaaatatattttgttgggatttgttaaatcactccaaattaatagagcacagaaaaagcccataaaataaatggaccatctacaacaaatagcagtaacaaaagaacttgaatctgttatattgagtctcaaattttaacagttgcactggatttttgggtataaaaaatctctgacttaaacaaaatctatatatctttttatttttttttttaaatagacggttctcactacgttgcccaggctggagtgcagtgattattcacagatgcgatcatagccactggccaccttgaactcctggcctcaagccatccgcctactcagcctccggagtagcgggactacaggcaccggctcaaacctaaatttcaagcattagcttttgcttaagagtatctttactttgctctcaagtgttgatactccttttaatggctggctggaaaaaaaaaaaactcccaaactctagactttgggtaggataaaaggacataagtagaacatgaggtgataacttttataggcatagcaagacttccagaatggctaagtaaaaagctcagcaaatcttcttaaaaaaatgataaaactggacaaaatggtcagaaacaaccatttaaggagtctggaaatgatcaaagatactggataaattgagaagcatttactcaagaaaatcaactgcacctcataagaacagtaggaatctgtgggactgctctcatcttaccctttctcccccactcccatttggagaatttctgccagtctaggataggctaagaggactggcagcctctgttgtaggggctgactatatgtggagcaaaatatagataatttcatgcccagaggcatcgttaaaaacacagcaacctcaatggcaaacaatcagagaaggtcaacatcacagacagcctgaggtctaatactggttggggcaagccaaaacaccagaaggccagccaacaatttaaaagggaaatcaaggaataagatatcagaagtgggcgttggctgggtgcggtggcttacccctgcaatccagcactttgggagctgaggcaggtggatcacttgaggtcaggagtttgagaccagcctgccaactggccaacatggtggtgaaaccttgtctctactaaaaatacaaaaattagccagtgtggtggcgggtgcctgtaatcccagctacttgggaggctgaggcaggagaattgctgaacgtgggaagaggaggttgctgtgagcccaggtggcaccactgcattccagcctggggacagagcaagactccatctaaaaaaaaaaaaaaaaaagaagtgggccttgacaagagctatttatagctcatgatgtggaaggctatgggcacacacacaaaactgtgtaaatgctcggagaaatcaaagaggaccctggtaagctatctgtccctgggtgaatgagaggtctagtaattcggaaagtaaaagctgaggcaggcttgtagactgaactttgatttgaatgcatccccatgccacacactgacccataggcaaaaggtggaaacctactggctcaaggtgtttaacacacctttgaacaatcactgactgaccactaagctatgctgacctatggttaaaagtgaacaaaaagaaaaaaagaaacaaaacttagctgaaacatcagtggctatacacagcagagaaatagattctacagaaatagtccaggcaagtcaccaagcaaaaatagcaacaataacacctaggaaatgacgttacaatatattatccaaaaatgtccagttttctacaaaatactatgagacatgcaaagaaataggaaaatgtactgcatacacagcaaaaaaacccatcaatgacagtttttaaggatgaccacatgttagacttggcaaagatctcaaagcagctattatcatatgttcaaagaactaaaagaaagtgtgtttaaataattaaaaggaaagtataatgaaatgttttatcaaatagggaatatagtaagagattataatgtttgggtgcggtagcatggcctgtagttttagctgctcaggaggctgaggcaggaggatcacttgagcctaggagttaagtccagcctgggcaacatagcgagacccctaattctggagttgaaaagtataattacgcaatgaaaaaattcaatagagggttcagtaggaaatctgaactggtagaagaaagaataatggacttgcaggttgattagaacagattattcaatctgaagaatgggaggaaaaatgacaaaaatgaatagagcctcagagacctgtggggaaaccatcaaacataccagcatatgtacatgtactggaagttcaagaaggagaagaaaaaaagaggagaaaaaaataactgaaaaataatggcagtaaactccccaaatgtggtgcataacattacactacacacaggaagctaataaattctaagtaggataaatgcaaaaggatccacatttagacacatcagtagaactttgaaagccaaaacaaatagaaaaacctggaaaacaacatcaagtatgagagaaccacataaaattaacaactgatttcttatctgaaacaatggatgccagaagtaagtggtctgattactcaaagtgcagaaagttaaaaactaaactgttgaccaaaaatattatatacagcaaaccatccttcaaaaaacaaaatcaaaataaaaacattcccagataacagaatcctcccaactgagagaattcactaccagtagacctaacttacaagacatgtcataggaagttcttcggctgaaggaaagagacaggaaatggtaactcaaatccacacaaaggaatagagaccaaaaaggtaattacataggtaattacaaaacacagtataaatatacattttatcttttctctcttaactgatttaaaagataactgcatacaacaataattgttgggctcataacataggagaccaaatatatggtgacagcacaaaggaggggaaggaaatggagctatattggaatagaaactgatatcagacagtaactcaagtctacaggaagaaataaagaatatcaaaaatgaaatatgtacgtaaatatcaaagtcttctataattatatattttctctcttctcttactctcttaacctctttaaagaatataagattttataaagcaatgattataacattgtactgtggtatataatacatagagatgcatactatatacatatatacaataataattgcaaaaagagatgagagaatgaaattatattagattttctatattttaattgaattaaatatttaataaataccttaagtatttaattccattaagttagtattaattttaacttaatactgggaaagatgcacatagagcgactagtaagaaaataatttttaaaatatagtaatataggcctaagtttaaagactgagaagaggttagggtgattagttataaacgaatcatatccataacctaaggtataattttgttttgtttttacaattttatagattcaaaaacataggcttaccgagatacacctgtcatgtgccaacgaaatcagaggcacattgacttttcctatgtaaatttctcctgggtatcactatcatcaaaaacataaaaactcagagactctgacttaaggtacgatccaagtccatattcattggcactgggaaatacatatgatcatcaaactgtggatcttgctactgggaatgatagctgtatcatggtctgcaaaatcaaaaaacttgtacacaactatgggtgtggctgcaggtggcttgctcgggactgcaggtggttgcaacatcttattgtatgtgaagttcatttaagttgccatctgtggaatctgtagaactgagttgagcagttttggtgcttgctgacttaactggaaaaacatacatatttatattaaggaaataacacagttaaagatgaacagcagctgccaagccccaaataagataattttgtcaatgacaaaagctgatattttcacttcataatttctcagtaaaataaacttttattctaatggaaaatcaatatccctagaacatgtatgaatagatgatcctgttattagcaataaaccttggagactgagatacatgtagcgattggtgctaaaatcaaataaaaccaagaaaaatgttaatctgatgtcttcaattctgttagataactaaagactatagtgagcaatgggtagatagacgaatgtctaactaaaatacattcacccgcccacccagagtaatgattctgttatatttgggttggcctcatcctgaaactgttgggatttgaggaagcagatacctgaggccaaattagccagtaaacaaagtctaactgttacgagaaaatgagaacagagtcagagacaaaccttgaagggaaaagagccaggaccgggaggatacttcaggagagagatgaacaaaaggagttattaggtgagttggaaactactctacggttcctttggaactattatggagatggacggcacacagaattttagaaaagtattgtgctgactgttaaatcttccatggctgatgtaatctggaacaagaaaatgctagtgtttctgtgctttgtttggtttagtgctggagtctctacattccacaaggcatccctctgcatttctgaatctggattgagcatctgggaccctgactccatgagagtttattggaggaggaaaaaataaagctgttgtcataatctccttagtggacaaatctgtgtgtggagaggagaaatctaagacgtgaatcacaatattgctttcccagggctagttgccctcagcaatagaaggctgagaggaatgactgaaaaagtacctccacttctccccttaatctacacaccagagctgaaattccaccaggaaacaacttattcaagtcagaatctggagtctaaaaagctttaaactacaaaaccaaacaatgtggtctccttatctctaactccctccccataacagcatttcccaaagtatgttgtaaggaatactggccagaaagatggtcttggaagcaggtgcactctttcttaagtttgggaatcagtgtgatattagtcacgcttcttaactgaaagtcatagaaactaattctatttagcaaaaacaacaaaaaagggactttaagttacaggcatatttcacggaatacatagtagaaatatggctggaccttcggaaggcagggcctagaaaccagcagaatgtcctctccatctgatctccatttttttctgtatgtttgtcattactctctttcttcagactcattgtgttaccttcgctgtttaacatggtagatgaggctgcctacagcccccaattttacgtgtccagatatgtcttgctttctcctgatctcaagggcagaatctgattggctcaactggggtcaagtgggtattcccaaatcattagttatatagggtggggagtgaaagaaaatgggatctgctaacgcaaacctggccactgggagccagctccatggattggaggtgaaggagttccaaataaaaaaagaggtaagataattatgattgaacagacataccaaatgtttctactatatcttatccctctgttactcaatgtgagtcatactttacattgcctactaaaattcatgttatatagactggctgcggtggctcatgctgtaatcccagtactttgggaggctgaggcgggtggatcacgaggtcaggagatcaagacatcctgcctaacacagtgaaaccccgtctctactaaaaatacaaaaatttagccggcttagtggcaggtgcctgtagcctcagctacttgggaggctgaggcaggagaatgcatgaaccgggaggcggagcttgcagtgagcagagatcacgccactgcactccagcctgggtgacgagcaagactccgtctcaaaaaaaaaaaaaaaaaaaaaaaagattcatgttatatatgaaactcctaaagtaaagaatcctatttaaccttgctcaattcaaggccttctgcatttatggatcatggaactaatatgaaaatatggtcattaagactccatgaaacattgggaaatgcaccctgaggaattgcatttaaattccaagttcccagaaagagaatattaattttgtatctactttgcagttcagaaacttaacatgaggaaataatttggaagcacaataactgatatccaataacggctgtttatttccttaacagtagaaatttttaacaaaagtcttttgatggtgacagcagtattgtgatgattaatttttcaaaagtgtcctgaatagcacggggcagttctttgtgttgatggaacagctctgtattttggttgtggtggtagttatatgaatctatcatgtgataaaactgcaaagaataattgcacatatacgtacgcgcgtgcgcgcgcgcgcccacacacacacacacacacacacacacacacacaaaagtgcatgtaaaaactgacgaatctgagtaaggtatgtagcctaattaatagtattgtcccgattttgaaattattctatattatgcaagacgttacaattaggagaaattgggttaaggttacaggggatctctttgtatatttttaccacttcctgtgagtatatgattacttcaaaataaaagttaaaaaaagacattgatggctgtgaaaatgattttagtttaaagcacgacacataaataaatattataaaattctatgtcataaaagggtcttaaagccaaatgagcttaccgactgcatatgctctggcccttaaaatttgatgttatataccccaaagcctttgccctttctcgataaagtcgaattcttgatccatgggaactcttaatcggaaccagtattccactgtgccaaaatttgggatgctccttttgttcctacaaatcagtacataacccaaggttaaaatagtttcatacattaaatagatagcagtaaaaatacatcaatggcattatgcattaaaactatacattttatgctagtaaaataatatgacttgcacaaatgatgtgagattggcaaataacagatgaagaaaaagttacttctgaagtatgagtttcattgtatattaaatattattaaagaactacatcaactatgtttgagatattccaatttgtactatttcattccttctgaaatatattttaaaaactaaacattggatcaaatactccacagattctttttgatgctatagtataatacttttttaaacaagttgcactcaatgttgtctgacatttacaatatgaaacctcaaaagtataaaatgacattccacattctaattcaagtttcaagacatctttggcaccttcccatttctagctatctcacaagcataagggaaaatgtcatagctatgccaaatacatgtcccatgcagtcacccttgcacgatgtttgccctgcacaccctcagtactcctctcaactcaggcagctctcatctctcttccatggggaagactttctgtgtggctcccaggagagtagagccctgtgctccttcatggacatcgtatgtccttgttagggcactgacttctttggcccgtctgtttccagcctatttctctaatacgccataagtttcttgagagcaagggccataatttccaccatatactcctactacagggactagtatataaaggctacttaatatttgtcaaatagagatattctatacataaactttcctgaacacaccagattattacaaatattacccctactcttcctactttatcaattttttccctgctaatggatcattctcatcagcatacaaatgtgattactatctgcctgctatagtttgaatgtttgtaccctccaagaatcatgctgaaatttattatcattgttaagagtattacgagtaggacctttaagaggtgatgaggccacgagggtccaccctcatgagtaggattggtgccattataacaggccgagattgaccccttcttgccgctcccaccctctaaccttctgccatgttgcagcaagaaggcccttaccagatgtgaaaccttgatattggacttaggtattctgttacagcagcacaagacacactatgacagaagcatcatttaaaaataagtcctaaaagaataatattaatgtaatatatatttgcttgtattgcataaaagatctttcaagctgggtgtagtggctcatgcctgtaatcccagcactttggagactgaagtgtgggcactgcttgagtccaggagctcgagaccagcctgggcaacagatgagaccctggcttaatgaaaaaacaccccaaacaaacaaacaaaaatctttgaaagaactgcagcctttggtgaggggacccagggtggctaaggaaaaggggagggaggtagacatgaagtctttttgatttttgagtcatgtgaatatattacctcaatcaatcactcaattaaaaaataaaatccgtcctgagaccctaagtcaccctccttccttcttcaaatactttcttacttggtctctggggtaccacagactcgttttcctcctacatcactggccactcctcagttcttttgctggcttttcctcctcttcctgaagccttaattttggagtttcccaaggctggtccttggctaccttctttcctttatttacattcactctctatgtgattttatctatgtcatggcttaaaatatattctatatgctaacaactcccacttttatatctctatcccttctttcagattggtgtgtccagccaccagcctgacatcaccacttggatgtctaataggcggtcagtcttaacttgtccaaacagaattcttgattttctttatcagatgtgctcctttccagttttccctatctcagtaaatggcatcactattcttctagctgctcatgccagaaatcttacttcatccatttccctcattatcacacattcaagtgataagcaagtcttgaagggaagttaataaaatatgtactgaatatgactactttttatcgccactttcattaccatctaatccaagccaccatcgtctttccttgatcaatacaatagcctgagaacggtcctatttccctcttgcctgcttcagactattctttccacagcactcagggtgatttttctaaaagtcagaaaatccaaactcctcactctgacctacaaggctctgcaatatgatctggccccgctatcacttgaatcccccctttgctgcaggcactgggcttactgctgttcctcccactgcaggcttgctcctccctcaggtttttgcacttgctattgcctctgcctgaaacattcttccctggatcctggcatggatcttcattctttaccccctcagagaagcccttacctgaattgcaacctgccatttctccctttagcctctttctctgattaactgttctgtattgcctgattcctctctagaaggtaagctacagggggtagttttgtctgtcttatttaccactgacaccatattcccagtgcctactaacagtgataacataaggtcttaaaaaattaataatttataaatagcttatattattatttataatagttataactattaaaccataaataatttaactattattatgaacttaaattacagttcaatacataaattaatttatttataaataaatacataatttagccaaaaagagtatcaatacaataaacatctgaagttacaagttttaaaaattaatagccattgtactgacatcatcaatgacattttttttttgagatggaagagcgaagctcttgttatccaggctggagtgcagtggcgccatctcagctcactgtaacctctgctctcgggttcaagcaattctgcctcagcctcccaagtagctgggattacaggcatgcacaccacacctggctaatttttgtatttttactagagacggggttttgctgtatttgtcagctggtcttgaactcctggcctcaagtgcttcacctgcctcggcctcccaaagtgctggattaaaggagtgagccactgtgctcggcatcagtgacgtttaagatagtccaattaacttgggtaaagaatgttgtccttgctctaaaggcacctttaatatacaagaaaagatagtatgtagagtaccataacgatatataaaccaaattagtaattcaaacacccaaggcttataattgtacttaccaatcaaacttgctgtacaaaatattcggccgcttttttcaagaatttgtgaaattttaattgacatgctgcaattgtttcatattctgtgctataagcctggtggactcaagggtgatagtattcttctgaatatattgcaaaaataagtcattaacatgaacaaatattgagaagtgaagttatattcgggatgaaggcctcgcactacgggagttgtctgtattcaaaatcatagaaagcataggtacagaaagtgacaggctctttatctccagatgccttaaaacttcagaagaaaaggttactttgttgatatggatttcaaatagattttcgcctcttctaagtggatggtttcatcaaattcatcaacagagtcatctggcatgatttctggttaaatttgtactgcttggtgccataggcaatatcctttaattgggctgcaagagaagacaacagtttagagatttcaaaatattgacatgagaaaatgaaaactggcttttgaagtgtagaatgagtacttctggtgaacagtctctattttaaattctatgactacactgtttttcttaaataatactttatcgtacaaaaatttatcatttctgttttgacatcacttattaggcgcaacaaaattgcaacttcagttttaatatagcctaagccaggaaaaaggggagaaaaaatcaaaagaagaaaagcgctcttaatgaacagctgagataactacctggatttcacctgttccctgtctctgctccacccattgtcttcactcctataaagtcagtctctctttctgcgcctcctttcctttaacttattaagatttatacttttcttcttcgtggggtgatggatagtttattatcctgatcatgatgatggtttcaccgttatatacagaggccaaccaaatataccaacgtgaatatctgccttgcttttctgtgaaactgctccagaaaaagccaacaatatcaattaattgctagacgcaatgaacgctggtccttgtattacttgatttctttactactttgacactgatgacaatctcccattagtgaactctgtctaacctggacttccatgtattcatcatcttctctgcttctcctcctatccttcttctcattcttttgggatttctcttctctgctagttttctgggcttctgtttttaattattttcttagtctacatattctcatgatgatctcatcaacttttatgacttttgtcattattaatatgctaaaggcttccatattatattttaaattcatatttatcttctcaactccattcctatatttctaaagttttgtttaccctctatgtatctagatatcccacacaacatattcaaaacagaatgtatcatactgtctgtttttttgtatgttttgagacagattctcactctgtcacccaggctggagtgcagtgcggaatctcggctcactgcaacctctgcttcccaggttcaaacgattctcctgactcagctcccgagtagctgggattacaggcacctgccaccacactcggctaatttttaaaatattttagtagatggggttttgccatgttggccatgctggtcttgaactcctagcctcaagtatccatccgccttggctcttcaggttaataagcttctacctcatcaatcagggtgaaaaagggccttcacaattttgttccttatagctttctctccaggttctcctcctttttttgatttcctgaattccagttggatggatctacagtgcagtttctcaaatgtactgcaatacgcatatttagggcatctttccctgctttacttactgcctggaatgccttatattacttttcttagtagtgaattctgtcatctttaaagactccatacctactgtgtgaagtcttgcctaatcttgaggtagaaataggcattctctcctcaatgtttccttgatacctttagattttttagctttacactcttcatagtaaaacataaccatttatttacttgtcaacatcttagggttccatgagggtagtgcctcagtttttcctatttgtattctccctgcccagcactttgttaggatgcattaggggcttgatcatgtttatggagtcaatcaatgaattgaggggacaataaaatatgatggttaaaatttagtaaaacttgaaaggaatgaaaatcccaaacactggacctcccttttaaccaagaaaattccattaaacaaatttttattgagtactacttggataaaaggtacacattgctccttgacttttggaaaaccctgcttcgtcagataaagatattattgagctcttctgcccagatcagagtttctgaaagtgtggtttggaaacccctgatgtctctgaaaccattttggggatctgtgaggtcacaactatttttataataatggtaaaggtaatctgcccttttcatttttatcctctcacaagtgtataatggagtttcttggaggtacatgatgtgtgatatcacaacagattaaatgcagaagcagatataaaaatccagctgtttctattaagccagtctctaagaagatttgcgaaatgttaaaaatttaaaaaattttaacaatgtccctcttcttgaagtatttttttgttttggaaaatataacttaaaaaaggtacttaatttatgttaacacgcaataagtttattattattttaacaaattaaaaatatttaacatttttttcacttttgttatgataaatatcaattaagtataactcatgaataaaggcctctcgaacctcaataagttttaagagtgtaaaattactgctggcatagaccactgaagtaatatggtacgtagtggacgtggacgtgaaagagagacaaagaacttatcactgtagaattacattttggttatggagaatatgcaaaactccaacagctgaagaacacttatatgctcccaaacttacagcttctgagtgcatgagaagaaaactgggttggtaagtgctgagctatttttttcaacatgtagtcttgcacctccatctgaatagcttgcagttatttctaaataaatataaaaaagcatgggccccagaacctctaggggtagggcccaggaaactacattttaaagagttcctcaagtgattttcctacttgctaaagtctaaaaatcactgtaaggacattcaagtagagggatcgctaggaataattagaaccagcttcctagcacaggtgagtattagttaggtttcaaagcagggaagcgtgtatcttggaatcatggtagaaaggaggtttaggagagcaaacagcaagaacaaaggcatggcagcgggcctgagcatgacatatctgcaaaggcaggtggaggacctgtttggctgaggtgcacaggttgcttagaagagaaattaaaaagggtagtaaatttgagtttgtagtaatttatgaagtaatttgaaatcttgcttgcaacacgaatttaaaaagcagtagggaattactaaaaattcttgagtagaaaagaatcaaggcttgtgcagtgtctcacgcctgtaatcccaatactttgagaggccgaggcgggaggacgattgagcccaggagtttgagatgagcctgggcaacataggctctacaaaaaaattaaaaattggaatactgctggaacccaggaggtcaaagctgcattcatgagctagctatgaattagggtaaacacagcaaaaatacactgtaagtgcagatttggatgacattatcaactgttataaatccattcctctagttactgtggaccaaaaaatcgtatatgttgtaccttctagtttaggatacgtgcagccctgatatcaagaagatgaacatactgttccactttgagttcataacttgctgcaaattttccatcttacgggtcactgcctcaacctccatctacaaaataaggaaaataagttttaatacttatgattagttctattttcattattcaaagcaactatgattaagcattttctagatcctggaaatagtaggagctatgaaccatggtttcctgacctcaatagcttacactttagaaaattatgcttggcaatattcacaaatcagaagaaagataaaatccagattcccttttatggagatgtgttttcattttgttaaaagctaagacaatacagtatggcatgacttcaggataactataactcactcgcagaatgtgctaaagctaacaaagggatttcattgccactactcattccctaaaatcagggactttaaaaacattatttgtggcgggcatggtggctcaggcctgtaatcccagcactttgggaggccgaggtgggtggatcattgaggtcagagttagagaccagtctggctaacatggtgaatccccatctctactaaaatataaaaattagctgggcatggtggcggcacctgtaatctcagctacttgggaggctgagcaagagaatcacttgaacctgggaggcggaggttgcagtgagccacgattgcgccactgattccagcctgggtgacaacagcaaaactctgtctcaaaaaaaaaaccaaaaaaacccacattatttgttttaaaactatttattctaactaagtacctagttataaggctacattcagagatgtgatatgttagtagattacaatagatgttaatagataacaggtgataacataagtatttagaaaataaatcatcagaatattatagaaaacttactttccccatttagtgtttacattacctgataatctttattaattttgtgttgcataattagcatgtttcttgtctttccagctcttgcaccgtttctgcatgagttgcttgcagctctctcatagagcgttctaatctttattaatttcactatctactttcactaaaaaggaaaggtctccatttttttgtttttttgagcctaaaataaaaaacatgttttatgactgaaacaaaaatttctaagatgtgttttatgaattaatatagatgtatcaataaataattcattgattgatcaattttcaattcattaattgaaaacagacaaaggaagtcctgatatatatatcaggactgcttcattcctatggaaaaaatgaaatttacctgttaatcaaatttgaatatttggatagacaattggaaagttatagagaaatcaaaaaatagttactttatgacatataaaagaatcatgtacattttttttatttcatttgattaaaatctatgctgtgatgtaaaagaagtgtttttttgtgtctataaataacagaatattctagaattaaaaattatcttcttgagatatttataattcaaattttacttagggtgtgcatcaaggtctcttagggcagaaaatcgatgagttaaatagtaagcagataaaagtaaaatgtttgttataattaaagaaagtgctttaaatgagagttttgaggtctggtttaatgtaactttgatgtcattatgaaatatgtatatgctataactaaagtcacctgatcactttcctgagtcttagtagtgttgacatgttacatacatatttgtaaggatgtactaagtttcagaagatgcaagaataattcattctccaaatgtaagggttacaataagggtcatcattatgctgaaacagttgtatgcagacatgaaaatcacgatgaagttagaaccttacctttataagtaggagagcttcactcaattcatcagcattaatatcattccctgcaatagattaagtaaaagctcacaatgagttatgaatggaaaatacaagagacatccaagtattcaaattatccccatgaaacataaactgactgatgccatgaactaacaaacaagtctacaagacattccagtgcttcaaaatgtccctatggaacataaactacctgatacatgagttaataaactgagtaattaatatatctgtatgctttcgctttgtagtatagtgtttctctatgcataaaatattgagataaaaattctgagttttatttcttaaataaggaataattcacctggttgtacaattttatgcgttttttaagttcatcaagttgttgcttttgtccagatactgtaactgtagttctctattctcttgaacgagtttttcattttgatcttaaaataaagtccacacaattggaaaggtaagtaaaaatcaggtttaaggacacatttcaattactttaattcctgttccacaccagtcttgatctagtattgttctggtcagaaaggaactgagctagcacctcgacaaagacagcaggggaatgaggaataaatgaacactatcatggtctaccatatgattcacttgctcatcaaaaacccaagacataagttcacagtattaattaaggaaattgtggcctctgggacttcaaaggaatgttctatttaaaatacctgagaaatgtgtttcaaaatctgtgattttttacttacttattaaggctcctgaaaagcatgtggaaaaaaattgtcttttagttttttaattgacatctttgaattttattttcccaacttagctatagtatttttattaaaacaaggtaatttccagaacatggtaggggggtgagggatgaaaattacctgttgggtataatgtacattattcgagtgatggttacactgaaaggccagattcatcactacctaatatacccatgtgcacttgtaccctctaaatccataataaaaaaataaaaagtaaggaaattctgaatctgtatttagtcaaccatacttccaacaggtctattcattaggaggactggattcttaagccatgcatggtggtatcaataataattcatatgggtgggcatcgtggcttatgcctataatctcagcactttgggaggctgaggcaggaggatccttaagtccaggagttttgagatcagcctgggcaacacagggagatctcatctcttaaaaaaaaattaaaacaaaattagctgggcatgcttgtagtcccatctacttgggaggctgagtgggaggatctgttgagcctggggagttgaggctgcagtgagccatgattgtgccactcattccagcctgggcgacagagcaagactctgtccccccaaaataaataaattcatatggttctttattcactgagttcatgctactaatcagtcggaatggacttggagctagtgctagaaatggaataatggttatgcttgtctaggtactcagttgctatgacccacaagcagggggtagagtagaatttagaagatagcaaattcataaagagactaatttttcactccctgattaaacatgtttagctttttttaaaaaaagcataatagctagcgaacaaatccacagttttgataatctcacgtacttaagtgtactctttgctagagctcactgtcacactcaggttcctcctttgttgactccctgtggactaactctaagccatgtcatctaaagtatctctacaatttcatcctgctctcaaccatttatgtttatcataagtcttcaatttatgttgtactttttgtttccttttcttaaaaaaatgaacacatttgccaagaattctttgcacaaaggatttgcatactgactgcattttaaacaaaaatatgtttctgacttttataaggcattgtttctcaagctataaatactacatataaataaaaatgttaaattacacagttaggaataatttggatgtttttaatgtcatataattcttggcagtctaaaaagtaaaaaaataaaaaataaaaaaaaaaaacctgtgatcctaggcaatacagagacattttacatcaaggctggcgagtggctcatgcctgtaatcccagcactttgggaggctgaggcaggtggatcgcgaggtaggagttcgagaccagcctgaccaacatggtgaaccccgtctctactaaaaatacaaaattagctgggcatggtggcacgtgcctgtaatcccagctactcaggaggctgaggcaggaaattgcttgaacccaggaggcagaggttgctgtgagccgagattgcgccactgcactccgcctgggcaatagagtgagactacatctaaaaaaaaaaaaaaaaaatcaaatatactgttaaacacttttgtcttattgatagaaggttacaaggttatcctagagtataaattgctttatctagtttactaaagaaaagaatatccaggccgggcacgatggctcacgcctgtaatccagcactttgggaggcagaggtgggtggattatgaggtcaggagttcaagaccagcctgtcaacatggtgaaaccccatctctactaaaaatacaagaattagctgggcatggtggtcatgcctgtagtcccagctactcaggaggctgagacaggataagaattgcttgaacctggaggcggaggttgtggtgagccgagatcgcaccactgcactccagcctgggcaacagaggacactccatttcaaaaaaaaaaaaaaagaatatccaaatgtgaacaatacttaaaaatttgaaggtataggttaaatacttgtctttaaactaaaaattcagatgaataataaatatgatttatatgagataaacttttttgttagagaatagaataagtaagtgggactctgtatttgattaaattaaaacaacatctagatagaatggttaggtaacaaaaagaaggcaaataagtccgaagtatgtaaaaacaaaggtactgaggataatataattttattctctggccagaaaacattttagggtttctaagggtgagctaaagtgtaaagggcatgactgttccatcttatccagacacactgtattttgattatcatttctatgttctggttttccttttctttcatttttcagagcagggttcctatatgttattaggtagaaataaacttatttatttaaatgttccagcctttcctaactgttgtttcaacaacgatatctccattcactgatattttttaacaagggcattattagtggaaaaataacttagtgtgagaagacattactgagtacctgtacttaccttctactgaattttatttagaattatccactacatttttcctttctcaaacttttatttgggacataactcctgggtctttaaaaagtactgaaatgctatagttcaaagagaaatatacttgctgaattataataggcaaaatcaaagcactctgtacaagatgaaaaaaacctccttaccttatgatttgacaaaaagcaggtcaagctaaacagcattttattcaatgagataacatttcactcttttaaaattatgttcttccagcacaccattaataagcagatgcagagaacaattcaactaaacaattttcagagcgcctttgtgctaatatcttcagcttgatcaatataaccatatgcattatgctgaattatgcatttcagctaaagatagaaaggactttcaaaagcaagcccttaaacacatgcagttaatttaagcattaaccaaatgcaaatgcatttacatatccttcccccacatattcacacaatctgaaactaatttgtaccttgataaagaggtgagtattctttaaaaataatttgccagttagatgaatgactacaagaagcagggaaacatcttctggcaaagaacacttgatacatgagaaggtaaatgtatgaagacattcaaagtaaaattaaacagtttcaaaatctgtaatacaaaatggagctttctaaatataaaagattttcttaaatagacagtttcggtttttttgtgtattatttccttggaagaaaggttaaaggctgtaatatttttcttataacccattgtaacattcccacaaagaaacgaaacttaaatccttagacttgcaaatctgaggtattcaaacaaaaataactggaaagtaatgttgcattaaaagtaaggattcagttctagcaatttttctttagaaaataatcggataatgtgtaaaaatttgtgtggaaagatactgttttatgatacttaaactgaagctatttaatattcaatagaagattgttaaataatccatggtacatacacacactggaaaactgtaacgccattataaatgattgtgatgtagatttatattaaggaatgattttacaatatagcaaaaaagcacattgtaaaactacatctatcatttagaaataactctgaaaggacataaatcaatattagcagtgattattttgctaatactttgtgggttgtgggattgatttttctaattacatactggactttttcataatgtacatgagttatgtttattattaaaaaaaattcccaatgataaaaaagccactaaaaaagatgaggaataaattagataaattaaaataagaacgtaatacttagtaagaaccctcagaattaattcaacgacaataaacaggtctaacaaaaaaccaagattttaccccccttaagaaaagcttctttgcaaagatcagttcagatatccaaagataacagctttaggattcttgatatctaagtaaacacagaaagcacagaaataaaatggtttatttcatttcctttccgtttaagaatgggcaatttatctgctcttggaaaagaagagggaatatagagcacttccacatttttacctaaacaataatttattgagcaattacaaggcaaagcactctgttaggtatttgatactgcacgttaaaatcaggaactgtatgtattctgacatgaaaacttaaaaaaatccaccaggtcagaaaacctgtcatcaccattttatccactcacagtcttctaaagaaaaagtcataaaaaaaatctatcatcaaatgtagtcattggtgaataaacattgccctagtgtgtttcattgaaattaagactccattgattatgtttccaatttcagacttgctaaaatgtgaaaaaaaggtcacactgaaatttaaaaatgcctcacttataagatgcaactcaatattagagatgttaaaatatgaaaagataatgttcctatagtcagtgaaatatggcattgtggtctaaataaaaacataagaatactaactagaaagtaactgttttttagtgagtatgtattaaacttttaaacattctcatgcaactgaattgaagttttcaaaagcagcaaccttcttagcacatgactcggtttatctagggcatgagcaacagatataacaacacttaaagcaaataattcatttcccctattgtgcatttgtgtgtaatctatgtgtgtgtaacacagtaaaattcagacttctttaattataattcttttacttcatgagatctgttacttatactgaaacttattagtgattattattttagcatggggcacaaactttctggtatttaaggtcactgtcacaaagtagaattagacatctcatcagagatttccctattcgaactctcaaaaacggcaagctactatttctgccactctctgtcatcttaactagtttttgtgccattacacttgccaccacctcacgtattacatatttatttaattgtgttagtttctccctattaaattcatatttcatgagggaaagacttttgtttctattcatgctgtatccccagaaattagaacagtacctagcactaactggtgctcaataaatactttcaactgttgagtaaagaaaggctcagaatttaggaaaattgaacaattaaaaacaaccaaataagaatagctatgagaaaaagcaattcttttggcatatacactaagctgagtatggaaattttgagcaaccactgaattcatgagagtggatgactgtgtctgtccctcatacatgcggggatactggcaaacagtaggcaccagagtaagtactgactgattcaatgaagaacattagatgtctgaaatgagtaaggcagtggttatttcaaatgtacctctttcagttttaatctgtcaaggatttcagttttgtctgttaagtcagacttcaaggcagtctcgagctggcaatctgcactttcagctgttgctcctttaacttccattgctcttcatgggcagcactaaggcactgcaaaacacacgtgacatgcaaggaaagcttggaaatcagcttcaaccgaaataataaagagaaaagcttttagtggcacagagaccactgtcatcatgtcttaggaattagtaaacatatgctggtctgctgctgttgaaaccaaggcgcctttctcaggctgcggttgggaacatgaaagagtttgtgggatgagcaaaggaactggccttaatttagagctctaagtcagaaaagttggcagtatgcagcttttgtgggactagtaaaggaattcagatactgtcatactccagaggaatccacaattccaaaactcagcaattgacatcggacaaaaccatttctcccacatacaaacctcttaatacagagaaaatggactttccacctgatctttaatttgtgaaacttttaaagagtctgtgataataacacgttcacaaaatattggccacaaaatatagcatattgaaccaccagacaatacctccgatattgattaagaagtagtgataatatgtttttgttaaaaaacaaaaaacaataggctaaaaacagttttagatgtaacacgattgaatgaaaaccagtgctctgtgcctgataagaatgacgaaaatagaattactattcctcataaaagtacagcagtttaaaccatggttaaaatttgctaataatcaagacccagcatatagaagaaagaactggttgaaaaataactagacaacgtacagaaagtgtacaatcaacatcgtttatgccagtggttcctaaacgctgacctaaatactggtagtaggccagctgctactaaggacacttagggagattttaaaatgaagatcccagggcccaggtattcatatttttgaaagctccccagatgatagccaggttttggaaaaactgatcttgatctgaatttcagcgaaaaccattatctatgaagcttgatatgactgaataatcatcagcagctttgaccatttatgtattttaagcccagtaaatacaacaaaaacttataaaatcttgttttatacgatgtgaagtaaatggaaaagaaacatattactggaaattgcccttaatgttgctcccaactatcttcagtttttatcccaaaaaagatacttttctgggaggcatagcttctcaaaagagaacattgtgtattcatttcacattttgaatattttactgcctttaagataacatgaccttaaaataaatggaattatggaagcttctctaaatatgacatctgtttcttctattagtgtctcatttcacttatggaaacttaacaaaatataggatctatatatcaattatttaagttattttatcaaaggtacaatgaccaagactttaatgaaatccaaataaaatatgtattttaatactaaataatattcctttttatgtttgtttttaaaataaagaacaaatataatttcatgtatggccaaattgtatatatcaaacacatccacatatatgcatgaatgtgagtacactatgtgtgtgtgtgtgtgtgtgtgtgtgtatatatatatatatatgtatgtatgtatgatatgcatgtgtcttattttattaaaaacatgtaccacccggaaaaaaaaattagcatgtgaaataggcacaacatacattatatcagatgccaaaaattagaaacagtagtgttccatagcattagtaccagcaaaaagatcaccaacagctaatctggcagaaacatcagaagcttatgtgtttaaattaagaacaatttagcggcctgggttttccaaacccacaaaatactatgtaaatcagcataagtcaatctgaatttagtccactgctatcttccctctaaatttagattacattccactggagtttcatgagaaattccttttgaatttactgtattccgctatgttagagccatctgtgtaactataaatggtgaaccacatctggctccattttctttgtaaggctgtacacatgattaaatctgcatatgagaacagtctttgagaactttttattcatgaaatgtttttgtatattgcctatagtgacaactgaagggggatcatagttagtctttgtcacatttcactgttacatgatgttgcaggactgatcaaatgtcagcctgcagtggaatgccattgctgcttgtggtcaccggcatgtccactggcagacatgggtcagcaaactgtaatacacacccttgaccaaaaacatgataaagatctaaataaagccaaagagttcatctgctcctaagatctttccttctacagaagaaactccatttgttcaatgttcaagggcatcctatgtgagagacaggaaagaatatactctaaatcatccataaagaaatccacagtggctggtacagcggctcatgcctgtaatcccaatgctttgggaggctgaggcaggaggatggctgagcccaggagttcaagaccagcctaggaaacatagagagatcccatctctataaaaaaaaaattgaagacccagtgtggtggcttgtgcctgtaatcccagcactttgggaggccgagtgggcagatcacttgaggtcaggagttcgagaccagcctggctaacatggggaaacccacctctactaaaaatacaaaaattaggcaggtgtggtgacaaacacatgtaatcccagcactcaggaggctgagacagaagaatcgcttgaacctgggaggcaggggttgcagtgagcaagaccatgccactatgctccagcctgggtgacagggtgagattctgtctcaaaaaaaaattaaaaaataataataaaattaaaaattagacaggtcttgtggcacatgcctgtagtctagctacttgggaggctgaggtgggaggattgcttgagtccaggaggtcgagattgcaggagctatgattgcgccactgccctctagcctggacaacagagcaagatcctgtctctcttctccttttttttttttaaatcataggtactttatttagggcctaatgaaaattaaattatatttacatcaggatatttcacttactgaaagaagatgatgccccaaatgtacttggatttgatttctgggaagcataagctgctcatatttgatcacatgagattttatggtttctgaaggttacagggcacagatgctcactttacagaaacagaacacagagcatctatgggttcagtagtgctcttttacattttgagaagtagatgactatcacataataaaaacttgatcacccaattcttaaaaaggttaatatcatcttaaaaactagatgaataccttttaaaaaagacattagtgtctctcaaggagttaatacctcaaaatcacattcaacagatttttttgacccagtctcaaattaactgaatcagagttggatggtatgggggcagagggaggggtgcgatggataggcgaagaagctctgaagaggtggtgaaatctacattttaataagttttccggttatttgcatacattatagtttaggaaccattgcatttatcagttacatggccccaaactaactaacttcaaaagtgaagcacagcattactaaattatagcatactaatataatatgtattacataccacagtatagagtttctctctgacccaacagaaagatataattgcaaaaatgtattctcaacttttaaattgaacatttattaaagttatacttacttcttggcaggtatcaaaagtgttttagcatattaaaaaatgctcatactaaaaagtaacatgagggtttatcttcccacatgattctctaatatgtcatatgtcaagtaataaacacattcaaaattatttgaaaaagaaagatgagaatgcaaactgcaaatcatatttttctcctgaaaactagcaattttgaataacaaacaaatgctgtccttttaaaaacatgttatcattatgactaagaaacagggagtatgtgcagtttttgatgaacattagttgttggcaataacgaataacaggtcatgaaacaaaagagctgtaaagaatctgagagacaatgtagacttttgtcgaattttccaactatacttctaaaatgtatcatatatttcaaaaacattatattagagaattctgagttctgttgactattatgtgtgtttgctgggttttgtgcttatgttacattaatttttttttgacattaaatgttttgacactcattacacacatttacttccatatatctcacataacttcacgtgtgagcagcataacgaagtctgcttttagtgtgacaggaaaaaaatgttatgcaagcataaaacattgaaaaaaaaaaacccttcaaatttatactcttagatcatctttaatatggaaagataaagttttatggtgggaaagtaaatatgagaaaaacatgactttccaaaatttcgtttatacattattcccaggtaagtttgattttttttattccaagtaagttgttcagcaaattttcaaactggggagaagtagaaaatttggaagtaatggccatatggactattttcttctatttagactgtgtaaattatttgaaattacaagatactgaagacattgtaaatcagtaagaatttctggatgtataacagttctgttattccatgaatgtttccctccacatatgcaattttccaatgcaattaaaatcagatagtgaagcataacaaaaaaagattcaagttttagagtttaaaaaaatctgggttttagttctaaactagagtctcagcaagctgtgtgactctgcacaagtcttaatttttctggaatcccaatttcctcatttataaagagggatgatatcttctctaatagggtactgtgcaatttgtatactgacatttaaactttcaaacacacatatgattttaactggtgtctgaacctactgttggtaacccttaatatatcagtcactgtacaaagatagtcccaagtaggtaaataacatagatgatacaaactactaaataatgcctatgttaatttaggtaactttccagaagtaaatcaaaataaaagcctatcccacactccttgggtataatttgtttaatttacaaaatgtaaatttaatttataaaaataagacaaagagctaaaaagttaaagatgcacttgtagctcaaatggttattttctgagtttcagcacatgaccagaagtagtagctgttgaatatcagctataacatatgtatttaatatatattacatttgctttcatgtaaacctgtatttatcatttatcagtatcatatactaaaagacttaaaattacacacacagacacacacacacacagatatctgtatcacttaacaaacttagatgtggggtataattttgtttctaatactaccagaagggattaatttctaaataccataattatgaagtagattaagaaacaaaattgaagcagccctttaaaatgtatctgagataaagatgcttgtgtttctctttataaggaacagagacaattgtaagtggacactttgcttttccctaacagaataactctcagttaataagctggggagtctaagaaagagacaaaagaggttcaaacacaagctctattactttatacatttaaaaggtatgggctgggccagtggctcacccctgtaatctcagcactttcggaggctgaggcaggaggatcacttgacccaggagttcaagatcagcctgagcaacatagaaagaactcgtcactaccaaaaaattaaaaaattagtctgacatggtggcatgtgcctgtggtcccagttgctcaggctgctgagtgggaggattgtttgagcccaggaagttgaggctgcagtgagccatgattgtgccactgactccagcttgggtgactgagacactgtctcaaaaaaaagaggtgggaagtgcctcttatgttacttaattttgcttcatcttccttgtctgcaaaatgggaatttgtaatacatacattcagggtgctgtgaacaatttataacaataaatgtagagtatctagcatggtgtctgtagtttatagttagtgttcaataaatgatagcagtttactggcaacaaagtgatatggtttcttagtagtgataggctactgctcaggttaaataacttattacaatgcctttaaaaagttgtatttcctttatacagtttgcatatttcttgctatcatttgttgctaattctttgacaacatgatctattctgacaacagcaaatgcttacatataaaagagctcaaacaagacatgaaagaacacatggaatcacgatttacctgtcataaagtttatcatagttttcctttaaagttcccgttccttttctaaatcattaattctatcctgcagctaaaatgaaaataaaatacatattaagtaaatattatataaaaccacttgggggtaaaaaaaaacattaaaaaacctatatgagagaaggttaacatgttttaatctcgattgctaaatggtagctgctaaccaaccacttatattgtctgcatttaagtcagcattgatttttcccaagttgttaaataaactgaaattaatattcctgttttaatttagtagaaacgtatgcactgctttatgcaacatggccagaagtcattaaagaatatgttaagagcttgctaagtcccgggaaacatagtatttttacttttcaccatgataacttctgtcattatattcattttgtattaatttacaattagccataaagaattaaaagagttaacttttttttaggttcatggttcaaattgtgttgttatcacaatttactctgaagatacaatttctcacattatctgaaatttataaatagctactgcaccttttgtgaataaatgaataaacaaacttacatactgttttagcccatgaacagtttttcagaaataaacggagtaataattacatccctatggctaaaatgtagatttctgtatctagtatttatttttaagttttattcataagtatattttgcagtcacaactttttccttggatcagattactctttatttccattttcagaattctcttttgatgctagtatgagacgtaaaagattctcccaagatcagaacagaatgcaggcatcttatttcacttccattctcttgggaacaaacttaacaggctacataaaatactacgataataggaagatgagttttcaagaactctctaaaaaaattagataatttcacaaaattactgataatgcagaatacaacaccatctcctcagaaacagatacagtcctgttattttgtttcagtatctcaaatgattaaaagctgttacagttgagaaagttaagttccataggtaatctggcatcagtttcaaaatgtggtttcattttactcaaggatctttaatcctttgggtaaacagtggatcttgccacattgcaagtacagttaaacactgatttgccattcatatattaacaactatattttgctgtgtcaaaacaccatgtacataacttataattttaaataagtacaattttgaaatatctctatttactttttcaaaacagttaccaagaagttgtaatgcaacagatggctaaactctttggagcttacctcttctattcttctttcagaaaacttcatagaatgtaattgtttctcaagctgcagcattttaaacgctgctctttaagttgcatgtttaattcatccccatttgccataaagcatcgtggctgattctgagagttctttgcttctaaaagataaaaagaacatctttaaacattatttttgactaaatgattaaatttgactaaatgatttgactaaatgattacattctataaatgaatttactcccgaagttcaccttatacagattattttttacataacaatgatgtatacgtgctacttatccgtaggagacgctctgaacatgtgtgtgacatgaggagaaaatacagggttatcttagcatagagtcacatattttatttcctcctagtttttgactattgatggtgaccagcaagtaaattcattttaacaataactttttttctttttgctgtgttacattggttggacatgctgtctaaaaatgctgtagcatgggtcaaaaatgctgacccagatattcgaactgaagggattcgctgccacatcgtataaacagccttggatggtcagttttaatttgcatacaattaagttaaaatttccaatttagtaaaagttatgaacttttctaatttttcaaaaatggtctatttatgaccatgctgtaaattcaattttatatactttatgtcacatagtttttttttaaaataaaaaaaggtaaagtcttttcatatagaccatataccatagcatgcaatgcctcacctgctaacttaaatctctcaagtcccactgaagtttttttcactcatttaaatgacacatggctattgagccattcaggtcaattttcgtttatcttgtattattatagaacagtatcttcagccacctttttctaggctccacacttcactgaggtgttgggcttaacctctcaattttttaccctatgtcaacttccaaaagagctgcctgtatacagcagacacctgttattgttggtatttaaactaatacctgggttcactgttaaataaaatcaaaattgtcaaagtgataagagaatgtaaaatcatttttcaattcctttcttaatcttaatcttagaaatggctttcaactacagggatttttaaaatttccttcttctaacactgtagatagcactatcattctcactctctcatcagtctccttttacaaactctcatattatgcagaagtaattaccacttggcatttaaagaggttcctgcaggatggaaaacaaaaccccagagcatggctgaaaaatatttaactattgaattcaacagtgaatttaggcttcaatgaccctttgctttgcatcaatctactgccctccttgtctcgggacttcaaagaaagtttacttcacataaattctgctcaactggaatgtcttggagttcattaattccagaaccttgttaattatgcagtgccaacaaatagaagccctcagatggcatattcctgtggggtcaagtccttgttaaaacaaccatgggcataaagaatcccaagtattgtcaacctgaagggtaaggtttaaaataaatacactgatagttgacgttaagagtaatcaaatattttcaggtatggtagtgaccaaaaaagaaaaaaaaattcaaataaaagaaagttttaacagaacatgatactgacctattcattactttggtctattgccaataattttataaatgcttaaaattgagatatatgcaaatatggcaaaacttcagtgctatgtgtccataataaattcagataaaagagttaaaaataaatttccttggtagaagataatttataataaatatggttattattttagatgacacagatatttataaaaagtccaagcagttaattatttctttagtgcttgagtataaataataaacaatatattaagggaaatgatacacatttgtgaatacaaagaacaatcttcaaaattatgttctagtgttatgataattccatgttaaaaaaacaacttgaatactcttttgaatcctttgcatctctgtaacattgtaataaaataaattatcactgtacctctgaagctgaataaattttccttccattgctgaaagagcattgcttttctctactagctgttatgaagcttaatcatttctacattgtcccgaatatttgaccttcagagttgtgtttaaaaaaagagagacagaagtaaaaaacgcaagttagaagaaaatctatggtggaatcacaattttcaactaatgttacatagaaaatatttatatacttgtacatcagtcaatgaggttttggattattataaatgcaggacagattaattatttaaaacaaaccaataatcattcctgactttcataaccttgaactcacaaagtttgaagggagcccccaaacttcatgactatgtacctctacaattgataatatggatttaaaatcattttatagtatcctgaaagatggcacgaaacacaatagtttttagtatagcaatggtaccattaccgaacttcacacttattttaggaggactatcacgctacttttccctaaatgaaaaatatgcaatacagccattcatcttctacaactctctcgacgcaaatggcatcataagattaccatttattggagtttcctcttgagttttaaacttttcaaaatatttgcaaaaaaagtgacttagcattttatactaacaagtccaaagctggcatttaaatatgttgcagatgtgcctttagctgtaagagatcacttgtgtccacagggtatatagaaaccttatatgttacaatactattttgtatttttcctactagattaaagcaaatgtagaatttaacaggaagatcttgttaaaggttaatcatagatctaatgagtacctgttttcaaaaggcatttattttcttgacagagaaaagttccttaatttatacattttatattaaaaaatattttgttaattttgaagcttcatttcagagttcactttaggaaaaataaatgtaaaaaatttaaaatcagagttcaatatttaaagtaagagatttacttttaaaacttatctagtgtacacatattggaaaaattgtcataatgccctactggaccagaaaatggactacaaagctcacacatctgtaaaccagctgaggacttgaaatacttattttcctctttgatatttgaaagttcattgtattttggcattggacagttagttgtcccacacagaagataaacaaaaccatgaatccaaattttgcccagggtacagtcttaacacatgttaaaataattatatgtctaaaacatgttatctagtagttctgagcacatattcaaaatatactcactaatattcactcagtattacctttagccactaaaaatacatatatataaatataaagagaaaaatacatcttaaagtctaaagaaaatattctttttttcatatttaaagccaaaatataatttacttatttgccccagaattacctggtttgaccactcagcagtaatgacatttattgatatgtaaggacagaatgtgattcaaataatttaaaatcttttcaatatttccagttgtctctgatattttatttttgttttaaagtatgataatttatttattatttttttttgagacggagacttgctctgtcacccaggctggagtgtagtggcgcgatccggctactgcaacctccgcctcctggtttcaagcgattctcctgcctcagcttcctgagagcagggactacaggcgcgtgccaccatgcacagctgatttttttgtatttttagtagaacgggttttcactgtgttagccaggatggtttcgatctcctgacctcataatccacccgctcggcctcccaaagtgctgggattacaggtgtgagccactgtacccggccgcagtatgtgatacttttaagaaaattaagatatatttgaataataaccattaattacagtaacacattaaatctctataatccattcgggcacatagggtgatagaaataacagtttttaattttaatttttttgtaaggcagaaaccagtaagcatatgtcaaaaactttcagtggtttaatcgtgggtgctttcctgaatattttcctaaactccttggagtttaaacttttcaaaatactccaaaaacagtgacagggcattttaaactggtaatggccaacaggtaggtataaatacacttacgtagtatttagacaacagcagtaatgtactttaaacaataccttaagtaacaactggtataataatgttgtacttcaaataaaaagtcagtttgctgcagagtacacctttccgggacaatgctaaacttgtaagtctttaataattacttttacgtatcagttttagggacttattattatgactttatttttttttcatgtaacaatgagaagaggaggataatctgttaactaaaagtgctaggtcagtgataacataaaagttcaaatcagcaatgtgataaatgtgtctagcctttaagaagatgtgcaataaaaattacttcaaacctgacaatcaactcaactttttatatagacgaaatatggtacaagaataatgggaggaagtaagagagaaagaggggagagatgtcacaaaaagatgacaagaaatgtgagaaggatgttgtaggcaacacggagtagggtgtttagctaagtgaccagtcctagacctctgtgcttgtggagcaaggcctcagttggtatttgaagaatagacttagggctaattttatgagtaatattttaagtgacctcccacaatatttttttgccctcttctacacactatgacaggaataccaaatcttcaggatgtgacattctaacagaaagaataatgcatggtaaaaacattcagacattcggatgaactcgacagtcatggaccaaatcacacatgctgcattacacatggtgaaatgatctgcaaacaatatcaagcatactaattaagtgctttgtaaaaataaatttctcaaaattttcatcaagattttgaaaaagtcaggaatgattaagttggaaaatgcagtttcttttctctttcctttttttttttaaaaaaacatgattttaaattatgatcaaatcttataaaactatgagaagattgctggcccatctctagattaagaacaaactgaaataaattagatttcatgtccaaaaaaagtaatccagctcaacaacctgtgtgccaagtttctctcatataatttgaaacagtcagcaataaactctgaaaaaggaatttctaatggaagccttgaaaacacttgactccagcttgctactgggtgccataataaatccagaaacctaaaacctcagatacactggagaagtaaaactttcagcggagctatgtaatgtatagtctaatatgaaagcttaagaagcaaaaatttgctccagtgaaagtttcatatactttattccccaggcattcaattcccctcccccacctttgccaacatttcattccttgctaccatattatgaaagctaaaaaaaagcttcctgatttttgagataaaaatgtcatagtatttaacgtcatttagaagagaaggctttaaaaccaaaagctaggctatgagattcggggaagtagttaggtcaaatatttacgacacagaatgagagactgttttgagtaatagttacaggctgaccaaatttggggcataaggttgaaaaaaccttagggttaaaaaaagcactctagattttcttttcaaacagtggcagacattctgagctgtattgttgaaggaaatgtaggtcattcatagtttttattagggatacacagatacaatcagcagcaaggctatcccctatgactagggctacagaaggctgctagtaaactgatagaataagcttcactaaaatagctgaggaaagtctatttgaaagataatgattttgctaaaattgctacttgacttcataggtgaaaacagtgctctctgatttaagattgctcaaagaaaaaaactgtctgtgtatatttatttgcctctgaatcattactttcctgtggtgttggtcaaactataaatcagaactcagtattttcttactcttaccacccacaggaatggagggacagttttgtcagctctctacatgcataaaatcacactcagtggaagggtactcccaaggctggttgggaacaggaagaactcaaatcctggctcatcttcttatagggaccattttacggtcaagtttaatggattccaacttgagatttacagtaaaagaaatgggaatctgattttttttccttttttttttagatggagtctcactctgtcaccgacgatggagtgcagtgcgtgatctcggctcactgcaccctctgcctcctggttcaagtgattctcctgcctcagctccggagtagctgggactacaggcatgtgccaccacacctggcaggaatctgaaccttaagtcaatatttcagaaagcccaataagaaacatacatttactggcaatgaagttgcaaactgaactaatggttttgtgttgttttcatttcttgatagaattgtgccaatccagtgtctaacgcaggttatttaacaattagcagaaggagggattggcatgatacaggtctctttgggaatacaaacagctaatttagtaggccaaatctttctgaacacaaggtccctagagagaaaacagctgttgtttaaaggcagggaatcatttacccatttcaatctaatcattttacgttcaggtggttaactgaggctcacagaagtaaagaatttggccagagaccttaagtaaggaaacaacactcaaatctcgctctaagagttaaattcttcccactcttcaaagttaaatcttcccactcttctaagttttttcctctaagatcttcctaagttttaactttccctccctatcatgcatacactcatatactagtaactattatctgtgacaatttctgtggtttgttaaagtggcaggaggctatgttaagtcactatcaaggaaatatcttaatgttaataataaaacatgaggataaaagaaatggtatttcagtgtgaaaattttcattgggtgaattctaactgttcaaaataacagtcagagcatggtgaatatattttaaaaaatgacagatcactccctgtgtaacaaggtctgcatggctatccctggtcccagttacccctccatcagagaacagatgtgccctttaaattagggggttgggcaatcaggcaaatccaaactgagggacatttgcatacaactgtcaatgggctataaaagagtgggggaccatttgagaacaaaggatattagaagacatgataactaaatgcaacaacacgtgaccctcgactggatcctagatcaaagaaaataaaacaacaacagctattacaaaaagaccaagctgcaaaagacattattgggaaattggggaaatttggatatggactgtgtattagatgctgtggctgtatcattcattgtaagtgttctgaatgtgatagctgtattgtggttatgtaggaggatgtccttgttcctagagatacttacccgtaactgtacagagggtgaagtgatgtatgcacctaatgggagtaagaagggagagaggtgaagagaagggaagtgaggaatgagtgaagagaagagagagagggaggagaaggagaaataggagggaagaggagatgagagatgttgagagaagaaaacaggctagtgaaagaaggcttaagcaagagcaggccgagtgcaaaaacaggcttgttgtaccattaaaaaatatgctaaggggtgaaaggttatgtgagtgctcactcaactattctttccattttctgaaggtttgcaatttctcaaaatgaaaagttgggcataacctagagtgctagaaataatcttgtatctgtgcagaggggaaagagtgagccctgaaagccaaggcatggcgcaaaggcctctctgttgcgagatttgacagtcggctgtccgccaaagggaaggcaagtcagatgtctgagatacttatgggttaaatttcctccactgggacattatggcagttacatgattctaattaagaaggtaaacaccctaacatttattttaaaaaaacacttagtacaaactattacacatttgtaagagtataaatatttttggagttgaaaaaggtcagtaaatggtaaatcattctgattttaatgttcatgtacatgtgttcactggttactgctttgaatttaattaagacggcctttttaataagcagaaaatgtgcatttttatattgtttaaatttaatatgatttttcttcaaaacaacacagacattcaggctacttgtaaatgatataagattttttgtaatgaggcattatgtagaacatatgcaaaaatcacaactcactctcccaaaatagacccaacaacaggaaaaaacatgattttaataaaaaagagcagcactgggctttgacttcaagcaattaagggctttggataaccaaaagtttatgtcaagctgatgccaaaccaaactggctattaaacacatactatgaagagtttctgtaatattctatgaaaaggctctttgccataatatcaagcactgccactctgaagattacaactacgttaggttcatgtttgagaacaagagtccaacatccagatcagacttctagaatttcaaatctgaaataatgtatccgtgaagaaaagtttaaatatgtttcccattttgtgatttttctctacagtaaattataccaagtttatattctccctaacatttttttcaatagttttccattagtctcaaaaaaattgctgtacatataaaattataagctatgtgtaaacatttaaaaaaggcattgaacatccttatttaagctatttcctcaatttcaacaactgtatttcaagcaacaatatgctattcactatagtatctttccttctaagcaaataacatgtaaattttcaattttataagatcaagtgaggtgggtacacactgatttatttctctggtctctgcaataaaagttcctttgcctgtaatagcattttgtctctgctttaattcttgatgtgacaaaaatagactgctacagagtaaataaatagccccctaaggagggacttacctcttctatgtatacatgttggtgtctcttgttggaatatttatagtaggaaagtatgtacccttgtctatcactctatttcttctgttgctctgtttcaggattgaaggacttttgggtttccctttcagttaacactagctcctaaatgatacatccctttggaaaagggaatggccaatacagtgtccaccttacactaaacttgagaatgtaacagggaaagcaatccttgataaccttgtactcagtggttcagtaaagatggggatgccccaagcttgagcttggcccctatatgaatttttatattcagacaatgtcttaaactggctgttggcatttactaagatcaccatattcagtgttgagaggtctggtcctttagcctgtttctcacaaggaaccattcttggtttttaaagtaggccaaatctaaatcttcttctacagaaatatgaataactcataggtattcaagcttatgctttagccagagttcaaatttatcccctaatttaaatatgattctcaaaaatattcatgtttcttttgtcttgcacttaaagggtatataatgtcactagacatataggatttctcatataatttaattttacacatattttttaggaatagaatttttagagataacactaatctgataaatctatgaaatataaacttcttatatatttttagcccactttttttttaacaagtctgatattaagcatcctttctagcttcttcatacattaccacataagtttagtttgttaaaagatgaataaactctgaactgaaatgaaaagccagaaaatcttacttggtttttctaataagaacctaggcatacaatatgatatcaaacttgttggaaaggagaaaagtaagtacagcaactaggtctggtttaaaaaaaaatccagggaaataaaagagacataataaccaaatgctatgtgtagaacttattggattccaattcaaatgaacagtagaaggacatcttcacagaagtttgaatataaaccattattagacgatatcaaagaactactgtgatttttgttaggtgtgataatggcatggtagtatgtttttaaaaattccttttcagacagaaatagaggttgaagtatttatcagtgagtgacatgatatctggctggggataattcgaaaaataaatgtgaggggatagatgaaacagattggtaagatgttaatagttgttaaagctgagtgatgtgtatgtgggggttcaatatctattctctacttttgagtacacttagttcaaaaaaaaaaaaaagaaaaaaatccagaagggaaaaaataattcaagaaagaatatttaaaaagataaagtattgttgaaagcacaattcaaagcagaaaatgaatgaacaggtactaggaaccaaaaaatggcaaagaagaatgggaataaaatatcgtacattataaaatgtcagagatgacaaaaacaagcaatccctatttataagtggtgctggaagaactggctagccatatgcagaaaattgaaaacgggcccctttctacaacttatacaaaaatcaactcaagatggatttaaggatttaaatgtaaaacccgaactacaaaaactctagaagaaaacctaggtgatatccagttagaatggtgatcactaaaattcaggaaacaacagatgctggagaggatgtggagaaataggaacacttttacactgttgtgggactggaaactagttcaaccattgtggaagtcagtgtggcaattcctcagggatcagaactagaaataccatttgacccagccatcccattactgggtatatacccaaaggatttaaatcatgctgctataaagacacatgcacacgtatgtttattgtggcactattcacaaagcaaagacttggaatcaacccaaatgtccaacaatgatagactggattaagaaaatgtgcacatatacaccatggaatactatgcagccttaaaaaatgatgagttcatgtcctttgagggacatggatgaagttggaaaccatcattctcagcaaactatcgcaaggacaaaaaacaaacaccgcatgttctcactcataggtgggaattgaacaatgagaacacatggacacagaaggggaacatgacacaccagggactgttatgggtgggggttggggggagggataacataggagatatacctaatgctaaatgacgagttaatgggtgcagcacaccaacatcgcactgtatacaatgtaacaaacctgcacgttgtgcacatgtaccctaaaacttaaagtataaaataataaaattaaaaaaaaaaaagaaaacctaggtgatatcattcagcatataggcatggcaaagttttcacaacgaagatgccaaaagcaattgcagcaaaagcaaaattgacaaagggatctaattaaactaaagagtttctgcacagcaaaagaaactatgaacagagtaaacgacaacctatagaatgggagaaaatttctgcaatctatccatctgacaaaggtataataccagcatctataaggaacttaaacaaatttacaagaaaaaaaagccaaacaaccccattcaaagtgggcaaaggacatgaacagacacttctcaaaagaagacatcatgtggccaaaaaacataaaaaaaaagctcaacatcactgatcattagagaaatgcaagccaaaaccacaagagataccatctcacaccagtgagactggcgagtcaaaaaacaacagatgttggtaaggtatggagaaaaaggaacacttttacactgttggtgggagtgtaatttggttcaaccatttgtaagactgtgtggtgattccgcaaagacctacaggcagaaataccattcgacaaggaatcccattactgggtatatacctaaaggaatataaatcattctattataaagacacatgacacgtatgttcattgagtaccagtcacaatagcaaagacatgaaattgacctaaatgccatcaatgataggctagataaagataatgtggtacatacataccatggaatactatgcaccataaaaaggaatgagatcatgacctttgcagggacatggatggagccagaggccacttccttcacaaactaatgcagaaacagaaaaccaaacactgcgtgttctcactttaagtggagctaaatgataagaacacatggacacatagggtggggggaacaacacacactggggctgtcggagggtgaggggtgggaggagggaaagcatcaggaagaacagctagtggacgctggtttaatatctgggtgacgggattatctgtgcagcaaaccaccatggtacacatttattatgtaacaaacctacacatcctgtacatgtacccctgaacttaaaagttggaaattatacaaaaaaagttttttaatgtcatagatgaaaaggcagcaaggagactatctacaggacaactgtaatcttatcacagccaacagattgcaatccaaacttggaatattagggatcttttgggattacaaactggtaccatattatggaatttactatcttttaaggttgaaaaaagaatgctggacttatgtacaagatatgccaacagttgagttcttgtcacccatatttctccagtagttataatcaaatggtatcagaacttcctgcaatcttggcaaatggggtaaatgacatagaaaacaagatgagggtgatttccacgcatcagaagctgcttaaaagcacagcagttagggaaaactgtctttagactagagttcttgacagcagttagtaggtcgagcatagcttatatgaagaatgttaagtaaaaacatgatttttaaatagactagataaacttatcctttatggcacatgataaagtattttaaactaattttgaccttatcaaagtgatatttctttttaacatacctttgatctgtagcttgctgttctcgaagctgaagaagagataactcatttcattttcttttctcctcaactgagttttcaggatctcagccaagtgctctaactccctatctggcctctttgtgactgaataacgttttctctgaaataaagagcctctgtaagacttgtagtttgaggaaaatttttcaatagttaagatcagtgcaaagaaagttcttcatgaaaagagcaagcagaagttaaaaaatttagcttaagtgcctctgcacacagtgaaatagagcagattaaatgtgatgacttggaaatacatacggaacaatgcaagatactgcttttttaagataatgtcctaggcaatggattggactttggtttgattcaattgagtaagtatttttgtggagtacacctactatgtatgccacaatctggtcttcagaatatttatatgtcttgttctttcatatatgcacatctgcttataacacccaaattaacacttcagagagagaggcaggaaatttgccaaatataacttagtggtctctggcatgcatttatctctatcatgtcggcagcatcacactgtaatgagtctcaggaaccggtataaacgttggcttttcaggtgacatcaggtaacaaggttatgtctagtcttttattttcctgcaggctaatcattactgtactgctatttaaaatattcaaaaggaaacatttgaagaccatattattcttaagcaactacttaagtatgatactgtgcgccatgttttcttttctcatgaagtattgttactttttgagatccaggtgaaggcttaaagtggaaccttaccttcatttgtgtaactcacagacactgaaccatgaggcttggattaactagaaaagtaagctaaatgtggcagaagtaacttttttaaaccatatgatgaagaatgcagtgccatagaatcatacgaaaacaaaatctgaaatcctatgtatctgataactccaaacttttatgccactccccaattctttatttattttttttaccaagaaaagggctaattgattcaggatctaaaaaaattacctgtgattttctgggaaaaaaatgttgcctctaaatcttacactattctaactgactggactttatgccattcctcgagggtcaaattataataaagaagactattacataaatccttccattgaggcagctggaaagttcttcattttcctttttctgagaacatgttatataacatctgttgttaccctacaaacatagctgtatttcagtggagcaaactgtttacatataaataaaggaaagggaaggaaaaaaaaaaagacattatcaataaccaaagttctcaaattaccacaaaaaagaacacatcaaatttcttatttctcctctggcttcttcaagtaaactgttgccatattttgtaaacagggatgtggagtttctgctacatctgcatcttggaattttatacctaaaaacaaagtaaaaaatatgattacagaattgaagttagaaaagaaggatctttgatttgctataataaggtatttataataaaatctcttaagtattaagaggtatgtgttttatagtacacagaattaaaatacactgccaaagggaatatgtgatctcagccaccagtaggcattaaataaaacacgcagcaagtattgctcattttacaaatctactgtagaaatcaaattacctagaaataatttattcaacttaagatttagactcctgcagtaatttctgaaataaatcagtcttctattaagttttaacaatgtaaataggttataaaaacctgattttttccccagtgtttgtgatagggttttttaaatttttaaattattcatattccttgcccttaaatgtttaagtaaaaatttttctgtattttgatttattccaccccaataacaaaatccctatttatgaaaaggtacttgagaatggatcatcgcaagaattcctttaaataaaacatttccctgctgcacttaaatataatttttcttatagaaatctgtagaattttacaaagacagtcccattgtttaaaataggcatattcttaattatgtgagttattttacatttatagaataactaaatattagagttaaggtagataaagcatcacagatgattaaggtttttaaatggagaacaaaacaacaaattattcctttagaaaagttaactttttaaacgtgagatttcattgctctgcatattctcgtaaagagaaaatttaaataaagaaaaaagagaattttaactagaacaatggaactattctcgctctttccaaagtagtcaatatctattgctgtaatccagaagaatagaaaaggcttgcctaaaacattaaaatagtttactgtgttagaatttgccaattgtattattttggcataatgctaattcttacgcttttcctacatataccatgaaaaaattcaacattactagtgaaataaaaaataatcaaaacatatcttaaaacttacagtctcatggtgatttgccaatgctatatatatatatatgttatatatatgttatatatatatataaaaccttttaaagattatacataatatttgtacatatcactggggtacatgtggtattttgatgcatgcatacaagtgtaatgatccaatcagggtatttaggatatccatcaccttgaccatttatcatttgtttgggaatatttcaaatctcttctggatatttttaaatattcagtatgctgttgttgccatacagtctactgtgctataaaacactagaactttttcttattttttctatctaactgttctatgtgcccattaaccaacctcctttcatcctccccagcgccccatactcttcccagctctagtaactatcattctactctctaccaatggttacatttcaaaacctttgctttacaaaatctttgttccgttgtttcctcataataagtattgtttctatattacattgatcaccatttagccagtgctttccatcctttatcctgacaaggcacaaacagaaaacagtagtattgtatagcaccttgatggtaaaggttgcttgtggccagagaggggttttagggttcttgccagccatcccaggctgagatattttcctgacaagtctcgcctgtctcagcctcaaagtagtcctggagagcctgttaaagtgtcagttttggtaatgatgcttcaggtttactcataagacggattaagaaagtattcatcactacttaatgctttgtgtcacttccatgtcctgactctatcctgaacagtgagaaaggtctgaatcaccaagagagtacaaatgtaaggagaattaaagtatgtagtcatgtttttaagagtctgctgatctgtggctcttaatttcgctaagggagaaacttccagcaaactctcctgtctgaacagcaatttatagcactagattagctgccattttaattaacattgacaatattatgattttatcaaagagaaagtcaaaacttattttctcttcctaaagacacttaaaagcatgaataatacagaaacaaaactttttttgtttaaatgatctaattagacttcagtttagatttaatgtaaaatctgggcattatagactatttatttatttttgagacttagtctcctctgtcgcccaggttggagtgcaatggtgcatcttggctcactgcaaactccgcctcctgggttcaagtgattctcctgcctcggcttccaagtagctgggattacaggtgcgtgccaccaagcccagctaattttttgtatttttagtgagatggggtttcaccgtgttggccaggatggtctccatctcctgaccttgtgatccactgccttgacctcccaaagtgctgggattataggcgtgagtcactgcgcccagcctagaccacttatttttagagactgtgtctcactacgtcgcccaggctagactcaaactcctgggtcaagtaatcttcccacctcagcttctcgaggactttaggtgtacaccattgtgcctagttgaacattatttttatttagtataaaagatcttgcagactttagagatcatcttgcccgttccagttccagatggcaaaactaaggttcagagaggataggtcactttaaaggtaaatatattattgtgggagccaccatctcctgatctcttatctaagctggattattaccactcattttatagatggggaaaatgaggctgaggtcagtattatcttccatgtaaaacagttctcagtggcagaatgtactttctaatttataattcattatgcttactttagttgtattcgagtctactgccaatctcacatagctaggagtagccaagccctttcatcctgcagctgctcctgcctgtgtggaggccttattgacttcaaaggaactctatctagggaaaagatagtctaacattttggcttcaagagcgaactacaacaaatttttctccctttctgttcatagtgtttttcgtttttttttttttaattcctcaaagaattgaaactaaagttttacatgctatttacatccctaaaaatgtttggtctttatgtaaagtatagtctaaacaaaaaccaattgagctaaaacctaatttcctttcctactagttgaaattttaaaaacgttacttaagatattattgaattgtggttccattataataaagtttctctgtgggtgaagagaattgaaaattttattagaaatatttatgttctatattgagtcttgtctacacaatttaattactttgcacttgggtacattttaggttattaatttttaaagtgaacaaagtgattggcctatgatctttttagagatggaagagacctttatccttacttgtttcaatccttttactttacatgtaagaaaactcagggtcagattgattaggagacttgtctaaggtcaccagccagtaagtgagaaataaggacccaactttttaaacccctggttacatgcacatgccatgtcatgctacgccatccaatgagaaagatttcaacacttttgcaaatttcgaaaaggtctttggatgaaaacttaaatgtgatcattcattacagtaaatgtggtcatatgtaagcaaactagctagttccccacctgcctgagtacagtgggtttaaccaacccaaacgcaattcaactcattttattagtttcacacatctcttacattaaggttatgtggaatgtttttactaaacaaatttggactgatctagtgattcttaaataatcttcactgacaatattattttatcaaagtaaaaattatttttctcttcctaaagacacttaaaagcatgcgtaatacagaagtaaaactttggttttttttgtgttaaacaatctaataagacttcagtttagatttaacgtaagctttgtttacctttcctggggcattcctgtaaaccagcattttcatttgcttttctacgcccagtttaatacgagattgtacattattgtatggagtttgcctgtaaccctgggtttgaagttgtgtttggctgaaatcagtctgtttttgagggtttcattttgtttttcaagctcatgaacttctcttgcagctgctcaatcatttcttccatttccacatctcgtcccagccgcttgggccgccaccaacccgctcatatcttttcttgtcattaactagccgtattaacttggtggcattctggggaaataataaaaagatgaaaaggaatgtgagaagtcagcataaaatccatttgttgaaaggaacataatcactgtgaagacttcagtgcagaacctgaataataaatttcggttttgatgtaactattactgcctgtgaagaatcctttgatgataattgaaaccactggcaacaatctgctttatagcactgacaaataacagtttcctaaggcttatcatttaaggtagtaaagagaggacacatatttactccatatgttcctgaaacgcaatttttaacgcataccttatataggaatgctgtacgcacttaagtgtagttacagattgtggatgtggtgggtatatctgcaatccacagtaagttaaaacttttgaaaagtgtgttaagactgtgcagcattaggtaatatattgttttcagtttctccaggattaagacacactataaatataaaaatttagaatgcataaatgcacacatataaagcccaatgaaaaattcaaaagaaaccaaaatcaccaataaatgttgcttagtgctcaagaaacacttgtgtttaatggtaaaaaataattgatgcaaaagtatcattttaatgctatctttaaatttggacataaattgtgcttttgactctcaggagtttatacctttgattcttttaagttttgataaaaactggttagaaagaacaaagacagaaagggcacatgggggtgatgtaatatacacgtacggaaaacatgcctgacgtgaatggaaaaatcttggcaggacaagaaagaaaaggtggctttgatgagagacacaattcaagactttacaaaattggtcgcacatcttcaatagctgattctagtttatagtgaactatttttataaagacccagacaggagattgaaaataaaaacacacttcatttttctttaatgggttttgctttattttagcgtggttatggacagaagcttttacttaagggaacaaagtgaaataaaaaaacctttaatagctttgggatgtcatagaacaaccttttttctgcctaagcagagtccgctgtaaatgcggtagtaatacatgtctatccacactctggctactcgcctacagcatgtggcatcagggagagctatgcataacataatcagttaagattgtttttctttcccttgaggcacatccattaagcatgctttataaaggatacaggataataaaaacaagatccaagagtaccacaaacactctagtaaaataatcaatggattagttccttttcacctaattccgagaatgatatatcactgggaaatttggccaggtatcacagtccaagaggccacacactctacctggccctttaatgagtttagggtcctaagccccacccaatggccgtgcacaaaagtaaggttgtcatatgaatgagacgtcaacctaaatatctgaattttctttacagagagactttcacacagagatgtagattacattcaaaagaaagacacagatttatataaaaaggcagttaacacccaggtaaaaataaatgaccctaatttttaaggcagggttctttaaattcttcaaatgatattcaaataaactttgtcaagaaacatgattgcatctgttgtctcgtaatagccatacattccatttgctggatttgattattttatcatattaatgatcatacgtgatctggcaaagtctgagtgcttatttaaaaaggtagttttggctagacgggtggctcatggctgtaatcccaacactttgggaggccaaggcagacggatcacctgagtctggagttcatttgagaccagcctggccaacatggtgaaaccccgtctctactaaaactaaaaattagccaggtatggtggcaggcgcctgtgatcccagctactcgggaggctgagcaggagaatcacttgaacccgggaggcgaaggttgcagtgagccgagatcttaccactgactccagcctgggcaacaaagacttcctctcaaaaaaaaaaaaaaaaaaaattaaaaaaaaaaaggtagtttataaaatctacatttatagaaaataaactatttacttttttgttttttttgttttttagacagagtttcgctcttattgcccaagctcagtccaatggcgcgatctggctctgcaacctctgcctcccgggttcaagcaattttcctgcctcaacctccgagtactaggattacaggcttgtgccaccatgcccagctaattttttgtatttttagtagaaatgggtttcatcatgttagccaggctggtcttgaactcctgacctcaagtgatccgcccgctcagcctcccaaagtgctgggattacaggcgtgagccactgtgcctggcctatttactttaaaagataaatttaaagacagttctacccatgtatctaggtcacagtcagtggtgtgaatcgagaggcatttagagcttttgggtcatagtgttcattggatcattattctcgtagcaaagtaaaacgaactttcaggaggttaaatggcttgaacatacataccacaggctagtgcagagagataacagaatgcatacatacaacttgattcctagctcagtccttttcccattaactacatggctcattattcagttgttttttattttctggctatgacaaattactaatgggtcaaggatgtgaattcgattcttttactgaccaattaggcttacaaagaaaaaaattttaggtggtcatagcagactacatgcctcattctgactggctgatgtgtgtgggataatgtcagaaaaggaatcaggcaagtgagtcacaaatcttgaaaacagccatcatcatgactaaacccaactcaaagtaaaaggcctgcacatagcatgccagtgggttgttgaagtccacgagtagaaactgaactggaaccacctccttaggatggattctaagcagaaaaaccctatttcattcttcaatggttgtctcaccttttctttgaacctagaacataaatatgaatacaacctgctcatgattacacatctgaacacactttgtttttaatgccttcccctcagaaaaaggcacagcatttctgaataaaaaagaatgaaagagtatctactcttaagaaatcattttgccaagattttttgcacataaatcaaaagtgacaatactgtttcttcagaaacagtaggactctttgaaatcaatatagaatctagtataacccaagcaaagttaaatatgttccaggactgaagtgatgttttcattagtaaaccccaaatcttaagggaatgtgcattctaacagttagaatagttagttactttttaaaactttcattttaaaatcaagacatttaaaaaacgatgctttggccatttgcttattaaactataaatattaaaccaaaagttatttataggttgatatactaacggcactctattagcttttttcatttaaatagcaaattcagacataataacactcataatctttttggtttattattctagtttgcaagattttccatttttaaaaatgtacttatttacatcctgccttgttccaaacaagattcaaggtggggtattca

SEQ ID NO: 5045 - DNA, 24624 bp, Homo sapiens
tagaatataacagctccctctgggagaccaaaggagagaaaagacaggctaagcctgacgagtgtggctctttctccaacctacgcaatttcctatgaggatttccctttgtaagatttctttccacacaatagctgtccccagattcctcagccatcatgcgcatggctggggatgtgcatcattcttgggcatacctaggacacctgtccatcccctggtggatcttggttcagattttgttgctggtatgttccacataaatcagaagaaaagaaggtgcagggtcatcaaaactcttctgtttattgcgtcagactggagtcaatgtctttccctttataatcaagaggggctcaggagggttgtgaaatgatatttggcaggaaatcaagggaagtgaatattctaacggaaccaccctgacctttatgctttatgagatattcatataaagggaccatggcaaagaaaaatcattttattcatcaaactctagttgagcagagcttgtgttgcagggtgaattatacactgtgaacaaaggtcattttggggaagatcccaggttggatgttgaactagaaaaaaatattagtgggacaactggtaaaatttgaacaagacttgtagattagttgattatatgtgtcactgttagtttcctgtcttaaagattattctatgtttatgtaaggtgttaacatgtgggaagctgcgtaaagggtatatgggaattctgggcaccatttttacaactttaagtcaaaatcatttcaaataaaaagggttaaaaagtcaaattataggctgacaattattttctttggcattttgaaactatttcccactgtgttttggttgctattgagaagtctgagcttacctaataccaattccttcacagatatttcttctgttttttgtcgttttaaaaatctttcgcctcaaaggcacttaaaagatactactatgtttttaggtgacatctgcttgggtgatctttgtggaattcatgtatttgaggattagcatttttcattaattccgaaaatttcggtcttgtctcttcaactattgcctttcctccattcccttttatttgttcttctgcaactctgtcacatgcattttaacttcctcactttgttctccatgtccctgaatatctctgttgatttccatctcactgtttttctgtgctgcattctgagtagtttcttcgaatctgtcttctaatcaataaatgcttttcagctgtgtataaattacttttcaacaaatcctttgagtttctatttctattattttagtttttatatttctaagttttgtttggttcttgtgcaaatatgccaatcaaatttaatacactattgttcctttatttatttatttatttatttatttatttatttttgagatggagtctcgacctgtcacccaggctagagtgtagtggcatgatctcagctactgcaacctctgtctcttgggttcaagagattctcctgcctcagcctcctgagtagctagattacaggcacccatcaccacacctggctaatttttgtatttttagtggagatgggtttcaccatgttggccaggctggtcttgaactcctgacctcaggcaatctgctcacctcacctcccaaagtgctgggattacaggcatgaggcactgcgcccggcctattcctttgttaaacttaattttttctttctttatcttgaaatttactaaatacactaatacattcttttttttttattgagacagagttactctgttgcccaggctggagtgcagtggtgcgatctcggtcactgcaacctctacctgccaggtttaagccattctcctgccttagactcccaagtggtgggattacagatgcccgccactatgccttgctaatttttgtatttttagtagaaaccggttctaccatgttggccaggctggtctctaactcctgtcctcagtgatacacctgcctcgcctcccaaagtgtactaaatacattcttttttattctctattcaattacaatatctgcgttttgttgctctggcttatcgtttattatctggcaacttttgcacattgtggcttattatttgtgtgtattctttgattttgtattatgacctgatattccttggaactttatcaaattggaaattctttgagaactatgtaaaaagtgtttccctttgaggggtgtttttatttgttttgttaggtgcatgggagcactaccaagccagaattgcttaaaatgaaattttctactgaggtttttttttttttttcttgccgcatggatagtgagaatttcagcccaaaacaatatgcttctccacttaagattagaaattatcaatgactttttttcctccctgctttacttgggccaaagccaaaaacaggcatgtgtagccccatcatttacgtctgcaaggagtttgtctccagtttaacctctgaatgggtcctggttttatgtgagttctatgatacaatgtacccgtgcaggccccagactttgtcttccatctccttcataatgtaatgtagtccatgagaagtgatgtagatcaccaacacaaatgaacacatgcttattctggtggattttcactttccgtcatttctggacttcagggaattccttactctcttataaatgcagctgtgcatttaaaaatatgttttgcagattatatagcatttttcattgtgatacacaggctttttgttctgttatatctggtctaccataatgcttgtaaggaaacacatttaatcttctgtgaggtataattattattcccaggttttatgtaggaatatcttagggtcacagaggttaggtgatttttccaacactgtagagatactaagtggtggaggtgaggttgaaataggtctaaacccaaagcaaggcacttttaaaagattaataaagtttgtcgaatgatacttggactaactcctgccgaattaagctagaaattaatataagttctttaattcagttaggaagatcccaaatcagaacaaatcataataaaaattgagatcaggaagcttcctgagtgtagctcctcatatcacttcccacacataagtactgccccatatggcaatcgggaggccccaggaatgcttgctaggtcaggccctgctcctctaagttagttgaaagctccctccctactcagtgactgctctcaacttcttcactgtagctgttggctctcagaacatgatgcccaaagtatagcgcctcggttgctgagtactttgaactgaaagacattggaagggcctccgaagaaagatctctttgacttctcctgccctcttgtctttcatgcttctttctcccctggagtgaaccatggaaactaaattcctcttccgcaagacaatgatagaaactagaagccctttccccaaagcaagccataaacttaggaaggtcactctctcccttctcccttctcatttgaagacccttaatccagagaatcctgccccatacttgcaaagaagaaatgctacacagagagtccaagaagaatttgacccagtctattaccattagatcatactcttgtccaaacacatctctacagagctgcccttcttcatggaacctaagcacaaaaacagttttccctggatctttgggtcttcatttctaaggctctcatatcacataaaactttgattaagtaaatttgttatgcttttctcttgttacttgtcttttgttataggagtgtcagccatgactcttacaatgagtaaggagaggtatacctacctccttttacccctacatgctcttggagctgattatcacagtttgtaatttttcaccttccattcctgcttctgtgtattttgataaatttttgcaggtcagtagacttccctggcagaatatttcctgcttctcaccagcccttaagccaatccaaggaaaacaaaagaaatcataatgctttgtcatatgacaagattacaaaagcagcatccagtggcagaatgcccactgctccgggacacagccaatagctgacttcagtgctccccatccctgcttgtcagtgttagtctaaattgttatcacaagcccagtctgaccaatgaatgtgagtgaggggccatttgattgtcagctcctgattctgcagaaaacacgaaactgagctgtacaaagatgctgataggggctgcagcatgcaattcacttcaccagcagtcactaaggtctgatctcttttctaccatacctggaagatggaatgctggacccagggtatgcatagaaaatgggagttattagaaagcagctttgcttgctttaacccaggaattgtatttctggtatgttgtttccttttaacaattgccctaaaggttcttttgtttaaggagcaggaggatgggggaggttatttctgtctcagcaaaagtcttagaaccagggtctcctcgtttgtaaggaagcaagtaggtccctgacctgggctgggatatgatttgtgatcagccaggcaagagttaagagtggaagtctgtctctctgcccatcttataatatcttaagggtgatcatctgtggtattcttgagtggtattcccattccatctagcatttcattagaattattgtataaaggatgacaggcagaggacattgacatgggaatgctggacctattggatgtttattcattagctgcagttaccccccatagccttttttaatacaaagtaaaaatttagttgacatgtaaaaattgtatatatttatgtgtatagcatgttttaatatatgtatacattgtggaacggctaaatcaaattatttaactatgcattacctcagctacttacctttctttttgtagtgagaacacaaaatctactctccagcaattttcacgtatgcaacatatcattattaactatagtcaccatgatgtactatgtagcctcttaatacggtataatgccttggcaaaacccaaaatccctagcaggtctggattttgagtttggaaatggtccaaggtgcatatactatgtctgtgaataccagagggcaacctttatgggttcctggtgtagggtctatattctaaattctgagagatgaactcctttaggccacagtctttctgccacttatgaacctacaagcaagtttccaggtgttaaatcagctgggaatcatttcagaatttatttcaaatattacattaattcctaggggataaggaatttaaaggaaagtgttcaaatgatcatcttatacatttatatacttttacctttctgtttaccctttgtgactagatattacattcatgagtgaattaaaaatgaactgcagaagttaatccaagagtccatggaggctattcccccatgtgtttaagagacctttgctgtccaggtctgctttaacctgaacaaaatggagctcaccgtgtcagatgctggcagtttgaaagggactgtgtagacctggatggatctctgcccttttgaccagcctcacactgatgtccctcacacttgtcagggaggcatttgcccagatattcctgggcttacagcaaccctgtctacagcagcgctgctaactgggcatggggcttagttggggctcctaggctggaaagacagtcatagttctataatgtaaggataggctgccttcagggggagggtgttcattctaagggaggggctcaatgaacatgtcgagaatagtatggtacggcttagcaattacccactgttcctagtagggaaattttgggaattaatattactgttatagtcccatacacaaaccacacaattacctcattctaacagagttgaaatgtttggatttattgtagcattactatcaggaatacacattattatggtattgctatcaagaatacatataaatacatgcctgaagctataagtgagatagagatattccagggttagtcaaaagttaatctttgagttccagaagtctggatgaaaatagatgagactgcaaattttgttgttaggcagtcaccatttatgacccttggcagggaggcaggaatggtggttatattgtgaactgaatgaaaactgagaactaatcagcatcatgtggcctgaagcatttattgctaccagtgattagttgtaagaccttcggactatgtaactgtatgaactataatgaacatgagaaaacaactcttttttttttttttttttttttttgagaggagtcttgctctgttgcccaggctggagtgcaggggcgcaatcttggctcactgcaactcttccttccaggttcacgccattctcctgcctcagcctcccaagtagctgggactacagtgccagccaccacgcctggctaattttttgtatttttagtagagacgggatttcactggttagccaggatggtctcaaactccagacctcgtgatccgcccacctcggcctcccaaatgctgggattacaggcatgagccactgcgcccggccaaaaaacaactctttaaaaatgtccttagagcaacatgcaaagcttccctgctcagcaatcccaggttggggccccctgtctcctatcctcctacccgtcacaaccaccactgcaggcttctgatgctctgttttcctccttgtctcagttcagttgctctgagttagagaggagctctctgggactggagctgactgcgcctggcccatttcctcactaccatcctcaagctcagatgctgacaggaaaatactgccttgcctgaaggggcatcccttagcaggcggcccagttccttctcataacatttggctgctgcagcagatctccattctgcttatgaattaatccttgaagataccaataatttggtgcatttgtggaagcagattttcagatacattctgtggttggtctttgatctcttccttgtcattgattttttgcttatggacaaaccctctaaaccatgttgcacagcagtgtcttcagactcccattatatttctgaaggttgcagtagcgctgatgggattgttgcttttcagcatcaggacttccttattgaatggtgtctgataacattccgtctccaggaactcagcgagatcgagtatgcattcagaggattcagtcccttctcaagagctttattcgaatagtccatagcaattgctttagtgcttcaatcatctctttatttccactagcttcagattctcctgtattcgcatttgtcttacttttgccttgtagcagcacccaatctggtgatagaggtagccattgttggtgtggattccaacacccgttgaaacagttcaatagctttgtctaggtcaccttttttctgtaaaatttggctgcactgcggaggacatctgtttggcaaggagacttttccaagcttcttcaacaaactgctctccttcagcttctttattcatcttctgcagtttcaggcccagagaaccttgacgtattggttatcaggactcagctcaatggcctgcttcaaaacatcatagagaactgtttctctgggtgattatccagatggtacatcgcaattgccagtccagagagaattctgggttgttgggcttttcttccagagccttctcaaaacacaccttcgcccttcatttcttccacacttcagttgtgtccacccttcctcacagtcaagttcagaatactcatactgtatggatttgaaaatttcttgcaggtttgtttcaccttatctacataaatctgacatctgagagtctgcccaagtgatagtagacccaggcgtagtttccccaagtgactagattctgatttctgcttggtcagcatgttcttgctggattaactcttcagcttgccgtaagattccagggctgcctcgttgttaccatctaggtgttttatgtaggccaacaagttgtacttgtagctttgaactcagtgtttaaaaattcaatctggttacacactctatcttctagacccttgagacactgtcttccttgaataagttccaggtgaaatggcatttcagctgtggaggattttctccagggaattcttggtgacctcactgtggagaaaataaacatggtcactggatgtacactgccaagcactgcaccctgtgatcattaattttatatgtcaattgaactggccacaggatgcccagatatttggtccaacattatttctgggtatgtatgtgaggttgttctggaagacatgaacatgtgaattggtggactgagtagagcagattgctctccccagttgggtgggcgttatccattctgttgagggccttaatagaacaaaaaggcagaggaaggggaattctccctctgaccgactgcttgagctaggacattggtctttttctgcccttagacagacttggactagaactttcaccattggcttacctggttctcagacttttagacttggatgggactacaccatcaactttccttggtctccagcttgcagacaacagattatgggactgccagtctccataatcaggtgagccaattcctcataataaatctctttatatatagatgtccttgacttatgatggggttatatcctgataaacccatcataaattgaaaacattgtaataaaaagatgcatttaatacatctaacctaccatagcttagcctagcttaaatgtgctagaacccttacattagcctacagtggggcaaagtcacctaacacaaagcctattttatataaagtgttgagtatctcatgtaacttattgaatactgtattttaagtgaaaaacaagatggaattatcacttttgtaccatcacaaggttggaaaaattgtaagttgcttcctacatcacttttctttagctacagtctgtgcagacacccacaaagcacatcccttacaccgtgtagcagatatgcaggaggtgaggtaagatgggtaagaggaggcagcttcagtgacaggaatgagatctctctcacgctgctcaattaccaagtcagccaggaatggtgactcatgcctgagtcctagcactttgggaggccaaggcgggtggatcacctgagcccaggattcaagaccgcctgggcaacatggcgaaagcctgcctctactaaaaatacaaaaattagccagggatgtagtacatgcctgtagtcctcgccattcgggaggctgagacaggaggatcacttgagccaggaggcaaaagttgtagtgagctgagatcacaccattacactccagccagggtgataggtgggaccctgcctcaaaaaaaataaaagtaagaataaaaattaaaaaataccaagtcattctcattccttgtacattctgggtaaggtttgtttagctatcccatgactctttattgggtacctctttttgtcactttattagatattatggatactaagaaaaatagagattatccaaccttctctgcccgccaggtgctttcagttttgttaggagacatgtaaagaaataaagcccagatatgtctgccaacatgttatgtgatttaggtatttttcccttcatcttttccccacttacaaacagacccacggaggctcagcttgagtctgactgaagtagtctccccacacacaggccagattcccagacagaatgaatttgttgcaacaaacaaacaaaatggactctttttgttttgtagttggaagatactaaaggagatcacttgccttatttagctggataattgcaagagttctctaagtgtgttcccattatctacatttgcctggggcttgggctgtagtccctcactcttgagtttgtgcttcttccttcttaccagtggagtcacggcaccataaattggaaagaacctccagaaatcattaaaccaagtgtccttatttttggatttcacagaaagcacaatttcagaaaaaaagttatgaaccaaatagggctgctaatgtatctgaaaagtaccaaccatctattctgaccaatattttattttaaaagatagaaaagaaagaattttcttgccactgaaaaagtaatctcagaataaacaaaattctttaaattgaatgcattttgtctacaaggagccattgactttatttgcaatttaccatggacgagcactggccctcacacgctactgcaagtgtactgatctattatacttcctgtctgtctctccagtaatgctgatcaaaccatttttggcccaatatgattgcacatgaaatgctttatagtgagagatgcagaacaactcaagggcaatgggagtgaggagggaagttgccatctacatccggctagcctcttatgtgtgtgctttgatttggggacagtccttttccttttcttggtccctgtctagggttcagtgtcaatatcttccctgtctattatagggtccttcctttcttccttccttctttcctccctccctctcttcctccctccctattttccttctttcctcccttccttccttccttcctccctccctcccttcctccctccctattttccttctttcctcccttccttccttttttgcagagacagggtctcactatattgcccagagtggtctcaaactcctggtctcaagcaaccttctgcctcgacataccaaagtgttgggattacaggtgtgaaccaccacacctggcctaggggttttcaatttggctttacctgggtattctaactaccctgtatgaaggactacagtcaaaagtcaagttagcaattatttaaaaaatgaataccaaaagtaagttataacgatataattgaacaactctgcttatatctgttatgccactaaatcataataaagtcatggaacatgagttaactttgctgatgtgtgaattaggaaggttaaaaggagaaagtgtgagtctagatcaatagaatgtatctgcagatttgtaggtacatatgggtgcctgaaaaaaatagcgaacactctagtaattaatagagagtatccagtggacctgcaggatgacaggtgatgttgatgtattgttggatgtatttgcctcaacgaaaccggaaaccaccttgcaagtctgatgcactatctctctctcttttttttttttttttggagggcagaaggctttgacatatcaatcaccagggatcttaccaaactaaattttaagcacttatagctcaagattctccctctgaatgaaacatacttccaccctgtcatgtgtcagcttcagaagatatcaattgctcaagaagtgttggacaagcagaaaagcacactgaacatttctggacttgtgaaagagctctgaattggatctctcagggatattccatccccaccaatgctttaccaatgcgagagctggccagctgagacatttaatgataacatggaacaatttattcaggaagatagtcaactactcatgggctttatgattataaaacccactgaaaattgggtcccttgattctcttgatttttcctagccttactccctaaagtctccaatttgatgaggtatttgatacttgatctctccttgagtaaaatttggagcaaaatatattggactggaaggcctgagacctcgataagaagaaactgaaccccagagccacaggtcaggaggttttcattataatactattgccctcttaaaacaatactccaattgccaaggtttcctcacttaataatttatctcatatgtgtttttgaaattactctgaatacttcttatatgtataaataagttagttaacagtaattaatgcagatattaaataaatacaagcaggcaggtgggatgatgactacagtcacttgataaagaacagcaggtggccgggcgcggtggctcacacctgtaatcccagcattttgggaggctgaggcggtggatcatgaggtcaagagttcgagactagcctggccaacatgatgaaaccccgcctgtctaaaaacacaaaaattagccgggcgtggtggcaggcgcctgtaatcccagctactcggaagccgaggcagaattgcttgaaaccggaaggcggaggttgcagtgagccaagatcgggcactacactccagcctgggcgaaagagcaaaactccgtctcaaaaaaaaaaaaaaaaaaaaaaaaaaaaaaaagaataaaagaaaaagaagaaaaaacagaatagctaggttcaggtgaacttggggagtagaatgccagtcctacctggatctgcatctagtagaagaccttaggggataggattccctcaggtccagaaagagatttcccatgacctcggattgcagacataagtttcgcttactaaagcagttaaagctagtgctgctagtccttaggaaatccccagaatcacatagttacagtctctcacctaacccagatcatgaccacctgtcttgcccacagactcagggtagataccacatctccttcccagtcaaagctattactagagtagaatcttgaaatttcagaaagtggctttcttgaagtggtaagagtggggatttccccactcttgtctgcactgtgcagcttgtccccagcatgtgctggttatgctccaactgactacgtgaaggaactgcagacctgtgctcagttggttggtcagaacaggcccaatccaaggagtccatcacttcaaaagcaagtgaaggaactctccagagccggacttctcaacctttaatgtacatatggaccaaacatctggagatctttttaaaatgcagatctggattcagataagctgggatgttactttcttacaacctcccgggggatctcagcttcagaccacactgtgagcagcaaggctctggaagacttccctttttggcagtgatttccaatcaccagtttctcatacttaaattacctttaaacagtcaaactttgctttatttttattttatttttgtttttttgtaggtctcacttgttgccaattctggtctggagcccctgggctcaagcaatcctcttgcctcagcctccaaagtgctgggattacaggcttagccactgtgcccagaaacaagctttgctttatttcacattcttcccacccctcccccctcctgcctcttggggtttcctccttcacatttacacaatacaatgcaggaagccttgtatgcatttaaggaagagaggatttggagatggacatttttctgtaagccattcagtatgcctatgaagtacttgtggtcctctttaaatatatgttttttctggaccttatttctgttttactcaatcaggatttcagaatgcaggacctagaaattgcattctattagaagactcaggttgatatgattcaggccactcgcagaacacagtttggagactgcaagcaacaccttctccctgttcattgatcacgtgggaggcttagcaggtcatagacctgctagaggacaactcaagtagacatatcccccaattatgaaaaagtgcatttaaggtaaaagtgacctcaacataaattggaattttgcagtgctgaattaattattgacaatttgctgagaagcaagcatggtttaaaaataaccacagtcacaacaaaaccacaaaccctgacttaggctttctaaatataagaaacaaaagacgaaccagaacctccagtaacttcctccaggccccagctttcactggcccgattttacctgaaagcatctgagcatgggctcttaggatctctcaatatgccccgtcccttcccagctcccagctcccatttccctgtgtccttggctgcctaactctatacatcacaaagagctacagaaataaaaatgcatgaattggtaggcagatttatgcttgaattagataaatgcatatttcatctctaagcaaacactgaaaagcataagtcaggaagttgtacataagaaattctgtttcctatcagagaagcagggacttttacctcatgatggctgtttccctgcagttctgaaaagctggggtcccggttgatttttttttagcttactgattccaagcaaatgctgaagaggtttccacccagggtgctgttagtctgtgcttttatgaaaggggaaaggaaagtgaaactgatggaaccctatcaagatccccttgaggggaaactgaaacagaatctgtgagaactgagctcactcacgccaggaacatgtccagacagatttggaaaactgtggtttgaaagttgtaaaaaggcactgtaaaaagaaataaaattttagaagcttccaaatgtgttatgtcaagaggcaaagttaagccctgaaaacgactcacgtaacgtgactgttttttttctcaggtgcatgactgttgctctttgacctgttggtgaggggttacatgttaaccagactccctagtctcactgcaatttctgcctctcggttcaagtgattctcctgcctcagcctcctgagtagctgggattacaggcgtgcaccacctgcctggataatttttgtatttttagtagaggcggggtttcaccatgttggtcaggctgtctcgaactcctgacctcatgatctgcccgccttggcctcccaaagtgctgggattataccttgcaccaccgtgcccggcctcagacaacctagtctttattaaaacgtagacctcatttatggaaatagagacccttttgattgttacttttttttttttttttttttttgagacagatctcactctgtcatccaggctggagtgcagtagcacgatctcagcttactgcaaccttgcctcccaggctcaagcgatcctcccatctcagcctctccagtcaatgagactataggacgtgccaccacgcctggctgatttttgtatttttagtacagacggggtctcactatgtgcccaggctggtctccaactcctgagctcaagcatctgccctcctcggcctcccaaagtttgggcttatgggtgtgagccactgcggccagccatgttacctctttacaaaagaatataagcaattcccttggactgtaatcaatagtagccaatcaaattgtatatctgtatgttacctctgtatggaaaatgttggccaggcacggaggctcacgcctgtaatctcagcactttggaggccaaggtgggtgcatcacttaaggtcaggagttcaagaccaacctgaccaacatgcaaaaccccattgctactaaaatacaaaaaaattaaccaggcatagtggcgtgctccttagtcccagctacttgggaggctgggtgggagaatcccttgagcccaggagtctgaggcgcagtgagccatgatcgggccactgcactccagcctgggtgacagagtgagactctgtccaaaaacaacaacagcaacaacaaaaacaacaacaacaagagaagttgtcattctgttgacacctctgtctttgcctatgtaaacagtcctcatttttctctacactggaagtactgtcaccattcttgggtgcagctctactcctgggactgctgccctcaactttttgttgaataactcttttaactggatcctgagccttctgattattgtatattgacagtactgactatgcgtcctactcccagagattctggtgcagtgaatctgatgtgagcttagaaacctgtgtttcacaagtgccttggaaattcagtgcaggagttcctgtaccacattttgagaagtgctgtatagaggtattttaaaaagcagttttcccctttatttatggagctaatgtggtgaattagcagcattatcaggcatcttgagtgaagggaagaaaaccacaggacacctggatttcaggacctctttgcttagttctgggatatttcttgagtcatatcactgagcctcattccctttccttaaaatgccctaggatgaatttccttttcccttcatccaaatgatagaaaattatccctggggagaaccactttcacccttctccaagatctgggttcagttcttgtggctttgccactctaaggcatgggtaaccatcaaaggctggcccttactctccagataggaagccctccctggccccctctctaaagtgagcatagttgaaagcattaagatctttcaccttttgccattgggcatagagtcagatgatcagcagtagagtttggtgcctccattaatgactctctctgacacctgctctctatctgatgtcttgggcaagtaatttgcccttctaagccccatttggtcatctagaaaatgaggctaataatagaaataatagctcttacttcctagggctttggaagggtgatatgaggtcatgcgtaaaacgtgtttaacacagtgcccacttgtcagcctctgagcccaagctaagccatcatatcctgtgacctgcatgtacacatccagatggcagttcctgccttaactgatgacattccaccacaaaagaagtgaaaatggcctgttcctgcttaaccgatgacattatcttgtgaaattccttctcctggctcatcctggctcaaaagccccctactgagcaccttgtgacccccacacctgcccaccagagaacaacccccctttgaagtaattttcctttacctacccaaatcttataaaatggccccacccctatctcccttcctgactttcttttcggactcagcccacctgcacccaggtgaaataaacagccttgttgctacacaaagcctgtttggtggtctcttcacacggacttgcatgaaaccactaactacagacacaaagaaatgttaccaccatgattgctggtactaatatatttgtgttataattttaatgaatttgtgagtgtgtaaagggagcaacagagttcctcagtggatggggcagaggaggtgcccatcagctggcacgtgccagtgagttctccaggtgattttcccatttggaaattttagcacaactggggaggagcagcccaatctcttcctgttcctatagcctctggaaatagagcaccttgatgtgaacctgagtccagcatagttcagagagcccccctcagacctcctcggtcagtggctatagacacacctaaagacaggaccctgtaaaacctttcctgcaagctgctactaagacgccttgctctctggtcaatcccactcacacagacacaattaacatcactttgaccaggaacttattctatataaaagggtattctatatactgaggtatttggcagtgattcctcttacccatctcatccccaaacatgacattgcagagcatcttcaagtccttgggcagagtaaggtagggaatccagttttccttttctgcccccctgaatggtcgatggggtttccctccctggcaatcacctcctcactcctttcctagagatgcttggtgggaaaggcaccttttctcttagttctccctaacatgctatcccctgaagaactccaggaggacaatattaaatttaaaaatcaagtttactgagattatgctttatatacaataagatgcacccatttcagtgtatagtctgatgagttttggtaaatgtttatgcatatgtagccaccatcactactccctatagactattcctatgattctaaaaagattcttttgggagccttcctactcaaccccaccatctccaggcaaccactgatctgcttcccaccattagagattagactagtttagataatagattaggtcattacacttttgaggagaaattctttttttgctgctgaccagattcactacatcaataaaaataaatgctaagctttgggtttgtttttatataagaaatgcaaaaatgcccatttgtaagaattgtttcttccacttcccaccttaaagtaatgcaacgttcagggcaaaattgccttcttcatgagtgggtttgcagtactgattgtatctttcacatatctgttgaaaataaattcctccttttaaaattacaagaaaaaaagcctgtgacttaacttttcaaacaaaatgacaataacagaaaaacccaaaagagtaattcccttaggtctaccttgaatcagccaagtttgtggctgagtgaaatacaccgctcctgccaagccttcctctattgcaggaaatagctgcacacagggaggaaacatgagctgatgcattccccaccctgctccccccatgtagttccgtagggaaccattccagaaacttaagaagcctgtgtgtacacaaaaaaagccacagggaaaaacccctcaaacatcttacaaatgctcagactgataaagaatattgaatctataaacatcaggacaattcaggaatgtgcctgcacagtaagaaactcacttacaatttgcactcaaaaacaagcatgattatgcattcttatttcactgacctcatgctgccctctgtgtctctgctgttccgaaaagctggtgaccaggctgatttgttcttcagagtcttcctgtctgcctcaagtaaatactgaaggaactatataaaggggtgggagagtaggcacgcatcagctgatgttttctccgtttttgagtaattgcttttaggggaaggaagagaaactggaaagtgaaactaatttaaaatcgttgggaggaggaaaatgaaacctaacggttgagacctgcaatggctgagccagagtacgttattcaaaactgtgactaaaatttgttgagagaatgtggaagcattcctaatgtaaaccaaaaaattaaattctaaggccatactcccaaccatgtgactggacccctgcttttggccaagggcattccaaagttaacctgaaaatgatgtgaaggggaagctggatatgcctcattacatcctttttccttttggaattactatagaacacactctttttttgtttttgtttttgtttttttttgagacagagtcttactctttgcccaggctggaatgcagtggcatgattgcgtctcactgcaacctctgcctcctgggtcaagtgattctcttgcctcagcctcccgagtagctgggattacaggcacccaccaccagcccggctaatatttgtatttttagtagagacgaggtttcgccatgttggtcaggctggcttgaactcctgatagcaggtgatccaaccaccttggcctcccaaagtgctgggattacggcatgagccactgcacccagccagaacatgctctttttaagtgtattaagaaacatttcaacctattctctctgaagcctgctacttggaggcttcatctgcataataaaaccttggctccacgacccagacattcctttctaatgattgtctattgaatttctattggatgtctcaaacattcctttctattgataataactctttcaacaaattgtcaatcagaaaatctttgatctgcctatgacttggaagctgccccgcttccctgtttccaattgtcccacctttctgacctagccaatgtacaccttacatgtattgattgatgccttatgtctccctaaaatgtaaaaaccaagttgtggcctggcacatgttctcaggatctcctgagggctgtgtcacaggcataggtcattcatatttggcttagaataaatctcttcaaatgttttacagagtttgacttttttgtcaacattaggtatctgaccatcagtctagggtggggcccaggaaacagcatttttaagccaattcttattatttttaaaaattttttgtggacacatagtagatatatatattatggggtacatgagatatttgatgcgagcatacaatgagtaataatcacatcagggtaatgacttcaagcatttattctttgtattacaaacaatccaattatactcttttagttatttgaaatgtgcaataaactattgttgactatagtcatcctcttgttctaacaaacactgatcttattaattctatctaagtatatttttgtacccattaaccatccccacttcccccctactactcttcccagcctctagtaatcatcattctaatctctatctccataagttcaatgtcttaatatttttagcttccacaaacaagtgagaatatgtaaaatttgtctttctgtcctggcttaattcacttataatgacctccacttctatccatgttgttgcaaatgacaggtctcattctttttatggctaaagagcactccgttgtgtaaatgtaccacattttctgtaccattcttctgctgatggacacttaggttgcttccaaatcttggctattgtgaatagtgtgcaataaacatgggagtgcagatatctctttgatgtactgatttcctttctttttgattattcctggcagtgggattactggatcatatggtagttctatttttagtcttttgaggacctccgaactgttatccatagtagttataatagtttacattcccaccaacagtgtacaaagtttccttttttccacatccttgccagcatttgttattgcctgtcttttggataaaagaattttaaccagggtaagatcatatctcattgtaggtttttttttaacttatattttattgcaggtatacacgtacaggtttgttatttaggtaaattgcatgtcatgaggctttagttacagattatttagtcaccccactcataagcatagtacatgataggtagtttttcagtctctctcttcacccattctttaccctcaagtaggccccagtgtctgttgttcccctcttttgtccataatgttcagttcccacttataagtgagaacatgcagtatttggttttctcttctgcattagtttacttaggataatggcctccagttccattcacattactgcaaaggacagatattcttttttttgtggctgcatagtagtccatggtgtatatgtaccacatttccctatcctgtcttctgttgatgggcatttaggttgagtccatgtctttgctattgtgaataggctatgatgaacatacttgaacatgtgtctttatggcagaatgatttatattcctttggtatgtacccaataataggattgctgggttgaatggtacttctattttaagttctttgagaattaccacattgctttccatagtgactgaactaatttacattctcaccagcagtttgtagtgttcccttttctctgtaacctcaccagcatctgttatttttgttgactttttaatatagtcattctgactggtatgacatgatatctcattgtggttttgatttgcatttttctatgattaatgatattgagtattttttcatattcttttttttagggtatctgaaggaagaatttattttctttttttattattatactttaatttcttgggtacatgtgcacaatgtgcagtttgttacataggtatacatgtgccatgttggttcatatgtttattgcggcactatttcaatagcaaagacttggaaccaacccaatagactgggtaaagaaaatgtggcacatatgaccatggaatacaatgcatccataaaaaaggatgagttgtgtcctttgcagggacatggtgaagctggaaaccatcattttcagcaaaatatcacaaaggacagaaaaccaaacaccaatattttttcatattcttattggccgcatgcatgtcttcttttaaaaagtgtctgttcagtcctttgcccactttttaatggagctgtttgcttttttgcttgttaatttgcttaagttcttatagattctcaatattagacctttggttatgcatagtttgcagatattttctccctctgtcagttgcttgtttactctgttgatagtttcttttgctatcagaagctctttagttaattaggtcccgtttgtcaatttttggttttgtcgtagttgcttttggtgtcttcatctgaaatctttgctggtttctatgttgagaatcgtatttcctaggttatcttccagggtttaatatttttaggttttacatttcatccatcttgagttgatttccatatatgatgtaagaaggggtccaatttcagtcttctatatatggctagccagttatcccagcaccctttattaacagggaatcatttccccattgcttgttcttgtcagctttgttgaagatcagatggcttaggtgtgtgcccttaagtttgggctctctattctgttccattggtctatgtgtctgttttgtaccagtaccatgcattttggttactatagccttgtagtatagttcaaagtcaggtacatgggctctctattctgttctattggtctatgtgtctgtttttgtaccagtaccatgtattttggttactgtagccttatagtatagttcaaagtcaggtaacatgatgcctccagtttgttctttttgcttaggattgctttgggtatttgagcactttttgttctataggaatttaaaataggtttttctaattctatgaagactgtcattggtagcttgttaggaatagcatgaatttgtaaattgctttgggtagtatggccattttagcaatatcgattcttcctatcatgagcatttccatttgtttgtgtcatctctgatttctttgaacaatgttttgtaattccattgtagagatctttcacctcctgcgttagctgtatttctaggtattttattcttttttggctattgtgaatgggattgtcttcctgatttggctctcggcttggattttgttagtgataggaatgctactcatttttgtatgttgattttgtatcctggaactttgctgaagctgttattagacctacgagcttttgggtagagacgtgggggttttctaggtatgcaatcaaatgtctgcaaagatagatagtttgacttcctctcttcctatctaggtgccttttatttcatctcttgcctgcttgctcatgctagcagtactctgttgaataggagtgctaagagtgggatccctgtatttttccagttctcaaggggaaatctttcagctttcgcccattcagtatgtgttgaccttgggtttatcatagatggctcttattatctggaggtatgttccttcaatactagtttgttgaggatttttaacattaatggatgttgaattttatcaaaagccttttcttatctattgagatgatcacgtggtttcagttttaagttctgcttatgtggtgaatcacattattgatttgtgtatgttgaaccaacagaaacaagaattttataaaggaatgggaaatagaatttggctgtgggacataaattggaagctctagcaggcatggcttgcctggctacagaggccagggtaggtggggttgcctaccttgcctgaatgtttcccaggacaacaggaggtgtgctctctggctgaattcagacagaagtggaaccactgggatggaagctctagcaaggttgcctgcctggcaaccagtggcaggggtagatgtagtcacctgtcttgccctccagggcttcctgggagaacaggaggctatggtcactggctgagttcagacagagaagtaggacagtaggctggaagctggcaccaagccccatccagaaagggtttgagatggggcaatcttctgctcctaggcactgggactgcagcctttattgggctatggcaccagtgctggtcttctgggggcacaaggcttgcagaagtctccttggactagagagttgccctccaaaatgtctgggggctctctgcctcagtctagaagcacggtggtggggtcgggggtgggcaggggtttaggggcattctcccatttccagtcttgcacaggtccctgtcgagagtgtgaatcccctaggggttctcactcactcaccctttccagtgttggagaaattctcctggatccacgctgacccggacaggctggtatctagcttcacccctttctgctctctgtaatccccttacatctgaaggatcccgaatccctgacatgatttctcagatgattggcctgcagggtcaatgctcctagcccttttgtttcctttccgtgatagcctggcacatgagttgcttctagtttaccacttaaccccgagctcgaaactgcattttttaaaattttactttaagttctaggatacattgcacaacacgcaggtttgttacatatgtatacttgtgccatgttggtgtgctgcacccttaactcgtcatttacattaggtatatctcctaatgctaaccctcctccctccccctacccatgacaggccccagtgtgtgatgctccccatcctgtgtccagttgttcttattgctcgttccgacttatgagtgagaacatgcggtgtttggttttctgtccttgcgatagtttgccagaatgatggtttccagctt

SEQ ID NO: 5046 - DNA, 100000 bp, Homo sapiens
gcaagaaggtaataatagcttacaacaacagccaaggaagttagagtcaggtgatgtttgttctctatagaaaccaaaaatagggtcttaagcgtgagctgcgggattctccttgcatgcaacccgcaaacaaatgccctcctttctcttgttgcaaaaccccactgtgggtgtttgctttactgggctgggcaagtggaccccagttttgttcagtagcagacaatgtgagcatgtacctctttatgcttaaattgcatgaaaatgtttttttggtgaaagtccttttgtccttttgtatacactttttccagttgaaagatctgcgtgagaatgggatataactgaacaaaatatatgattgctgaataggactctctgactttgtcgcaatggaaaaaaatagaaactcacccccagggaggcataaaggagaggaagtcattaacaatctttttgtttttcagaactgtcctggaagatttcccttctgtctgacggaaatcttcccacgctgtctttccaaactccacttaatgctttgaattcagattgctgagcctctgagcacaacagacagcactggggttgaggtggggatccactctggaactttccatccagaaaacctcagatgtcttcctcactctgtgtttggaactgatagcttgaaggcagttcctctgaaagcaaggacttcagtgtatttttggactggaatggaaaccttacggtggtaggccccaccatggaaggccacatggtggggttgtaaacctgtactgcctaaggcatgtcccgcttgggctgccatgcatgtcctctggattgtgctttgtgtctgtgtgtacctgactgtcatgacactgtctcagcccaggaagggatcaggtccactttactttcctggcctcagctgtgatgtgccaccaggttaaaagtttatatagacatgtacggaggaagctctctggacttctaagatagacctttataattaatcgatttgtttaagctggctaaattcaggatccttaaaagaggataaatactgaatgtattgaaaaaactgagatcaatactgacagagatcctagaaataataattttactataaagttccttgctaaggactaaggggatggaccatgcagagttagcatggcaagtttgaaactgtatctttagaaagacttgcttgcaaggttggcccttggctaacatcagggaacttggattttaagttttctagctattctataaatgatatgggtggcttactatgctaagactgtttagcaaatgatggagtttatgctaacacttgctttccttctcgaagtctggaattttggtaatgctaggcagagggtgcatacatgatcagtccccagtaaaacccttgggcacacagtcaactggcttcacatgtgttgtcacaatttgatgctggaggaattaagcacaacctgatgctctaccggccctcttggaaacctatacctgattttctttggacttggccccatgcacttttgtctgtgctaattttgctctgtatacttttgttataataaggcttagctgtgagtagaccatatgttgaatcctgctcatctttccagtgaatcatcaaatctaggggtagtcttgagaccctgatgtcaatttcctagaattctctttagaaaaaaacaatgcagcaggctatagaatataacagctccctctgggagaccaaaggagagaaaagacaggctaagcctgactagtgtggctctttctccaacctacgcaatttcctatgaggatttccctttgtaagatttctttccacacaatagctgtccccagattcctcagccatcatgcgcatggctggggatgtgcatcattcttgggcatacctaggacacctgtccatcccctggtggatcttggttcaggttttgttgctggtatgttccacataaatcagaagaaaagaaggtgcagggtcatcaaaactcttctgtttattgcgtcagactggagtcaatgtctttccctttataatcaagagggactcaggagggttgtgaaatgatatttggcaggaaatcaagggaagtgaatattctaacagaaccaccctgacctttatgctttatgagatattcatataaagggaccatggcaaagagaaatcattttattcatcaaactctagttgagcagagcttgtgttgcagggtgaattatgcactgtgaacaaaggtcattttggggaagatcccaggttggatgttgaactagaaaaagatattagtgggacaactggtaaaatttgaacaagacttgtagattagttgattatatgtgtcactgttagtttcctgtcttaaagattattctatgtttatgtaaggtgttaacatgagggaagctgcgtaaagggtatatgggaattctgggcaccatttttacaactttaagtctaaatcatttcaaataaaaagggttaaaaagtcaaattataggctgacaattattttctctggcattttgaaactatttcccactgtgttttggttgctattgagaagtctgagcttaactaataccaattccttcacagatatttcttctgttttttgtcgttttaaaaatctttctcctcaaaggcacttaaaagatactactatgtttttaggtgacatctgcttgggtgatctttgtggaattcatgtatttgaggattagcatttttcattaattccgaaaatttcggtcatgtctcttcaactattgcctttcctccattcccttttatttgttcttctgcaactctgacacatgcattttaacttcctcactttgttctccatgtccctgaatatctctgttgatttccatctcactgtttttctgtgctgcattctgagtagtttcttcgaatctgtcttctaaacaataaatgcttttcagctgtgtataaattacttttcaacaaatcctttgagtttctaattctattattttagtttttatatttctaagttttgtttggttcttgtgcaaatatgcctatcaaatttaatacactattgttcctttatttatttatttatttatttatttatttatttttgagatggagtctcgacctgtcacccaggctagagtgtagtggcatgatctcagctcctgcaacctctgtctcttgggttcaagagattctcctgcctcagcctcctgagtagctggattacaggcacccatcaccacacctggctaatttttgtatttttagtggagatgggtttcaccatgttggccaggctggtcttgaactcctgacctcaggcaatctgctcacctcagctcccaaagtgctgggattacaggcatgaggcactgcgcccggcctattcctttgttaaacttaattttttctttctttatcttgaaatttactaaatacactaatacattcttttttttttattgagacagagttactctgttgcccaggctggagtgcagtggtgcgatctcggccactgcaacctctacctgccaggtttaagccattctcctgccttagactcccaagtggcgggattacagatgcccgccactatgccttgctaatttttgtatttttagtagaaaccggttctaccatgttggccaggctggtctctaactcctgtcctcagtgatacacctgcctcgcctcccaaagtgtactaaatacattcttttttattctctattcaattacaatatctgcattttgttgctctggcttatcgtttattatctggcaacttttgcacattgtggcttattttttgtgtgtattctttgattttgtattatgacctgatattccttggaactttatcaaactggaaattctttgagaactatgtaaaaagtgtttccctttgaggggtgtttttatttgctttgttaggtgcatgggagcactaccaagccagaattgcttaaaatgaaattttctactgaggtttttttttttttttcttgccgcatggatagtgagaatttcagcccaaaacaatctgcttctccacttaagattagaaattatcaatgactttttttcctccctgctttacttaggccaaagccaaaaacaggcatgtgtagccccatcatttacgtctgcaaggagtttgtttccagtttaacctctgaatgggtcctggttttatgtgagttctatgatacaatgtaccagtgcaggccccagactttgtcttccatctccttcataatgtaatgtagtccatgagaaatgatgtagatcaccaacacaaatgaacacatgcttattctggtggattttcactttccttcatttctggacttcagggaattccttactctcttataaatgcagctgtgcatttaaaaatatgttttgcagattatatagcatttttcattgtgatacacaggctttttgttctgtgatatctggtctaccataatgcttgtaaggaaacacatttaatcttctgtgaggtataattattattcccaggttttatgtaggaatatcttagggtcacagaggttaggtgatttttccaacactgtagagatactaagtggtggaggtgaggttgaaataggtctaaacccaaagcaaggcacttttaaaagattaataaagtttgtcgaatgatacttggactaactcctgcctaattaagctagaaattaatataagttctttaattcagttaggaagatcccaaatcagaacaaatcataataaaaattgagatcaggaagcttcctgagtgtagctcctcatatcactgcccacacataagtactgccccatatggcaatcgggaggccccaggaatgcttgctagggcaggccctgctcctctaagttagttgaaagctccctccctactcagtgactgctctcatcttcttcactgtagctgttggctctcagaacatgatgcccaaagtatagcgcctcggtggctgagtactttgaactgaaagacattggaagggcctccgaagaaagatctctttgacctctcctgccctcttgtctttcatgcttctttctcccctggagtgaaccatggaaactagattcctcttccgcaagacaatgatagaaactagaagccctttccccaaagcaagccataaacttaggaaggtcactctctcccttctcccttctcatttgaagacccttaatccagagaatcctgccccatacttgcaaagaagaaatgctacacagagagtccaagaagaatttgacccagtctattaccattagatcatactcttgtccaaacacatctctacagagctgcccatcttcatggaacctaagcacaaaaacagttttccctggatctttgggtcttcatttctgaggctctcatatcacataaaactttgattaagtaaatttgttatgcttttctcttgttacttgtcttttgttataggagtgtcagccatgactcttacaatgagtaaggagaggtattcctacctccttttacccctacatgctcttggagctgattatcacagtttgtaatttttcaccttccattcctgcttctgtgtattttgataaatttttgcaggtcagtagacttcccaggcagaatatttcctgcttctcaccagcccttaagccaatccaaggaaaacaaaagaactcataatgctttgtcatatgacaagattacaaaagcagcatccagtggcagaatgcccactgctccgggacacagccaatagctgacttcagtgctccccatccctgcttgtcagtgatagtctaaattgttatcacaagcccagtctgaccaatgaatgtgagtgaggggccatttgattgtcagctcctgattctgcagaaaacacgaaactgagctgtacaaagatgctgatgggggctgcagcatgcaattcacttcaccagcagtcactaaggtctgatctcttttctaacatacctggaagatggaatgctggacccagggtatgcatagaaaatgggagttattagaaagcagctttgcttgctttaacccaggaattgtatttctggtatgttgtttccttttagcaattgccctaaaggttcttttgtttaaggagcaggaggatgggggaggttatttctgcctcagcaaaagtcttagaaccagggtctcctcgtttgtaaggaagcaagtaggtccctgacctgggctgggatatgatttgtgatcagccaggcaagagttaagagtggaagtctgtgtctctgcccatcttataatatcttaagggtgatcatctgtggtattcttgagtggtatgcccattccatctagcatttcattagaattattgtataaaggatgacaggcagaggacactgacatgggaatgctggacctattggatgtttattcattagctgcagttaccccccattgccttttttaatacaaagtaaaaatttagttgacatgtaaaaattgtatatatttatgggtatagcatgttttaatatatgtatacattgtggaacggctaaatcaaattatttaacaatgcattacctcagctacttacctttctttttgtagtgagaacacaaaatctactctctagcaattttcacgtatgcaacatatcattattaactatagtcaccatgatgtactatgtagcctcttaatacggtataatgccttggcaaaacccaaaatccctagcaggtctggatcttgagtttggaaatggtccaaggtgcatatactatgtctgtgaataccagagggcaacttttatgggttcctggtgtagggtctatattctaaattctgagagatgaactcctttaggccacagtctttctgccacttatgaacctacaagcaagtttccaggtgttaaatcagctaggaatcatttcagaatttatttcaaatattacattaattcctaggggataaggaatttaaaggaaagtgttcaaatgatcatcttatacatttatatacttttacctttctgtttacactttgtgactagatattacattcatgagtgaattaaaaatgaactgcagaagttaatctaagagtccatggaggctattcccccatgtgtttaagagacctttgctgtccaggtctgatttaacctgaacaaaatggagctcaccgtgtcagatgctggcagtttgaaagggactgcgtagacctggatggatctctgcccttttgaccagcctcacactgatgtccctcacactcgtcagggaggcatttgcccagatattcctgggcttacagcaaccctgtctacagcagcactgctaactgggcatggggcttagttggggctcctaggctggaaagacagtcatagttctataatgtaaggataggctgccttcagggggagggtgttcattctaagggaggggctcaatgaacatgtcgagaatagtatggtacggcttagcaattacccactgttcctagtaggaaaattttgggaattaatattactgttatagtcccatacacaaaccacacaattacctctttctaacagagttgaaatgtttggatttattgtagcattactatcaggaatacacattgttatggtattgctatcaagaatacatataaatacatgcctgaagctataagtgagataaagatattccagggttagtcaaaagttaatctttgagttccagaagtctggatgaaaatggatgagactgcaaattttgttgttaggcagtcaccatttatgacccttggcagggagggaggaatggtggttatattgtgaactgaatgaaaactgagaactaatcagcatcatgtggcctgaagcatttattgctaccagtgattagttgtaagaccttcggactatgtaactgtatgaactataatgaacatgagaaaacaactcttttttttttttttttttttttttgagatgagtcttgctctgttgcccaggctggagtgcaggggcgcaatcttggctcactgcaacccttccttccaggttcacgccattctcctgcctcagcctcccaagtagctgggactacagtgccagccaccacgcctggctaattttttgtatttttagtagagacgggatttcactgtttagccaggatggtctcaaactccagacctcgtgatccgcccacctcggcctcccaaaggctgggattacaggcatgagccactgcgcccggccaaaaaacaactctttaaaaatgtacttagagcaacatgcaaagcttccctgctcagcaatcccaggttggggccccctgtcttctatcctcctacccgtcacaaccaccactgcaggcttctgatgctctgttttcctcctcgtctcagttcagttgctctgagttagagaggagctctctgggactggagctgactgcgcctggcccatttcctcactaccatcctcaagctcagatgctgacaggaaaatactgcctagcctgaaggggcatcccttagcaggcggcccagttccttctcataacatttggctgcttcagcagatctccattctgcttatgaattaatccttgaagataccaataatttggtgcatttgtggaagcagattttcagatacattctgtggttggtctttgatctcttccttgtcagtgattttttgcttatggacaaaccctctaaaccatgttgcacagcagtgtcttcagactcccattatatttctgaaggttgcagtagcgctgatgggattgttgcttttcagcatcaggacttccttattgaatggtgtctgataacattccgtctccaggaactcagcgagatcgggtatgcattcagaggattcagtcccttctcaagagctttattcgaatagtccatagcatttgctttagtgcttcaatcatctctttatttccactagcttcagattctcctgtattctcatttgtcttacttttgccttgtagcagcacccaatctggtgatagaggtagccattgttggtgtggattccaacacccgttgaaacagttcaatagctttgtctaggtcaccttttctctgtaaaatttggctgcactgcggaggacatctgtttggcaaggagacttttccaaggttcttcaacaaactgctctccttcagcttctttattcatcttctgcagtttcaggcccagagaaccttgacgtattggttatcaggactcagctcaatggcctgcttcaaaacatcagagagaactgtttctctgggtgattatccagatggtacatcgcaattgccagtccagagggaattctgggttgttgggcttttcttccagagccttctcaaaacacaccttcgccctttatttcttccacacttcagttgtgtccacccttcctcacagtcaagttcagaatactcaaactgtatggatttgaaaatttcttgcaggtttgtttcaccttatctacataaatctgagatctgagagtctgcccaagtgatagtagacccaggcgtagtttccccaagtgactagactctgatttctgcttggtcagcatgttcttgctggattaactcttcagcttgccgtaagcttccagggctgcctcgttgttaccatctaggtgttttatgtaggccaacaagttgtacatgtagctttgaactcagtgtttaaaaattcaatctggttacacactctatcttctagatccttgagacactgtcttccttgaataagttccaggtgaaatggcatttcagctgtggaagattttctccagggaattcttggtgacctcactgtggagaaaataaacatggtcactgtatgtacactgccaagcactgcaccctgtgatcattaattttatatgtcaattgaactggccacaggatgcccagatatttggtccaacattatttctgggtatgtatgtgaggttgttctggaagacatgaacatgtgaattggtggactgagtagagcagattgctctccccagtagggtgggcgttatccattctgttgagggccttaatagaacaaaaaggcagaggaagggaaattctccctctgaccgactgcttgagctaggacattggtctttttctgcccttagactgacttggactagaactttcaccattggcttacctggttctcagacttttagacttggacgggactacaccatcaactttccttggtctccagcttgcagacaacagattatgggacttccagtctccataatcaggtgagccaattcctcataataaatctctttatatatagatgtccttgacttatgatggggttatatcctgataaacccatcataaattgaaaacattgtaataaaaagatgcatttaatacatctaacctaccatagcttagcctagcttaaatgtgctcgaacccttacattagcctacagtggggcaaagtcacctaacacaaagcctattttatacaaagtgttgagtatctcatgtaacttattgaatactgtattttaagtgaaaaacaagaaggaattatcacttttgtaccatcacaaggttggaaaaattgtaagttgcttcctacattacttttctttagctacagtctgtgcagacacccacaaagcacatcccttacaccgtgtagcagatatgcaggaggtgaggtaagatgggtaagaggaggcagcttcagtgacaggaaagagatctctctcacgctgctcaattaccaagtcagccaggaatggtgactcatgcctgtgtcctagcactttgggaggccaaggcgggtggatcacctgagcccaggattcaagaccacctgggcaacatggcgaaagcctgcctctactaaaaatacaaaaattagccagggatggagtacatgcctgtagtcctcgccattcgggaggctgagacaggaggatcacttgagcccggaggcaaaagttgtagtgagctgagatcacaccattacactccagccagggtgatagatgggaccctgcctcaaaaaaaataaaagtaagaataaaaattaaaaaataccaagtcagtctcattccttgtacattctgggtaaggtttgtttagctatcccatgactctttattgggtacctctttttgtcactttattagatattatggatactaagaaaaatagagattatccaaccttctctgcccgccaggtgctttcagttttgttaggagacatgtaaagaaataaaacccagatatgtctgccaacatgttatgtgatttaggtatttttcccttcatcttttccacacttacaaacagacccacggaggctcagcttgagtctgactgaagtagtctccccacccacaggccagattcccagacagaatgaatttgttgcaacaaacaaacaaaatggactcattttgttttgtagttggaagatactaaaggagatcacttgccttatttagctggataaatgcaagagttctctaagtgtgttcccattatctacatttgcctggggcttgggctgtattccctcactcttgagtttgtgcttcttccttcttaccagtggagtcacggcaccataagttggaaagaacctccagaaatcattaaaccaagtgtccttatttttggatttcacagacagcacaatttcagaaaaaaagttatgaaccaaatagggctgctaatgtatctgaaaagaaccaaccatctattctgaccaatattttattttaaaagatagaaaagaaagaattttcctgccactgaaaaagtaatctcagaataaacaaaattctttaaattgaatgcattttgtttacaaggagccattgactttatttgcaatttaccatggacgagcactggccctcacaccctactgcaagtgtactgatctattatacttcctgtctgtctctccagtaatgctgatctaaccatttttggcccaatatgattgcacatgaaatgctttatagtgagagatgcagaataactcaagggcaatgggagtgaggagggaagttgccatctacatccggctagcctcttttgtgtgtgctttgatttggggacagtccttttccttttcttggtccctgtctagggttcagtgtcaatatcttccctgtctattatagggtccttcctttcttccttccttctttcccccctccctctcttcctccctccctattttccttctttcctcccttccttccttccttcctccctccctcccttcctccctccctattttccttctttcctcccttccttcctttttttcagagacagggtctcactatattgcccagagtggtctcaaactcctggtctcaagcaatcttctgcctcgacataccaaagtgttgggattacaggtgtgaaccaccacacctggcccaggggttttcaatttggctttacctgggtattctaactaccctgtatgaaggactacaatcaaaagtcaagttagcaattatttaaaaaatgaataccaaaagtaagttataacgatgtaattgaacaactctgcttatatctgttatgccactaaatcataataaagtcatggaaaatgagttaactttgctgatgtgtgaattaggaaggttaaaaggagaaagtgtgagtctcgatcaatagaatgtatctgcagatttgtaggtacatatgggtgcctgaaaaaaatagctaacactctagtaattaatagagagtatccagtggacctgcaggatgacaggtgatgttgatgtattgttggatgtatttgcctcaacgaaaccggaaaccaccttgcaagtctgatgaactatctctctctcttttttttttttttttggagggcagaaggctttgacatatcaatgaccagggatcttaccaaactaaattttaagcacttatagctcaagattctccctctgagtgaaacatacttccaccctgtcatgtgtcagcttcagaagatatcaattgctcaagaaatgttggacaagcagaaaagcacactgaacatttctggacttgtgaaagagctctgaataggatctctcagggatattccatccccaccaatgctttaccaatgcgagagctggccaggtgagacatttaatgataacatggaacaatttattcaggaagatagtcaactactcatgtgctttatgattataaaacccactgaaaattgggtcccttgattctcttgatttttcctagccttactccctaaagtctccaatttgatgaggtatttgatacttgatctctccttgaataaaatttggagcaaaatatattggactggaaggcctgagacctcgataagaagaaacagaaccccagagccacaggtcaggaggttttcattataatactattgccctcttaaaacaatactccaattgccaaggtttcctcacttaataatttatctcatatgtgtttttgaaagtactctgaatacttcttatatgtataaataagttagttaacagtaattaatgcagatattaaataaatacaagcaggcaggtgggatgatgactacagtcacttgataaagaacagctggtggccgggcgcggtggctcacacctgtaatcccagcattttgggaggctgaggcgggggatcatgaggtcaagagttcgagactagcctggccaacatgatgaaaccccgcctgtataaaaacacaaaaattagccgggcgtggtggcaggcgcctgtaatcccagctactcgggagccgaggcagaattgcttgaaaccggaaggcggaggttgcagtgagccaagatcgggcactacactccagcctgggcgaaagagcaaaactccgtctcaaaaaaaaaaaaaaaaaaaaaaaaaaaaaaaagaataaaagaaaaagaagaaaaaacagaatagctaggttcaggtgaacttggggagtagaatgccagtcctacctggatctgcatctagtagaagaccttagggaataggattccctcaggtccagaaagagatttcccatgacctcggattgcagacataagattcgcttactaaagcagttaaagctagtgctgctagtccttaggaaatccccagaatcacatagttacagtctctcacctaacccagatcatgaccacctgtcttgcccacagactccgggtagataccacatctccttcccagtcaaagctattactagagtagaatcttgaaatttcagaaagtggctttcttgaagtggtaagagtggggatttccccactcttgtctgcacagtgcagcttgtccccagcatgtgctggttatgctccaactgactacgtgaaggaactggagacctgtgctcagttggttggtcagaacaggcccaatccaaggagtccatcacttcagaagcaagtgaaggaactctccagagccggacttctcaacctttaatgtacatatggacaaaacatctggagatctttttaaaatgcagatctggattcagataagctgggatgttaccttcttacaacctcccgggggatctcagcttcagaccacactgtgagcagcaaggctctggaagacttccctttttggcagtgatttccaatcaccagtttctcatacttaaattacccttaaacagtcaaactttgctttatttttattttatttttgtttttttgtaggtctcacttgttgccaattctggtctggagcccctgggctcaagcaatcctcttgcctcagcctcccaagtgctgggattacaggcttagccactgtgcccagaaacaagctttgctttatttcaaattcttcccacccctcccccctcctgcctcttggggtttcctccttcacatttacacactacaatgcaggaagccttgtatgcatttaaggaagagaggatttggagatggacatttctctgtaagccattcagtatgcctatgaagtacttgtggtcctctttaaatatatgtttgttctggaccttatttctgttttactcaatcaggatttcagaatgcaggacctagaaattgcattctattagaagactcaggttgatatgattcaggccactcgcagaacacagtttgaagactgcaagcaacaccttctccctgttcattgatcacgtgggaggcttagcaggtcacagacctgctagaggacaactcaagtagacatatcccccaattatgaaaaagtgcatttcaggtaaaagtgacctcaacataaattggaattttgcagtgctgaattaattattgacactttgctgagaagcaagcatggtttaaaaataaccacagtcacaacaaaaccacaaaccttgacttaggctttctaaatataagaaacaaaagacgaaccagaacctccagtaacttcctccaggccccagctttcactggcccgattttacctgaaagcatctgagcatgggctctcaggatctctcaatatgccccgtcccttcccagctcccagctcccatttccctgtgtccttggctgcctaactctatacatcacaaagagctacagaaataaaaatgcatgaattggtaggcagatttatgcttgaattagataaatgcatatttcatctctaagcaaacactgaaatgcataagtcaggaagttgtacataagaaattctgtttcctatcagagaagcagggactattacctcatgatggctgtttccctgcagttctgaaaagctggggtcccggttgattttgttttagcttactgattccaagcaaatgctgaagaggtttccacccagggtgctgttaggctgtgcttttatgaaaggggaaaggaaagtgaaactgatggaaccctatcaagatccctttgaggggaaactgaaacagaatctgtgagaactgagctcactcacgccaggaacatgtccagacagatttggaaaactgtggtttgaaagttgtaaaaaggcactgtaaaaagaaaaaaaattttagaagcttccaaatgtgttatgtcaagaggcaaagttaagccctgaaaactactcacgtaacgtgactgttttttttctcaggtgcatgactgttgctctttgacctgtgggtgaggggttacatgttaaccagactccctagtctcactgcaatttctgcctctcgggtcaagtgattctcctgcctcagcctcctgagtagctgggattacaggcgtgcaccaccagcctggataatttttgtatttttagtagaggcggggtttcaccatgttggtcaggctggctcgaactcctgacctcatgatctgcccgccttggcctcccaaagtgctgggattatagcttgcaccaccgtgcccggcctcagacaacctagtctttattaaaacgtagacctcatgtatggaaatagagacccttttgattgttacttttttttttttttttttttttgagacagatctcactctgtcatccaggctggagtgcagtagcacgatctcagcttactgcaacctcgcctcccaggctcaagcgatcctcccatctcagcctctccagtcaatgagactataggccgtgccaccacgcctggctgatttttgtatttttagtacagacggggtctcactatgttcccaggctggtctccaactcctgagctcaagcatctgccctcctcggcctcccaaagtgtgggcttatgggtgtgagccactgcggccagccatgttacctctttacaaaagaatattagcaattcccttggactgtaatcaatagtagccaatcaaattgtatatctgtatgttagctctgtatggaaaatgttggccaggcacggaggctcacgcctgtaatctcagcactttggaggccaaggtgggtgcatcacttaaggtcaggagttcaagaccaacctgaccaacatgcaaaaccccattgctactaaaatacaaaaaaattaaccaggcatagtggcgtgctcctaagtcccagctacttgggaggctgggtgggagaatcccttgagcccaggagtctgaggctcagtgagccatgatcgggccactgcactccagcctgggtgacagagtgagactctgtctaaaaacaacaacagcaacaacaaaaacaacaacaacaagagaagttgtcattctgttgacacctctgtctttgcctatgtaaacagtcctcatttttctctacactggaagtactgttaccattcttgggtgcagctctactcctgggactgctgccctcaactttttgttgaataactcttttaactggatcctgagccttctgattattgtatattgacagtactgactatgcatcctactcccagagattctggtgcagtgaatctgatgtgagcttagaaacctgtgttttacaagtgccttggaaattcagtgcaggagttcctgtaccacattttgagaagtgctgtctagaggtattttaaaaagcagttttcccctttatttatggagctaatgtggtgaattaacagcattatcaggcatcttgagtgaagggaagaaaaccacaggacacctggatttcagtacctctttgcttagttctgggatatttcttgagtcatatcactgagcctcattcccttaccttaaaatgccctaggatgaatttccttttcccttcatccaaatgatagaaaattatgcctggggagaaccactttcacccttctccaagatctgggttcagttcttgtggctttggcactctaaggcatgggtaaccatcaaaggctggcccttactctccagataggaagcccaccctggccccctctctaaagtgagcatagttgaaagcattaagatctttcaccttttggcattgggcatagagtcagatgatcagcagtagagtttggtgcctccattaatgactctgtctgacacctgctctctatctgatgtcttgggcaagtaatttgcccttctaagccccatttggtcatctagaaaatgaggctaataatagaaataatagctcttacttcctagggctgtggaagggtgatatgaggtcatgcgtaaaacgtgtttaacacagtgcccacttgtcaggctctgagcccaagctaagccatcatatcctgtgacctgcatgtacacatccagatggccgttcctgccttaactgatgacattccaccacaaaagaagtgaaaatggcctgttcctgcttaaccgatgacattatcttgtgaaattccttctcctggctcatcctggctcaaaagctccctactgagcaccttgtgacccccacacctgcccaccagagaacaacccccctttgacgtaattttcctttacctacccaaatcttataaaatggccccacccctatctcccttcccgactttcttttcggactcagcccacctgcacccaggtgaaataaacagccttgttgctccacaaagcctgtttggtggtctcttcacacggacttgcatgaaaccactaactacagatacaaagaaatgttaccaccatgattgctggtactaatatatttgtgttataattttaaggaatttgtgagtgtgtaaagggagcaacagagttcctcagtggatggggcagaggaggagcccatcagctggcacgtgccagtgagttctccaggtgattttcccatttggaaattttagcacaactggggaggagcagcccaatctcttcctgttcctatagcctctggaaatagggcaccttgatgtgaacctgagtccagcatagttcagagagcccccctcagacctcctcagtcagtggctatagacacacctaaagacaggaccctgtaaaacctttcctgcaagctggtactaagacgccttgctctctggtcaatcccactcacacagacacaattaacatcactctgaccaggaacttattctatataaaagggtattctatatactgaggtatttggcagtgattcctcttacccatctcatccccaaacatgacattgcagagcatcttcaagtccttgggcagagtaaggtagggaatccagttttccttttctgcccccctgaatggtcgatggggtctccctccctggcaatcacctcctcactcctttcctagagatgcttggtgggaaaggcatcttttctcttagttctccctaacatgctatcccctgaagaactccaggaggacaatataaaatttaaaaatcaagtttactgagattatgctttatatacaataagatgcacccatttcagtgtatagtctgatgagttttggtaaatgtttatgcatatgtagccaccatcactactccctatagactattcctatgattctaaaaagattcttttgggagccttcctactcaatcccaccatctccaggcaaccactgatctgcttcccaccattagagattagactagttttgataatagattaggtcattacacttttgaggagaaattctttttttgctgctgaccagcttcactacatcaataaaaataaatgctaagctttgggtttgtttttatataagaaatgaaaaaatgcccatttgtaagaattgtttcttccacttcccaccttaaagtaatgcaacgttcagggcaaaattgccttcttcatgagtgggtttgcagtactgattgtatctttcacaaatctgttgaaaataaattcctccttttaaaattacaagaaaaaaagcctgtgacttaatttttcaaacaaaatgacaataacagaaaaacccaaaagagtaattcccttaggtctaccttgaatcagccaagtttgtggctgagtgaaatacaccgctcctgccaagccttcctctcttgcaggaaatagctgcacacagggaggaaacatgagctgatgcattccccaccctgccccccccatgtagttccgtagggaaccattccagaaacttaagaagcctgtgtgtacaccaaaaaagccacagggaaaaacccctcaaacatcttacaaatgctcagactgataaagactattgaatctataaacatcaggacaattcaggaatgtgcctgcacagtaagaaactcaattacaatttgcactcaaaaacaagcatgattatgcattcttatttcactgacctcatgatgccctctgtgtctctgctgttccgaaaagctggtgaccaggctgatttgttcttcagagtcttcctgtctgcctcaagtaaatactgaaggaactatataaaggggtgggagagtaggcacgcatcagctgatgttttctccgtttttgagtaattgcttttaggggaaggaagagaaactggaaagtgaaactaatttaaaatcgttgggaggaggaaaatgaaacctaacggctgagacctgcaatggctgagccagagtacgttattcaaaactgtgactaaaatttgtttagagaatgtggaagcattcctaatgtaaaccaaaaaattaaattctaaggccatactcacaaccatgtgactggacccctgcttttggccaagggcattccaaagttaacctgaaaacgatgtgaaggggaagctggatatgcctcattacatcctttttccttttggaattactaaagaacacactctttttttgtttttgtttttgtttttttttgagacagagtcttactctgtgcccaggctggaatgcagtggcatgattgcgtctcactgcaacctctgcctcctgggtcaagtgattctcttgcctcagcctcccgagtagctgggattacaggcacccaccaccatcccggctaatatttgtatttttagtagagacgaggtttcgccatgttggtcaggctggtttgaactcctgatagcaggtgatccaaccaccttggcctcccaaagtgctgggattacagcatgagccactgcacccagccagaacatgctctttttaagtgtattaagaaacatttaaacctattctctctgaagcctgctacttggaggcttcatctgcataataaaaccttggttccacgacccagacattcctttctaatgattgtctattgaatttctattggatgtctccaacattcctttctattgataataactctttcaacaaattgtcaatcagaaaatctttgatctgcctatgacttggaagctgccccgcttccctgtttccaattgtcccacctttctggcctagccaatgtacaccttacatgtattgattgatgccttatgtctccctaaaatgtataaaccaagttgtggcctggcacatgttctcaggatctcctgagggctgtgtcacaggcctaggtcattcatatttggcttagaataaatctcttcaaatgttttacagagtttgacttttttgtcaacattaggtatctgaccatcagtctagggtggggcccaggaaacagcatttttaagccaattcttattatttttaaaaattttttgtggacacatagtagatatatatattatggggtacatgagatatttgatgcgagcatacaatgagtaataatcacatcagggtaatgacttcaagcatttattctttgtattacaaacaatccaattatactcttttagttatttgaaatgtgcaataaactattgttgactatagtcatcctcttgttctaacaaacactaatcttattaattctatctaagtatatttttgtacccattaaccatccccacttcccccgtactactcttcccagcctctagtaatcatcattctaatctctatctccataagttcaatgtcttaatatttttagcttccacaaacaagtgagaatatgtaaaatttgtctttctgtgctggcttaattcacttataatgacctccacttctatccatgttgttgcaaatgacaggactcattctttttatggctaaagagcactccgttgtgtaaatgtaccacattttctgtatcattcttctgctgatggacacttaggttgcttccaaatcttggctattgtgaatagtgcgcaataaacatgggagtgcagatatctctttgatgtactgatttcctttctttttgatgattcctggcagtgggattactggatcatatggtagttctatttttagtcttttgaggaactccgaactgttatccatagtagttataatagtttacattcccaccaacagtgtacaaggtttccttttttccacatccttgccagcatttgttattgcctgtcttttggataaaagcattttaaccagggtaagatcatatctcattgtaggtttttttttaacttatattttatggcaggtatacacgtacaggtttgttatttaggtaaattgcatgtcatgaggctttagtgacagattatttagtcaccccactcataagcatagtacatgataggtagtttttcagtccctctcttcacccattctttaccctcaagtaggccccagtgtctgttgttcccctctttggtccataatgttcagttcccacttataagtgagaacatgcagtatttggttttctcttctgcattagtttacttaggataatggcctccagttccattcacattactgcaaaggacatatattcttttttttgtggctgcatagtagtccatggtgtatatgtaccacatttccctttcctgtcttctgttgatgggcatttaggttgagtccatgtctttgctattgtgaatagtctatgatgaacatacttgaacatgtgtctttatggcagaatgatttatattcctttgggatgtacccaataataggattgctgggttgaatggtacttctattttaagttctttgagaattaccacattgctttccatagtgactgaactaatttacattctcaccagcagtttgtagtgttcccttttctctgtaacctcaccagcatctgttatttttgttgactttttaataaagtcattctgactggtatgacatgatatctcattgtggttttgatttgcatttttctaagattaatgatattgagtattttttcatattcttttttttagggtatctgaaggaagaaattattttctttttttattattatactttaatttcttgggtacatgtgcacaatgtgcagtttgttacataggtatacatgtgccatgttggttcatatgtttattgcggcactatttgaatagcaaagacttggaaccaacccaatagactgggtaaagaaaatgtggcacatatgcccatggaatacaatgcatccataaaaaaggatgagttgtgtcctttgcagggacatggagaagctggaaaccatcattttcagcaaaatatcacaaaggacagaaaaccaaacaccactattttttcatattcttattggccgcatgcatgtcttcttttaaaaagtgtctgttcattcctttgcccactttttaatggagctgtttgcttttttgcttgttaatttgcttaagttcttatagattctcaatattagacctttggttatgcatagtttgcagatattttctcccactgtcagttgcttgtttactctgttgatagtttcttttgctatcagaagctctttagttaattaggtcccgtttgtcaatttttggttttgtcgtagttgcttttggtgtcttcatcagaaatctttgctggtttctatgttgagaatcgtatttcctaggttatcttccagggtttaatatttttaggttttacatttcatccatcttgagttgatttccatatatgatgtaaggaggggtccaatttcagtcttctatatatggctagccagttatcccagcaccctttattgacagggaatcatttccccattgcttgttcttgtcagctttgttgaagatcagatggctgaggtgtgtgcccttaagtttgggctctctattctgttccattggtctatgtgtctgttttgtaccagtaccatgcattttggttactatagccttgtagtatagttcaaagtcaggtacatgggctctctattctgttctattggtctatgtgtctgtttttgtaccagtaccatgcattttggttactgtagccttatagtatagttcaaagtcaggtaacatgatgcctccagcttgttctttttgcttaggattgctttgggtatttgagcactttttgttctataggaatttaaaataggtttttctaattctatgaagactgtcattggtagcttgttaggaatagcatgaatttgtaaattgctttgggtagtatggccattttagcaatatcgattcttcctatcctgagcatttccatttgtttgtgtcatctctgatttctttgaacaatgttttgtaattctattgtagagatctttcacctcctgcgttagctgtatttctaggtattttattctttttgggctattgtgaatgggattgtcttcctgatttggctctcggcttggattttgttagtgttaggaatgctactcatttttgtatgttgattttgtatcctggaactttgctgaagctgttattagacctacgagcttttgggtagagacgtgggggttttctaggtatgcaatcaaatgtctgcaaagatagatagtttgacttcctctcttcctatctaggtgccttttatttcatctcttgcctgcttgctcatgctagcagtactctgttgaataggagtgctaagagtgggctccctgtatttttccagttctcaaggggaaatctttcagctttcgcccattcagtatgagttgaccttgggtttatcatagatggctcttattatctggaggtatgttccttcaatattagtttgttgaggatttttaacattaatggatgttgaattttatcaaaagccttttctgatctattgagatgatcacgtggtttcagttttaagttctgcttatgtggtgaatcacattattgatttgtgtatgttgaaccaacagaaacaagaattttataaaggaatgggaaatggaatttggctgtgggacataaattggaagctctagcaggcatggcttgcctggctacaaaggccagggtaggtggggttgcctaccttgcctgaatgtttcccaggacaacaggaggcgtgctctctggctgaattcagacagaagtggaaccactgggatggaagctctagcaagtttgcctgcctggcaaccagtggcaggggtagatgtagtcacctgtcttgccctccaggtcttcctgggagaacaggaggctatggtcactggctgagttcagacagagaagtaggaccgtaggctggaagctggcaccaagccccatccagaaagggtttgagatggggcaatcttatgctcctaggcactgggactgcagcctttattgggctatggcaccagtgctggtcttctgggggcacaaggcttgcagaagtctccttggactagagagttgccctccaaaatgtctgggggctctctgcctcagtctagaagcacggtggtggggtcgggggtgggcaggggtttcggggcattctcccatttccagtcttgcacaggtccctgtcgagagtgtgaatcccctaggggttctcactcactcaccctttccagtgttggagaaattctcctggatccacgctgagccggacaggctggtatctagcttcacccctttctgctctctgtaatccccttacatcttaaggatcccgaatccctgacatgatttctcagatgattggcctgcagggtcaatgctcatagcccttttgtttcctttccgtgatagcctggcacatgagttgcttctagtttaccatttaaccccgagctcgaaactgcattttttaaaattttactttaagttctaggatacatggcacaacacgcaggtttgttacatatgtatacttgtgccatgttggtgtgctgcacccataactcgtcatttacattaggtatatctcctaatgctaaccctcctccctccccctacccatgacaggccccagtgtgtgatgctccccatcctgtgtccagttgttcttattgctcattccgacttatgagtgagaacatgcggtgtttggttttctgtccttgcgatagtttgctagaatgatggtttccagcttcatccatgtccctacaaaggacatgaactcatcctttttatggctgcatagtattccatggtgtatatgtgccacattttcttaatccagtctatcatgatggacatttgggttggttccaagtctttgctattgtgaatagtgctgcaataaacatcgtgtacatgtgtctttatagcagcatgatttataatcctttggatatatacccagtaagggatggctgggtcaaatggtatttctagttctagatccttgaggaatcgccacactgtttccacaatggttgaactagtttacagtcctaccaacagtgtaaaagtgttcctatttcccacatcctctctagcacctgttgttactgactttttaatgatggccattctaacgggttgagatggcatctcattgtggttttgatttgcatttctctgatggccagtgataatgagtctttttcatgtgtctgttggctgcataaatgtcttcttttgagaagtgtccattcatacctttgcccactttttgatggggttgtttgatttttttcttgtaaatttgttgaagtttttgtagattctggatattagtcctttgtcagatgggtagattgtaaaaattttctcccatctgtaggttgcctgtccactctgatggtagtttcttttgctgtgcagaagctctttagttaattagatcccatttgtcaattttggcttttgttgccattgcttttggtgttttagaatgaagtccttgcccatgcctatgtcctgaatggtattgcctaggttttcttctagggttttatggttttaggtctaacatttaaatctttaatccatcttgaattaatttttgtataggtgtaaggaagggatccagtttcagctttctacatatggctagccagttttcccagcacatttattaaatagggaatcctttccccattgcttgtttttgtcaggtttgtcaaagatagatggttgtagatgtgtggtattatttctgagggctctgttctgttccattggtctattctctgttttggtaccagtaccatgctgttttggttactgtagccttgtagtatagtttaagtcaggtagtgtgatggctccagctttgttcttttggcttaggattgtcttggcaatcaggctctattttggttccatatgaactttaaagtagttttttccaattctgtgaagaagtcattggtagtttgatggggatggcatgaatctataaattaccttgggcagtatggccttttcacgatattgattcttcttatccatgagcatggaatgttcttccatttgtttgtgcctcttttatttcattgagcagtggtttgtagttctgcttgaagaggtccttcacatccttgtaagttggattcctgggtattttattctctttgaagcaattgtgaatgggagttcatcatgatttggctctctgtttgtctgttattggtgtataggaatgcttgtgatttttgccattgattttggatcctgagactttgctgaagttgcttatcagcttaaggagcttttggctgagactatggggttttctaaatatacaatcatgtcatctgcacacagggacaatttgcttcctcttttcctaattgaataccctttatttctttctcctgcctgattgccctggccgaacttccaacactgttttgaataggagtgttgagagagggcatccctgtcttgtgccattttcaaagggaatacttccagtttttgcccattcagtatgatattggctgtgggtttgcataaatagctcttattattttgagatatgtcccatcaatacctagtttattgagagttttagcatgaagggctactgaattttgttaaaggccttttctgcatctattgagataatctgtggtttttgtctttggttctgtttttatgctggattacatttattaatttgcatatgtgaaccagccttgcatcccagtgatgaagctaacttgatcatggtggataagctttttgtgtgctgctggattcagtttgccagtattttattgaggatatttgcattgcatcgatgtcatcaggggtattggcctgatattctctttttttgttgtgtttctgccaggctttggtacaggatgatgctggccacatcaaatgagttagggaggattccctctttttctattgattgaatagtttcagaaggaatggtaccagctcgtctttgtacctctggtagaattcagttggaatccatctggtcatggactttttttggttggtaggctattaattattgcctcaatttagaccctgttattggtctattcaggaattcaacttcttcctggtttagtcttgggaggggtatgtgtccatgaatttatccatttcttctagattttctagtttatttgcatagaggttttatagtattctctgatgatagtttgtatttctgtgtgattggtggtgatatccccttatcatttttaattgcatctatttgattcttctctcttttcttctttattagtcttgctatggtctatcaataatgttgatcctttcaaaaaatcagttcctggattcattgattttttgaagggttttttgtctctatctccttcagttctgctctgatcttagttatttcttgcctctgctagcttttgaatgtgtttgctcttgcttctctagttcttttaattgtaatattagtgtcaattttagatatttcctgctttctcttgtgggcatttagtgctataaatttcccttatacactgctttaaatatgtcccagagattctggtgtgttgtgtctttgttctcattgtttcaaagaacatctttatttctgccttcattttcttatgtacccagtagtcattcagggcacgttgttcagtttccatgtagttgagcagttttgagtgagtttcttaatcctgagtctagtttgattgcactgtggtctgagagacagtttgttataatttctgttcttttacattgctgaggagtgctttacttccaactatgtggtcagttttggaataagtgcaatgtggtctgagaagaatgtatattctgttgatttggggtggagagttctgtagatgtctattaggctgcttggtgcagagctgagttcaactcctggatatccttgttaactttctgtctcgttatctgtctaatgttgacagtggggtgttaaagtctcctgttattattgtttgggagtctcatctttttgtaggtctctaaggacttgctttatgaacctgggtgctcctgtgttgggtcatatatatttaggatagttagctcttcttgttgaattgatccctttaccattatgtaaggccttctttgtctcttttgatctttgttggttaaagtctgttttatcagagactaggatgcaaccctgctttttttattttccatttgcttggtagatcttcctctatccctttattttagcctatgtgtgtctctgccatgagatggctctcctgaatacagcacactgatggttttgactctttagccaatttgccagtctgtgtcttttaattggggtatttagcccatttaatttaaggttaatattgttatgtgtgaatatgatcctgtccttatcatgttagctggttttttgctcgttagctgatgccgtttcttcctagcaccgatggtctttacactttgacatttttgcagtggctggtaccggttgttcctttccatgtttagtgcttccttcaggagctctgtaaggcaggcctggtggtgacaaaatctctcagcctttgcttgtctgtaaaggatttatttctccttcacttatgaagcttagtttggctggatatgaaattctgggttgaaaattttctctttaagaatgttgaatattggcccccactctcttctggcttgtagagtttctgcgagacatctgctgttagtctgatgggcttccctttgtgggtaacctgacccttctctctgctgcctttaacattttttccttcatttcaactttggtgaatctgctaattatgtgtctggaattgctcttctcgaggaatatctttgtggcgttctccgtatttcctgaatttgaatttagcctcccttgctaggttggggaagttctcctgcataatatcctgcagagtgttttcaacttggttccattctccgtgtcactttcaggtacaccagtcagatgtatgtttggtctttcacatagtcccatatttcttggaggctttgttcatttctttttactcttttttctctaacttctcttctcacttcatttcattcatttgatcttcaatcactaataccctttcttcagttgatgaattggctactgaaggttgtgcatgcgtcatatagttctcatgccatggtttcagctccatcacatcatttaaggtcttctctacgctctttattctagttagccattcgcgaatcttttttcaaggttattagcttctttgccatgggttcaaacatcctcccttagccgaagaaatttgttattaccgattgtctgcagccttcttctctcaactcatcaaagtcatctccgtccagctttgttccattgctggcaagcagctgcattcctttggaggagaagagcactctgattttttagaattttcagcttttctgctctggtttctccccatctttgtggtttatctacctttggtctttgatgatggtgacatacagatggggttttggtgtggatgtctttctgttttttagttttccttctaacagtcaggaccctcagctgcaggtctgttggagttgctggaagtccactccagaccctgtttgcctgggtatcaccagtggaggctgcagaaggcaaatgttgctgcctgatcctttctctggaagcttcatcgcagaggtgcactctgcctatgaggtgtcagtcagcccctactgggaggtgccttccagttaggctactcagggagggtaacagactaactcccacttgaggaggcagtctgtccattctcagatctcaaactccggctgggagaaccactactctcttcaaagctgtcagacaagggtgtttaagtctacagaatttctgctgccttttgttcagctataccctgccccagaggtggagtctatagaggcaggaggcctccttgagctgtggtgggctccacccagtttgagcttcctagccactttgtttactactcaagcctcagcaatggtgggcgcccctcccccagcctcactgccgccttgcagtccatctcagactgctgtgccagcagtgagcaaggctccctgggcatgggaccctctgagcaggagcaggatataatctcctggtgttctgtttgctaagaccgttggaaaagcgcagtttagggtgggagtgtctcaatattccaagtaccatctgtcatggcttcccttggctaggaagggaattccctgactccttgcacttcccgggtgaggcgatgccccgccctgctttggccacactgtgtgggctgcacccactatctgacaagccccagtgagatgaacccagtacccagttggaaatgcagaaactaccatcttctgcatcactcatgctgggagctatagactgagctgttcctatttggccatcttggaacctcctctgaaactgcatttttaataatgtcttaggagattctgatgtaggggtttctgggagccggttatatgaaagacttccaaaatgtttgtaaaaaaaatagtagttttagtatacatatgtaactaacctgcacaatgtgcacattaccctaaaacttaaagtataataaaaaaaaatagtagttttgtccagtaaattgtccccagaagtaaatttagacctagagacctagatttaattatctctgtttactttactagtttcgaattttccaggggccatatcattgagccagaatttcctttttgcctcacactaaactacgaagccaggccctggagggatctgtgagctgtttagctttccaagctctggataatatttagtttacccagctgtaaaatgggcaaaagtaatacacatattattgtttaatggaggattatatatttatgctttgagctctgaaggagttgatactaccctgagaggtttttttttcttttcatttttataatacttcccaaccatgatgtaaatattcataaaaacctaggagtatagttgtcatgactaatttgataatgaaggaattgttagctagaagcgtttcctcatcctgtagctgcacaaagcagagactcttgtgtagcaaaattaacatgacatatggtgttccaacaacagagtctcatgagatacttcgagttcagaggttgttatagtctaagaaaaaacctgcaacttggaaaagtctaattctgattggttgtttaacttaacaatttgttatttggtgataataaagtgacatatctttataaaaggtacatatatttgtgatatcataaaggtataaataccatccttatacccagttagaaggtgcctttggccccgtgctttagaggtcccatatatcacagatacaaacatgtaaaattttgaaagaacaaatagcacctctgttctcagaatccagtgcttaattctggtagaattggacttgaaaccctaaacatccagcccgggaaaagttgcctatcttcccttctttgctcacaatgaatggagattatatcatgcattttgtgcattgtgagggagctgatttttagagacagattctgctttggagttcagagagattgtagcaataaagatcagagaaaaggcaaattcagcaaactgctcaaagactgtcttcaccagaatgcaatagattcttatgtaatgaataattatttttccagtacagtaggaccattgtccattttcttgcttttctttttgttctaattcctggctcaaaaagtactcatgattagcagtatttgcaacagttgcacatggtgactgaataacattctgcatcattaagaattcatactattcttttttttctttttgacagagtctcgctctgtagccaggctggagtgagtggcacaatctcggctcactgcaaccttcacctcctgggttcaagaaattcacctgctcagcctcccgaatagttgggactgcaggtacccaccaccatacccacctaatttttgttttttagtagagatggggtttcaccatgttggccaggatggtctcgatctctaaacctctgatccacccgccttggcctcccaaagtgttgggattagaggcgtaagccactgcgctcggcataaattcacattattcttaaacttgtacacatgcagatttgaacttacatatggatcaaattctcttctgtatttggactctttctttgtgccaatttgccaatcagtaaggttctgcgtatgagtatttaaatataaaatcagatgggaccagattttcatagcacacccaatcagaaaatagaatacataacttatctaacatatctaccgaatgtgaaagcaatgacagattcaaaatgctactaataaggatacaacacaatgaaaacaaacttagaagtaaaaataataacaaaagaaaaattttctttattatatttggaataagagtgcccatttttaacagcataataaaatataattcacatatcatataatccactcatttaaagtatacaattcaatactttcattatattcacagttatgcaaccagcaccacaatcaattatagaacattctcaactgtcatctcccatcgtcacaaccccctcccctagccttaggcaactgctaatctatttctgtgtctataaatttgcctccgttccacatttcatataaacagaatcatacaatatgtactttttaaattgccttttgtcactttgcatgttttcaaggttcatctgtgttgtatcagtatcagtaagtacttcacttatttttgtttccaaataatattccattatgtggctctacatatttaatttatcaattcatcagttgatgggtccactttttggccatcgtgaataatcagctatgaacattcatgcacaagttttgtgtgaacctatgttttcatgttttccttttcttacatatgtatctaggaatggaattgctgggtcatatggtaactatgtttaaccattgaagaactgtccaactattttccaaagtggctgcaccattttacattaaacatacttattttgaggtaatacagattttcttatctgagatctcaagagatgagttactgaaagagaggaaggctgtaggaaggaaaatgtgctggtatgatcttcatttctgactaaaggataaacgaaaaatggaaccagattgaattggttgcagttcagtctatacctctgctattcaaggttagtttacagactacaggccttgttttgacctgagagcttgtgagaaatacagagtctcggctccacccagatctactgaatcatagtctacattttaacaagatcctcaggtgattggcacatgaaagtaggcactgcacattaaagtctgagaaatactggtctagttagaactcagatattctacaggtaataacatgtaagacagtgctggactacacacaaaagtgtgtgccgtgtgattgaaagctagagtgtattctaggtatgcaagccatgtcctctgccagtcatttctccctcctcccatgtctccttcttggataatttgctctcattcctgcagaaagcatcactctaagcccctgctttctctggaatatgatctcattctcttggtcaactggattatattattattattttttttttttgagagggagtcttgctgtgtcacccagcctggagagcgtggtgcaatctcggctcactgcaagctctgcctcccaggttcacgccattctcctgcccagcctcccgagtagctgggactacaggtgcccgccaccacgcctgtctaattttttgtttttttagtagagatggggtttcaccgtgttagccaggagggtctcgatctcctgacctgtgatccgcccgcctcagtcaactggattctattggtaatggatattgacttgaaatgaacaaacagatatttctttggaattttgatcagaagaaagtgattctagaaagtctttatgaattattattattatttattttttgagacagggtctcatctcactgtgttgcccaggcgtagtgcagtggcacgatctcagctcactgaagcccccacctcctgggctcaagtgttctcctacctcagcatcccaagtagatgggactacaggtgcatgccaccaagcccagctaattttgtattttttgtagagatagggtttcaccatgctgtccaggctggtctcgaactccgggctcaaacaatccgctcacctcagcctcccaaagtgtggcgattacaggtgtgagccctgcacctggcctttgttgaattattaggagaagagataaataacctggtaggcatgtttccacttcatgcacagagacgcaaagtcatctctagaaagagaaacttgaaggaagaagcgtaaagggaagataaaagtgagaaagaaggagagaaaaaggaagagagagatggtgggacagacagagagagaggagagaaaactagcattctgggtgtggagaggatttccgtcatcagattccacacttgaacattttatttttctgtgatctatacgccagtgccttttttggaatatatgcatgcactcatcagattgacaaaaattaaagactggtaacattcagtattgtgaagatgctgaaaacagtatttctcatacattgctagtggaaataataatttccttttaacacctagacaaatcaactcttttccataacctaaaagccttaatcattatttaaaattttctatttaaatattctagtgaactctagttttccttaatcaacaattagaagatatatacaaagttttatacatatgttttaaagctccaacttatgtaggtgtttcactaaatgcaaaaacgtacaagtaggtttgagggtttttttttttttttttttttttgagacagggtcacctctgtcacccaggctggagtgcagtggtaccatctcactgcaactaccacctcccagttcatgagattctcctgcctcaacctcctgagtagctgggattacaggcacacaccgcatgcctggttaatttttttttgtattttttttggtagagatggggtttcaccatattgacaggctggtctggaactcctgacctcaggtgatctaccctccttggcctcccaaagtgcgggattttaggcttgagccaccacgcccagccaggtttgagtttttaaatgtagtgcttatgacaaattagtaagtttaatttaaaaatgagaaaggaaaatgtgtgctcagtggtttatatcacagtgcctttgctctgtaatatctgtgaatcaaaagcagaacataaataggctatttacttgggatatccaggattctggaaaggtaaagaaagacttttcaaatattttaatagattatatctgtataaacacactggggccaatttccagatctctagaagggtttcagaatttctaggttcagggcagaatttactatatatttttacattttactcagaaataacaaaactatgactcattatgtttccaaaacaagtgagacataaaccaaggctctggggtcttttgtatcgtttacctgtttggtagcctccttttcaacagcagcctacagagaaccagagagaagcagaactgtttgggatttgtttccacaggcttccaacaaatcctgcctctggttcttctctagtcttaagtcctgtatgtaaagcagctgaagggaggccccatgtagagctagaatgcctctcttacaagtgcatgcacctaggtacatctaaggattttagtgggtttcctctttgcagcctccctagaaggtgtagataatcagcaatgaggtagctgcactattaacatggggaaaatttcttacatattagtctaagttagtcccttttccaaaaagggcaataggcaaatgtaggttgcaaactgcaaccctcagattggcatccaaggttgattgcacgtaggtagggatcctaacacaaggcctatctgtgttataatcagaattctaatgcttccagtttccagttgcactggatccagttgtattggatatgtcaattgacatagggtatgaaggaggtgaaagtgcagcatgactcaaggtcagctgtccccagggactgtgtctgagctctatgagaaagacaagcagaagtgatgaatctttttcactgaggactctgaggcagagaaataataagaactacttggaaccaacacagagataagaggaattcttctcactctttcactggactaacacacttgaaaacattgttggcagagatattagtactctcaaggtggcaatcaatacagagaatgtgaaatgtattgaaggcagttttaggggcaatggtcattgatggatatggtgttgaagctacataagtagcagatgtggtccgataactctgataaacgggttcatggcacataggagacatctactaggggcttgccgtgttggatgaatatatgaagggagtcaatgtcctgccccgggaaatgtggctaaaaggctgggaattacaagtcaagcccaattaagtgacttcatttgttattcttggatagtgaaatttcaggaaactggagctatgtacatattttcattgttttccaatcatttgttaactttaagccctcatattaagtgtaatatgtttgtttcccttttctacccttcttgctgttttcccactaagggtcctgttccagcaagggctggaggcatgacatgcaaggacaagattacatacatccatctttagcacacacaggtacaagggtcctctctcaaggtcggcatacctgtccattttaaccttccactcagaatacggtggtgttccttcccaggcaccagatgtagtcctaatttactcagatcaaggtgagctaatcttcccctgaaacatacacttgtccattttgatccaatgaaatgagtttacctttgcgttggtgtgatttgtgttttccattagaggcctcttgaaaaataatagagattttgggcttcttgtctcttcctattctttacttaatagggaagactctttaacatgcatttggattcgtccaggatggggcataaaatggaatcagtgacttttatttctcataacagaggtcagatagagaaaatgtgatgaaagcacaaaatttaacaaagaaaaggggagcagcccacccacatcaaggtggagacagaatgtctgtgttcacgtaggtcaatggtagcaggtggcagatgcagctgttatccgaagccctggactcttaaagctgaggaaaaagttttgttctgttcagtgattatgatagtagaccagtcgaggttatttggatttggttcacacctgtgtaacgttcatttatcagtagctgagtctgaaagatttaaagtacagcaaaattccagatgaaccaaacactgctttatgttttatcatatttaggttatttattaatgaaaatatatgacatttcaggaatacaaattttgcaccctgatgacctcaaatgcgtgcaacaagatgtttaatacgaaaataacacaaaaactgttgttacagtggttagaatttttaactttaaaaaaccatgatttgtattgttttaattgcacaataaaataatgttgatatatacttaagcttaaattattccaacaggcaaacattttccaacccagagtgtggctgatgctgggtcagctgactctttttggttcacaccaactttgatgtctaggctattcagcatctacctagaaaatctcaacgttccaagcataccgtgaattttgtgatttctcagaagattttcggagttaaaagaaggtttatatcacttaatatccaacatttctaaaggggggaaaaccccaccatctattatcatgacatttcccaagtccttgcaccaggcccttagtcaccaggttcccacgttttgttgtttcctaccgtctcaaaccaggttcatgaaagcatttgaacagagttcagtcttcatttacaaaaaaaaaaaattcctaatagtggctaaaatactgcaaatttctccattcgattacatctacaaagataaaccagcattcctttctctttctctcttttggttacttttcccctaccctactggtggaacatttattttttcacacaggttttaaagaaatacattatgttggttctagtgtattgtacagaatccattctcattctttacttgctacattatgactatgagggggcagagtagaggtgaactctctgtatacttgctgaaagtcttcttgtacacattgcttttgtacccgtcgcttctagctatgtatcttcctgttctctgccctcgtctcaaactatttgccacctcaattaatcaggcacttgaattcacattgtgtagaatactcaaggttgatatagactgggaaggaggaggaaggaggcagagataagcgatgggggatactgagccctattagactttggtcccccagcttttggatgaacttagcacattactggctatgcaggactacctctatgggatgcaaaatgactccaagtatggaacaacattgcaaaaatggacttcatattacatgaaggatttggctgctttatataaatatagaaacaagcccagtggattactcactaaaggtgactaagcaaatgttacagttcaaattgcactcaagaagtcaatcgagaataattctatcaccaagcccgtggacctaccccccaatctggtccctctcccagaactcttgggctctctcaagacccagcaattcaggtgttaacataaccctgtccagtggtatggcagtgtcttagtccaatcttttgccataccagtcattacatattttgaataccaacttgtggaggaatttcagctccctttcagcagtagcctagtgggcaccacatctctattcttcttccccattccagcttgatgctgaagggatgaggcttccagactccaaacccctctcaggtcttcatctgcttgttgcattttttcattcagctcctgaaggaatgccaagacatgcaagcctcagaatctgctccatttttagaaagtcgcattttggcaattttttgcagtttgttttcatcttttctttctcccttgatttctggtttatttttacaccctctataaagtggtgatggccttgtcttcacacttcatttggtacagctgaaagttgccataccgcagatggacagttgtttcgctacaggagtaagctctttactgaattccttttggaagtaatactctgttcttcatactgatctgctagagcatggaggctggcaagaatggaacagacacggaagaattatcattggcctcatcagctttcttcagatgagccacagcgtgtcctattagttccataactttcttttcccatacattccattctctcttagattcattacttggaagacttttgcctatagcagcacccaatttggcaatgcaggtaggcattgtttggtatgtattctaaagctttttaagcagttcaatcgctttgtctggctcatcttttcttcgataaaacttggctgactgcgaagaacatctgttacacctggggctttctccaaggcttcttcaactaacttcttccttcaccttcctcttcaccttcttcacgcatcttatgaagcttcagagccaggaggatttaaggtactggttgtcaggattcagccgaatggcttgcctcagagggtcaatggcgtctgagatggtggccagttgtccagacggtagcttgctattgccagtccagaggtgaatttgggttctttggcttcttttccagagccttctcaaagcacaccttcgctctttcattttgtttcctccacactttaaccgtgtccacccttcctcacagtcaagctctggactctcaatctatagggactggaaaacttctcacagacatgtttcaccttgtctacataaatctgaagtctgagagtcggcccatgtgatagtagacccaggcatagtttccccaggtgaccagactctgatttctgcctggtcagcatgctcttgctggattaactcttcagctttacgtaagcttccagggctgcctcgttttgccctttgaggtgctttagataggccagtaggttgcacatgtggctttgaattcacgattctgaaactcagtccggtaaaatactttgtcttcaaaatatccaaggagttttctccctccatcaagttccaggtgaaatggcattttagttgccgtagctgctctccaaggaattcttattgttctcactgtagggaaaaacacaaagatggacttgagacacagatttatatgtcaagaaatgggagcatggcaaataaaatgctcctcctcctaaggctgttaacacaaatcaaagaaactccccttcttttctttctataatatgtttttcttattgttaattcctgcatgtggtagcaggagtttagggactgtgggcagcagaagaatagggcgagggcagtgggttgttctctgagtctgtggctaggttttcatgaataagacagttttgttaaacagctctgccctctctgctttcgagggtctctgtggaggcttggttttattatgtagttttaaagaagtaagtctttttcattgctgtttctgttcttcattcttcccagctttacttttgtactttgaaaatttcagctttataattttttattcttttaatgtttgccatggtgattttaatttctcatccctccgaaatgcagcttcattttatctttgatatcttaattccttagttctccttcatttgcctttaaagaaatctttatcactttcgatttttgtctatttcagcttttaatatatccttcatttattttgtctattcaaactttctgagctttatcagattggttttattttgtattggtttattactttaacatgctacattctcattttttctgtgaatttttccattttaaccatttgaatcttattttcaaccattcttaattttactcattttatctgcttttgtattattctctcatttaatttcaagtattatttatgttgcaatgtcttaaacatttattttggaataaaatgtaattttttttcctcccctccccccatacctctatttcttaaactggtgatttctgttcttaacacatctcattgagttgctctttaataattttgtactttattgttttaattttttttttgaaattttatttttctcttctggttttgcttttataataaggggcaagaagtgcagctacagggaaggctcacaaggccatagctccttttcttatagaaagagctcttttttctttagggtacccttatgactctcctgaaagattttccattccctttagtgttggtcctcaaaataaataaataaaccaaaatcaccaaaccaaaaaacaaaacaaaacaacaacaaaaaaaccccgaaaaaacccagagaacaacaaatgagcaaaagcctgtatttcgaattactttggagataaatagtattctatgcccaaattatttctcaacactgtctgtgtattggagtctctgtaatgttgccttttcttattaaatttttttttcgtggtatctatacagcaacccttgtatcaggagctgtatttctaaaagtatggcttcttatacaaccaatagatatctggaatgtcatgcaatgtggcaggatcattatgaaacatatgtctagatagaagattatgtgacccctctttctaactgcccctctcctcccactttttataccactgcttcccactcccattttgattgggaatcttcctgtaactcactaagaataaaaacagatctgtttggacatgagcttttcaacgggaatgcatctgcattaggatgcctgataccaagccaagcactctccggggctcccgcgcctggggttagttcatcaagggacttagacaacctggctctttgctaagacctatttggagctttgaatggaggcgggtccttcctataaactcctgcctattttccatcctatttttgtttgtttgtttgttattctgcctgggatagttaagtctccatttgttccaagaaacagaggtgagcaggaatgatttaaagttactagagtgcttcacaggaccatgggtaggactgtagtgaccccaggggatcagaacaggacactggggagcttggagggctcagaccctgtgttttctccatgtgatctcagtcacactctctactgcattcattacagaatatggtgagtcctacagaatatgccactctcagaccccaagcatgtgcagcacgcatcctaacacctgaagactcactatagttccttgctccctctcaattctatttccaacttccagttgagtttgggagctcattccctaacacataaactccttagctcctttctcattttacaaaagaaacagagagagtaaataaattgaggttatctccaccatataaaacataaagtctattgtgcatttgcaggatagagtatttaatatacacacttaggtaaaagccctttgagcagccatttaaaaggcatccaactcactgcttgattttgggtttttatttccactggtaagttagagaagctgatgccagaccttgcttcctgggctctggcttgtgaggacctattctcccgattcctatagaagttccattgtatacacaacaacaacaatttcttcctttgcctcttatctggatgaaagccacagtacattatcaaccaggctcagaactaatgctaccaccgcagtctcagaatcactgaggagcttttagaaacacacatcctcagactctaacccagacccacttaatgagaatctctgggagtcaaccctaggactctgtccttaataagctgtccaggcaatttttatgcatgctcaatttgagaaccactgtcttagggcacaagggcaatgcccagtgaaagtcacaatagataagaattaaggaaagaaaggacagatgggtctgtattgtaatgggaaaaattctaagataaaccatgctaaaattctaagaaataagaaaagggttctatagattctgggtgactacaaaaaaagaaatctgtaaatatctcaaatcttttttttttttttttgaaatcaggcagaacattagactagcaggaaataatatcgtttcaagaagagaaatcaggaacctcacagacagaggcaaggtgtctcataggaagtaagcacaggggttggtaacacgggattccagagctccaggatgagggttaggcaaccaggtccggccaccccaccttcaaactggagaaaatatttccttcctattcaatgagctaacacttcctctccagggcagtctcatgttttggggatagagggaatgttagaggtgagaacagaactattttctccaagcactccatctctaattcatctcaggaggcattttggggtgaaaatatttaagtttaccagcccttgtgcaaatctgagtgaagaactacattaaaagtaaaattcacctttgcaggaagtggggtttgctattctgttatatctttaacagtatctgctgaaaagaacccttttgttaaataattgtattacaagtcccaacttaatcctttcaaatatgaaataagacagggtcagtgcacaagagcaatgccccagacccatctttaagtgaagcaccaggccgatgaaacatcatccctctctgctgcctttttctctgattgcaactcaactccccaggcgtgcagttctggagatgaatttaggaagctgccagtgtgaagcagaaaattgttcaggagggaacaaaccaccattggtaagacagattacaaccaacagaggtagaggcatagtaaggctataaacaaacactaaaatggagctggcctctttgggaacatagcttctcaggatttgcattggacaagatgactcaacagcactacgaatacgaagggaaaatatttacctcatggttgcagtgcaattctcagctgttcggcaggctcggttcaggcagctgcactcttcagaaatcttcctcttctgccaccaataaatgcgaagagacctatatatacaagtggcctctggttcctttttgtttgtttcccttcagctgcgttacaaaagggaaagtgaaactagaaagtgaaattggcaggactctttttcttttttctttttattatactttagaggactctttttcctccggagctgagttgtgatcagagaaaaaggcagcagagagggatgtttcatcggcctggtgcttcacttaaagatgggtctggggcattgctcttgtgcactgtccctctcttatttcatattcgaaaagattaagttggggactgtaatacaattatttaacaaaagggttcttttcagcagatactgttaaagatatacacgaatagcaaaccccacttcctgctaaggtgaattttacttttaatgtagtccttcatctagatttgcacaagggctggtaaacttagatattttcaccccaaaatgctcttgagtaaggccaagcccagctgcgtagtgagttagaagaacttcctctttgtggaatgtactgatggatcaagggagcacaactcctaggaggacacatttacaaagctccctgccttgtgattacatattaacccatctttgctctgccttataccaatatgatccacaggccactgtaaggagagttatttagcctcgacagggcaggggattttagtctgaatcattgctgaatctccagtcctgcaaaacaacctgcacattgcatggtatggcaagcattccaaaagtagttgttgacaaatgaatacatgattagaagcatgggcagtgatgtctgtctatctggatttgaaatcacttccacctttatgctatgaaactctggggaaaattattgaatgtctctgcttcggtttgtaaattgggaataatacaactactggtttattgtggtgttgggaggatgaaatgagagatacgtgaaatgtccttagaataatgcctggcagtaataagtaaatgctagtttctatttaattattaactaaaatcgttaaccaaagtgatcagaggggaaactctttttttcaggcggagtgcagtggaaagatcctggcttactgcaacctccacctccctggttcaagtgattgcctcagcctctcgagtagctgggattacaggcacgcaccaccacgcctggctaattttgtatttttagtagagatggggttccaccatgttggccaggctggtctcgaactcctgattcaggtgatctgcccgccttggcctgccaaagttctgggattacaggcgtgagccaccagcccggccaggggaaatttcaatgttggctttttccagaactttatctcctctgacattaacaatccatcacaattactgacctaagccaaacaattcctaacatctccttatgttctggcttccccaagccccacaatattttccccctttttattgatgtataataatttacatattatgagttgcatgtgagtgtttgttacgtgcaaagaatgtttaatgatcaagtcagggaattggggtatgtatcaccttcagtgtttatcatttttatgtgttggtatcatttaaagcctctcttctagttactttaaaatatacataatattgttgctaagtatagtcaccctagcggctatcaaacattagaacttattttttttatttaacggcatgtttgtacccataaccaactctcatcttcccaccaccccccttcccagtctctggtatctattattctattctcatgtccatgagataaagttttttagctcccacatttcagtaagaacatgcagtatttgtcttctgtgcctggcttattgcatttaacataatggtctccagttccaactacattgctgcaattacatgatttcattcctctttaatggctgaataatatcccattgtgtatatatacatattttctttatccatttgttcactgatgagcacctatgttgatttcatatctttgctatatgaatagtggtgtgatgaacatgtgagtgcaggtatccttttgatttactgatttatttcctttggatagacatccagtagtgtgattgctgggtcttatgaaaattctatttttattttttgagagctttccatactgttttccataatgactgtactaatttacattcctaccacagtgtataagagttccctttcccctgcatccttgccagcatttgttattttttttttaataatagccatactaactggggttagatgatatctcattgtgatttttatttgcatttcttggggttgagtgatgttgagtattttttcatatgcctgttggtcacatataccagagtcctttataggtgatgagatgcttttcctttgctgtctttaaaattttctttttgtcacgactttagatagtttgactataatgcgccatggagaagaacgtttttcactgtatctgatggggattgctgggcctcctgtatctggatgtctaaatctcttactagacttgggaagtctcatctattatttcattacataggttttcaaaccctttcagtttcccttcgcctttgggatactgataattcatatatttggtcaccttatggtgtcccatagatcgtgaagactttttcatactttttaattctttttttttctttattttcgtcttattggattatttcaaaagcctgtcttcaagttctgatgttttctcttctgcttggtctagtctactgttgaagcttctgtatattttgtatttcattcaaggaattcttcagttccagaatttcagtttggttattttatgatacctatttctttggcaaatttctcattcatatcctgaattgtttctccgattctgtgtattgtttgaattgtattggatttggaaatctcttgtatcttgctgagcttcttagtattttttatatatacatatatattatttttttattttttatttttttgagatggagctcactctgttgcctaggctggagtgcagtggtgcgatctctgctcactgcaacctctgctccctggttcaagtgattctccttcctcagcctctcgagctgggattacaggcatgtacaccatgcctggctaatttttgtatttttagtagagatgggttttcactatgttggccagctggtctggaactcctgacctcaggtgatccaccctccttgtcctccctaagtgctggattacaggtgtgaggcactgtgcttagtataattttgaatagtttttcctggatttcttttgattgggatctgttgctggggaattgtattcctttgaaggtatcatatttccttgctttacatgcttcctgtgtcctttcactgatatctgagcatctaatataatagtcacttcttcaatttttgaatttgcttttgtaggggaggactttttcctgaagatatatcaacaatatggttgagtaaggcacttcaactttgattctgagtgtgcatggtagtgtagcctctgtaaatttatttggctgtgatcagtgatatatatgatttccttgatggtttagggtggggttattcttggaggctatcgtgacattttactgggaacagggttgccatgtgggccagtcttaggccccagtggtggcagcagtgggttgaggatgtctgatcttcggccccagaacaacaacactggcactggtgttagtgggaccaggtaggctaattcctgggcccccagatagcttctcagatgctgatagtggcagcagtgggccaggtgggtgagtgggttctcaagtccctggcagctgatgtgatctgggcaatggcagtagccaacggtgggacaaacccttgggttctataagtgtacactgatgttggcagtggctgtggtgcagggttgccacctataccacagaacacagctctcaggctctttcattctctgtaatagcaaccccgcagcactgtgcagagaaggagagacgctgttctttaggtgtgagcctaggcacagaggccatgcgtccagtggggtgcagtcaccactcacagcaccagacaggcggccatctggcttccctgccccagcctctgtagtagcatcagtggctgtgcctgcagcagtgtgtagaggacaagaaggggctctgcttctacatgtaagcccaagcacacagcctgcttcactagtgggagagtatctcactatcccttgtgaggccgagtacagagtttgtggtgctgctaagggtagggtcacttctcacagcccaaacaggaggctctggaaaggacatgttttagtttcctttgtatcaggggctgtcttttggcacattgcaccattctttccctggggagtagtactccctgtgggctggggtgctgggacactgtattacctttgggtctagccagtgctgtgtcactgtagcccactgggtggaactgggaaatatcactgggggctcctgggatatggagatatgggagctgcggttcccagataggatgtaattccatgactatagtctcacaatggtgccgcttaggtcttgggggagcgagagacccagcgtgagttccctgtctcatgaaatacccttgtggggtctccaaatcacacccatactggtgtcagagtttgtatgggtagagaaactctctcatgtttcagattgcacagtttgcaggagggatgtggactgctgaagttctctcatttgacctttccctgaaatgcaaggccctctgttatcctggccaatctcagccaagctggccacttgataccttcttctctgcgccttgggtgtttcccatgacttctctgttgaattctagtgttgtctcctagatgtctattcgaggtataattatctattcataattttggttcttctttctagagagggtggggtctgatgtctctagtcagccatcctgaaccagaatccccaccatattttaaatccctgttgttgccctggtatttgacatccccaaatcacaatgtacagccatagtgttttgtaatatagaagaaatgtattttccttattcatacccttagtcacaaagggggtaatcatgtattaggcccaaaagaaaataatagtacctcaaagattgaggtcagaaaattacacaaagcaagatagaacacattctccagcaaaactgaggttgttaaggtaggttattcagtcttgggaaagttatttaccataattttttttctgcctagggcagggaggaaaaagaaactatcctcctaaaaagtctccaccctttgattaggatgcacagctaagcctgtcccagttggaaaccttacttttgtgtcttacgcaagagtttcaagttccttttctgtttacaagttcttcttttcttttttttttttttttttttgagacagtctcgctctgttgccaaagctagactacatggtgagatcttggctctctgcaacctctgcctaccgggttcaagcagttctcgtgcctaccctcccaagtagctggctacttggcccagctaccaggcccagctgatttttgtattttagtagagatggggtattgccatgttggccagtctggtcatgaacttctggccttaaggatctgcccgccttgggaagcactcccaaagtgctaggattacaggcatgagccacagtgctggcttctatttacaagttctattaggtacttacagaaatgtatgttaggtttttaagaatgctgaaataggaaagtggaaatgctgtgggtttggtttgatttattttttgaactcgtattcaagaaaactattggataggaattttaaaatcttgtgaataaaggtactggttgggagaagcatagagaaaggttttgccatggtcactgtgctttgaaatggttgagatactatttacacttcagaaatttgtatggctagtgcctgtatataatgttaccacagcaggtagcatcagctgatttagtagctgggttagtgtgagactatgcatgcaatgtgattgcaaatagcaactgaaaaggaaaaccaactttctcctggtgttatttctattttgagaaaatgaacttattagaaagagttctgcctaacctcgttgctacaaatatatatgtgtctttttccggaatataggccctgttcatatttcctagaacaatagatttcatttatatagaatatagtttgcttcctgttcctggaatgggttacatcaactacagatggtataatgcaataattccatattgctacttgccaccagcaatatcagcatcacctggaagtgcaaattcttaggcccattctagactgatagaatcagaaattccagtgtgggacccagaaatctaggtgttgatagccttccagataattataatggatgctaaagtctgagaaccaaataatatattgaatgaagcaaaaatacttttacttctataaaatgaaactctatgctttttccttgagatttttaaaaaatttgaccctcttttttgttttgagtctatttttaactgaagttttgtccacctgaagagctggtgactgttcaatagtattcgcacttgttagaggaatacttaggtagcccgtgggttctcttgatccccacaatgggctgtaatttgaaaacaatgtgttcccacctattgacattcccttctgtactcattcacaaatacacgtttaaaatggtcttccacatgaactcaaaaatattgatatagttaataaaatagctccccattcttttttcctttccattccttcctttcctttcctttcctttcctttcctttcctttcctttcctttcctttcctttccttcatttcatttcctttcctttcttcctttttttcttttttcttttcagacagagtcttgtctgtcacccaggctggagtgcagtggcgcaatcagagctcactgtcgccttgacctcctcccaggctcaagtgatcttcccacctcagtctcctgagtagctgggatcacagatgaggccactacacccagctaattttttatttcttgtagagatagggtctcactatgtttcccggctgctctcaaactcctgggatcaactgatcttcctgcttcagcatcccaaagtgctggattacaggcataagccacagcacttggccagctccccattcttattcttttttcaaaattaattaaacaccatttcttcttgctgtggtttgaatatgtcctccaaagttcatgtgtggaaacttgatccccaatgtggcagtgttgggaggtgggacctaatgggaggtatttggttatgggggcattgtcctcttgaatagattaatgccattattgagggacggagttccattaaaaggatgacttcaaccttctcttgctcaccctcaccccctatttacccttccatcagggatgacccagtaagagggccctggccagatgtggccccttgatcttggactttccagctccagaaccatgtgtccataaatgtctgttcattataaattacccaatctcccaatctcccatctgtggtattctgttatagcagaaaaaaatggactaagacatttttcagcattattttttagactgcagttgggcagtctttgagtggaaacttgatgcgggtaaatgacttttctttccatagtcctattcagaaataagaccatgctaaataaacttctgctgggacaattgtacacttatccctgttagaacactaggagtatttgtttcattcattcattcaccattgttcatcaaatcaatacttactgagaatctactatgtgccaggcaccattctaggctctaagatacatcagtacacaaagatctctgtcttcatggagcttatattctatcaggaagaatggcaataaacaactgctttggactgaattgagttcccaactcctttcccaaaattcacattgaagccctaaccctcaacgtaactttgtttggagatagggcctgtgaggaggtattaaggttaaatgaggtcttaagggtggggcccctaatctggtaacccctaatctggtaaactgacgtcttcatacaaacaagaagaaaaagaagagacctcagatatctctctctctcctctctctctctctctctctctctctctctctcgtctcacacagaggaaaggccatgtgagataaagaaaaggctgccatctccaggtcaggaagagaggtctcaccagaaaccaactggacttctagcatctagaactgtgagaaaatagatttctgttgcttaagccacctagtcgtgatttttcattatggcagccaatgtagactaatacaataataaataaattagacaattgggacaagtccatggggaaaaaaaagagtaagtggagaccgtaagaggaattacatatggtggagaaaagggggccgggatctgactgctgctgttaagtaatagagatggaaactggttagtctgttctcatactctagaaagatactacctgagactgggaaagaggtttaactaatcacagttccatggggagggctcaggaaacttgcaatcatggcagaaggcaaaggggagcaaggcaccttcttcacaaggcagcaggagggagtgaatgtaagcagaggaaatgtcgatgcttataaaaccatcagctctcatgaaaactcactcattatcatgagaataatatggggaaaccacccctatgatccaatcctcccatcaggtcctgcccttgacacatgaggatatggggattataatttgagatgagatttgggtggggacacaaagccaaaccatattagaacctttctgtgcctcaatttcttcatttttaaaatgagaattgtgcccaggtacagtggtcatgtctgtaatctcagcactttgaggggcagaggcaggagaattgcttgaggccagggtttgaaacaagtctgggcaacatagcaagaccctatctctacaattaaaaaaaaaaaagtagccaggcatggtggcatgagcctgtcctcctagctacccaggaggattgctttagccaggagtttgaggctgcagtgaaccaagattgcaccattgtactccagcctgtgtgacaaacgtgactaggtctctaaaaaagaaaaaggaattatgttagtatttaccacatagggtttgtggagattgagtggactactatgtataaagctctgagaacagtgcttggcacatggaaatgcccaataagggttagttattactaccttctactgccacccataccatttaccattttgaataccacttacttctagggccaggggccactcacctgaaagtggtctgttctctatgtggagctttgactatagtattatcaggtattggtggctgccgctggattgctatttagatcctttttttctttttattcgctttgttggccacagtgagaaactgggatgctactcagaagaagacaaatcagtgcctctgtacaaagggatctttgtgctgccaaaagagtagaaagtttatcccagaaccaaaatatttcagaattgtggaaaatcaagttttggaaacctctcaaaagaagaagaaatattgctatcacagaatccctgaattagtatacacctagccgtgtaacaaagatgctcaaaaacataaatgacactgtaaaagaagtttatttcttgttcaataactgtccaaggctggtgttcctgggcaacttccagttctcttccatgcaatgattcaggacacagagttcttccatcctgtgactctaccatcccctagagcctggaaattgagataaagagggtacacctgattcttaaccatctttacttggaaatgacatacatcacattcctcacattctattaggaagcactagttcatggcccacctggggagaagtgaaggttagtcatgtagctgcagagtaggaagcccccttcctggtgacgacttcatattatgaaggggaacactaatttggaaggatcatgagttgtttccacaacagtatcctgctctggccctaaaaaccatgtatacacttcttcccaaacatagaacataatgggacctttcccaggggagccacccacagtcaaggaatcattgcactcagctcatggtcagggatttctgagtaaagcacgtcctgcctaaaggtcagtatgtgactccttgtggtctcatgcttaaaagaaaaaaaaatcaaaaggctagttaagactatataactcatgtgtatcatggtatcatgtattgtggtagttaactataataaatactttaaactgaaaaaagacagcatggaagaatctcagggtgtgcaacaaatcacaaaataggcaccaaaagagttatatgtggttacctctggagactgggaatagggtggaatggggaagggggttgctatgtctcctaccttgtagatcacgttgacttttaaatgatgtgaatgtatacatttaattaagctaaaaaggaaggaatctggaaggcaggaggaaggggaaaaaatgaggaagaagagaatggagggaaggaacaaaggaaggaagtagaggaaggattggagagaaggaaggaaaaaaggaatgaaggaggaaaggaaggaaggaggaagaaaggaaatgaaaaaaagaacaaagaaaggagaccgagaagtcatcctacatccacatccatattttgcaatattattatgaagctctcaatacccatgtcattgaaaaattgaataatatcagaaaacactcacaatataatgttaagtgaaaggataagatgaaaccaacgtaacatacacccttaactttgaaatattttccaaagaaatctattttatatagtttcatcttttccacgtgaagagaccaccaaacaggctttgtgtgagcaataaagctttttaatacctgggtgcaggcaggctgagtctgaaaagagagtcagtgaagggagatagggccgggccgttttataagatttgggtagatagtggaaaattacatcaaagggggttgttctctggtggcagaggtgggggtcaccaggtgctcagtgcgggagcttttgagctaggatgagccagaaaaggaatttcacaaggtaatgtcatcagttaaggcagggacaggacgttttcacttttttgtgattcttcagttacttcaggccatctggatttatacgtgcaggtcacaggggaatgttggcttagcttgggctcagaggcctgacattcctgtcttcttatattaataagaaaatagcataaaatagtattgaagtgttggcagcaaaaattttgggggtggcatggagagtaatgggcgatgtttctcagggctgcttctagagtgggagagattaagctgaagaaagatttgtggtaaggggtgatactgtggggttgttagaaggagcatttgttgtataggatgatggtgatggcctggatacggttttggatgaattgagaaactaaatggaagacataaggtcaaataagaggaggagaaaaacagataataaaggactaagaattgggaggacccaggactctaattagagagtgtccaagggggtccaagagggtttagtgtaattacttgcttggttgcaagtttttaggctctatctttgagttttttttattgttgtcatataccaggccagatgatttaggtaaaaacagcactcttcatgtgaaaatatacagagtcccccccccccttttttttagcagtgagtaagtcaaggcctcagcgattttgtaggaaagagaaatgcaaagccgcaattgtttgttaaagaaggattagaaatggctaggagagagtgactgagattgataggtggtggagatagctggggagaggtagagggtggcctaagaatgggaacgagaataagataagtgtaaaagtaaagaataggacttcatcggggtgaaagtattagagtatactttgtaccaaagatcttctatccgttcaaacagagacttaagggtggcagtttgaggtaaaaccggcgccactgaataccaagagcctgagaaactgcttgggtgatttgactaataaaggccgttcgttattagactgtatagaggtggaaaggccaaacagaggaattttgtctcacagagggaagaaatgaccatggtggccttttcagaccctgtgggaaaggcctctacccatccatgaaagtgtctacccagaccaaaagggattttagtttcctgacttgaagcatgtgagtaagtcaatttgccagtcctgggaagaggcaaatccccgagcttagtgtgtaaggaagggaggggcctgaacattccctgaggagcagtagaatagcagatggaacactgagaagtgattccttaaggatagatttccatgatggaaaggaaatgagaggttctaagaggtgggctagtgcttgtaacctacatggaagaggttatgaaatgacgatagaatagaatgggcccgtgagctggaaggagatattttccttggtccaagaaccatttgccttgtgtgggaagagattgaaggtggaagtttcagtgggagagtaggtgggagtgaccattgagaaggagaaaaactggcgtgaaggacagaagttggaatgctagctgcttctttagctaccttatcagcataagcatgccctgagcaatgggatctgatgccttttgatggcccttgcagtgaatgactccagctcctttggaagtaaagcagccttgagaagagtttttattaaagaggaattaatgatggagacccttgcgtagtgaggaaacctctttttgcccatgtaacagcatggtggtgcaggataggaaggcatatttagagtcagtataaatattgatgtgtggtacttttgcaagagtgaggcccgagttaaggcaatgagtttggcttgctgagagataatggagggggcagagtggtagctcaatgataggtgtggaagatactatagtatagcctgcctttgctggtgagtggagataggcctggtggaactgccatcaataaaccaagtgtgatcaggatgaggaacaggaaagaggaaatatggggaaatggagtgaatgtcaggtagatcagagagatacagtcatgggggtggggccagcctaaaacaataaggtcaggttgtttggacagaaaggctacaggatgcagtctggctcttgtgtaagaattttgactgcacagccctgtactttcgctgtgtgtaatgaaagggttgggatgagttagggagagctagcatgggggcagcttctagggctgtttttaagaatggaaagaggagtggcaaaaggatttaggatctatggggtcagctaggtttgctttttcagtttacataatggtttagtcaggatggtaaaactaggtatccaaaggtggaaatactaaccatgcctaggaaggaaagcagttgttttgtagaaggagttggggtttgggagattgtcagacatgatcagcagggagagcacatgtgttttcatggagaattatgccaagatagtaacagatgaagaagaaatttggacttgactgaagtaatgggggctgtccgcaaagcctgcagcagtacagcccaggtaatttgctgagcctgatgggtgtcggggtcagtccaagtgaagtgaaaagaggctgggatgaagggtgcaaaggaatagtaaagaaagcatgtttgagaccagaacagaatactgggttgtggagaggttgtggagggaggtattgaggacaaaagaggtacgagttgggcactacagggtggataggcaaaacaatttggttgataaggtgcggatctgaactaacctgtaagacctgtctggtttttggagaggtaaaatgggggaattgtaagagagtttataggctttaaaaggccatgctgtaacaggcaagtgataacatgctttaatctttttaaagcgtgctgtgggatgggatattggcattgagtggtgtaagggtgattaggtttaatgggatggtaaggggtgcatgatcggtcaccaaggagggagtagaggtatcttatcttgtgggttaaggtggggggatatgaaaggaagacatgaaggaggctttgggttgggagaagggtggcaatgagatgtggctgtagtttaggaatagtcagggaagcagataatttgttaaaatgtctcagcctaataagggaactgggcaggtggggataattaaaaaagggtgctaaaagaatgttgtccaagttggcatcagagttggggagttttaagaggtttagaagccggccgtcaatacccacaacagttatggaggcaagggaaacaggaccttgaaaagaaggtatgcagagtgggtagcctctgtattgattaagaagggaatggacttaccctctactgtagagttacctaaagcatctgtgatggtccaggaggcttctcaggtgatcgggcagtgtcatcttcagccactaagcccagaagatctgggaagaagtcaatcagagagccttgggccaggttccaggggctctgggagtggctgccaggtgagctggacagtctgattttcagtggggcccacacagatgggacacagcttaggaggaatcccgggctgtgggcattccttggcccatggccagatttctggcacttgaagcaagatcctgatggagaaggtcctctaggaatgctgactgctgcggcttaggcattttgaagttcttgtgtgctggagatgtggctggggtttcctcacagtggaggcaaggaattgcaactcagaaatacattgttacttggctgactctacctattattgtacaccttgaaggcaaggttaattaaatcctattgtggggtttgagggccgaatttaatttttggagttttatttaatgttgggagcagattgggtaataaaacgtatatgagaataagacggccttttgacctttcagggtctagggctgtaaagcatctcagggttatgccaaacaagccatgaactgggctgggtttttatatttgatgaaaaagagcctaaacctaactgatttgggagaggttggataaagaaaaaggagcattaaccttgactatgccttagctccagccacctttttaagaggaaattgctgggcaggtccgggagggctagtcgcagacgaaactggaagctggactgggtgtgaggaggggaggtgatagaaggattatagggtggggagcggaggctaagggagaattggaactggctcggcctggctaggagcagcctggggggaggggagaggtcagatgggtccgtagaaaaggaagattggaaagacttagtgacactggggttggaactgaggggacaggcaggagggaaagaaggaagatttgggatgagttgcatgggaacagagattagggagggacgagggaccgatgtgtaaaagaatgcctggacgtcagcacctcagaccatttgcccatttttcgacaaaaattatctaggtgttgtaggatggagaatcaaaagtgccattttatggctctttggaaccactgtcgagtttgtattggggttaatggcattgcagaagaaaataaggcatttgggttttaagtcgggtgtgagttgaagaggtttaagttcttgagaacacaggctaagggagaagaaggaggaatggagggtggaagtttgctatagtgaaggaggcaagtccagagaaaagagagggtagagacacagagagaaggggtgggggttcttgcaccccaggaacatggggaaggggtggggtgtttgtcccccagggaagggagagaaaagagagggtagagacacagagagaaggagtggggggtgcttgccccccagaaagtggagaaggggtagggggtccttgccccccaggaaagtggagagaaaagagagggagagacatggagagaaggggttgggtgagcagccctgggctgcaaatgtgggtgagcagcaaagcaggtgtccccacaattgccttgccactaagggaatgtgggtgaatgaccaaggaggcatccccacggtgatcagacaccaatgaaatgtgggtgaataatcaggcaggcatcctgcagtgattaaacaccaagggaagactgtcttcccgaatctgtgaccagcactggagtttgagtccacagataaaacacatctcccgtatctctaccaaaaaaggaaaggaattgaattaagagaagggaaagattgaagtgtggtgccgagattgaaaggagaaagaggttgaggatagtgagagagattggagaagagagtaaagacaggccacttacccgatttaaaattgtgagatgttccttgggctggttggtctgaggagcagaggtcgtaggtggatctttctctggaacaaagagcaggaggacaggggattgatctcccaagggaggttccccgatccgagtacggcaccaaatgtcactcgcgtccatgtgaagagaccaccaaacaggctttgtgtgagaataaagctttttaatcacctgggtgcaggcgagctgagtccaaaaagagagtcagtgagggagatgggatgggctgtttttataagatttgggtagatagtggaaaattacagtcaaggcggatgttctctggctggcaggggtggggggcacaaggtgctcagtgggggagctttgagccaggaagagctgggagaaggaatttcacaaggtaatgtcatcagttaaggcagggcaggccattttcacttcttttgtgattcttcagttacttcaggtcatccggatttatactgcaggtcacagggtatatgatggcttagcttgggctcagaggcctgacatatagcgtaacaggtgtacacagaagcataatgtttaaatattttaatttcagtgggtgatataagggcagtatgattttttttcgcttatacttgctggcatttttccaaagtttctttagtgtgctatagtattcatatcctgagaaaaatctttcatgattctaatctttttattattattatttttaaagatcactgagaactaagagcaaaatgcaaagggagatctttttgaggtctgacaagcccagcttcactggaggcttttaggggcctcagaggtgtagatgctggtttagtgctgactgtggctccttagaaaagaaccagctaaatgcagcctgtcctttgctagagctgcaatgctgagctctgacacagagaaaccctgcctctatgatgaatatagcctcatgctctgactttcaaatgaaaaacagaaacacacatgcttgttaagaacgtttcagcctggtttcatcattaactgatgaaaatgtgcctgcaaggacagaatgaaatagatttgcccctcctctccagcaacccctcctatgagggacgttcgtctctggctccaggctctggccacttccggttaggattgctaaaggcttccatcagggaatgttgatatgagtctggaagcgccacaattttaaaatgcctgaattaacaagaaacaagtattctctaagatatgttaaatatttagcagatgcccaaatccagcacctaagaaaatctaccttgaggttttcaaaggcacacaaataatttcaagggataaatgcaagaaaaaatcctttacctcatggtcgcaggctgggcgtgcactggtgtcctgcagtgttctggcaaaggctgatttgctgcttagaaatctgcctggctgatggcagattcagaggaaaggaagcactgtgctgctgatgaaggatacctttatggtacttgcaaatatgaaatggaagtgtatcctggcaagtacaaacaacataactacactgtttcctgctggagggaaaggagatttcagcagggagagctttaatctttctggctgggactcaactggaacaacgtttagggggaatagtgtgtaaggaagttcaaggtagatgaaatttactagaaggaggattagcaatgtagtggtcagagaaccagaaatctaaaaatgacccaggactagggtggattccggagaactgttgtcatcactagctaatattaatagtgacacagtagctaatgttaaaagaaaaaccttagacaaattaaatttagtagagtttaattgacaaagaattattcaccaatcaggcagacttccgagccagagtggcctcagagagactccgtgcagctgcctggtagaagatttatggacagaaaaaggaaaatgacctataaaaaacaaagtgaggtacagaaatggaagtgttggttacagcccagcatttgccttattttaacatgtttgaatggttggccacctttgattggccaaaactgtgagtggcacaggagtaggttaagtctgtttacacatccagttaggttatagtttactatgtacagaaaaactgtcagggtaacttaaaatatgcaaggaggcagctttaagtgaaacttaattcaacactaatattgatgagaatttttgctcagggctttataggacttacctaatttactccattttacactcatggaaatatggccatttaacagatgagtaagagaagattcagagaacttaagtgatatgccaaggacagaagtccaggtctgcccaattctagaacttcccttgttcagtgtgttccttagtgcagcaagtctctggatctaaactatatagtttctgatttcaactctgaaatgcactcttgtgtgaacttgcatccgttcttcatctgtaaagagtggtagcacctatttcataggttgttgtgaagctcttagaatagtgcctggcacataatggattcgatgaaagtatctgtttctttctttcttttttttttatttttttgagacggagtttcgctcttgttacccaggcggagtgcaatggcacgatctcggctcaccgcaacctctgcctcctgggttcaagcgatttcctgcctcagcctcctgagtagctgggattataggcatgcaccaccatgcccggctaattttttgtatttttagcagagacggggtttctccatgttggtcaggctggtctcaaactccaatctcaggtaatctgcctgcctcagcctcccaaagtgctgagattacacgcatgagcaccatgcccggccaaaagtatctgttttcatttgctgttcagaatgagttttggcctcgctgtatttcctacttctgtcaccaactgtttgtgatattagataaatcataaaacaggctcagttttatgctcagagaaataaaaatcgttggtctggatgatccttccaggaccttctcagtatgaaatatgatgactaacatttcatgaatccatatcctggaatcaagttcaagtgcaaaccagtctaggtctgaggttctgggaaagtcacagtagttctgtgccttggttccatctctgtggaatgagaagagtaaagttgattaactcttgcctcatcaacagcaacatgtagaccctgcatgtgaatgcacatggaacactaaagggaaaactctaatagtaccatactgtttattctgatggagaaccaagagccagggttgaatatctcagccaggaacactagtagggatagtatgtatagttctcagtagctggccctatgatgttcatgccagaggactgatttcataccccaatagtgtggcttattgccaaataccatcatcatacatcctgcctatactttccctaaaactggcatttatgacctaaactggttccaaactgagatgttttcacaactattgagctgagaaagtcagacaaaaagtgcagtagcgaagtgtttgtttggtttcggaatatcagtgcttgagttcacatctgttcctaccacttaccagtggtttgaccttggtaattacttgatctattggagccttagtttccacatctgtaaagtgttgagtattgatacaaccttgtggagttaaagataaattttgcagtgggcacctgttaaaatgtcaagagagcttttattttttttcaagactattacaatgagagagacagactattgcaatatgggagaagactaaactcaacactgaatacaacaagtgtggatttgtagtcaacaggccggatgaagagtggatggaaaattactaaaaagaacttgcttagatatcaaggcctgggaaagaagtcttaattgtatatcagggtgggggggcattcttgataaagtggctcagcaggattctttctaaaactggtctctgaaggagaaggatgagagccatgttgaggcctagtcaagaagaggctctgactaaaaaggaacctgcctaaagtttggtcaaggagggaatccttctcaagagtgcaaatacttaacagacaaatatttgccttctttttaaaatcataaatagccactgttttaaaaccaaagttatttattatttcctctgtggcatgaccatagttggaaatatattacgtgctttttcttcttgtacttctttgtttaagacttttcacctataatatctgaggcagagtttctttagggtaaattgggattataatagctggaatgcaaagaggtaaacagaataatattcagccatgaattccaaaattggccattgaaaccaacttcagaaatgataccataaaaaacactggagcagcttagtcagaaatttctactttggaataataacgaggaagaagcatcagataaaacatcctcacacattctatctttagtgaaaccagatggtgaagaaaattcagacttccaaccgacacataaatatgggctacggtcaaaagtagcagaaatcagcaaaccaacatgagaaactctgactggagatgaatgggtgaagctgggaccaacttaaaatgggacagtgtttggagatggcagatcacaaaattagaattgagggtcccctcctaggaggaccgtcactctgagtgcaaacttctgaaagcagaaatgtaatccagctgtgtttaacgcaggcgaggcagtgggaggcgaagggagaatgtacccaggagacccctcccctgccttcagtgtctcaaggaacctttcctgtttgcctgagagcacgttcactttttacctgactatgagggagattcttccttttgtttttttctttgctacacattgatacccttaaattttttcatatgttttctaattataaaaataaaaatctatatattataaattcatcagtataaacaaataaaagtctgaagttaaacttggatcataatgtgctttaatcactccccatccatgtgttttgtagctgtggttttcaattcaatgataaatcttgggtatctctccatgtcagtcttataatcttgctattttttttcaaggacaacatttaataggcatattttaatgtttattaatgtatttttgctggacatttaagtcattttcagattatcactattacaaacaatgtgaagtgaatatcactgtatgtccgtctttgtacaattgtgtgggtttttcaatacgatcattccggaaattagaatttccaggtcaaagaaattgaccagatgcttcacaccatgtctaaatcctggccccattttttgtccaaaatggtgttgagttgctatttaattcacacttgctaccatttcccacttccttacttaagtacagtgtgtataggccaggtttaggctggaaatccctccttccactgtcaattctgttacccctctgggagcatgggaaggtcacttttgtttgtgggtttatattttcctattactttctcaggaaatgaatgaatttttctatcaatgttctctatcatcccttgtggtttggctcgaagccctggtctccaatcaagggtcatgcaggaacttggctcctgccaatacatttagaaatctggaatccttccataaatgcaaacccttacactcccatctttccctatattctgccacctggtagaaagcaaatccctgaatgttctccaaaactctcttccaaccctaggaccaccaaaggcctccctcacactcttcattatctgctaattcattctctctctccttttctagaaaatagtcctctttggcttaactggtggaaattacactctcagtaagctaagagggaaggaataagaggatataccatactatggcagggagggtggtgaaaggccagggttcatttcagctttaaagcactggagctccaaaggacacaaatcatcacatagaaactcatgatcagtgcactttagaatgcttctcatctcctttgggggttattctatttctattaatgtagtcaagaatggtggctatttttctgggcagattattttggtactaactggtctttcacagaagccattttctcaagtatgttctacatagctacaagcaattgttggtaaaaacctgttaccattctgtatgtttccattatatattgtctctgtgtgtgtgtgcatatgaaagaagactatatattatttttatcaaaatatattagaccatgtacattcttttaattatactatatataaaagtaattttatattacatatttaaaatataaacatatgtaaataatattactataacacatatgtaagtaatatatatttgtgttcttccataattactttttttaacctagactgaagattttacatttttcacaattaattatattttatgagacttcttacttttccaaagcataaagaactatttggagcctgttttgtaattttatatttttggttaatattccaaactaagataacattgccaggtcttccggtctgaagcaaaatagagcagcattttagttgtgtggccctggggaacttgcttaaccctctttccctctgcttcctatcacagatgtttattgtaaggattaaatcagctaaaccagaaaagcctcagggatggtgcctggcaaactgcacgctgttaatacatgttagtggaccttctccacaccttcctgctacactaaagcagagagaattacctcctgaatcatgtttgcgaacttctgggcacagtgactcaactcccagctattcttgtcatggattttttctcttgagccaatccagccatggagatcactggtcttgtgacttattttttctctttcagtatgaatcattagaactgagaaaatgaaaacattcctgttattacttcctgagagaaagaaactagtaacatgctttggtaggaattgttcttctttttcctgctgtgtccctcttgctggtccaccagggctcttggtcctgagcctgatttacaccaggagcataatctgatcaaaaagaggaaactaaagaaaaaaggcaggattgtatgaggggttctcacaatggcagtacataatccttatacctcgtattatgtagacccctgtgtttccaagttacctttgtaatttaggtagtgagcacgaaacacttaaaaaaacacaaatgaaaacaagagaaaggaaagagtggggagggtttgtttatttttgaaaacaacgacaacaacatagagtaaaagttaccaggtaagtcaaatatagtagtactttgttttcttggaagatgaatgaaagaagtcaccttactgcctcaatccagtcatatccctgaacccaatcatgaccagcagaggttgttctaaattgtttctccaatatagagataattgccaataatttttcagtggttgttttctgtattctctgtatttttagggaagctgaactcagaaaacatactttgtccatctagccatccatttatcttttggatccatctttattcattcattaattcactcagtcaatatatattgaatttcaaccagtgtcagacactgttccatgcctctaatgttctgcgtataatgcaagtaaaactaaagaagctaacatttattgatccctaccgatgtgccagtaaccctcttaggtgttttacttaaatatgtgtttaacctctgaaacagctttatgatatatattgtgattatctgctttttaatacgagaaagcagactcaaaaggattacataacttgtataagatcgcacacttgtaagtaaaatgcagtaatgcagaaatgcagtaacgctatttcctctcgtattgcagccactccatcccagcgaaccttcctactgcatgcaggctttattcttccatcactttcctcctctgttctaaatgacattttcacccccatttcctggatacttccttcttttaatacacagtaagttatgtgactgggtttggcattcatctaataaaaacagccattaggtatatattcaataacatttagtgaagccaactgatgagctctggggtgagtactagggattcagcagtgaatagacggagggtcgagacagggctctgggggctaggctgccttcgttcgacctcagacctccactcgctagctcctctagccattatttagtatttctgttgcagtttcctcatctatcaatgggaataataatggtaattattaattaattgatattctaattttcaattaaaaatcaatggagttgtcaggattaaatgactttatacatgcaaaccacttagaataacactttgagccactaaatattaaataactggcatatgttattattattagatggatcctaccctcaatgccttacagtttggtagacagaaaaataagtctcttccaacgatactgttaaactaacagaaacttggttaaggtcatttgatcatctaaggctctacaacagtacagttttacagtcttattttaaaatgttcccctctaatccataaagatatctcaagatagggcaatgccatacttggtgtattatagttaaccaatactgtatgtggaacataatgtggtgtgatactttgaatttgtgtctatctgctgttaaagagcctggctgctaattgagtttctggaaaaagtgagaaatgtcttagctcaggctggtataacaaaataacagaggctgtaactacaatcaacttgcaagtagaagatctttgcttcaaacctagcagtctggctctagaaatcaggactggatgagggtgaagtgagtgagggcctagggcataaaatttaaggagatacttactctgaggtagttcaagtgctgaccacacatttgcaagacgtgagagtgagtgtcttcttaatggcattaagtgccttgcttaccttacctatctagtcccagccctatccagagcctacctttacaactctaccttttaaagcttaacatcctctacaaaattatactatggagtagaaagttgtactgtgaactgagctggcattattctcacacaagctatgtacttgagcatcaaagtagtattaaaatagatgcaatcataacataatctccatacactgcagttagaaagttattatgaagcatctggtatatctggacatacaatcatcaagtcacctgatagccctagagcggaatgaaatttgagaggatcatttggtaaaaggcatatactttaaaaaaactgaggctaaaaaagtaaaataattttcacaaaacgacagagccagaattggcagaaatgaaagtagtcactagttttctaatcccagtttcactcgatatctctgattgtgtattagtcaggatcagcaacagaggcagagccactggaagggatatacacgtttcttttgggtatttgatctttgcaattgtgggagctggccaagccggttctgtaaggctcttgatttcatgtctggtacgaagcttcaagtacataaggcaggtggaaaaaatgggaagatggatgaatgtccagtggcaggacaaggacaggctggaaccacaaccacgagctgcagttccacaaatacggactagacccaagtcagctctcactgcctctaacccctcctgcaggagaagcaggagcccttcatatggagctaactacacacctggcccaggattcagagatgctgaaggaggattcaggggagttggagtagttgcaggtctggtacaccaaggagttaacccaggagatgggccatagtatctgtggttcacaaacacacctgcttgaacgttccaagcataaaaaggctaaatagttgttcttttccaccctctaaatcacatgcaaaaatgtctactgactcatcctgactgaaaaacgaggaaattctgggaaacacagttcagcctagctgagttgagacattatttattataagccccgacagtttcaactctacttctttacctagctcagacactgtcatgtgagcctttggcagtgtctcttaagatagaatgccttttcattttaagaaaacattaaagaataaaagcattcttgacttctgcaatgatggcagaagtcatagcaccagaagcctcttctaataagcagcagcatcaacaaattaattcattctgcatctttgtgtgttataggaggaagaaaatccaataaagtctgtctcaacagaggtcacctcccacccatcagacacggaaattccagacctgctgggagttctggtggccatccttatccctagtctcttgtcattgttcaaggatagggaaaattcctctcaacctgctagatttcagcagcaataaacgggattgtttataggtcagtgagcccaggatactaagggacagacatcagtcaaaagcattttccaaaaaaatctttatattttaatcaaatcactataaagacatgatgtgtcctagtttctcagatgttcacccaacagtctctttctttaacttctgggctgcctttcagaactgagcagagttgtatcaacacaaaagactgtctggactcaggcaccgtacacataccccgtcactgctcctctccttgaggtaatctgttttttctctaatcatctccaaatgattgataatgttgatacccactataagtttttctttatcatttggacattaaaaggtgagtttcctgtgttctttaaaaggacaatagaaagcaatcctttgctctactttagacctttattattacttaattaaattaatctcacaggaaatgttaaatcatttcaaataaccaaaaaatcccccagtgagcttctgacttttgtccaagggccactggcacacaaactccagtagttcctatagttttatgtgtccatggatcccaggaatgtgacttatgtctataatgctgttctatagtggcagtggcaaatttttctgttaagagctaaatagtaaatattttcttcggctttgtgggcagtatggtcttgtatcaactactcaactgtgctgtaaaagtagtgtaaaagcagtcatagacaatacaattccaataaaactttatttacaaaaacaggtggcagactggtttcagcccacgagctgtgtgtgttaacctttgctctctggccctatgaattcttcatgttcacagagcatcttgaaaaatgaggcccaataaaatacctggttttatttcaaatctgccttcttgctgtaaatgactacagctcaggaatatctcaatgaatacccacacatgttatctgtctttacattggctaaacctttgactagattatgagtactgtcctgtcagttgtgattcttctttccctagcagctcctcacagctccccaattcacaatatttttctcagcacaacactttccagggtgtcaaatgttcttaaccatcagctctgttttctcagagcctttgttgatgctttacagaagctaggtaaattgggttccagtgctcctggtctcctgagctcctgctacattgacactgtgttatgccacttgtgttgatccagatgtgatattaacttcccagtacccccaaaacagtccacatagtgccacaaatgcttcctctggctcatccagcaacccctacctctgactccattccatttttccagaggacactcagctcatcctctcatcttcctcctataatgagggacatatgttctactctgactctagaaaatgtatcaagttaatttcttttacaaaaaacaaaggaaaaatagaaaggaattccttatgcttccctcccctccaccaaaagaggaattctgatttaactgtttagtcttcatttctaagacagggcacaaggttgtagctagtgtttataactctttcttttacctatcttcagagtgaccagacaacctacagaatgggagaaactttttcaatctatgcagctgacaaaggtctaatatccagcatctgtaaggaacacatttataagaaaaaacaactccattaaaaagtgggcaaaggacatgaacaaacacttctcaaaagaagcatacatgcagacaacaatcaagtgaaaaaagctcaacattactgttcattagagaaatcaaattaaaaccacaatgaaatatcatctcacgccagtcacaatggctgttaataaaactccaaaaataatagatgctggcgaggttgtagagagaaaggaacacttttacactgttgtgggagtgtaaattagttcagccattgtggaagacagtgtggtgattccccaaagacctaaggcagaaataccattcaacccaacaatcccattaccgggtatgtacccagaggagtaaaatcattctattataaagacacatgcacgtatatgttcattgcagcactattcacaatgaaaagacatggaatcaacctaaatgcccctatgatagattagataaagaaaatgttgtcacatacactatggaatactacgcagcaataaaaaggaatgtgatcatgtcttttgcaggacaaggatggagctggaggccattatccttagcaaactaacacaggaacagaaaaccaataccgcatgttctcacttataagagggagctaaatgatgagaacacatggacacatagggggaacaatgcacattggagcttactggagggcagggggtgggaggagggagaggatcggaaaaataactaatgggtactacgcttaatacctggatggtgaaagaatctgtacaataacccccataacacacatttacctatgtaacaaacctgaacattgtgcatatgtgccccgagcttaaaacaaaagttttttttaaattttttttttttaagacagagtctcactctgttgcccaggctggagtgcagtggtgcaatcttggctcactgcagcctcagcctaccaggccaagtgatcctcccactgcagcctcctgagtagctgagactacaggtgcgtgacaatgttctggttagtttttgtgggtttttttttttgtagagttggggttttgatatgttgtccagctggtctcaaacccctgaggctcaaatgatctgccggctttggcctcccaaactgttggattacaagcgtaagccactgagcccagcctatgacttccttcttttaccacctgttcctattacacttgcccttggcaaacactggttcttgtcatgactccttatctggtgagctgcccataccttcattcttaaagggtcactgccattagcagtcctcactgcattgaattgtttcattttaatattgatttcaggatatggaaatacaaagaggcaccccagaagacctccgcaagccaccatactcctccttaccctcactgtgtggtagcaaccccattttcccttcaagccaggataaatcacccatcagaacaataatcaccttttttaagcctgctggttaattgcataaggagtacaaagtggctggggacagttttactttccaggttaatgaagctacaatcaatgtaaatccatcactctggtcatctctccttctaggaacaatgaacatccaggtgaccgttcaaagctctttccactgggggaatgtcccataaccactgtccttcagaatcatcctaaatgtgacaggagtactgcattggccatttttgggtgatgccagtgtattgtgcaaaccatctataaagtagaccaaatagtctcttcctcagtcaactggtcacatggaactcccatgagaagacagatgagagagaaggggcaatgtagtatgagtaggggtcacaggaatttgctcatgtgacttgtgccttcaggacctacataagtctaatttcatttaccacttcctgtgatggaatactgctgtgcacactcaactttaaggtttgatgggtcagataacatccattcatagctcaggtcttgggccatcgttaaacattcagtctctactagagccccaaagaagccagccactgttcatcaaaagaatagttatctgcaggggatgacatagctgtgctcaagatcctaagggtatcttctgtgatttacctgctaaaggtgccatagagcctccctattgtcacagacacttcgagcaccatcagatctgttgggtcgtataacatgagtagcagagagcttgcctttagcttagagctgttgcattctcttgttctgggccctactcaaagctggagcctttatggttattcaggaagtgggctagaggagcaggcccaaatgaggtatatgttacctccaaagaggtccactaggatcagtgcctctttttcagtggtagaagaaaacagatcagaaatgtatccttcatattggaaaggatatatcaacatgctccagaaaatggacttcggaaattgcaataaggtggcagtcctctgaatttataaggggtttatttcccacccactgtgtcttgccaaggtgtctagaatgcttgctatttcctgcttacttggtctaaatcagcaatactgtcagtatcacattggaccacatgatgtattgtgaaatggagaagtgataagtttggcaggtaaaaatctttgcagttctggagaattacatatccctaaaatgggacaatgaggtggatttctggccctgactggtggaagcaaactgcttcagctgatctttaccaacaaaatagacaatataacatttgtcaaatatattgtggcacaccacatgctagggaatgtgcaactttctccaaggaaaagacatttagaatagtagctaatttggagtgaccacctggtaagttttaataatccacagctattcaccaaggtccatctgcactttgcacagacataatgagcaatccttcaaagaggaagaaattggagtaaaggtcacacaacttatgtctgaccaaatacaaagctgtgtgtctccaaagtctaggcccacatacccacaactgaagaccttagggctctgtaaactcatcaggttgctacctacaaatctgtacctgcagattcattactaaaattagtctcacattttagtaaagaataaagtttaaaaaaacctcatcctcccccaaattttaatacagcaaagtatggagagtcagttataggacattaacctttggtaaggaaattatatttttgaagctacaattgcattgctgtattgccaacgcatcgctttaaatttccccaaagaggaacatataagcttcagaaactccagtctctcatgtacaaactttcatgtcatttaaagtattatatggttgacttcagagaaaattaatgattatgtcatcaaagttttattgtcgaatatgttgaagcctttgcacaatgttgaagagaagaataaaatattaattagacaaaaaaaaaatccttaaagatatacctacattagacctaaaagttttgtttctaggactgatcctagtgaaattaccatggatatagagcgtatcctggcttaaaaaatagaaataactaaacttcttaaagtattattattatttttttgactctgtcaccaggctggagtgcagggtgagatcttggctcactgcaacctctgcctcccgggttcaagtgattctcctgcctcgcctcccgagtagctgggactacaggcatgcgccaccacgcccagctaatttttttttgattttttagtagagacggggtttcactgtgttggccatgatggtctcgatcttttgacccaggtggtccacctgcctcagcctcccaaagtgctgggattagaggtgtgagccaccgtcctggccctaagtatttttaaataaagtaaatcatttaaagtatttttatacttttttttttttgagacagagtctgtctctgtcgcccagactggagtgcagtggtgctatcttggccactgcaagctccgcctcccaggttcacaccattctcctgcctcagcctcccgagtagcgggactacaggcgcccgtcaccgcgcccagctaactttttgtatttttagtagagacaggtttcactgtgttagtcaggatggtctcaatctcctggcctcgtgatccacccgcctcacatcccaaagtgctgggaagcatttttaaataaagtacatcattcaaatgatttaaagtaatcattgtaactccagatgacaaaataatacatgcaaccattaaaaatgatttcaaaaatactgaatgacatatttagatttctactattgagtgggaataaaagtagataactaaaaatatatatagcttgagcctatttttgtgaaattatgtatcagaggaaaacaagtttgaagtacataccaaaatggtaactatattgaacctacatagtaactagaatccattaataacagcaaataaattggatttataaaaaaaattactgtcaggaaaaatatttaaaaaacacatcaactaacatctattgagtgcaaggcactattctaagcacttaacacatattatctttccaaaatttgagatgtccctagacaatattaattctattttacagaagagaactctaatcaagaagaagttaaaaatcttacactagtttgcacagccagcaaattgtagattttgcttgaatgtgggcagcctgacccctgagtctgcactcctaactacaatcctggacctcctttttcctcttccaaaggagagtggataaagatcatatgaaggatatctcccatgtagtatgagtattggggcacacattacatgaacaggagggttgaagataattttaaaatagatatttgtgggagtaaacttgatgttcataaacaaagatattttaagtttcatactcatagcacccacagcttattccccattccttaactcccctgagttccactttccattattctccacctgccctataaagtgggaggtttacagcagagactatacttgccggttccagtgtcctcggctactggttgggttttgttgacaggcggcacctgcaggagattgaaaggatggagaagtgatggtagagtaattatttctttcttttttttttttttaagtttcttttttttttttattatactttaagttttagggtacatgtgcacattgtgcaggttagttacatatgtatcatgtgccatgctggtgcgctgcacccactaactcgtcatctagcattaggtatatctccaatgctacccctcccccctccccccaccccaccacagtccccagagtgtgatattcccttcctgtgaccatgtgatctcattgttcaattcccacctatgagtgagaatatgcggtgttggttttttgttcttgcgatagtttactgagaatgatggtttccaatttctttggttcctccctgctgggactgcctggagcaggctgtgtcagtctactaaggaataattttccttcagggaagcttctgtgagactttctccttccattttccagtaacaatctcatctctctggcctaagggtggttaacagctgaactgctactacctggggctactgcactatcttatgctcccctgcccaacaactgttaaatagtctgtttgcaaatcagctgtctttgaatcattcattttgaatgcccttgttaggatcctgacatacaagttgtgattcctgtgttcataaagtgacactgagtattttggaaacacatcacgtgaacaggagggttgaagataatataaaatagagaatgtgtgggagtaaacttgatggttataaacaaagatattttatttgacattctagccacccacaccttattccccagtccttatttctctgtcctggatagactagatacattcaggaatatttgtaaagcatgttgcatggtaatcttgatgcactctgcagttttacaatgctgctatctcagaataattacacaaaagcaattctctctgcagttctcagggcaattacagagcttctggcaaacacagacattaagtcacagaacactttgtagaccattcttgtctggaacagatttatgaggttacttggtagaccctctttaattagaaactgggaaatgaaaatagtcagacatgagtaaaacatttttttataaagcccccttattttccactcaagtaacacaaagtacagattgagtatcccttatccaaaatgcttgggactagaagtgtttcgattttggaatatttgcatatacataatatttcaggcacgggatccaagtctaaacatgaattcatatgtgtttcatatacaccttatacacatagcccgaaggtaattttatataatttttagatcattttgtgcataaaataatgtttgtgtacactgaaccatcatcagaaagtaaggtgtcactatctcagccacacatgtggatagtctgtggttgtttggcatcaccatcttcttgactgaatttatatgctaccaatacacagtcattttcttacattaattcacacaaagaattttacataaaaaaagacatatcattaatacagtaagaaagaatgtgtttagtgaactaaacagcaccgtagcatcactggaatatctgcgtcagctgttaaatgacagcaacacaaacaacagcaggctttcagtctccacctacgatgctgtgttttgattaaaaagttatgtacaaggtattttttatgtgagaatctgaggatagaaaacatatatcatatgtagaaacatacatcacagctgaagggggctgggaggttctttcttagggacgctgaataaactggtgttgtacacatgcattttgattgcaacttgtcacatgaggtcagaatggaatttttctgttggcccaaaaatgctttgaatcccggagcattttggattttggatttttggataatgatgctccacctgtaataataacatagcatcttctttggtttttagttctctcatgttgggtctctctcattaactagtgagctattttacaagtctgaacacagcaaagattggagacttgcaatttaggaggagccaatggaaaatgtttgtctatagtcaagcaccatggacaaatcttttatgagtttccaatctttcccagtgttagaaactagactgcatattatcaatatcactagatattaattgaccctatgaacaacattttaaaaatgtaaaaggaaagtaaaaaattccaattcaagtcccaaagaacaaaagcatcttttctgtatcacttggtttatgtactgaaagctacttatacactgttcaaaaatgattttccacaaaaggatatgtttactgatctgatggcagcagcggcccatctggagtggcctctgcgaagacgccagctgcaccagggaggtgtgaccaggactgtgtactccatggagatggtgggagccctgtccccttccgagtggcaggtcaggagccccaccctcccaggcacagctacagctgcccagctgtagctgcaacctaggcatccctgcagtttgggggcccaggaccccatggcccccactccccaacccctgcaccccactcctttcccctcacccctgcaagctcagaagtgcctgctcctactgcctgcctctccctgctcctggcacccactccagaacaaagttgtggccaagcctaggtgctgtgtgacctggttaggtgtggatgtgctcagggtggcaccaacatgccagccccctgctgctgggcctcctccagactttgggggccaatgagcatgggagggaggctgaagaggatgggctgagggttgcttagcatgggcctgtgggttcccctcagcacaaacagcccaggggcctggatgacacgcagatggcagcaggaagcagataggcccctgggcagaaaggggcagtccagtgaagcaccaccttgaagccagggagggcctgaagcctgggggccaacctatcagtccaggtggtgtccacagcccagagtgagaacttatggtgctttttctgggcccacccatgccgcccatggaccaatcagcatacacttcctcccttatgagcccataaaaacccaggatcagccagactgggacagatgtcaggatgacctgcctacggataggagctacccactctggtgtcctctctgctgagggctgcacacttgtcaggacaacctgcctgtgaatagaagcacccactccaggtttcctccctgctgagggctgcacacttgggattacctgcttgtggaaggagctacccactccaggtctgctctccactgagctgcacactcattgggacaatctgttgaagataggagctacccactgggggtctcctctccactgagggctgatcacttgttggacaacctgcctgtggaaaggagctacccactttgggtctcctgagagctgtactgttgtcaataaaggacttcttcaccttgctcaccctccagtcgtctacatatttcattcttccggatgtgggacaagaactcaggaccccctgaatggtgggactgaaagagctgtaacacaatagggctgaaacatgcccctaccaccccccctgcttgccatgttgccagcaatgagaagagagaagggcagcagagaagagcagaggcccttccaggagcccaaacctagaggctcccaagccagggctgtgccaccctctttggggcactgtggtttctggcttctccaagtttcggatgccagcacactccccttatccagacttgggtgtccataggagaagctgcttgtgggcatctgatccagcagtaggcttgcacagaactggcatctgtactggtgcctgcagctgccaccccaccagagcagctggcttgctgactctccacagtggctggaccccacactcactgcttatgcacctctcaccactctacacctggcttgaccttggaggcgtgggatctggtggttagcatgagccaagcacagcctgccaggccaagtgggcaaaacaagcccagcaggctgagtaaagctcaggcaaaggtgccaacagccacacaggcttctggctggaaaagtgacccctaaggatcttatgacagttccatatgctatcagtacttctttgaactaaatctatgttctcaagcaacttttgattaatcataactttctgtgtaggttttgtattgcttttgcagatatgtttggtagggttagaggacaggagagtttttaccatggcaaatagaaaggatccagagatgaagttgttttcctgaacataaaaccaaccaaagatgcaagcatattaaaaggacatttgtagtttttggtagcaatccaccaaaaggtctctggtaatttcccacaaaatgagcacttagtaagtaaagtccaataccactaacacaaccttctcttgtttttataatcttctaaagtcagaataaggtcaccatccctgcagcaaaaccaaacctgttgtcatccagagaaattcaggatctattcatggcccaataggcttgcagttcatttaagaaagttcactagggagtcttggaggcggtgaagggcaattaggaggaagagaagtgaaagtcaaagccaactggccctgataccctatatctattttgtatgtgaagagaagttctaggaagaaagagtaaggaattcatgaagacttgatggaatctctagttgcctctcccttttattctgcctcgctgccaacagcaacatgttagtatgttttaaagtaactccaacaactgcacatgtaatgggcttggcagtttttactgttcccttcacaaaaagtgattgtcaactgagaggaatccagacaagagtccactgagatttctgaggaaatgtgaggaaagagtttggaattgttttgtgaaatttactacaaatatgaaaaatacgtttaatatatagaattagaatcttgtaaaggtgcttctcaaacattcctcatgtgagtcaccctgcgatctgataaatttgcactctgattagtagtttggaggtgaggccggaattttggcatttcttacatactcccagatgatctaaggtgctgggccagggaccattctttgcatagcaaggttgtaaaaaggctgggatacttgatgatatctgcagaatgaagatataaaaatgtcaaggtttgcttagcaaagctgtgatcagacaggaagaaagatactgagtttccatgaccctttgctcattgtgctgtcatttagagccttaggctgtaggtacagagagacaaagaaaagagagactccaacaagtgctgaaggagaatgcagaggcaaagagaacagcttgtgagcagactccagggatgacttgaagccctgagggaagccttactagatactcaatgctgtttaattcatgcctcattgcctgcatatagcttgccactgtcagatggtatatgctgatttttttttttggaacgttcagtccattgtgtgtgctaaatgagagagctagcaatcgtatgctttcccatagggaataccaggagttacaagtcctcagcactagtcaggtaacaataaaaatcttgttttctattatctcatcttccctgattctagcttgaagaagccagcagtaagcattgggtaggtgagtaaggaaagactgggaaaagggaaaaaaacagatcacataccccttcccatggctggacttcatcttaacaggcctgaagtaaaagagggagagaaacttttaattgaaaagcgagattggaattggatggttacggcaaaaaaatcaaccgggctgttcagggatagggaggggagctcaggaatacacattgcagggcagcaatagagagacagaatttcttaatgaatctgagcaagttcagccattcaatataaactagtgttagatgcacaggtctgaacaaggaagaataagaataaacacagaaggtacagaatgagactagagttctattctcctctgcactgagagggggctggattgacctatgccaatgagttttcccacatttctaagacatttatttcatcttgtaatcagagccagcattctctctgtttttcaagagaagccaggattatatatttttatgtgagctttctgattttttaaattttaattttaattaattaatttatttttttgagacagagtctcctctgtcaccccggctggagtgcaatggcacgatctgggctcactgcaacctcctcctccgggttcaagcgattctcctgcctcagcctcccaagtagctgggattacaggcgtccgcatcaaacccagctaatttttgcatttttagtagacatggagttttgccatgttggccagctggtcttgagctcttctgatttttaactgttgactactaattcaaatttctagaacaccagagggtccagctattttggcaaaggatgcatatctgagggcctctggctatgacttcggactaggcatcacatccaattactcacatttatgtaggagggcactgaaagcttggactagtcatttctgtgtcctcagctccaggctagttctttagtaggtgtccatacatgtcgtaataggaatcaaaggcaactatgggctggaaattaaagacccttagacaataatttctgaaattcttctggtgctggaatgtgtcactactagctacctttcaccttttgtgatgaactgactgagaagcccagcataggaaaaggaagaggaacccttgctcaccatcgcgggtcaagcctggagcgtcctggatatctgaactccatcttcaagtgcatgctagtaaacctttatcagcgcttccaaccgatacaaaacagaatgggacatgtttaaattgcctccctttggaggcagagcagtctgccctgtatgtgctctgtaaagcctccttccctttactgagcacaggagatggagggccttgaactgttaagcactgtaatgtgtgtggaggtggggaaaacacgccaaaggcctgtgagactctgaggccccatgtaccagaatgtgtcggcacctccaagtggaggcccaagcgtgcataggcccagacacggtcttcctggggaactgctgccccctgcggcaatgaagggtgagacaacattctgttctaatcagcttagccaatcttctccacagcacccaacctctcatccataagccaggtgagttgggccttcctgttttgagcctcaggttcccagcttctcgcttcctccactatgcactgagggcaggagccaggtatccttgttcagtcggaatctgcaacccttaggagagtggcctatcacacaaagaactgctgaatgaaaatggttaaattctcgttagtgaagaagagctggatctttggcattaggctacttgagtttaatatcatcttcatggcttgagtctctatatcatcatctgaagaaacggaaaacacctctttgggtggttactgattcaacacgataatgaatgttaagtattaggattatatctgtcaatagcaagggttcaataaatagtaactattagtatttttttaaataggcttatcgaagttgacagatgaagattaaactgcacatatttaaattgtacattttgatgagttttcacattgtatatacctgtgaaaccatcactacagtgaagataacaaatatatttattccctccagtttccccatgcctctctgtcatccagcctcctctcctccccaaagaaaaatgtccccttccaggaaaccactaattttctgtgactgtagactaatttacaatttctatatttttataaaatgaaatgagacatgtactgtttttgtttgtcctctttctctcagaataattatttaagagtcattcatgttgctgtgtgcatcagaagatcattattcttttattgcagagtaaattccattgtatagatacaccacaatttgtttatccatttacctgttgatgggcatttggttgtttccagtttatggctattacaaataaaactgctatgatcatttgtggacaaacatttcatttctcttgagtaaatacttaagagtagaatagctgggccatatggtagatatattataatcttttatctaaagtgattgtaccattttacattcccatcagcgatgaaagagttcccagctgcttcacatccttgccaacactttttaattttagccatcctggtgggtagatagtgttatctcattgtggttttcatttgcattttcctaatgattaatggtgttgaactcttttcacatgtttattcatcatccatatatcttctttagtgaaatgtctgtccaaatttttgctcatttttgatcgggtttttagtttttaaggagcagaccaaatcattttataagttaaaaaaacttactgagatacaatctgcataccattcaattcaccatttaaagggaaaatggcattcagtatatttgcagagctgtgcaactatcattgcaattaattttagaacatttcatcatcctaacttcctcttcttccccatcctttagccatcaacccaccatcatcctaggcaactactaatctacttgctgtctgcagagatttgcctattctggacatttcatgaagtggaagggtcttttttgagtggctttttaaatttggcataatgttttcaagattcaccatgttgtagttagtatcagtgcttcatttttaaattatagaagaatattccattgtagaacatatcaaattttatttattcatgtcttcatcagttgatgaacatatggttgtttcactttttggctatattgagtgatgctcttatgaacattcatgtacaagtttttatgtaacatcagttcttatttctactgggtatatacttgaaagtgcagttgatgggtcatatgatactctatgtttacctttttgaggaacttccagacagactgttttccaaagtggccacacatttcacatttccagcagcagtgtgcaagggttcacatttctccacatcctcatcaacattgttattacctgtattttttattatagctatcctagtgggtatgaagtggtatctcatatggttataaaacgtcttttttttagaaaaaaaagttactttactttgaaggggtccaattgttgatattttttcttttataggttgtgctttttgtgttgtatttaaacaatctttgcaaaactcaaatttcttaagattttctccaatttttttccaggaactcctatatttttactttcaaatgtatgtgtatggtccattttgagttaatttttctatgacttaagggtctagttcattgtttcgcatatagctattcaagtgttctagcaccattgttaaaaagattatttttccccattgaattgtcatggaaccttggtaaaaatcaattgggggtctacttcccagattcagtattcttattcttattcagtattcttatttttaaaaggcagccttaacttaggctgatcttgctccaatactgagacaatagtcttatgaatcttttattgagtgccttctggttacaatgttttcccactctggctggttgtaacttaaaccattccaagttttgtgtgaccttggggatcttaccgtttgcaggtggttctttccactaaactatggtctagcatagttcttcacatgcaaactgttagttaaagacttgaaggaacccatctgcagctcgccacagctctctctctcttcagctctctctgctccagcattctgccctgcaactctgctgccttagagaattcctactgccagatgagaatgcttttttaattctcatttttctcctctatttaataaactgctggattttgcttggatttggcctccctaaactacagcctggaaaatctgtcaggcaattatctgaggcattgcagggatcatttcatttgtttttcttttctcaaggatgctctttcttttgcactatttgttgtccaatgtctgaaattatcgtttcatactttttcaacttagctgtttaaagtaggagagtaaaccaggtcattgttactctatctttgctggagcagaactgctattagtattgtttctgtctttatttcaccagtctggcttatgatataagtgaccatcccaaacacacatgttcatatatgcacacacacacacacaccactactacccctgttttctataaaactttctttttatagttgtgaaagttgtcaaaatcaaaatgaagcctttatattaaagtcctggcaaatggacccatggaaggccataaagggagtattctcaacatatgcctgaaattcagaactatcacaaaagactgccaaaaatgcagtcttgcacagaaatacttctgcaaggatgtctattcagcaactgtcagtccttggaccaatgccaccctgttattgatcctcgtagccaaggacaattgattcaaaacaacttatttattctttctcatttgcctttaaaaacttccccttgtcttaacttctttaaatatgcacatagtataatatgcacacttattcacattgcaaacctgaataaatatcattttcttatgtagagtctcctttctctctttattaagtttaacttggaaaaggtataggtcatccaccagtcactgtggctacaatggcccaaagcaggaagtaggagaaatcttcccctacctgagtgaaggaacctcgggttatattttcattcattcactcacggatgacaacctggatttagtttgcctgggttgattttgggctacatcactttttacttttgtgaaattgtgctaagccctctacatacagttctcacttaatcctcaagactaccttcatacacccattttacaagtgaagacgctgaggttagaaagggtaactatattgcccaatgtctgacacacagaaatgctgctcaatctgttctcgtttctcagtactcacttcacttaagctgtcattggcacttgcctgggctgatcattcctctttcatgaaatttctttcttcagttcatgtcaagtacaacacactcatttctccccaacctcattgtcttctcagcttttatatcttctgaatctctacgtgtgttctttgctcttatgcttactttataggggatctcctccagcctcatgtctttaaatactgtttctaactgattagtcacaaatcatatctctagcctggagcttgaatacatctatatatcctagtcctactcaacatctccatgtggatgtttttccaatcttctcctttttgttccaaatccttccctgtcctacctctgctctgctctgtcttgtggagggtggagtggtctgacctctgcggctcttgtgtcagccacctttagcctgcctaggatcctcagaagggacttgtggaagatgaaggaagaaggaagaaagaaggggaggtccagctatttctagctcctctctttcttgccatgagtagtgtctctgacagagactgttgctcaacttctggtctatggtgtgacactccttcatccaataatgccccagctctttccactgttgctaataatttctgtggtgccaccaaaccctgtttgtcttctcagcaatgtcattacctgtgtaaccatgtcctctgtttgcatgcctagagtggcttctatttcctgacatggcctgagttgacacaggtctctaaaaggatctcaaaaccaacacatctagaacaaactcctaatttccctctcaagttgttcttcctgtagtttgtccattcaaattcatggcaactccattagtgccatccttgatgctactgtcctctcatacctgtattcaatccaccagcaagtcctattggttcaactttataaacatactagagctgcctatttttctccactttcactgctatcaccatcctggtccaagtcattataactctcacttggactattgtggtagccttctgatatggtttggctgtgtccccacccaatcattatcttgaattgtagttcccataatgcccacatgttgtgggagggacccagtggagataattaaatcatggggggcagttttccccatacctttcttgtggtagtgactaggttcatgagatctgatgggtttataaggggaaacccctttcacttggttctcatatcctctatgtctgctgccatgtaagacgtgccttttgccttctgccatgattgtgaggcctccctgccacgtggaactgtgagtcaattaaacctctttcctttacaaattacctagttttgggatgtctttattagcagcataagaactgacacagtaaattggtaccagtagaatggggtgtattgtaaagatacccaaaaatgtggaagtggctttggaactgggtaacaggcagaggtggaacagtttggagggctcagaagaagtcaggaagacgtgggaaagtttggaacttcttgagaactgttgaatggctttgaccaaaatgctgataatgatatggacaatgaaatccagctgaggtggtctcagatggagatgagaaacttgttgtgaactgtagtaaaggtgactctgctatgttttagcaaagatactgggggcattttgtccctgccctagagatttgtgaaacttgaacttgagggagatgctttagggtatctgggggaagaaatttctaagcagtaaaacttgaaatggtgacttgggtgctgttaaaagaattcagttttaaaagggaaacaaaacataaagttcagaaaatttgcagtctgacaatacgatagaaaagaaaaacccattttctgagagaaattcaagctggctgcagaaatttgcataagtaatgaggagccaaatgttaattacaagacaatggggaaaatgtctgacagggcatgtcagagacctttgaggcagcccctccctcacaggcccagaggcctaggaggaaaaaatacttttgtgggctggctcaggtcctcccgctgtgtgcagcctagggacttgtgtcccagcctgtgtcccagtcactctagccatggcaaaaggggttaaagtacagctcaggccatggcttcacagggtacagtccctaagccttgcagtttccatgtggtgttgagcctgtgggtgcacagaagtcaagaattgaggtttgggacctccacctgtatttcagaggatgtgtggaaaagcctgaatgtccaggcagaagtttgcgcaggggtggggccctcaaggagagcctgggctaggtcagtgcagaagggaaatgtgggttggaggcctcacacagagtccccaatggggcactgcctagtgcagctgtgagaagagaccactgtcctccagaccccagaatggtagatccaccgatagcttgcactgtgcacctggaaagctacagacactcaacaccagcctgtgaaaggagccaggaggaagggtccccctgcaagccacaggggcagagctgcccaagaccatgggaacccacctcctgcatcagtgtgactggatgtgagacatggagtcaaaggagatcattttggagctttaagaaatgactgccttatggatctggacttgcatgcggcttttagctccttcattttggccagtttctcccatttaaacaggtgtatttatccaatgcctgtacccccattgtatctaagaagcaactaacttgttttgattttaccagctaataggtggaagggacttgccttgtctcaggtgagactttggctatggacttttgagttaatgctgaaatgagttaagactttgggggactactgggaaggatgattggttttgaaatgtgaggacatgagatttgggagtggccaagggcagaatgataggtttggctgtgtccccacccaaatctcatcttgaattatagctcctgtaattcccacagttgtgggagggacccggtgggagataactgaatcatgggggcagtctagcccatactgtcttgtggtggtaaataagtctcacaaggtctgatggttttataagaggaaaatcctttacttggttctttctctcacatgtgccgccatgtaagacaagccttttgccttctgccatattgtgaggcctccccagtcctgtgaaactgtgagtcagttaaacctttttccttcataattacccagtcttgggtatgtctttattagcagcatgagaacagactaatacaccttctattagtctccctgcttctgtagttcagaatgatctttctaaactagattatgctgccctctattgaaaatattacactggcttctcatcttactcagaagacacggtaagatcttgacagtggctcccaaggcaccagacttctaggacttcatgttctattactttctactatgtaattctgttttagcctcaaagacctcaccactctggctaggacccaccaggaatattcctccacagggcctttgtacctgctattttcacccagaatgtgctttctccagtatctaaggtgttaactacctccttgcctgtgctcaggtgtcacttcataagagtcctttcctgattacatatacatatcatcctccttatccctgtttttttttttttttttgggatggagtctcatctgttgtccatgctggagtgcagtggcatgatctccgctcactgcaacctccacctactggttcaagccattttcctgcctcagcctcccaaggagctgggattagaggcacacaccccacacccgctaattttgtatttttagtagagatggggtttcaccaagttggccaggctgtcctgaactcctgtcctcaggtgatccgccgtcctcagcttcccaaactgctgggattcaggcgtgagccactgtgcccagccccttgttgtttgttgttgttgttgtttgtttgttttgttgttatttatagcacttatcaccacctcatgtattatatagttattcatgatgtgctcttcccatcagaatatatacaagagaacaggaaccttgtttggttggtttctataccccactgtcttactaatgcctggcatttagtaggtgctcaataaaatctttgttttagaaatgattaataaataatatgtacatattgaatattgtttcctcttttaacaaatctttaaaataataaaaaatttaaagcagcaagattgctttgcatcaggcacaatgataagcgcttaaatggagcccatgattcactttcatttatagagcccacatgctctctgtcaggcgcagaggtgccagccctgcaggagcttcgggggcggagcagaaggccgcctaaaacagcctttctaagagagcatgcgtaggcgacgcgctggtagagctgtggacctgccagcctgcgaggggaggacgggctccatctcttagaaacgcctacggcgcatgctctatggggtcaactgggggctggcaagcggcagcgctggtctggggcggagtctccgaggcacttcccggtggctgctgctctgattggctgaacaaatagtccgagggtggtgggcatccgccctcccgacaagcagaccaggccccctgcaggtcccctatccgcaccccggcccctgagagctggcactggactcgagacagcggcccggcaggacagctccaggtgagagtgccggcgccgcggcgctccaggtgcgggtgcggcgtggaagctggtgccttcagcaaggggagggtcgcgccccgagctctgccggccggcaagaccctctgcgtttggacccagcgagtcttgcctggggtgccgcgggtgctttttctgcgggcgttggctcaaggcatctgccaatcaaccagggcaacttagagagcaacttcagagagaagcccactctcttccctgggcgctgtccactttcctggaaggcgcggtctccggtcagtgaagctgcccagtgctcctggaccgcgaggacagcagggtgtctgattcctctctctgcatcctcgtgctctccccttagctcctccaggcatcccatctacctctcttgttagccaacggcgtggtcgaaagcagacttgggcatcaatcctggttaagtcccagcgatactgctttttaaacagctgacactttgcttccagtacttcagctggtgaacctcagattcctgaaaaatggaattaatggtactgccatagggtcggtggaggagaattgacagtagatcagaagcgctgcctgcggtggctggcgcctcgcaagagcttaaatggagtcgtaataattgttgttattagaaagttaaatagcatgctgcgttggggccttttttctgccactgaactgttggactgctcttatcttttttcagaatctgtactatgcatctatatatacgtggcactttgcttggtcctgggggtacaaagctgagtcagattgttacaagtctaaataactgagataaaggtgttaatacagcccagaaaagcacacttaattcagccggaaggttttttttcccccctccttcgagattttcagagtatctccttcttagtaagaatgcttggcttagtatgttgagaaaaacatactaagtatgtagtgttgtgttggaaggaaacttaactgggtgagattttcagctgagtagctttagctgttactctcatggaccttccctgggcggttgatacaggttctgtaggaaaaccgctgaatgaaagcagctcctgcagatctattctgttttcaattgtggtaattcctttaattttttccctttcaatttactccttatctctagtaataatagacttttgggaggttgcatttatgataaaaaatagcctggggcttacaatccttcctatcatgaagaagtacaaagttgtaagtagaagcagtggccttgcttgccaatgcacactgaaggggataacgtttgctcctgttcagagttcacggccgggcgcgtggctcacgcctgtaatcctagcacttttggaggccgaggccggcggatcacgaggtcagagatcgagaccatcctggctaacacggtgaaaccctgtttctactaaaaatacaaaaaaaaattagccaggcgtggtggtgggcgcctgtagtcccagctacttgggaggctgaggcggagaatggcctgaacccaggaggtggagcttgcagtgagccaagatctcgccactgtatccagcctgggggacagagcaagactgtctcaaaaaaaaaaaagaaagaaaagaaaagaaaagaaaaagaaaaaagaaaaaagaaaagaatttcagagttcactacttcttggaaaaaataatcccaggaggaattccatcaacagaagggagtcagttcacttttgcaatctcctggaatcaatttcttaagacttgtggaatattcagtttaaacacaaaactaaaaacaaacactgtattggagtattattgacatacaatagcatggcatatttcaattgtacaattgtatagtttttgcatgtgtacacacctgtgaaaccatcagtacattcaatattatgaacctgtcatcacctccaaaatattatttgtgcatacccctttgtgatcctttcttactgcccctttctccaggaaaccactgatctgctttctgtgaatatagattagactgcattttgtggagtttatatgaatgggatcagacagtacttttttttttccttattttgatctggcttctttggcataattattttgagattaatctatatttttttgtgttccttcccttttatagctgatagtaggtatataccataatttatccaatcatccatttaaagcatttgggtttttccagttttgtctattacacccaaagctgttataaacatttatgtacaagtctttgtatgggcaacatgcctgcatctttttaagtgattctatttattttttaaaaatgtagaagttctgggtctagtcctaggtttttctctgaccacttgcgtgatcttaggagaggcatttaactttgcttcagcatcctcaaggtctttgctgtgattttgagtcatcactgccagaaaccaagatgtctttgttgatttgatggttagagaatttcagaaggagagagacgggtcaaatttttctttctgtttcttttgaaagctctattttctttcatttcacttttttcccatgaatgacaatttaaatgctgacgtataatttggggcaagaacagaagtggttagataagtaggaggagagctaatagtggttagataagtaggaggaagagctaatagtggctgaacttaaacatgctaaatcataggtggaaggcaagaggtgggaaataagcaagctcagaaattttgtgtcttttctttttctcaaactatcctcttctaagtcttgccttttgttatttctccatgaccatttgtttttaactttggggttaggaggtgaatgggtatgctggactccaaaggtcatattcaactggaggtggtgggtgggaggtttcttagttaaaagtaattcctttgggccgggccggtggctcacgcctgtcatcccagcactttgggaggccgaggcgtgatcacgaggttagagatcgagaccatcctggctaacacagtgaaaccccgtctctactaaaaaaaaaaaaaacaaaaaaatttgccgggcgtggtggcgggcgcctgtagtcccagctacctgggagtctaggcaggagaatggcctgaacctgggaggcggagcttgcagtgagccaagattgcgccatgcactccagcctgggcgacagagcgagactcagcctcaaaataaataaataaataaataataaataaataaataaataaataataataataataataataattcctttgggaggcggggcgggcaggtcacgaagtcatctgagaccagccttgccaatatagtgaaaccctgtcttactaaaaatacaaaaattagccgggcatggtggcctgcacctgtagtcccagctactcggaggctgaggcaggagaaccgcttgaacctgggaggcggaggttgtggtgagccgagatgtgccactgcactccagcctgggcaacagagcgagactccgaaaaaaaaaaaaaattctgggcaggcgcggtggctcacgcctgtaatcccagcactttgagaggccgaggtgggcgatcacgaagccaggagttcgagaccagcctagccaatatggtgaaagcccatcgctacaaaatacaaaaattagccaggcgtggtggtgcgtgcctgttgtcccagctacttgggaggtgaggcagaagaattgcttgaaccaggaggcagaggttgcagtgagctgagattgcaccctgcactccagcctgggtgacagagcaagactccatctcaacataaataaataaataaaaaataaataaataaataaaataaaaataaataaataaaatttaaaaattccttattctctttcagatatggctggagtcatttgtttcatattttcctttcaccttttacttgccctaatctggttcagaactttttgtgggagcattaagttaccagaatatttttgtgtagtaaattcaagcaaataataatagactgttttattatacagaatgaaaatgcggttcttggggtggtggtctgtttggttctctggaccctgcattctgaggggtctggagggaaactgacagtgtggatcctgaaacaaacatgaatgtggtaagtttctcaaagttatgtacttttaaaagcatctatttccccgatccagttatgtgagctacatgaagccatacccatacattcatcctttataactcctttgcttttcaatttctctgaatttttttttttttttttttttttttaggcagagtcttactctgtcacctgcccgcccaggctggagtgcagtggtgtgatctcgctcattgcgacctccgcctcaggggctcaagtgattctcgagcctcagcctcccaagtactgggactacaggcatgcaccaccatgcctggctaattttttttgtatttagtagatacgggtttcaccatgttgcccagggtggtcttgaactcctgagctcaggtgatctgtccactcagcctcccaaagtcctgggattacaggcgtgagccaccgtgcccagcccaatttctcgaatcttagattcaatttgctaggcttttctcaccaggtaatatgtagccaaca

SEQ ID NO: 5047 - DNA, 54985 bp, Homo sapiens
  misc_feature 48521, 48522, 48523, 48524, 48525, 48526, 48527, 48528, 48529,48530, 48531, 48532, 48533, 48534, 48535, 48536, 48537,48538, 48539, 48540, 48541, 48542, 48543, 48544, 48545,48546, 48547, 48548, 48549, 48550, 48551, 48552, 48553: n = A,T,C or G
  misc_feature 48554, 48555, 48556, 48557, 48558, 48559, 48560, 48561, 48562,48563, 48564, 48565, 48566, 48567, 48568, 48569, 48570,48571, 48572, 48573, 48574, 48575, 48576, 48577, 48578,48579, 48580, 48581, 48582, 48583, 48584, 48585, 48586: n = A,T,C or G
  misc_feature 48587, 48588, 48589, 48590, 48591, 48592, 48593, 48594, 48595,48596, 48597, 48598, 48599, 48600, 48601, 48602, 48603,48604, 48605, 48606, 48607, 48608, 48609, 48610, 48611,48612, 48613, 48614, 48615, 48616, 48617, 48618, 48619: n = A,T,C or G
  misc_feature 48620, 48621, 48622, 48623, 48624, 48625, 48626, 48627, 48628,48629, 48630, 48631, 48632, 48633, 48634, 48635, 48636,48637, 48638, 48639, 48640, 48641, 48642, 48643, 48644,48645, 48646, 48647, 48648, 48649, 48650, 48651, 48652: n = A,T,C or G
  misc_feature 48653, 48654, 48655, 48656, 48657, 48658, 48659, 48660, 48661,48662, 48663, 48664, 48665, 48666, 48667, 48668, 48669,48670, 48671, 48672, 48673, 48674, 48675, 48676, 48677,48678, 48679, 48680, 48681, 48682, 48683, 48684, 48685: n = A,T,C or G
  misc_feature 48686, 48687, 48688, 48689, 48690, 48691, 48692, 48693, 48694,48695, 48696, 48697, 48698, 48699, 48700, 48701, 48702,48703, 48704, 48705, 48706, 48707, 48708, 48709, 48710,48711, 48712, 48713, 48714, 48715, 48716, 48717, 48718: n = A,T,C or G
ttacagattgggaaggaataaataaagctttgtttgcagacgtcatgatcatctatgtaaactctaaaagtatcatcaacaacaacaacaaatgtcctggaattaataagcaattatacaaagttgcaggatacaaggttaataaacaaaagtcaatagctttcctatataccagcatgaacaagtaaaatttgaaattaaaaatgcaataccacttacgttagcacctcccaaaatgtaatacttaggcatgcatttaccaaaacctatatgaggaaaactatataactctgataaagaaataaatacagagctaaataaatggagaaatattccatgcttgtggataggaagctcaatattgtcaaatattagttcttccaaatctgatgtataaattcaacacaattccataacaattctggcaagttattttgtggatagcaaaaaactgattcctgggccaggcatgtggctcatgcctataatcccagcactctgtgaggccaaggcaggaggatcgcttgagccaggagtttgagaccaccctgggcaacatagtgagaccttgtctctataaataataaaaaaattagccaggcatggtgatgtacacctgtggtcccagctgctcaggaggctgaggcagaggatcagttgagtctgggaggtcaatgctgcaatgagctatgatcacatgccactgcatccaacttggacaacatagtgagatcttgtctcaaaaacaacaaacaaacaaacaaacaacaaacaaaaaacctgattctaaagtttatgtggagagcctaaagacccagaatagccaaaaaaaaaaaaatggaaagaaaagaacaaagttggaaggctactataaagctacagtaacaagatggtgtggtgttagtaaaagaatagaaaaatagatcaatggaacagaatagaggcccagactcatacaaatagagccaactgatatctgacaaaggaacaaaagcaataccatgagaaaagacagcctttctgacagaaggtgccaaaacaactgaacattcatatgcaaaaaagactagataaagcctcttatccctctcacaaaaattcattcaaaatagatcatagactaaatgtaagttgtaaactataaaattcctagaagattggccaggtgcagtgactcacagtgtaatcctagcactttgggaggccaaggtgggaggattgcttgaggtcaggagttcggaccagcctggccaacatggtgaaaccccgtctctactaaaaatacaaaacttagccagtgtggtagcaggcgcctgtaatcccagctactcaggaggctgaggcaggagggtcgcctacttgaactcaggaggcggaggttgcagtgagctgagattgccccactgcactccatccgggggacagagagagactccatctcaaaaataaaataaaataaaataaaatccctagaaataacacaggagaaagtatggatggtctggatatggcaatgattttttagacactatgcaaaggcatgatccacgaaaaaaaaaattgatgagctggactttattaaaaacttccgtttgcaaaatacactgtcaggagagtgaggagacaagccacagactgggagaaaatatttgaaaggacgtatctaataaaggactgttatccaaaatatacaaagaattcttaaaacccacaataagaaaagaaacaacccaattaaacaatgagcaaaagacctcaactgacatctcacaaagaagatatgcagttggcaagtatgcatatggacatatgctcaacatcatatgtcatggggaactgcaaattaaaatggcaatgagataccagtacacacctattagaaccggcaaatcccaaacactgacaacgctatgtgttggtgaggaggcggagccacagaaactctcatcactgctggtgggaatactcaatgaaacagcttctttggaagaagatagtggtttcatcaaaactaaatatattcttattacatgatccagaatcattgggtaaatccattgatgttacccaaaggcattaaaaacttgcatccacacagaaacctacatacagatatttacagcactttattccgagttgcccaaacttggaagcaactcagatgttcttcaggaggggaagggtgaacagtggtatatccagacaatggaatattattcagtgctaaaaggagatgagctataagccatgaaaagatatgaaggacataaatgcatattactaagtgaaagaagctagtctaagaggcgacctactgtatgatcccacttaagtgacattctgggaaaggtaaaactgtgagagagtgaaaatatcagtgattgccaggagttgtggggagggaaggatgaacaggcaggcacaggggtggtttagggcagtgagactgttctgtgtgctgtaaccctggatatgtgcattgtacatttgtcaaaacccatagcatgtggaataacgagagggaatcctaatgtcagatgggctttgggtttgtggtgtatcactttggatgatggtgtatcactgtaggttcatcgttgtaacaaaaggacggctctggtgaggaatgttggtagtggggaggctgcggtgttgggggcatggattatatgggaaatctctgcactttctgctcagttttgctgtgaacctaaactaccctaaaaaatactctagtaaaaaaaataaataaatagagacccagcatggtggccacacctgtaatctcagtgcttcaggaggtcaaggagggaagatcatttgaggctaggatttgaggcctgggcaatatagcaagaccctgtctctacaaaaaataaaaatacagaaactagctgagtatgatggtgtgagcctgtagttctagctacctgggagcattgcttgaagcaggagtttgaggctgcagtgagctatgatcgcaccacagcactacagcataggcaacaggtgagactctgcctctattaaaatatatatatttctagggaatcatcattaaaaaggtttcactgcagactctgtcttcataattcggtaataatgtttctatagtccatctatttccacaaacatatgaaatggtttacagtaaaagatgtatgtaatagtacaaataaaaagcattttaaaaaagtaaagctttatggaaaaaagagagggacagttaatcctaaacctgggctatgtgatttctggtattgaatagatttacttttgaatttcctgaaagtcaaggcaaaattaaaatatcaaacattaaagtttttattaaagtttgttgttgaaaaacaaaccagctacatttttaggaggctcaaactttttcctgatagtcatttttaaatatatgaagagaacatcatgcaatgacagtcttcaattccagttttatcggtggctggggccgggcagtgctcccgtggctctccagtctctgccgggggccgggggttgggagcaggatggaggcagggctggggaagatgcctcacggtgatccctcctgtcgtgcttcctccctcctctgaggctaaggatcctggggagagagtgcagcacggagaccgcacagccggccccatgcacaaagctgtgccggtgccttcctaaagagcgcgccgcctgcagaacgggaggcctcctccctgcttcgtctctgcgccccctcctgctctctggatcctctggctgctctgatcattttatcttggatggggttcaacctttgaattccctaagacagtattttaactgactccttacgataacttgttattatggtttgaaaccgcgcccacactgaaaggggaccagtgctggcagaacttcaggactggtgagaggtttgtaaagggataggagcatccaagccgagatgaaaaatacaccaaccttctgctgaccttccgccgccaacagcaccttctctcctaaggatgctccctggccgcagactttctgtgcagtgcgcagcctgtgttcactgacaggaaagagcgatttcagcgctgtcattctaaacaatgatttcttctccgtgtctatgaaaaaacaaggtttttttttcttcggataaacaaaacaaaaacccaaaaccaacagataatctaaccttaatcacaaaggtgtccgagttatttagtaggtacagagtagaaagatatggttaaggctgggcgcggtggccacgcctgtaatcccagctctttgggaggcccaggggggcggatcacctgagatcaggattcaagaccagcctggccaacatggtgaaaccccacctctactaaaaatacaaaaattaccgggcgtggtggtgcgcgcctgtaatctcagctactcaggaggctgaggcaggagaatacttgaacccagaaggcggaggttgcagtgagccgagatcgcgccattgcacttcagccgggcaacagagtgagactccgtctcaaaaaaaaaaaaaaaaaaaaaagatatggttaaattgcacagctacactctcaaataagaacatgatatgttaatttgtatatcgttttaaaaagcactggctctccgccaaacacataagagatgggattttctagctttgtagtcatctttgtactgtctctggtcagcatagtggctttatgcacgtctgtatctcggctttcacttccagacgggattccctgcaagtggcacctactcagtgaattcttctctgccggaagacccgcagggctcgtgcctgcccaggttggctcttccctcacctccaggcgttagctcagtaccctggccacagtcagagcatccttggccagcgcaggctcctgtgcaatgtggggggccttatccccagccccacactgagttccctgctcacacttcctctgggctccgcgggtgggcacacctggttcaggatctccctaggcagccgttgcctcaggagaatgctggaggacattttcccttttcctccctccactcggtgccccagggctgtgctgaggcgcccgaacccttaggtgtggctggtgccaactgagacctgctgtgagtacaagacaccctgcatttcaaatatgggtacacataaaggaatgtgaaatctcaatcattttcattttgattacacattgaaagatagtattttggatacattgggataaataaaagattattaaaactaattttacctgctcttttcaaagttttacatgtagctactagaaactttaacagtactcatgtggctggcagtcttgctgttggcagtgttgccgagagggacagcaggatggaggcagcccccccagaggagctcccaaagtccccatttccaggtcaccttccagctcccaagggtgaaggaggccagtggctcccccagcagtgcgcctccctgttcgccgcgatgctgacaggactgaaagcacaacagcaagtggggtgtacggctggctgagggttccacgtctcacaatgcatgtctttactctggttttctgccacagactctggatcccaggggtccaaagggaattgcaaaggggaaaattcagtcttccttttctcctctgtggcttcctgtggctgtgtttgcaactagactgtccagacagctccacaaaagacagcttcctccctggttgcttgctcacttatgtgcccaggcctgggcccggcagccacacttctgtctctgctgcatttgtacttgagtttcctgaacccctctaagtggccaacactagtaatgaatgcagaaacatgaaagaatattctctcaatcatttcagggtgggtactcatcagatgaacacattttcagttactaagttaatgacaacattgaagacattggaaatttttattcatctttgctttacaacagaaccaaaagcgtcaattaagaattcattttacctgctggtttccacaagctagttatgtgaaccatgttttacaacaataataatattacaacaataattatggagaagttaattggataatagagcttttcccaattcaagtagaaacacagaagaaactggataattttaagtcctctaactcaagacatctggtgcaagcctggcctgcgaggccccattgcctgcgtctcccgggggccttaggaaaactgacagttcgcgtgcctctggggaaatatctacgctacagaaaatctttaggtgttcgtagttctctagagattttaagtggtatcacaacagcccatccggagaacttatttctaataatttgaaaaacaaacaagaaaccattagggttttcatgcagagcagcctccagagcacattctctgagaggaagagtcgaccagagtgagctctccgcagggcctgctctgccctccctgccccgctctgcccttcgcagggcctgctgtgccctcccctgccctgctctgcccccgccgccctgcagacactctcccaggactatgggaacccaagctctctcctctgggccgacaaacaatgctcaggccatgcacctcctcagaaaagggggcatgggttgccacatctcagagagctctgagtaaactccctgggcccagggatgcaggggagcctggttgttgctgagagccagcctcatgttcccctaaacatcctttctaaactagagatttctagactaagaaaaatcaacatgcattcacactttatactctactccattttcaatcccttagatttaaatcagtgtggagaatctgtgataagcaccttccaaattcctccaggatcatctgctctgcaggcacttggagcagtgttctttctcggcctcttctccctgagcaagcaggcaggcgcagtggcctccaccacctcccaggagatgcatgaggaaggccgcctgtcagaaacagagcattaaaggccgctcaacagtgcaccatttctacctacagtactatttatattcaacagaaattgcttgtccatgctattttaaagaacatcatccactaaaatctaacgttgtcttcctatactggaaactattaggctgggcacagtggtctgtaatcccagcaccttgggaggccaggcaggaggatggtctgaagccaggagtttgagaccagcctgggcaacaaagtgagacctttttttttttttgatactgagtcctgctctgttgccaggctggagtgcaatggcacgactcggctcactgcaacctccaactccctggttcaagtgattctcctgcctcagcctcctagtagctgggatcacaggcatgcaccaccacacctggctaatttttgtatttttagtaggacagggttttgccatgttggccaggatggtctcgatctcctgacctcatgatctgccccctcggcctctcaaagtgttaggattacaggcgtgagccaccacacccggcggagacccgtcttaaaaaaaaaaaaaaagaaagaaaagaaaagaaagaaaggattaactggttttagagaataacacagaggacaagtaaatctgtccgtttttgacatgcctctcatggcgggttgaaatttcctcaaaattagattcactgacgaacccagaggatcccgggctacagtgtcagcacgtgggccaggcaggaaattgcagaagcaggactcttggctgaggcagggcacgggacaagccgagcagctttgctctgagtcctgtccacgctgggtgtctgcctgtcctcccccaggcccacgtgcagccagagaaggccaaggttctgaggactcgcctgtcaaaccttgggtcctgctgtcaggacagccttccccatcaatgccgcttggagctgtgaaagaggttctgaagacaagttgaaccgcatcacatagcgccagctattctccccactgagctcagggggaactgtggcttagctagatagcaacccaggtggcgctaagtcgaaaaattttcaggaaactttataaaacattaaaaagtgttggattataaaaataaagcaaaatgttggattaaagctctctataaagacaatacacgatgactttggttgaagaagaaaagatagggctgccctgggaaaagaagggctgctaacactgcaagacgaggctccaatgtacaggcccccaccggctccacagaacacacatcctgctgcaggcgatgacattttcacacatcacttcacagacatgcagccaggttttggtaaatttttactgataaagacctctgtgggtcagctgggtgcgtggcttacgcctgtaatctcagcagtttgggactcagaggtggatgaatcacagttcagagttcgagaccaatatggcgagaccccatctctacaaaaagtagaaaaatcagccggagtggtggtgcgtgcctgtagtcccagctactcaggaggctgaggtgggaggatcacctgacctggggaggttgaggctgcgtgagctgtgatcgcaccactgcactccagcctgagcactgagtgaaagccctggtctcaaaaaaaagacccctgtaggtcacaatcatgagtattttgatatctctctaaccaaataagcatgaatttggctttgcaaaatattaattaatgacactggtagtttatcatgatatgaccattacattgaactcgaagttttttttaaacaaatgatggaatctaatagatagtaaaactatgactcaactttgagaactactaggattacaattggcttcaaaactgataaatgcaaaattatccaactaatccggatccacaactgcttagaaggaaaacaatctggaccaagtacagctctttgctgccacttcccacgataaaggataggaggtacgcactgtctttgctgcgctgggtcgttgtggctctatattaacgcaaaggcgtgtcagaactctgctagccctgctggtgatcctggcagcagggctcttttgtctggtaaaaacgggagtaactcagacagtgaggatgagaagacaaagaggacaaaacaggtttctcagcggggcctctaaggaaacacagtggccacccaggattagcccatggagggaggaacacttccctctgcccccaaacacacgcccgcccctgcaggctcacacattctttccagtgataaattgtcgttaattctcctctcaaattaacctctgttccctctattagcagaggttgttcaaagtacctacctatcgtgactgaatcttggaagtcctgaaaatttcgttggtggaggtaatggctgccttccaaacctccagtctgcatgtagtttggcatgctcattagtgttttcgttctgggctttcttcataatttttgcaaccaatgcatttgcaaatagaagaacaataatttgggcctggtaatataaaatgcttcaataaaattaggttgtctcacaagtcataaaaactgacaaattctatttggaccttaaataattcttcgcgtatatttgcccatgacgagagtgtgtgtgtgtctgtgtgtgttgagtgtgaatgtgtgggtgagagcgtgtgttgacgtgagtgtgtgtatgagtgtgtgtggggtgtgtgtgtgttgagtgtgaatgtgtaaggtgtgtgtgtgttgagcgtgtatatgagtgtgtgtggggtgtgtgtgtgtcgagtgtgctgtgtgtgcatgagtgtatgtggggtttgggtatgtgtgtgtatatgtgtgagtgaatggaatgtgtgtgtgactgtgtgtgtttgaatgtgtgcgtttgagagtgtgtgtgtgtgtggacctgcagttttcatcaagtgctgctgttgtggagatgccatagtcctgctgctgacaagtggaggccgagtgtatgggtgtgagtcccaagcagagagagggtgttgctctccctttctacccgggagccagcaggctgcttctttgacttgttttgaagaaagcctgccttagcgattataaaactctagcttatggttctctttcagcatgtgaggctattatgctggttcttgggtgcagagaatgtacaagagagtagaattcgaaatctgcctgagagcaggcctgtgctgggagctgtcaggggagacctctcctgctgccttgtgggtggattttgtttcaagctttcctggcaatgtgatgctgagggggccggcatgtcccatctgtacccagcaagccccccttgccccctcatgccaaattcttgctcatgtgggccccaggggctgaccaagagctggactgccaatcactatggtttttggctttctctttccttcagccccccggggatttcccttgttctttccagctgagagatgcatcttcagggggatgcgttctgtttcatctgcaccttgggtgttttgaagcaggaggctttatagagtttctagtctacacgaatgccagagactaagggcagtgctatccctttcctctgagcctgcacattctgtgggctgtgcccagcatagctctgccttggggaagtgggctgagccacagttccatggcagccagtgaaggtgttttcaggacagaggagctgctgtgggtgcgattggaagtggttcctcgggggtgatgtcagtccatttcaactgtgcatctctgtcgtgttttgactgtgttttccacatccgagctgggggtgtggggtccaccttcccaggtctttcagtgcatgtctccagaatcaggtggactgtttcaagcccaaccctctgtgacagacagcctttgaaaagtataattcacaggaacccccaaagacctcaagcaaaccaaaacagaggtttgtaaggaaggtttgctcggctgttcccctatagggcctaagggttccctcactttctctttcctcctttccctcaacacaaaggaaaaagaaatagcaaagagaggtgaaactgcgacagcactgaaggggaaagtgggtcctcattatctttgggaaaagaaaaagcttttgtccaggccgtgatctgcagcttgctttgttagctctctccattggcttaggctggctgtccattctggtctctgatggggctgtgagccaggaggagctacccttggtcaaagcaccaggtgaatggatgtctggggacaagcgccacaggacttggaactgactgagactttgaggccaaactgtcccccacggccccacctagagcactgggctttgctcagggaggaagaggcgcggctgccctccgggagcttccaccctgttggggaccagcgtggatcagtggccacagagggacaaagccacgcagagggcaccctcactggtactcagggctgggctcaggggaagcaacatgctccaaaaggagccctcagcaaattgcccggttcacaaagctcagctgtatttgggaaattaattcagattgatgtaagtgtcctctagaaactctggaagaaaaaaataattatatttatctttttaaattacagcaaagttttttaaccacaaaagttactcaacatatttacctgtgttttttgttagtgagttagggagtgggcactaacctcatagcactcgcagtaattcttcaggcagcctgacctcctgcagttcaccctttgttgtgctggggcttgacattgcccaattggcccttcccaatttttggctgaaagcttctggatttctaccaagacatgcctagggtagaatgggaagctccatcaggatgattttatcatttaaaactcagctcaatgaagggcatctcatttgaatctgattgttgtaaagatgccacaataaacagagtctcttgacatggttcagaaggtgcagccccttcttgttgatttccatttgtttccatacacaaaaagatatattgtagctaaggtttcttcatgtttgttttctgagtttccaagtcttacatatttactgtaaaaaaataatagatggtaaagtgcaaagaaaatcattatttccgtgtggacacatttccatccagcatttctggggcccttttcctaagatggttgagaccgtggaccatactagcagctcacactgcctgatcacaaccaacacaccatgtgccaggcttctttccatgggatttatatatacatgccctctcatttatcctcagcaactaacgtatgattgttttatacccggagaaacccaggcaccgagaggtaaataactgctggtaagtggcgagatcctgattcaaagtccctgtgctgacttcaaagcggtctcaaccgctgggccatgcctttcccaagcaatacacacgatatgttatccaggtcatttgttgtccctttttaatctatctatacacacaaatacatacatatctttacatacaaacaattcaacgctctttgtaaaaattcaaatacagaggtcacagtggaagtctgtggctccgttccgcttcctggggttgacatttggaatcggtgctgtccagcagcacggcccctgcacagggccatcgctacagaatgtgctgctggacagccccagcctgcggtgcgcggcttaggcattttcacggatcactgaagtgtgacaggcagtggaggcacacatctgcagctgggcatgatgatcttgtgcatgtgtgcacacctgtgtacctgtgcacacctgtgtacctgtaccaaggtcaagttagaggacaggcggccccacaggttgccttgtgactcctcctcagggtgcacccccgcggggaatgctcttcagacatagagggctttaggtttgcctatgctgtgcctcaggtaagtggaatcccacagcttgtactcccgtgtcggctgcctccctcagatacaactaggaggtccgtccgcactgctgcgcttagctgtagctcctgcttttcatcaatcatcaattcatccattctaccacggatggacatttgggctgtttccagtgcctggctacctgaatgaagctgctgtgaacattcccgtacaaatctcccagtggacattggcgcttgctctattggctatatttgtaggaaggaaatggctggatcatagcatacacaaaggtttagtttggtagctattgtcaaacagtttcccgaagtggttgtgcccctttatatgcctatcacaatgtatgaaaattccaaccctttttgtttttacagttttaactgtagatagtattcttatccctaaataaaatgtactaaagtttacatgcgtgacaattttcttctgtcctatggtctggctatatcaaaattggttagatatttcaagtcatttatccataattcaagaggagattaaattattttagaaaacaatgcagagagcagccacacccttataattgtgttctattgcacaggacattctcaggtctacagtcaatggctctcaatttcccttcgtgaatgagtggcaccggaagtgtctccctggagtaggttgacagccttgagcctaactgtccctccttatccctgattatcttttgtgcctaaagaaagggataaaagctgcaagctcctgtgtttaccttcagcagagtggccatcgggggcatcaaagtaaccttttgcgtctctgggaaaaccagattcttctctttttctggaagctgaggggtgaaatttaaattgttaaattttacaatgaaaatgtaggctgcctgatcactttcccctagccttctcacgcagtggactgtctacactttgcggctacactgctccagctcatgcttatctgctatgtaagatgaccccaaatgttaaactccaagataaagtggacattcgcatgttcttgaatcagaaccttcctagactgcgcatctctgaagccttcccacataataaaagggaaaaggcctttctctgcctaccactttacaacagccgcttgtcgtggttcaatacccccaccggcaggaatcaagttgtattcaagtaaattcttcaaaactgtgggttttttccaatgaggaatctctgaaggtgattttatgacatctcaaacagtttgaaatgcttttaaaatgcatacatttaatggacatttattacctaatggctttaaaccgttcaatatcatgatgcaagttgttgcaacaattattacaattgagttgttgcaaaagtccccactggcaaagcagtcacagtacctgtgaaggaaaggacaggtgagtggcaggcacagacggcacagtgagtagtgaaaagaagagcacacacgtgtaagaaagagcgggcagtgtgctgcagtcagaacactgaacactttcatagacggctcagactcttttatatgagaactagatcaactaggataatgctcaccagtgactaacacagaaggggtaaaactagttaaaaccatttgtttcataatataggattttgcaaagcaaaacaatttctgtcaaatccattgcatcaatcaatcctccctggcccctaattgccctccgccattttccaggagcgcaataagtttggtgggcagaaacatcaagtaatgaagagctgtccccatcacttccccagtccatccaacatgactgaaggtgtgttcacttcttcaccagaccttgacttgagtgaaaactaatgggacccagaggtggaacctggcctaggccttaactcgctttcttctgtgagggggaagtgaatggcagaggaaaggaatggatgaggcggctgcagtcacactcttggttgtaatgcgagggttgttcgagaatcctgagtctagtgaagcccttggagtgacaccaccatgccctgtgactcctggggccacacaggtgggtggcagtgctgtggattgctctgagggcttcctgggagagccgccagtgctggcagccagtctccctcccaaggtctgtaagacgcctgctcctgcattgtaaggcagagaggtgtttacaggcacgcgctttaccttactgggatgggcaagggcgacgctctccttaactcatgtgaaaatgtagcatcaagcaaggactcctactgtgccacctatgacccgcgccccagagagccaccccatggcttcccctgtgaccagagaagacccctgtcactgtcttctgtgagcatggttcatcgaaaagagttccaactcgttttccacatcggctctgccgccttctccccatgtgccagtcagctttgaagctgtagagtgggaatcgtggtgctcagcctcccagtcccaaagcgctgctgagggaaccctgggcgtgtgaagcttcccatagtgctgcaggaacacggcgagggccgtgcaggaaccagaggtctgcagaaacctctctggggcagaattcccaaacacaattcttttcataatattattttcatattttaaaataatattttaatgtcaagtcaacaggaaagtaaagaggtcattagaggccaaaaagacaagaaattgtgaacccagagaggcgagttctgcagcagcaagtgctgccctggggcatctgccagtccctagggacccggagcttgggttccaatgtgagcagacaggagacaaagtctgggcatcagaccagagacccctcataaagtgtggatcctgaaaggcgagctccccaaggagtgaattattagagacaactccactccacaacagggggaggagagacacatcccctgcagggagaaaggggaactatagaggtctctcctgaacctcaagccacgcagatggaaagaagggaaaggggacagtgacagaagatttggacaccagaagcagaggggcgagagaactggcgtggcagactcaagaatgctgaacctgaagtcagcagaaagagctgggaaggagcttcggaaggctctggaatgggcagcaccaggttcctccaaggagagcaaagccaggtgagataagaagagaaccagggggattctctgcaggaaggcatagtccccagatgactcctccttcctaagcagctgggacccccctgccaccgtggcagagctaaaagtgactctcttggagcaaaaccattgggcgtgggatatgataatgaacaaatcaagaaaagtgattgttgagacccctaggtttcttctactcagcttctagcattctagcagagactagaaaagcctcctctgaggactctgaccagcccaggagaaaatatctagaattgacattgagctttcccaataaaatagctaagtgaccaccctgtggtgaagctacagtgacaagccctcagcagtgcacctgcaggcccagtcagcccacacctcagctacagcccccaacagcccactcctcagctacagccccccggtcagcccacccctcacctgcagcccccagcagcccacacctcattcttaagtatgagcagagtgacgcccagggatccacagacatgtaggaaatcttccagagtatgaaagacaggggcccagagaaacggaccatgcatggaaaaaaaactaggaggaaagtggtatcaacagccttagagagactaagaaaagttattgatcgtgaaacaggaaaataattcttattaaaaatctcaggatatgaaaaaagatattttaggagcaaaaaagtaatcacagtgatgaaagacctagaaggtatgaaaactagaactaatcagggagaaagcaacagtgggccagactagaaaatccaacatttatatagtaagaatttcagaatactgaatattaagaatgaaggggatacaataattccagaacatttcccagaactaaggccatgagtttctgaagggaaaggacctgccttgggctctgcacagtagctaggaaaggactggaaccaagacagcatgagcacattctgcagcactgggaataagagatgatcctcatggttctagaaagtataaaacagttttcatacagaggatcaagaaaaacaatgatgttaaattccactagcaacattggaagctagaagaaatgcagtaaggccttcaaaagtccaagaaaaaccatttccaacctgaagttatactcccaatctaaattatcatctaagcatgagatagactaagacatttttagacacgtaaggtctgaagaaattacatcccatgtactcttctcatggaagctactggagaaggcactgcaccaaaatgaggctgtgaatcccacaaggagatgcgggctccaggagtcaggagcccaaacatgacaaagaagctggtgaaccccttagatgatagtagaggggggtccaagacgagagctgcacacaggcctggaaaccagcccctcatggcaggccaggccaggcagctcaggaaaagccttcacgacaggactgacagtgccccacttctgggcatgttgagaagaccgttacacaaccagaggagaggttagtgttatgttatgttgtgtgcatagaagactaagtactgggtatgaacagaaagggaaaggtaaagaagtcaggaaaggataattcatgaaggctcagcagggaccagagttttcatcgtcataaaaattaaagactcaatgctaatctaaccaagtctatctcatgtctgggtgtgggaaatgtgtggttggtaggggttggtgtgtgagtgggagaggaaataaagctaaatccacatttcccacgtacaaaaacaatagatcacaccaaactgaaaagccgaggagtaattcagacctgttattagacttatggaagcaaatattagaagattcagttaaaagagttgaaagttcctgggggcagaaaataaggaacaattgtcagggtactactatgttttgtcatgagcctggtacaatatgtggctctctaaattatatgtgtatgtgatttggataaaaataataaactgagagtagacagaataaaagataaagaaattagtctagatgcagcacagaagacagattgcaaataacaagagaggttaagagaaacagtcaagagttagagaggctaacgtgtctgtctggtgacattacggaaggagagaggagagaaaatgggggagaggcatctttggagtgaggatatcgtgagttttccggaactgatgataactgtggatgctcagatttaggaaacctaatgaacctaagaaagacaaacaaaaagaaaaaccaaagacaaaaagaaaatctcaaatgcactaggtagaaagatacattacctagacttgcatctgactgcttgttagaaataatgggaaacacagactgttttcaaagcattggcagaaaaaacctgacaacctagaattgcatacccagtaaagtatgtttactcaccgaggtccaggctaggcacacttctttttttcaccgtacactttttgctgactgattttattaactcttgcccttttaatcttttgaagattttaaaatctttttcaccaaacctgctctctctcccacactccagaccctaaaatccttattgttttattcccaaacataatgaaagggtgggctgtccacatgtgctcttatcattcctcatctcccttcattctttaacctttgcgttcagatttcctcctcctgcccacagactctcaaaggcatcaaccagctcctggaaaacccagggctctcttcactgttcttgagagctttagaccctctgtgttccagaaccacatcccagcttccagtcagaaatctctatcttcaattcagcgttccaccccttcacccacggtcttcatctgcacccctcgtgctgctccagccactctctctcctgtgcttgctctccatccatggtgttaccatctgcccagtaacacagcccctgtgtggttctgacaattaccttgctctgtttccccacatccaagggttgccaaatctactgatctggctcagaaatgtcttttattaattttatttttgataaatgtaaatcatatttattgggaatttttaaaaatacaaataagtaaaaagaaacaaattacatccaatctgaatctcatccctagagatgatcatttgatgaatatatttcagactttttctgtaaaactatacatatgaaataagtatatgttgtttggttacagattatatgtaaacaaaaataagatcatatttacaaactgcttcagtgtgcttttattacttatcaatagaagtaataaagataacatcttcattactcatcagtatgttatgaatgtttcccatgtaaatagatttacataccattttattgctgtacataccccatactatagcagcaccttgatttatttaataattcactttatctgagcatgtagatgttttatatatcttggaaatataaacaatactatagtagtggtgtggtcttctttctgttcctagaaccatccaccctccctctcttgccacagggcctttgcactgctgtttcctctgcctacaacactcttagcatccaccttcaatctacttccacccaagaactccccctaatccaaacacacctcctcagggaagccttccccgactgccatgcttgtcaacacgtcccaccccctcagcccattactgctcctttgccacattttccatggttccctccgacctttaattacatgatgattcatatgggaatagtcactttagactgtgagtgcgggagggcagggaccgtaactctcttgctcactctgtcttccctgttcctgagatcatggcattcaaaaatatttatggaatgaatgaataaatgagtgaaaaaatgatacaatgcattgttggaaaagtctctggaatctgtgttttttccttcattgttaccacccctgcccgggtcaggtctgtgctgctgcagtggcctcctaattaacctcgctttcaacttcctccacttgccattagcactaattttccaaaacataaatcaggcaaaaataagcaagcgaaaaagcataatcagaaaatgcaaaataagatggtattgtatattcctagtgggggtataaaatggttggccactatggaaagatacggcagttcctcagaaagttactatatgatccagcaattcacttctgggtatgtacgcaaaaggagtgaaagcagggactcaaccagatacctgctacacagtgtccattgcagcatcagggtaaacaaaacgtgattcatccatacaatggaatatttgcagtcataagaagagaggacattctgacacatgctacaacatggatggcactttagaacactatgctaagtgaactaagccagatacaaagggacagatattgtatgagtccattttgtgaaggacttagaatagtcaaaagaaagaaagtaaaataggggttaccagagattgggaaaggggatgatggagagtttgatgggtatagaatttctgtttgggatgatgaaaaagtctggaaaaattcagtgatggtggttgcgcaacactgtgaatatatttcatgccactgattgtatattttaaaagtttaaaacagtaaattttatgttatgcatattttgccactatctaaaagacaaggcacagagcagaatgtatggaatgctgccatctgaatgggaaaaaggacctaaataaaacttaaaacttcaaaaaaaaaaagttgttacaaataagtccctatgtgtaataatcagacaaagaatgcaaatagattaaagaaagctattgaacatgggttattagattgcttttttgaaaaattcagctatatttaacctacagaagacacacctaaaacaaaacgccacacagaaagtgcaaaactaaaggaatgttataaagcataactcactaatactgcatagagaaagaaaacatggtgcagcaacattaccgtcggacagaaaaacaactgaaggcaaatgcgccaagatacagaggcatagtcattaacaactgatggaataattcaccaaaaagtgtagcaatcatgaatttgtatgaccttcatgctatagatctgaaatatataaagcaaatagaattataaggaaaaaggagacgaattcataatcttaagtgagggatctcaacacattttagcaaaaacataaaaatcacacaaaattgaataagcaattagcagatttaaacaacaaataagccagtgaatggatagataactgcccctaacaaatagagaatatacatgttttcaaattaatatagaatattttcaaaattgattgtattaagtcttcattaaaggaagtctcattaatttcaaagaattgacgtacagactacattatctaactacagagtaattaaatgaaagaattaactaaaatatcatttaaaaatatatacatatacatacacatatatgtataataatacaaatgtggacactatgaaatgtacatctaaataactcatgaggtaaagagaaattacaataaaaacgacaagctatttcaagcggatgatagtgaaagtactgcatatcaatcttgtaggatgcagtaaagtagtccataggggtaatttacagctttaagtgcatttccaaaaaaaaaaaaaaaaaaaatttaaagactgaaaataataaggtaagcagttaacacaaaagctagcaaaacaagagaaggaaataataaagacagcagtaaaaagcagaaattaatgacttcatgaaccacaaccaagaaaatcaataaaaccaaaagctggtgctctgagaaggcgacaaaatagacaacctctcctagaactgatcgagaaagtctagaaaaggtcaaaggcctaattatagatacagaggtcatctttaaatatagaatatatgaatacgaatatatgaataatttgaaagttttgaggattcaatactttttaagaaaaatataaaatatcaaaattgatcaagaaaaaacataaaaaagaaaacaaactacaaaagaaagtgaatgagtaacctatcccttcaccactccaactccaatagacatcagacccagacagtttttcagacaagtttttcaaacgttcaatgaacaaataaatcctaccttacccaaacttttttagaggctagagaaaagaagccagtggggtggggatggggaagcctaactaacgcattttattaggcaatacatattgataccaaaatgaaagaatatatgagaaagaaaaattacaggtctatctcacttggaacaaagattcaaaaatcctaaagagcgaaatcttacagtacataataatcaaattggcttaatccctggaatgcaaaggcagattaacattggaaagtttgttgtcatagatatatatgagattaaaagaggaaaacaatctgatcatttcaacaaatacataaaaaggcactcataaaattcaccagtcctttattataattccgataattataataatagcaaatcccttagaaactaggaatagaaggaagcatccttaacctgagaagggcacgtagcagagaagccagcagtcctgcaacagccacttccccttatcctacagtggcagcaattgtagtggagcataggttggctcacctcaagagtgcatttcccagcttcctatttagttggcccgaccacatgctaggctgtggccaaagggctatcagtggaagtgattatgacaatgccggtcttgccataaaggttaaggagtgtgcacttgccctcctgttttctcttccccagtgtctggaagatgacataagggtaggggctggtgcagccttcttagaccacaaaatgcaagccctccattgagatgtcagggcaactaagacagaaatctgagacaataacattgattagccaccatattatcctgaaatggttgtagttttgagtctttgttatagcatctgagtatgtattctacctataagggcatctctcaaaaacctacagcaactatcttatttagggcaaggcaagggaatttagaaatatttagaatttaggaggaattcaacagtgccccagaccagaacttccattcacactatgaggttctagccagtataataaggcaaggaaaagggaaaagagtacaaagatgggaaggtatcacggtccaatatctgtgataagatcattgtttaaatagaaagttgaaggaatccacagacaaatcattacaaataagaagcagaattcatgtctggagcgggattgagaccccaaatcagacccatgtgtaatcaaaccctgagagctgacggggctgcactgcagaatcgtggactatatctgtgttttgccatacatggtgctagacaattaattgtccgtatgaaaaaaataaaattgaatccctacctaatgccaatcacgaaaatcaattccaggtgattaaagctcaatgacaaaagcagaaatgtaaaacttttagtagaaattctaacatcacattatcccaccttgatctaggttgcagtgagcatcattccattaaagacgctgtcctggagggcagactgcctcaatgctggcacactggcaacactgcaacactttttgggtcatcctgcctgtggcttgctgagagggtgatgatactgttcaaggaaatactcatgataccctctgtagattcacttcccacaggcatattgaatcatgaaattttagtcttggtggttgaaaagactaaaatgacagttttttgttgttgttgttgttggaaacgggttctcactatgttgtccggctggtctcgaactcctcggttcaaacaatcctcctgcttcagcctcccaaagtgctggactacaggtgtgagctaccatgcccagctcaatgacatatattctaaactcattcttattcattggccatcctgacatattgcttgctataaaacacttaataacattgaattaaattttaaaaccttttagatggctacttgagctggtaaaaaattaaggaaacccaacagaggcaaaattcagagggccaagctaaaactgaagcctgaagtgacctctgaagcatctgctgtcccagcaaccaaaggcgctggttttaactgctgcgtggaggagaaagggggaactatgcaaccctaactgtggcaaacacttacaaggacatgtgtgatctgctgggctgtgctctagtgctttacgtatattaaccccagtcgaaggcacactcagggtagaaggtctgctgcagatccacacatggaccagaactgcggagggctctatctactctgggaacaaatgccctgaaacaaatggcaaggaaatgtgcgtgtgatcctggctggtgggaggggaggaggctcactcaggttgaaatctgaattcatactgtgcagcctaataaaaaaaaaattagccaaaaattttagtcatccaagttggaagtgccaccaagctccaagtggaagcaaacaaaccttctctaagagcacattctcaaaacaagcctcaaagaactcccacagggaaagccccagtgattaaattcgcagtttaaaaaaatcacaaaatatgtgaggttccaagccataaggagaaaaatcaagagatgaaacaaacacagaatgagacagagactttactatagttatgagctacagaaagataattatttcatatttttaaatttaaaataagaaatcaaaagtgtgagtaagcaaaagagactaccaaaaaaaatgaccatccagatttcaccttctactccacagaattctggggcaataattaatctagttaattagagacaaaaggccacgtgaagaaacaatatcacagctgtacaatctatgcctgaaattttagggtttgggctgggtgcagtggcttacacctgtatcccagcactttgggatgctgaggtgggaggattccttgagctcaggagtttgagaccgcctgggcaacataatgagaccctatttctaaaaaaaataaaaataaaaaagctggctttgatagcaggaggttgaggcaggaggattgctggaccccaggaggtcaaggctgcattggctatgatcataccacctttgcatatcaattcatccagcctgggtgacagagtgagatctgtctcaaaaaaaaaaaaaataatgaaatgaaactgagtctggattttcttaaagtcaacaatatatgaaagggctaattaaaactgtcctaaaaggctgagtgcagtggctcatgtcgtaatcccagcactttgggaggccaaggtgggcggatcacttgaggccaggagttcaagccagccttgccaacatggcgaaaacccatcctactaaaaatacaaaaattagctgggcaggtgatgcatgcctgtaatcccagctactcagggggctgaggcacgagaattgcttgaactgggaggtgaaggctgcagtgagccaagatcacaccactgtactccagcctgggcaacgagccagactttgtgtcaaaaacaaaaacaaaacaaaaaaacaaaaaaactgtcctaaaaatatctacactcatggtataaaaccaattcctgcttttctgagaggaagagacctctcccatcctagtggacagtgctccttctcactctatgaaataattgtccaaaaatgtataattaacacttataggcaaacctcattttattgcactttgttctattgggcttcacaggtatgcttttttaataaaacaaattgaaggtttgtgtcaactctgcatcaagcaagtctacgctccatttttccaacagtatgtgctcacttcatgtctctttatcatattcctgtaattctgtaatgtttcaaaccttttcattactgttatgtctgttatagtgatctgcaatcctcgtctttgatgtcactaagtgtaattgttttggagtaccacaagccacatccatataagagacgaacttaagtgcaattgttttggagtaccacgagccatgtccatgtaagaacatgaattaactgatgaatgctgagtgtgttctgacttctccaccaactggcggttccctgtctcctccctgtcctcaggcctccatattccctgagacacaacaatattgaaattaggccagtaacaactctacaatggcctctaagtgttcaagagaaaagaagagtcccacgtctctcacttaaatcaaaagattaagcttagtgaggaaggcatgtcgaaagccaagataggctgtgatcaaaggaaaagctttcggaggaaattaaaagtgttactccagtgaacacacaaattatagaaagcaaaacactgctgacatgaagcaagcctgagaggtctggagagaagatgaaacggacaaagcctaatccagagcaaggccctaatgcttgtcaattccgttaaggctgagagggtgaggaagctgtacatcaaaaattggaagctagcagaggctggttcatgaggttgaagaaagaagccatctccataacggaaaagtacaaggtgaagcagcaagttctgatggagagctgcagcaagttctccagaagatctagctgagatcactgataaaggtggctacactgacaacaggttttcagtgtagatgaagcagccttctactagaagaagatgccacctagaactttgcagctagagaagagaagtcaatgcctggcttcaacgcctcaaaggacaggctggcctcttattgggatatggtgcagttggtgaccttaagttgaagctaatgctcatttcccatctgcaaatcctagaccctttaagaatgttgctaaaactactctgccttgtgctttacaatggaacaacaaagcctgaatgacagcacatctgtttacagcatgatttactgaatatttaagtccaccgtgaagacctactactcagaaaaagattcctttcaaaatattactgctcttgaccaggtacctggccccccaagagctctgatggagctgtgcaaggagattaatattttctcatgcctgcaaacacaatatccatcctgtagcccatggatcaaggtgtcattttgctttcaagtctcattatttaagaaatacatttcataaatctatagctgctattgatagtattcttctgatggatctgggcaaagtcaattgaaaaccttctggaaattattccattcttgtgccattaagaatattcatgattcatgggaggaagtaaaaatatcaacattgaaaggggttagaagttgattctaaccagctgggcgtggtggctcacgcctgtaatcccagtacttgggaggctgaggcaggcggatcatgaggtcaggagattgagaccatcctggccaacatgtgaaaccctgtctctactaaaaatacaaaaattagctgggcgtggtggtgggcgcctgaatcccagctacttgggaggctgagccaggagaatggcttgaacctgggaggtggaggtacagtgagccaagatcatgccactgcactctagcctggtgacagaggaagactctgtctaaaaaaaaaaaaaaaagttgatttcaaccctcatggatggctttgtggggttcaagactcagtggaggaagtcactgcagatgtagaaatagcaagagaattagaattagaaatggaactgaagatgtgactgaattgtttcattaccatgataaaactgtaatgaatgaggaattgctcttacagatgagcagagaaagcagtttcttgagatggaatctgctcctggtgaagatctttgaacactgctgaaatgacaatacaggatctagaatattccataaactgagtggataagcagtgcagggcttgagaggattaactccaattttgaaagttctactgtgggtgaaagctatcaaacagcatcacacactatagagaaatctttcctgaaaggaagagtcagttgagtgccaaactgcattgttgtcttattttcagaaactgccaccgcaaccccagccttcagcctccaccaccctcaacagtcaatagccacgacattaaggcaagaccctccctccaccactagaagatgacaactcgctgaaggctcagatgattgttagcatttcctagaaacagtgttttaaattaaggtatgtactttttagatagaatgctattgcacactgattgtactacacatgtttataattatataaacataacttctacatgcattaggaaaccaaaaaccttgtggacttgctttattgtgatttgctctgttgtggctgtggagctgaagctgcagtacctccacgcaagcctgtatgttgttgcctataccaaaataggcctgttataaacgtttttatatttatattttacgttaaatttttaagttgtatattttacagttgctttaaaaaatgatgtgcaaatcaatgtttaacatatacaaaaatgattaagaaagacatttgtaacagtgctggaaggtagatgttaattactttaaaaatctggctgggcgcagtgactcatgcctgtaatccagcactttgggatgccatggcgggcagatcacctgaggtcaggagtttgagaccagccggccaacatggtgaaacctcgtctctattaaaaatgcaaaaattagctgggcatggtgggggcacctataatctcagctactcaggaggctgaagcagtagaactgctggaacctgggggtggaggttgcagtgagccgagatcacaccattgcactccagcctgggccgacaacagcagactttgtctcaaaaaaaaaaaaaaaaaatttaaaatccatcagtaagtttccaataaatagaaagcatttaactacctcttcagtttacatcaacaccattttaatcatccagataatttatcagttaaaaataattcccaactttttatggctactgaaacaatagcaacaaaggttggggtacattgtttcaagtttcaggggtaaggaactaagagaggaactaaaaaggtagttccagctctatgtggaggaggaagatgaacgagtaaaacgcttgtctaccacaggagagggcaggagacaatctttacaggtgtggaggttcccccaggaaacctgaaagcagagttgctaagagtggaagcttcttggagggagacagactatgggagaagtggagcagggtctatcactttccatggagccttgactgtggtaatcgatttttacccatgccatcgctaaaacaaatacaaaaaattagctgggcatgagggcgcatgcctgtaattccagctactttgaggctgagctgggaggatcacctgagcccagggggtcaaggctgcagtaagctacgattagccactgcacaccagcctgggtgacacagtgagaccctgtctgaaaaaagagttataaataaaaaaaaaaatactgtcatgtgtttttatctctattgatggcaattataataataaccctcatagcctgtatacagcagagactcccatgagagtaggactaactcacgctaagaaattacattccattgccttgcgctcatgacttagttgcggggaataaaaaggtaaaagaatggaaagctattgatggcgatgatgccacaagtgtgagtgaagcaagcaacggaggatcccagcttatgttccttcacctgaaccaagtgtctccacatgaggacaggtggcatgtaggagagacaccagcacgaggtcaggggtctgccaccaacagacctcactgcttgggtgatttacctattccttagcttttccaaaaacagaacacaaactttattagtatttccagagtaactggtttctcagtgatggattgattccagccaaatcacaatgcatgatcagaatgcatgcgtcaattcatgatggaaataacatccttttccagtgcccaaaatgttcacgttgttctccaaggcctctcatttctcagtatggagctactaggaagctaagtcaatggccagaagttgcatgttgagcacagaattcgaggtgtgtagacatcgagtagattgggagggctcaagtctcttgcccactgcacacagcacttcgtggagaaggcatctccgtgcccttacagcagtgctctgtcgcctgccagcactggacacactctgggcctcctttcctctgttccaagctgaccgagtgccctcgtgatggtacattctttcttacatgtgtcggtcaccaattaactaggaagctgcttctagacaagaagctgtttctttggccttccattctgacgtaattcagttaagcctttcttagagtcatctcgtttccaagtccttaggagttacctcattttgtcctagttacagtctacaccctgctttaggcttcatggtcatttgacctgcctggtcccccacccagccagcagctgagcagctcccatccccaggagcccaccaccctgcacagctcttcctctggatgccaccacctggtcctcctccacatctgacatctccatctgggaaggccgctctggcttgacagcgtcacagggtccaggctttctcccactgtgcttcctcctccttcccagagctgcgtctttagcttccccatcagtcatgtcatggcgtttccaatgttcagaaagtatatggcctcgtagactaaaccaatgagagctcaaacattttcagacagtcaacctagactgtctgcaattactttttaaaaatcaatttgtttttccactttggttgtgtgaataagtttcacggacttctggatttctacccactggtgcacccccacatcactgtcccatactggggctctcagtgacttcagcaggagctctgtaatggaaaaatcacgtgaagactgggttagggtcgttagacattgggactaggacatgttctcccttttcaacgtgtaacttaggctaggcagacataagagcagaaagtgagcagcccacagcaagagctgagggaggacaacagcacagacaccagatgccagctttggcagggtggccgaggaaactgatgcccctaggctgtcaagcatggcaatgaggtctgcctcctacttcagccacatcgtctacttccagccccgactccacgtgacaattggccctaccatcccttgaccacacctcctggctgggggaaactttctgagaaaatttcaatgtagaataaaccaattcataaaactttttaaaaatggatgtggaaatattacagttaacgctcaacaatgacatcgttagcacttgtctgaggggcagaggatgcaaaccaaaacccaagaaaaattacgccccttgaagtgtgagccaccagtacttgactaaattagttggccaagataataccaaaaattcgtaccagcttcatgcaaaagggctgcttctcgctgttttggttgacaacgagcattaggacaaggttgctgagaagtaatgtaacacgtgcagtgctagccgttccggtttctctagactatgctccacttactgactctaagtaaccttatttcatatttaataatgaaggatttgtgattacttacaatttcagaactgggatttggtacagttacatggctttttagactttgtgtcccatgaactaagagttctctataaagattaaaaaagaaaatgtattcagctggttactccttatatagagaattactaagcatctggtgtttttcaacacattgtgagaatctcaacaccagatcgttataggtttattgacagatgcctaatcatgaagtgggagtttccaatgtgatggaactagcaccacaaacacagccacacatgcccagggagccagtgtgcatgcggagcagggtcctaaggctctcacccttcccaagatgtcttcctggagttcttctccccctgacctatttaaatctctatttttgtgctcctctccccactgaacagctctttccccgccaaaatctgaatgctaatggaagtacaaattaaagaacaatagatgaagcgtcgttcatcttcagatataccagtgctaagcagtccacgctgtaatattactaacaatatcaaagcatgttagtaatcacttaagttgccatgtgatcattggggactttcctcattttaggaagggattattacaactccctccaactgcatttggcgattagctcagaagtcatcttcaggggcattagagaagaaacaaaccttcctctaacgtgtctctgggtgttgctaaatgtgagggcagctgcacattaaaccatgggagaagttcccaagcattgctcagaagagacactcaccaaggagctcagaacatttgaatggaagtggttcaataggctgtgatgacaaggaggggcacgtgtacaaaacaccatggacaaaaaccaaactagatgaattctaaacgaatatagcatttaatttagaattctgtgcagggctgtccctgtgcccagtgggggcatgcatctctgtcagtgtgctctttgaggtctgtacacaggcctcatctctgcaacgcactggccacttctgagcaaggctgcatcttagcttgggttttcccccagagctagaacagcacctggcacacagtccgtgcttgctgtcagctcgcgccatctcatggaacataggggttggtaactaatacaaacgccctaaagagaggaaagtcttcgccctgtcctctgtgctccgagcgcccgcacgctcagcagtcttggctggtgtcggggctgaggtcagttccaaatcctcccccacttggcctgccctcacctcactgcctggtcttccgcccctgctctcaccacctgtgcatctgtttagtgacccatcccactcccatgggaaacagctcatggcacctgacatgggggcaagctgctaactttgactgcttctgagagagctcccattttagaggtaaagacaatgttgctgaatgctgtattaattgagaatcatctagttttgtttttcctttagagacagaacagttacagctttttgccctcatggggcctagaggtggcaggtctagctatcctgccacctggcctgtccacctgtgggtcagactgggcctgttcagagggggggctctgacagctacttcactgctcttgccctcggccctccagacctgccctgagctggggcacagggtggcccggcacttcctgtccagaggaacgaaactgttctgttgaggaagtggtgtgggggcttgcggaggcagtccagtggggacccacttaactgtggagggagggtgacaggcccacgagtatctacagagtcaggaggaggccggcggcatttactataaatcactgtgtggccaggactgtggtcagtgcttcaggggacaccaggataactatctgtttaatatacagtgcctgtcctggaggagtccaccaagtcagcaggacatgagacataggcaatggaaacattagagcacagaagagaataatcaaccagcacacgtcctatacggactgtgcacatggtgccatattgactgtaaatgccacaggaactcagataatcaaccagcacactgtgctacaccgactgtaaacactgcaggaactcagaggcagctagttcggcacagatggaagaagtgaaaaccaaatgcttttgaaggaggtggaacttgaatcaacttttaaggcggcaaggtttcttcactattactcaacaggatgacccagttgaataacagcgccagtaaagacacccatcaggaatgagcacggagtgcaggggcagtgagggctctgactgcagtggacactaagtggaaactcacttccatggctccagatggactgctcctcagtgcccatctaaaaattaaagagttagaagagatgtggacaactctgcctcagaaagcattctaaacaaactacaccacaacaagataacctcatctttaggaaaaaaatttccgagaagcggactcttgaatattctttattatgatgttcattatgttactaaaaccagtacatcaacaatgtgtcagaattcacatttattaccagattggtaataggattattaaagcacagagtgtcaggacaaggatttgtattaaagagtttttattaatatgataagctagttataagttagccagttcaccccccaaccctaacaaatgaccatcgggtcagctcgcacaccagcctgctggcctccagcctaagctgaactgcttctatggcctctataggttagatatgctgaaccacactgggctgacagtcttggttgggaactcacacggaatgaaataaccagaaaacgttctctgactgctttcttaccaccaaaaataaattggtagagattccagtatacatcagtattgcagatgtcgagataaaaatcatcaggcccaattaagtggagaggcattgattaagtaattatgtgcataaaaaatacaaatacacatctcatgtttttcctggcacacgtttacaatagagaaatattttgtaacattcaaaataaagaaaaacatgtgactgattaaaataatctagtatagacacagaaggaggaaaaggagagaggaagaagagcagggggagagaacaaagaggaggaggaggggacgagaagaggaaggaggaggaggagaatgggaagcgggggagaggaaaagggggaaaaggagaaatagctgccctgaaaacgctgtcatgactctgctctgtgcaaatgcccatcggctgcaacacatagaagcctcagagggtgctgcaacgggagagcacgcaattaaagtatgagaagtatcaaatgtccttgaatgttctagacacatacagcacagaggcaatactattgaccagatgcccccagattacaagaaagatgagtatttcagaactgtagccttttagatcatcctgtgtaatgtatcagcagaatctggaagtagtgaagtcatttttgtttggtccagaaatgttaacagccatgatgagatgaccaattacatcatagcaactgcaccctcaccgatccatcacacccagagagtgaagcaagcagcatggccacagtcttattctgtccaactcagcaaaagttgtcaacagcctaggcacagaattacacagctgaaagagccactgcagaaactgaagcagcggtgcccaggagcaaccaacgccctcagcgaccatgagggctgatagcgttgatcggttccagtgtgtttccagattcacggctttcattccagccccaaaccactctcctcacacttaccaaggccatcacgaagccatgccgatggcagaactctgcaggagcctggaaagcactggaggctgcgggctgtatcctgtaggtgtttgactgctgtctctcaggcccagggtatgtgtttgccttagactgtgggcccaagaactcctgcaggcaggccgggcacgcctgtaatcccagcactttgggaggctgagatggcggatcatctgaggtcagtatttcaagaccagcctggccaacatggtaaaacccagttctactaaaaaatacaaaaattagcctggtatagtggtatgcgcctgtggtcccagctatcgggaggctgaggaaggagaattgcttgaacccaggaggcggaggttgcagtgagcaggatcatgccattgtattccagcctgggtgacagagcaagagtccgtctcaaaaaaacaaacaaacaaacaaacaaaaaacaagaaaaaacaaacaaacaaacaaacacctcttggaggaggaatatgctgatctccataatcaactacagggctcaacgaatggagagggttgcccaaccactgttaatacataaatgttaacctgataatttcaaccagctgattagtttaattacaacaattataaacacaagacaggcaagaaatagcaagattataaacacaagacaggcagaaatagcaagatgaggtcccagataagtgcagcctatgtccacctggagatgtgaagaagatcatgcattagcacctgccatagagctcgagccaactcagcatggaaggcagcgggggaggcagctggagggcactctgcagccccccgttcatgctgcatggctgccacaccatatttccacggacgacagcaaaaaagagaggccagtacagtttgaatcaacatggaatgagacaaagagctataaatggcaacaagcctcagaaacaccaacataggacagcggacaggggacagggacagatgcaggttatgggccagactttccagcagcctttgcagccccagtgaaccagacacagacagcaacaccgttagtggcattgctgatggtaaaaacatttctcagagtcatgaaggtgtgcagtgaagctcattttatagtatagaagaaaatcgtgaacgtatcaagagtctcttaaattattacattagagtgacaatgtattgcttctaatccttacccaccaaagttatttttggtggtcctggaagagttgatcccgaggggaaagcagacccgttgctaccgatggtaaggctccctcaagctgttcaaagtcaaaggcaaggatattttgaattgcaaggatttttaaagttccagtcagccagccccctagataaaaatgattctttttttcctaaaggtttacatcaccatccctttataaccatgtctggccttattaccacaaggaatcactgacattcggaaggtctagtgctgaggtgtgtcacaggcctgtctggaagtgtgcaagatgtctggaagtgtgcaaagatgcagggctggcctccacgggctggaggccgtccatgctgtcactcagctggccaggggtattgtcatggaactccttttcatttttatagactacaattatgaaataaatttaatgacaaatttccataaactagaaatgttcttatacagatttgacatttgaagtcttgttggcaaccatgatttttcatgtattcaaaaaaatattttgaaccagttttaacaaattcaaaagcaatgtcatcatctctgcattgtccatgttctttgtttcccaggtctcatctttctttatgttactcattagcatggcctgtggaggctgttcaagggaaaggaacaggcagcaaagccatcactggcctacttctcttctactcagtagcttaagaaattaacagtactaaatacaattaggttttcagattatttgcatatatcacaattaacctcatatccttgtcccttcctctgtccaaaaatggaaatgtatctttaaataaattatttttaaagctttaagaagtatagtcttagaaaaaaaatgcgtcttgtattcatcctcgcacttcctccattctgtgcccagtttaaactgtgtgtcatcaccatccattacggctgaagacactgagaaagcctcctgggtcccactgcctcatttacaatcagtcttaagtcccaggcttcttcccgggaaaccccttcctgctctcctcttgctcgtgcacagaagggagtgtcacaaggccctgagacaggtgtcccttttgccctcacctggacacctaattgttaggccctgtcttcaaatgtcagtctgaagagttttgcattcttttggagaaaggatgtcatagtctcaggattgaggcaattattcgcataaaccaggtaaaattactttttttccccctttcttatttagccccaaagtaaagcagagacatctcttatgtactccataggttgtaaatcagggcaactttatgctggaatccacgagtttcttcagcaatgtttggtcctcttggagtaaggaagtcaactcggaggcagggcttctcagactctgctgtgtgcacaagtcacctgggcctttatgaaaatgcaaatctgattcagggggtctgaatcccaggtttggggtggaactgaggttctgcacttcttaacaagctcccaggtgatcccaacagttctggtccatggacacactttgggtggtaacactccaaagaatatacagaactggggtctggcaaggaagcaacgattctcgagaagcagcaaatgcattgctaaaagaattgtccttgaggtccatgctggtaaggggccaaaatggggacgataataaacagtcaaggaaaggtgggggaaggtggggaacagcaagttgtggccaaatgggtgtttctcatggaagatcttagaggtgaaagagcaatacaatgtgtgccttctggactggtggctgaaacagcagagaaaggaaggccagcagcgggagggggccagacggtaggaggattctatgaggttccaacacagactgcatctgcgtgtcgccagatcccgacttacactcacctcctgcactgataacactctcttttatcttggcaatgtatcacttgagaagtatttactcactcattcaacaaatatctaattcaatttacatcacttcctttgagatctcatctattcatatggctttcaacgccatctatacactaggatcccaatctcatccctcctgcccagcccttcctcactctaaactcctacgcaacatctttgaggcatcccaaatttaatatatccaaacggaactcctggacgcctttgaaaaacttgaccatctcatctttgttgatggaaactccatctctccaatcatccaggctgaaaaccttggcgcatccttgactcctctctttctctcacatcccacatccaatccatcagcaaatccgttgactcaaccttcaaagtatccctagaagctatttcttgccacctccactgccaccactgatctgagcgatcatctctccccgagattattgccataacaggctcaccgttctcctgacccctcctccccaccagcccctctttagagtggaagccataatcctcccagtgccttacttcctccctgccctgctcccctagctcacactatcccaggcccagtggcctcctcgcgccaccacagcaggcatgaccctatccaaggcccgcctgggatgttccacagcttgcttacagagctcattccctcatctctttaaaggctttgctcaaatgtcaccttcacaacggaccatgatcaccttttttaaacctgcaactaggctttttccccatcaaatccccatcccccaatccgcttcctctgctctcctaacagatgatgtaattggcttcctattagatttgctattgtctatctcctgcagtaaaatgtaagctgcaggagggcggagttgtgtgttttgtttctgaggttcacttacctcacagatcagtgcctgcccttattgaagggtgagtgggtgcctacatgggccaggctttgtgctgattctcattttacagagatgaacgagacacatatgcctctgcccctatggagcctgcattcttgtgggtggatgcagacaaaccaaccaaccacaaacgcaagccagtgagagtgccatgcagagcaggagacagcactgtgactgtggctggcgtctacgctggggagttagggaaggctcttccggggaggtgacacttcataccaaaaccgggaaaaagagcgtatttgtcctctacttttatgtaatatacacatatcatggtgtaacataaaagcaaactttaaaaaagtatttccataacactgaggagggtgaggagcgttctgaccgaggaggtggaatatgctgttggtggggtcacagaggacaagttagcaagcgtggagaatgccggtctggaggctgcaggaaagggcaaaagggcttcatcaagttggtgaagataactgtgtccgagactgactccagcccacagtgtctgacacagtggggcagggactgacacttggtaagtatttcactttgacttttaaatggaaaataaattatatttcctgagtattccaaccataacaatcaaaattttaagagacaataatgcaaaattgtattttttaaataaaacaatgactcacttgttgtgtaatgagatttaattttgttgatgctggcaaaaatcccctactaaagcagtcattggtttagggacatctgtaaggaagataattaaaaattaatgtagcatctatcgttcctcttccacttacacgtggatgaaagtacaaaagtctgttatgacatgtcctgtgcaaagttatttcaacttatcttgatgctagttacgcattttattctcaaaacctttcaagtcagtattttacttaatatactcatttttcttttcttttttggggaatggtcataaagctacttgatctgagcttccagggttgctctactaggctaaaacaatgtgttagtgctctggttcccaaattgtgtgccaaggtgccctgcatagccacagcaaactactaggaaaaaaaatgtttgagatagggtctcgctatgttgcgaggctggcttcaaactccgggctcaagcaatcctcctgcctcagcctcctaagtagctgagcctataggcataccagcttcgctggatattttatgttttcttttttttttttctttttgcttttttgagatagatcttgctctgttgcccaggctggagtgcagtggcactaccacggttcactgcagccttacccccctaggctcaagtgatcctcctgcctcaccctcccacgtagctgagactacaggctgtgccaccatgcctggctaatgttttcattttttgtagagacaggatcttgccacatgaccagactggtcttcaactactgggctcgagcaatcctccggcctggcctcacaaagtctgagattacaggcgtgagccagcactccaggctggtattttatgattttaaagaaagccagggacatctattggataccacaggaactacttttttttttttttttttttttgagacgggtctcactttgtcacccaggctagagtgcagtagtgcgatgttggctcactgcagcccagcctcaaccttctggcctcaagcaattctctcacctcagccccccagtcaactgggaaacaggtgcacaccaccaagcccagctcatttttttttgtatttcttgtagagacagggttcgccatggtacccaggctggtcttgaactcctgagctcaagtgattcacctgcctcacctcccaaagtgctaggattataggcgtgagccacggcagccagcactactttcgattttgtgtatttttttttcaagtggttactaagttgtttggatataaatacttactaagctattagactaaactacttagtactggaactgataggtacttatttggtctacaagtgccataaaaacattcttgagacactaagggtgtgtaagcctctgtgctcatgagttcaagtagagcacctgaacactttttctcctccaggcctaggcatcctttgagtgaggaatctcagaccaggcagcaggatgcacgtactttattgtgatgtttaatatgtgcacagtgtaacaaagagatgcaggtggggggagtatgattatatgataaggaacttgaactggaaaacactataaaactctctcctcctgcagaccttaaggcactaggattttgtcatgtgccaggaggaagggagcaggaaagaccttctccctgcctgtagagatcagagatgcagcatgaacctatagagatgaggccaaagctccaacctcagcttcttcactgtgaaaagagtcaatgtcttgagatatttattctgtccctggacagggagacaatcaggatgcaatggggagacagggagtccgctttgtctttttgccctggacttcaaaggccagtgaaactacatctggatttgctatggtttcaagttataggcaaggtcagtgaatcacctgacagtgaatattctctcgttaaccaagatctagggtaatgtgattacgtgcagtccccatagagaggcctaattttcaagaatagcatctcacttttgttaaacacaatcctaaaatacgtcatttactctttctctaatctgcataaggaatttcagaacaatcaagtacttacaggtcatttcttattattgtgccagttaaaaaagtttcttagtcaggtaagaatgaatttcttagaatgaatgtcagacaaatctttgttatttcagaactcatggtgattaaagcagaatgatagttctcattgattacactaaatgtttacattaaaatgtaggtgtttacaccacacctgaagtcaacccatcaggtcatctgggaaaggctgatatttcaatctaggcacatcgaggcacctatttgtggaattcctccaatgcagtgtcggtctgagtcatcacctgttaggatcacaaagctctcagcagctagtgacatgagggacagctatccaagaatttgagacagtcagtacagggtacaaaaattagctatagatatacatttttatattcttagcttactaatatggactacgaggtttgccaaattcctatttaatatcctggttgccatttcactttatatacaaagccaaacatattcattaccaacttacatatatgacatagttttttttattaattaactttgtacctgactgtagaaattattttgatcttgatactgaggaaccaaatggagtgcttttagttctcttgttctaaattgtctatacatagcatttgtgtgccccctttcaattggcatatcacctaaaatgaaaagaacaatcaggtttcatttttgaaacataattccagtaataatgaacctaaataaactaaatctgagaaaatagctttaatccagaagttacattttaatggaagatagaaaactaagatctgttttcgatttcttactctacactaacatgctctttggagacaccaaagggcaaaaaaaaaaaaaaaaaaagaaaaacccagaaatgtttcctgagatgcgtccagtgtgtgacagaaaaaagttcctgtgcctggctttctccacaggtgtctgatttagttggggatcagtagccatgccccagagcttcctttgtcctgtcctcactccaccattgacatgagcagagagggtgctgctccgctaagccccagcccattcagccccagtgggcactgaggccctggggcatgtccctgagtccctgggcacgcacttaaaatcctctctaattttactccaactgcctttcctgccacacacatgtcattatttaacacatggggttttaaaaacacatctatttatttcctacaagtacagcttagaaaggttagtccaagaactataaagttctaagaagcacactgatctgcttgggcctgagcagcactgtcagaccccccttggatactgaccataataaatggtcgcaagccgggtgggtctgccagtccatcccatcagtcaagcaaaagcactagggaactgtgtgcccagccctgcttcaggctgtggcatgtggggatagaaaggcgagaatgctgtggcttctgcctggacacagcttccaattctgctggcagaaccacaactacacgagcagctgtgctttatacacttaagttgcttataatctagataagagaacccaaagaacataaaggaccaatgttatcaaagtaatacacattggacctactatggtcattggatcatattccacatcatcctgacatctgatgagaggccagcattcatgttcaattggagttgttttgtatttggaggataaagttatagctacacacacacacacacacacacaggaaaggccagagtgaactctgcagacctgcctctactgcacactcctgggccctatccacatgggaccttggctctgccctctggggaaatgtgctaacatcactctgcagtcttggggagtcgggagttctcatcctgctgacctgcttttagggtcctagaaaaactgctatcagaacccacgccccaaatagaaccaccgatggagaggctaatgttagtgtacaccacagctaaaccaactcatgacaggctcattttcaagtatttgcttgttaacgtctatgccttacagcaagggctcatttctaggaataaagaattgctgggggaaaggcaatgatcggttcttggactctggtgctttgctaagggaatgctgtgggcgacactctccccattcctagtccttgccacgtagatctggagtcccagatgcaccacttaattatgaagaccaatgtagatgatgtaacattctgtttcttacccataaagtggggataaaaagaatgcctatcctacagagttgttaggggattaaataaaggtgcaaaaatatgacataaaccacagctgtgactgattacgtacccatacaagcgttacctgttatcatgagagattgggacacgaaggaagcaggctctgccctaagccacaggaccgtgccccacaccaatatgccaaaccatgaggctcagctgcagtcccgaccccagcactgcactaactgatgtgatttgtgcttgctctccttaatgaatacagcatgtcctcatctttgttcaatttgctaagatggagtagaaatgagaatcttagaggtgagtgtgaaaggctcatgtccctgttttgctaatgagacaaccaaaaatcctgatacaatactacgtgaaatgaaaaacgagtgaaatgatcagtcgacttagtaatgatggggtccagcattagtataatgttagtcctacacatcttctttagcataattaccattgggttggaatcttcttaagagaacagcaggaggcatcctctagttcctgggacgatgggaacttgcaacagattcctgagcaagaagattctgcaaagttgcttcttccggattattacttgtagtagtacacctgcttccttgatttcaacctagaaaaaagcaataattattttagagaacacatggggacactggctcttgcagttgcataatttagaaaattgaaatctcagtgataagtagaattatggtgaaaccctgtctctactaggcatggtggcacactcccagctaccggagaggtgaggcaggagaactgcttgaacctgggaggcggaggttgctgtgagctgagacagtgccttgcattccagcccagccccatcacacattcttccagcatgctcagtagtttgaattagtgttctagtcaattgttttttcctcaaaaagccccaaatccttggtaacgttttaatatatttatgatgtgtttataggaagatttgtaattaggtagtagccctttcctgccttaatgtaggacaacaaacatgaaatggtggagagtagggagtggctgccagctttgtgttcaactgtcttctgtaacaactgtcaacccgatgacaaaattaccaaagatatggagaaatacgggataatactgaaaatcaatagaatttttaaaagtaagaatcctcgtggttaaaaaaaattacaatcaggattgtttcaacattgggatgctgctttttacaatctgtaggaatgtgggaggactgggaaacccacgctttgcatcctcccctcccctcctcctccacctacacttcccgagctgcctggaccagaggacagtggggctccccaaaggccaggaggcaggccacaagcccttccaaaaagatggtggctctaaggtaacatactgaagacctcaaataaaaatccagagcaggtatctttcaaaatgcagatagtgactcaaattggagcttgtccagcccaaaaaatcagaggcccaaacaaatcatatttcccatgtatgggcaaatcactcagcacagcgactagcatctaggtataaatcttaaaagagataaagtttagctatattttaagtagcttatttagaaattttaaatttcatataaatacacataaaattttcttctacttgctgcttgggggatgtgctatgcacgtcatcccagtttagatttaacttatctccctgtaatcaacaatactactataataaatatatcatttcctcagacctatgcaactaatatctgaactactatactaaaattccatttctgacctttcaaaacaaaggtcaacatgtgggaatgaattttagaagaaggaaattagcaactgatcctgaatatttactgaaaataattccattctgttaaacgataaacatgtctgtgctgtatctggtccattttattaatgaatcagaaagcagtaataaaaatttaaaaagcaaagtctctcctttagtttgtcagaccagcaatctcttaaattggattaaagagaattttactatctttaacatcagagaattctcttgtgtgtgttttgttgttttttaagacagggtctcactctgtcgctcaggctggagtgcagtggtgcaatctggctcactgcagccttcgcctcccaggttcaagcaattctcctgcctcagcctcccgagagctgggattacaggtgtgcgccaccacacccggttaatttttgtattatcttccctgtctgattaatgctttctgactccactctgtgaggaaatgagccgagctaggacctacgggaggaggcgctggacaccaatccggctgggcagcaaaatgcagttcttaacatttcaagcctctgagaaaggctgtgagaaagacctctgtcctgggaaacggctgggggaactggtgactctatggctcctctgaggacaaacagaggtcagtggaggccccagcctctgcccatcctttcctgtacactaaggactggcaattaccataacagaaaaccggaagagcagaaatccagctcctgctgctctggcttatgatacagggtcaggctccagccatctcaatactgactaagcattgtgtcccacaaacgcttcatctacaacttactaaaatgacctcatggatgagggtctcgttttctgagctgggtcctttttgaggggtcgagaacacattttcctgggacctttgtttcctttgaaaactcattagttttggcaagaacaaagcggaaaattatcagcggcatctacagctagagagggcagtcggctgagagctggcaagcatttctttaggctctgattacattgcatatgcttgaagagctattactcattagcaaagggaagatctcacatcttacttcaaggcccggaaaatccaagtattaactctgagtccttgctgtggattccaagccggtaaagttaaaggaaaaaaaaaatgcaagatgcaaacacgccaaccctccaccacattcgtttgttttcacagacaatagttaccagcagacagcgggcctctctccttaagccaagatagcaacagggcccaagggaacctacgtcctagctttccccctttttttgttgtccgcgtctgcatggttaggtcagctttggacgactggtgcagggcagaattccctccaggggaagggcttggctgggccgatgcatgttggattaggaagacgacaaagagtatacgctctacgagaatcagtgactccggtgggctgtgtgtggtgtcaccagggaaaatgcttgtagaggaaatcctggggtacactagcagcctcagatgggttggggaagggatggagggggagcttgcccattccccaggcggttcttactgggatcatgcggacgcccgggtgggaggctcctccaggacccaggcgcccaggggcaacaccgccgggctgcggtgcgcgggtagcagcgagacaggaagtgcacgttgcaggcgggcggctgcggggcctgcaggagcgcgacgtcctccgcgcgctgagctctgggatcccggggtactccccgaggagctccccgccgtcgctgtcgcccccgcgagcttcgccttgacctggcccttgcagtcggcgcccagcgcggggttgaaccgtgcaggacgggttccttggggtccgccgggcccaggtacgcttctttgaagacgtggactcgtcctcctcgtacttcacgggggccttcaggccgatgttctccgaagcgaacggacctcggggcttaagagctccgtcaccatcgcatcctcggggctgggcagcccgcccggcgagggccctcctccatggcgcagggcggcggggcgggatggcgggggccgcgcacctgcacacgcggccaggtgagaggcagccagaggagaggacgaggggaggggcggccagaaagggacagccaagggaggggcagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccgtcatcctcctcggaggacgcacctggggccgccggggctgccgcatcgtggatcgagcgggatgggcgtgggccgggcctcatgcgcatgcggccgttggcggttggagaagggggaagggtagggacaggaacctggggggaggggaagaggcgcccgggcagtgggcggggcctgggcgggggcggagtcgaggtcggggcggggaggtaaaggcggggccagggaggtgtggtgggctggtctggggcgggaggagacagagtcgcgaggggcggggcctggactgccgctgttgcagagcgggtcaggggaggcactcccaggttcagccgatccaggctcaggtggggaaactaggtccccatcaactcgggcagcgctaagtgggactgcctagcttggcttctgaccttggcttcagttatatttttctggccaggcgtggttgctcacgcctgtagtcccagcactttggaggccgaggcaggcggattacttgaggtcaggagttcaaaaccagcctgggcaacatgtgaaaccccgtctctactaaaaatacaaaaattagctggccgtggtggcacgcgcctgaatcccagctacttggaaggctgaggcaggagaatcgcttgagcccgggaggtggaggtgcagtgagccgagatcccgccactgcactccagcctgtgccacagagctagactccgtccaaaaaaataaataaaataaaataaaacatttttctacactcgagctctcaagacagatccggcctgggacgctgcgggtggacagagggcaggggcttgcaccgcacgttcccagcctgcacccactcccggtccttggtgacgcagcttacaggtgcaactgatggagttggtccgaaatagaagtaacaaatacggctgggcgtggtggctcacgtctgtaatcccagcacttgggaggccgaggcgggtggatcacctgaggtcaggagttcgagaccagcctggccaacaatagtgaaactccgtctctactaaaaaatacaaaaactagctgggcgtagtggcgcacgctgtagtcccagctacatagaaggctgaggcttgaacctgggagatgggggttgcagtggctgagattgtgtcactgtactccagcctgaccaacagagaaaggctccctctcagaaaaaaaaaaaaaactcacaaatacaatgaaagtctcaaattttgggtggggaatgagctattcatctttaaggagtcaatagatatcactgtttaatcaagaggaggtgaaagtttaattaagtgatggcgaaaactgcaaagggtgtagagggactggtgggagtgggtgctggggagcagcctcaggtactgtctactcaggtactgttttggtaaaaataaagaatgtaaaacatagctttctaatctcacttttaaaaattaaatacttttctaaatttttaaagggtagtaccaaggcacagcaacaccgtgtactatttagttgtacatttaacattcaaaaatcaagaaattttgcctggggctgggcgtggtggctcatgcctgtaatcccagcactctgggaggccaggtggtcagatcacttgaagtcaggagttcaagaccagcctgactaacatggtgaaacctgtctctactaaaaatacaaaattagctaggcatggtggtgcacacctgcaatcccagtatttgtgaggctgaggcaggagaattgcttgaacctgggaggcggaggttgcagtgagtgagattgcaccattgtactttagcctgggcaaaaagattgaaactccatctcaaaaataaacaaacaaaaacaacaacaacaaaaaacactcacagaagcagaaaaaataataaaaaaataaatcgaagagcccaagaattatgcatagcttgagtggcccaagcgagagagtaaccacaaggttgcaccgttcattcgtttactaatcagaatcagacgtctactgagtagcatatgccaggcatacacagccacctgtgggggtcacccacgggttgcaatcaagcctggagctctgcacctgctgctcctagatgcttgctgccctgctgcactggccgggctggctccgcgagtctctcaggtctcagctcaacccactctaagtgggtcaacctccctgccagctacaccccctcccaatgatcctcttagttgcctcagaacacttaaaatccttcaactggttgcttgttctctttttcctctgtgatatggtttggctctgtgtccccacccaaatctcatctgaattgtaatccctctgtgtcaagggaggggcctggtgggaggtgattggatcaaggagcggttcccctacgctgttcttgcaataagaagtgagttctcacaagatctgatggcttaaagtgttcggcaattccccctcactctctctcctctgctgccatgtaacaggtttcttcttccccttcaccttctgccatgattataagtttcctgaggcctccccagccatgctgactgtgagtcaattgactgtctttcctttatacttacccagtctcaagaagttctttacacaatgtaaaaatggactaatgagacagccagaacctggtggggtcactgctgtctccccgtgcctagaacaggcgctgatatggtttggatgtgtgtccccacccaaatctcaggttcgtggtaatccctaatgttggaggtggggcctgatgggaagtgactggatcatgggcgtgatttctcatgaacagcaccatccctcttgctactgtcctcaccatagagtgcgtgagttctgtgagatctggttgttcgcaagtgtgtaagagagcacctcctctctctctctcagattggttgtttgcaaatgtgtaagagagcacctcctctctttctctctctgtctcctttcacatgtagaatgcctgctccccctttgccttccaccatgagtaaaaagctgtttgaggccccccagaagcagatgcctccatgcttcctgtatagcctgcagaactgagagccaattaacctcttataaattacccagtctcagctatttctttacagcaatgtgagaatggcctaatcaggtgctcaagaaaaacagaaaaatggaattcatgcattacttttaacatatttattggcatcttttatgtgtcaggcactgttctcagcattgaggcaatggaatggatgaataaagcacagcaagtgaaaatcaacaggcttttctttccagcccagcacatgaacttggtgattccatggtctcctccaaggccttgtttccatatgctgagactttccactttgtctcaagatctgaacttggtccttgacttataatccccttaatataacaaaagagacagaaacaaacttgtagtagactggggttaatgttttattaatgataacctacattcacactgcatttcaagatttacatccaaagagcatactgtatttacatgcaccggtcagcccaagataacaattcaaaccatggctgcgttaagacaatggtttgttccaattaaattaaacagataataccttatcaccccccttggacatgtacaataagacccctctttctcccctcaaggaatataaattgcattgataactgcactgatgagcaacaattacatttgaaacatttaaaacctgaagagaaacccaaatatgtttaagcactcacgtctacactcaaaatgccctgtgaactctgtgtaacacagattgctcagtggtcaacagtgcatgatctagctggctctgatagggacgacgccggctgctggcttttaacgggaagtgctattcttgcccagggcagagagagctaatccccgctgcctgcttgacggacagtcaggggcttttgttgttggtttgtttttgctttttttttagacggagtctcgctctgtcgcccaggctggagtgcagtggagcgatctcggtcactgcaagctccgcctcccgggttcacgccattctcctgcctcagcctcctgagtagtgggactacaggcgcccgccaccacgcccggctcattttttgaatttttagtagagacgggtttcaccgtgttagccaggatggtctccatctcctgacctcgtgatccgcccgccttgcctcccaaagtgctgggattacacgcatgagccaccgcgcctggacgctttttttttttttttgtcttttgttttcattttttcttgctttcaggagaaaaaaaatctttggcccataaggtgggatttttacatcatgaagtatacatacataaaacatgcatgtgggccgcgcaggtggctcatgcctgtaatcccagcactttgggaggctgaggcaggtggatcacctgagtcaggagttcgagaccagcctgaccaatatgatgaaaccccgtctctactaaaaatacaaaattagcagggcatggtgttgggcgtgtaatcccagctacttgggaggctgagacagggaatcgcttgaacctgcaaggcagatgctgcagtgagccgagattgcaccactgcactcagcctgggcaacaagagtgaaactccatctcaaaaaaaaaaaaaaaaaaaaaaggcacggttctccggcaagcaccttccatcgactccaacagttcagccatcgctgttgtactatcgggtgcagcactctgaaggagtcaggcccaactagaaccaagtggtcaaaaaaataaatcacaatttaaaacaatggacagctaagcttgtcatgacagacagtgggaatttcattcctgatgcttcatttttgcattaaatactgaagatgactcagtgcataattgctttgtggtcatgagacgctttcgtgaaggcactcctatctgaaggacaggctgggtgaacacctagcctgtcacttgagacatcttggctggtcaccaaggtgagccggcatactgtctccatcacctctggtgagtctttcccctcaccgggtgggaggagaaggccatcccttggggtcgtgggccactctctcctcaccacggtgggctgccctccccttcctcacttgctagtccccgctggtggccgatgccctgccctccttgctgtcactttgggaaagagatcctcctgaggcactgtcatgttttattcttgagtgaattatctgaccatcacggcccttgctccccttttatacatgtgcctgttatttcttttgttgcttatgatgacaagaaggcagtcccgggagggggtctggcacagctgcccttgggaaggaactggtgtttctgagggggagggggctggtgggtgtagcaaatgcttatgtacggttatccatactcagtcaattgtgaagggaacagtatcccacaattccacccaaagactctacaaaataaatctttctctccatctcccttacattagggcctttcatttttaaggcactgggttgtgaagacttgaagacatacaaggtcagtaaactgaagaccttgcatcctgcttgcttcaaatgtggagaggcaaacacaggctactggccagacgggaacggttacccacggtgacaaaagcaggtctccaaagcacagcattttggtagtgcattccagatgtgttagctacaactggggacaccaacttgaataacacatttttttttaacaaaacaaaagtttaccctgcttggatgatgctaaatgcccttaagcactaggcttcggttgccactgagaaagcacaccatttccattccactgtgtgtgaagccacaacctactaattccttcattaactcaacaagatttgcatcccttaataaatccaagccgatgcgagacatcaggggagactttatcagatgtcccccaagggagggcaagtctggaagtagtgggttatgcttcacaggggagagatactgttctaggaaaaaaaaacacccacattttctgaaggaaaactgagtttttttaagagcagtgtttcatcccgagctaaggtcaggattaagcctatttttcatttggtttgcatcagaagagctcgttttccttcccagcagctccagtgaattactttttggaattagaactgagaccaaacaaagtgatgatgtcagtcattgctttttcaggtgccttccaaagcgatgagaatcctttcatgtaaaaacaaaaaccaaaa

SEQ ID NO: 5048 - DNA, 100000 bp, Homo sapiens
gcctgaatgtcaactccttcatctgcagtgaaaaaataagactgctctgtggaccagacacttagttttatttttcactgcagattatttttcactactcatgtgggcctgcccagggattctttcccaggaggcaagttatgtggcaagcaaaatgatcaggagagtcaaacaaacgctgcagaaacggatggacgatgactgtcagaaggaggagagaagtggagggtgacagcgaggtgagtgcctggctcattcatcctcactccctctcttgaatccatgttaatcacaattacatgaatgcagtgctttaaaattaaggtatatagagaaaccccatctctactaaaatacaaaattagccgggtgtggtggcgcatgcctgtaatcccagctactcgggaggctgagcaggagaattgcttgaacccgggaggtggaggttgcagtgagccaagatcttgccattcactccagcctgagcaacaagaacaaaactgcaactcaaaaaaaaaaggtaaggtaaggttatgcttataatcccaacactttgggaggccaggccaggaggatggcttgatcctagggttcaagaccagcctgggcaacacagtgagaccacagctgtcccccatctctataaaaatttagaaaaattttttaaagtgctaaaattacaggcttttttaaagtggtaggattatagccggggggtggctcatacctataatcctagcactttggcaggctgaggaaggtagattcttaagccctggagttcaagaccagcctgggcaatatagtgaaaccccatccttcaaaatattagctgggtgtactggcacatacctgtagtcccagctacttgggagactgaagtgtaggatcacctaagcccagggaggttgaggctgcagtgagccaagagtgcaccactgcacccagcctgggcaacagagtgaaaccttgtctcaaaagaaaaaattatccaggtgcggtgtgcatgcctgtagttccagctacttgggaggctgtggtaggaggatcacttgagcctggaggttaaggctgtagtgagccgtaatcacaccactgcactccagcctgggtgagacagcagacattatcttaaaataaatgaaaaataaaagtaaggtagaaagagtatttttaaaagcttattggaggttcacatcagcactgagagataagaaatagagcagatatcatgattccactttttgaatgcagaaactgaggcccagagaggtgaatccagcctgtgtccttcacacccagctggctcatagaaaccatggcctgttaccaaccaagccctccagagcccagcacttaggccgatggcggccttccctggcctgctcctggggcaggttgctgagaagcattgccgttttggggagaggcctgcggcagcctgaggaatgagcctggcagtgggcactctcactgggcctcctccggcgctgccctcaggaagattctgtggctcccaaagccccaggggcgctctgaccacagcagtcagtcctgccgggttggggggggctcttgtgcccagcgtaacttacagagccagcacgttccagcctgggagggaaaccaaaaggcactttgcccaagtgtcacgggctgaaacgacatcctcatgggcccctgtccccggaagcaatgagattggacaggtctgagcccctgttacttcattgggatggacttgcatctaaggaacgaactgagagtgaaatttccaaatttgaggcctaagaaaagtttgttggcctgatgagctgtgacaggcaacctctggggaagtggaagctcagcacatcctccggttacttattacgttactgaagggtctaaaatgactgtccttggggtgctggaatcctgcagaataaaatagtgctgaattttaatcattctttgcaaatgaatgttctcaaggctccggttggagtcaggcaccctgggaccttcagtagtgtgctttgggtcccaggccacagcacagcccctttctttttttttttctttttgagatggagtcttgctctgtcgcccaggctggagtgtagtggcgtgatatcggctcatgcaacctctgcctcccgggttcaagtgattctcccgcctcagcctcccgagtagttgggttacaggcgcccgccaccaagcccaactaatcagctaatttttttttttttttttttttttgagacggagtctaactctgtcgcccaggctggatggagtgcagtggcgcaatctcggtcactgcaagctccgcctcccaggttcacgccattctcctgcctcagcctcccaagtagtgggactacaggtgcccgccaccacgcccggctaattttttgtattttaagtagagatgagtttcaccatgttagccaggatggtctcgatctcctgacctcgtgatccacccacctcgcctcccaaagtgctgggattacaggcatgagccacctcatctggccttttttttctttttttagagacggagtcttgctctgtcgcccaagctggagcatagtggctcaatctcggccactgcaacctctgcctcctgggttctagcaactctcctgcctcagcctcccgagtagcgggattacaggcacatgctgccatgcccagctaattttttgtatttttagtagaaacggggttttaccatgttgcctaggctggtcttgaactcctgacctcgtgatccaccctcctcgcctcccaaagtgctgggattataggtgtgagtcaccgcatccagcccatagtccctttctctctgggagtctctggtggccccttcataatgcttttttttttttttttttaattctggtacattttctatgtaatcatttcaataactgactgtccagtagagtctttagttttttgtatcccttcccaaatttagaaacctgacttgaactttgggccagttgtaatgtgtccctatgacaggccatcctgggcccccttccctttgttcctgtggccggagccctgagcagccccatccacttgagtccaagaggccctctctcctggctgctaccattgtacccacctgtggccaggcccccacaggggcctctttcctcctgacagtctcatccccactcagcagccgagtgccttctttataaatgtagatcagatcctttcactgtatttgttcatccaacacaatttactgagcacctactgtgtgctaggccctggtacgggcacaggaaacacatcagggataaaactacactctctgctctcctggagcttccatgctagtggagagaagaaagatactaaacatgtaatgagtcaggtggtgatgagtacaaaggagaaaagtaaagcagagaaatgagtagaaagtgctggcaatagtgggtggtggtggtggggggtgtggtttgcaattttcacaggggtcctcaggcctgactgaggagctgaagaggtaagagagtgagccacgaggctagtggggtgaaagagttggagcagaaaaggtgggaggatcaccaggcatgatggccccttctgtagtcctaactactagagacaggctcatgcctgtcatcccagcactttgggaggcgaggcaggtggatcatctgaggccaggagttcaagaccagccagaccaacatggtgaaacctgtctctactaaaaatacaaaaataagctgggcgtggtggcacatgcctgtaatcccgctacttgggaggctgaggcaggagaattgcttgagcctgggaggcagaggttgtggtggccaagattgccccactgcactccagcctgggcaacagagtgagatcccatctcaaaacaaacaacaaaagctaactacttgagaggctgaggtgggaggattgcttgagcccaggagttgaggttgcaatgagctacgatcacaccactacactccagcctgggccacagagtgagccctgtctcaaaaaaaaaaaaaaaaaaaagagtcccagcagagaacagcaagcacaaagccctgaggcaggagtgcacctggtgtgtttgagaacccacagagacaccactgtggctgagcagggtgagatgtgggaagggagtggctaaggaagctgagaggtcaaggaagaagtgggttggagcaggccctgcaggtgccgaaggcttttgcttctttcctgagatggcagccccacgagccctggagcttccctggctgccatgagatcaggtggaagggggtcgaggctgcagtggggacgcatgagtgggtgacaggtggcagtagtagaagtgtaagaagagctgggatctgggtctcttctatcttgaaaatagaaccccaggctgtgctggtagagctggatgcaggtggaagaagggaaaatatttttgctgcttaaatcctagcctggcttcccattgctcgggggtgcattctcgattcctcttccccgcctgaggtctgacatgtgctggccctggctgcctctcctgtaccttctaccaccagctccagctcatggcctgatgtggttcctcccccgatccagcgaccaggctgccctctgccccagcgcctcctccgtggatgtctgctcttcctaactgccctcccaccggacggctgctccttggtagcagctcaagtgtccttccttccctagccagtttccccaaacactgcagcacaacgcccttcatttctcatggcattcttcatgcctgtcaatggggcttttgttgttttaattttccgtcttcttgtttttgttggtcttccagaatataaaccccatgagggcagaggcgttcagcctgactccagcctggcaaagctgtacaaatctggaggaacacacacgttcacgggcactcagttctgtgaggtactgcaagcctctctgaacctgcaaggtggccattgctgtccccactttacaaaggaggaaagagtgcgggagaggttctacttagacccgccaagggcacagtcgttctagaaagtagcagactggggttccaacttgggcttgctggttccggagccccttctgtgccccttccaggctgtgcctggtgagattcttctcctaccagcacgtcttcttcctggagggttcagtggctgagctgaaccggtgggcaagaggccctggcgggcttgttgaaggactcaaaggtggcgtctgggagctggcgggactttctccctgtcagcctagaggcacttttagaggagtgtgtctgtttcgagtcttcgtgtctcataattcataactaaggtagagggtacacatttagtttacagtaaacctcaaacccacctccactcccagccggccacttctctccctgttcccttctctgcccccacaggtgagaacaagtgtccggggccgccccgtggggccccaggctgcccgccctgaactgcctcgctgtgtgcccttgggcaaccccgccctgctccgtgcctcagtttccccaccatagaggctccacaggtgacacacctggctccgggccccgatcggccgccgggccccgggggcggaaaccccgcgccaagcctcccggaggcacctccagggcagggcggggagcgcgggaggggccgcggggacctgcgccgctggggccgcctggccgccggccggctccgggggcgcccgcgggagggcgcggccggtgcggggggcgcgggtggcggcggcggggggcggaaagcggcgcggcttccgctcccgcgcgcccagctccctcctccccgtcgtcctggtccgggcgcccgaggggggaggcggaggcgccgggagccgcgcgaggagccgccgccgccgcgcatggagcccgagtgagcgcggcgcgggcccgtccggccgccggacaacatggaggcaggccgcccgggccgccgtggccgctgctgctgctgctgctgctgctgctggcgctgtgcgctgcccggcccccgccgcgggtaggtgggcgcaggccggccgggggccgcgggttgctcgacaatggcccgggcggccccgcggccaagtgcgcgggcgccgccgccgtctcggaagcacttggcgagttgggagcgagttggggcgcgcgcccgggatccccctgccgtccccggctccccgccacgcgcgggccctttgtctccccacccgggccctccccggggacgctgcgtccgggctggcgaggagggcgcccgctccgccaggtgcggcgcgggcgggtcctcacctgccgagcccgcgggaagccgggagccgagccgagcccgcgctgggcccgtgtggcccgggcgggcaccgagcggggacttggggcgcggaggcgggcctggcccggggagccggttcgcagcctgtttccagcggccgcgcggccgccccgcgtgctccgaggacgggctgaagttgcgcgagaaagttctgagcccgggcgcggggcggcctggccggtggcgctgctcctgtgagcgcgtggctgtgggtttccaagcggactgacacctgccaggtgcccgggcgacccgaatccccgtgtggccgccgggtccccagatagtgtccatccccgggtcggctacgcggaggtacgtggtcccagatcgcggggcagtgggggaggcaggcttgtgcctcagttgtacactccgtggggagaggtagggcgggggaactttctctccaacttttggtgtttcccagggggtgagttgaggtcaggaggactcaggaaacttaagcagtcgtgaaacgctacacatgttctttaatttggagattgccatgtggtttttcaagcaagcctcttgctacctaaatcattctttcggatgtgcgtgttttgtttttctggagtatggctggccaagtggcacggccgcaaggcctgtgcacgccgcggctcctgttctgtttgtggcagtttagcggggaggacctcgggccctttgtctgggcctccttaaggcaaacagctgtctccctgaatatttccagtgtgaaggtgcagcggggtggccctgtagtcagatcccccaggctgcagcctctgcttggaggtggggggacagcggggaacaggaggagcttggagtttgtttcacgtcctcctgcctctgaccaagcctagagattctatggacagtttcaccccaaatctgcctctttcaggagcgtgttacattgtggggccttgtctggagctagcaaaacaaggtgaagacaaaacagcgacagtactggggagtacaggccagcgccgctcctttttccggaaatgcctgggtcaaggaggcaaaggggttttggggaaactgtttgttttaaagggggggtttctaggccgaccgcgttgccttcacctcattgcagttttgggttttgtgcacgttttggggtgatgttgctggagtcaatgcctgtcgtccatgtggttcgagcccctgaggagaaagaattatagctgtagagttcattgtgtgtgaggcaaaaatagagttgattattttaacattaggcagcaaggcctgggagcccagtgaatgtggtgatccaggcctaaaatggaaggaaagggaggaatctttctgcagacggttttgatgttatatccctggttttactgtgtgaaatacatgcctcggacctcagcaagccagtaagtgggccgctaattatttttcctgattgcttcctgttgcaattggaagcgtgaacgcacggaaatggctttgttctagtggtcccagtgctgagaacttccccagctccaagccctagtcctctctcctcggggcccaagtgcttgttccagggccggcctgtccagcaccccctctccccctggaggttcctcctgtagatgcccaaggccaaggccgggccctcgggagagcccagaagggctgagtggggttaaccaagtgctgtgtggagcaccctgagaggtcccctccaaagcagggccccgtgtgtttagctcccctcttcagttccaagaaattcgcggtgaacccgatccagcatttgttcagcactttcctggggagattcacctcgtgcttctgtcgtttttggaacccgtttaatttcagccgtgctgtgtcactgctcaggcatttagtgaactcacacacacgggtgggggatgtaggcaggtgaggcctctgagttgctttctccctgcagcgacgggttgcagggctgatgggggtggaggggtttggggtcagacccacctggtttacatgctcagtggctgtttgacttcgggcaccatacctagtttctgttatctcacccgttcctctcccaggctatggggagccctaactgccctgtgtgagacctttagccccatcctggcagagctgcagtgagcgcagttgtgtgtcagcgtcctcgatctttctggccccaccggtctagaggctgttattacaatagtctggatttttcctgtatgaccttggacatccgtccactgacaaactcactcactcaccgctgcagccctcgggggcaggagtagttagttgcactgtggacagagcccctgcgcccagggtctgattccagcctggccgcttcctgtgcgggaggcttaggaagctgatgctacctttgtgtgcctcagttttctcacctgtaaaatggaatagaatccttcctaccatgaattcagtgagttaacgtgcacctggcccggtataatctgttgctgttttgctttggtgtctgctaccgagtgaagtgctagggttgagtgcgataaatggcagataaggccccgcccctgcgggcagagcttcccatgtagaggggaggacaggaaagaagctttgcagctatgcagaggtgggcccacgggtgctccttcaccctcggggtgcctgcgagaggcccttagaggccagatcatgctgtggagtctggttgtgatccacaaggagcggaagcttctggaaggctttaggcaggagttacaggaaatgcaagctaaagccagactttcctaggtgaaaggtgtcgagttgttttttttttaaattgaggtgaaacttatatatataaaatattaaagtatagaaggcaggcatttggtacattcacagtgtttacaacccttcttctatcaagttataagagatttccatcaccccaaaataaaacccatacccattacaggtgacttcccgttccctctccccggatcccctggtgaacaccagtcgactttctgccttgtggttctgcctgttctgggcattttgcatgaagggaatcttacaatgcgtcttcgtgctgacttccttggttactgtaacgttttcaggagtcatccaagtagtaccacgtatggggtttcagccttttattttttttttgaaatggagtcttgctctgttgcccaggttggagtcggtggtgcgatcttggctcactgcaacttctgcctcctgggtttaagtgattctcctgctcaggctcccaagtagcttgcattacaggtgcccgccaccacgcccagctaatttttgatttttagtagagacgggatttcaccatgttggccaggctggtcttgaactcctgacctaagtgagctgccggcctcggcctcccaaagtgctgggattacaggtgtgagccatcacgccggcctatttcagccctttttgtggctgaataatattccattgtgtggagggaccacatatatttgtcagttcatccgctgattggattgatcttggttggttgcatctcccagccgcacgagcaggtctcatgcctcctgcatcctggtggaggtggctggtgggaggatctggctgagactctcctgccgaggttcaggaacgagccaggtgatggggacaagttggggagtcgtgctggcatctcagaggaggggcctgggccctgagaggagtgctgggagggcagagtggggccaagttcaggttacagaagccgtgagacagccggacatctgtggtttgtgaggcttggaaacacttaatgcgctctccaaatggggagtctgttggggaggccctggcgggagcggggctacatccaggtcctcggcttggtggccttgttcacttatttgttcaggaagcagagggtgtgggctctgtgccaggccgccctggagggctgtcctggggccagtgaggtccagtgtgatgggcggaggcagctgtggcttgctacgagccggcctcagggacccaccggctgctccggctgctctctgcattctcttcagctctggagagccgtgtgccagccctcagcccagtttcctcatctgcaaaatcgggacgatggtgtccaccttgcccatgctggtggggtccaagagctggtgtctggggtgagggagctgggggccaaaagctcctgccctggggcatcagctgtcctttgaagagtaccccgagggtgtgactgagagccagtccccagcaccctttccagatggggaccaggaggtgggtgaagatatttggggtctgagctctgtgctggttgccccgagggggcctggagccctgagttaggagcagaacggggtgctggtcctatccgttcctacctgggtagtgggggctgccttcctgggttgggggtggggggagctccctgtgtcctaagccatgcagaggcatgcgcatacgcgctgctcttaggcatgtgggtggcgctctgggtccctgcccattccccagccccatgtggtggtccctgtgctccaggtccagcctctgtttccagtttgtcctagtttgtcaccttgtagggggcagttgacactttgctggcctgatcgtggtgtgccagagcccgtggctgctgggcgactgtgcctctttctctcagtggcaaagccttattttctaatagagcctgatgggccagaggttccgccacagggacactgttcttgtctctcgtgcttggggtctcttgctgtggaccccctgggaggttgtcctgggggtgcgggattgtgttttctgggtattttcttatttgctctattggagtgtatttaatttaataatatattttaaacatcttttagtttgccttaatgtaattttttttgagatttaattttttttttttgagatggagtcttgctctgtcgcccaggctggagtgcagcggtgtgatctcactcactgcaagctccacctcccagggtcacgcctttctcctgcctcagcctcctgagtactggaactacaggcacccgccaccacgcccggctaattttttgcatttttagtagagacgggtttcaccgtgttagccaggatggtctccatctcctgatcctcccgctcggcctcccaggtgctgggattacaggcgtgagccaccacacccggcctgcttttttttttttttttggtcttgctctgttgctgaggctggagtgcagtgattcagtcaccgcttactgcagcctcacctcctgggctgaagcaatcctctcacctcagcccgcaagtagttgggacctcaggtggcaccaccacgcccagctgattttgttgttttttgtagagacagggtttcactatgttgccaggctggtcttgaactcctgggctcaagcgatccacccacctcagcctcccaaagtgtgggattacagacatgagccactgcgctgggccttaatgtagtttttcttgtggttaaatgaggtgaaggttcactcaaggaggaaagtggtttttagccttttgaggggctcaaggacccttcaaggatatgacaacggctcctctcctgagaaggtgcctggtgggggcggcacagctccactccaccccattgcaagaatccagggccctgcagggctcagagccctctccctcctccctgtggggcattgagaggcactcaccttctgagggcctcagtttcctttttttgaaaatagaaccagctgattccaatctctatggtctcttctagcacggagcttcacgtttttctcccttcaggatcctgaggcctctggatcgctagagattgggggtgcccccagaagggcgctgcttctgtgccctccctcaccccaccgtgcctggctccttgtttttttttttttttttttttgagacaggagtctcactcacgcccaggatggagtgcggtggcacgatctcgctcactgtaacttctgccaccctggttcaagcgattcttgtgcctcagtagctgggacacaggcatctgccaccatgcccagctaatttttgtatttttagtagagacagggttttgcacgttggccaggctggtctcgaactcctgacctcaagtgatctgcctgcctcggcctccaaagtgctgggattacaggcgtgagccaccatgcccagcctgcctggctgattttttaaatttgtcgttgagatgggtgtcttgctttgctgcccaggctggccttgaactcctgggtcaagcgatcctcccacctcagcctcccaaagtgttgggattacaggcatgagccgctggcccagcctattttattattattattatttaattttattttttctcactattgcccagccctggcctccaactcctgggctcaaaggatcttcctgcctcagcctcctgagtagctggactgcaggcatgtgccatcacaccctactttgtacttttgcttttctgtctttgctcttttaaaagccaagtgccatttcatagtacacaggtgcacttgacagcatttacctgattgggagtttttccagccttcattgctattacaaagcatgcttgctcgtgtgtctctgcatggtataagtgtttttataggatacattcctagtcaaagagtgtgtccatttctgtttttaagatattgaggccgggcacagtggctcatccaggtaatcccagcactttgggaggttgagcaggaggatcacttgagtccaggagttcgagaccagcctgggcaaaattgggagacccccatgtctacaaaaaatttaaaaaattagctgagtatgattgcacactcctgtagtctcgctacttgaaaggctgaggtgggaaaatctattgagctcaggaggtcaaggctgcagtagccatgatcacagcactgcaacagatctagcctgggcaacagagcgagaccctgtctcaatacatacatacaagcatacatacatacataactcctaaaaggctgtagcagttcatactgcaagcatctacgagaacacacactttcctatatcctctctgatgctggcaattacaaattttggtttttggtgttttctttggtccagtttggttaaaaattataacaccttttgattgcacaaccctcatttctggtttattggtatttacttttctgcaaattgcctacactttccttggcccatttttctgttgtctttttcttttcttttttcttcttcttctttttttttttttttgagacagagtctcgctgtgtcctccaggctggagtgcagtggcgcgattgcctcttggttcactgcaacctctgcctcccgggttccagctgttctcctggctcagcctccaagtagctgggactacaggcatgcgccaccacgcctggctaatttttgtatttttggtaagacagggtttcaccatgttggccaggctggtctcgaactcctgacctcaagtgacctaccatctccgcctcccaaagtgctgggattacagacataagccacggtgccagcctgttttctttttcttatagatttgtgggaggtctttatttggtatggactttaattctttgttcgtttgtttcaggtttcactgctggtctgtagctagtccttcatccttgtttctggtggtcattatcataaagatattaagaagcttcatataatcataactctactttttccctatggttttttcctatcccttgttactccatctccagattataaatatatcctccattattttctccaggactgttactgttttatgttttacattcagacattattctgtctgggtttttttttttttttttttttgtatatggtatgaggtaggggtctggccagtgaatagggagttgtcaacaccttggtgggatggtccatcctatccattcattgtaaatgctgctcttttatgttagtgtccacagacacctgggtcctgattccagacccttcactgtgctccactgcctgtagtgtctttgtgtaccggaatgctgctgtctccatctctgaagcatcagaacatattttagatcagttatgtaaattcccacctcattgtccttttcaaaagacgtattggctctgctgcacgtttatgcttttgtggtgaacttcagagccgtcctatcaggttccaccctttgattcttgatctggggacggtaaatggtgatatccagcaggtgtcagagggctggattttaatggcctccgatgagctggcggtctcaggctgtggaagtgaattcatctgctgggtgcagggagccggccttgacatttgtgggttttgctgacatttgtggaaggctctggaggtgcctttgtgccgacttgcccgagccactcctgctgcccaactcactccggtgtctgctcaggaagaaattctaatgcacactaattttagcattagcccgatggcaaatataattactgagtaattatcactcccctccctagttaatcccagagcaaaatgtgggcacctttcatttctccttgggatgtacccctgtattagttcagatggggaggcggtacctgcctggcaaagcttcaggaaattgctcaacggggcattaatagctatctgagcgtgtggcctgggctggaaccaccagcctgggtgctgggtgccttccaggctctggccaccttgggttctgccccaggaggagcagactgtctcctctaggggacctgaagcttaacgtcctcactgtacgagatagtttggagcaagatatgttctggggcttgcttctgcgggtaaaggccatttctccaaacttcccccagagcgaacttgcttcccaaaaggagtctggatccgggcgtggccgtgctgcccggccgcctcctcacttcagctggagcctccgagctgacgtccatgcctattcctcctgacactgtagacacaggccccagctctgtcccctgccctctcctccactcagactccctggctctgaggctttacctacaggccctgcggtgcatattcagtgaaagcctagattcagagcaatgacatcagcttttacttggtctccttgctttctggaacctcccctttgcccattttcttatgctctggccagattaatttttctccaagtagttttcatcacatccttcccttttcagacagtcgtgcccattctccagcatctgaagttggaactttttggcctggcaggcctgccgccctgagcagacctgcccatcttctgcccctggtgtgggcacttctcttgccagtctgtctggaaccttccatggtccacccaacctgggagggccttgaggacaggggctgtttcgtctgcgcccctctgcctctagtgtgatgtctggtagatgatcagtaactgttctgggccaaggcctcatctgtccagggagcagatcttacccatcttttacctcctctggctcaattctgctggagcatgagctccctctagcctaggttgtagaacacctgtctggctatggacagcttctgggccaagtgtgaggacccccatggtcctgcagtaagagcccatatttcggggtgtgggaaacccagtgtaccccaaagggacttgactgtgaagtcccgggtccacgggtacccaccagcctcctagggcccagactccgtgagatgccacggtgggggcttgggctttgcagccttcacttggcattcttaccattttcaggaaactttatataaacatttttatcatgcaaaaaaggaattatggaataataaatgtttatattaaaaagtcttggtggtttgattgatttatttattttttgagatggagtctcgttctgtctcccaggcttgagtgcagagcacagtcttggctcactgcaacctctgcctcctgggttcaagcagttctcctgcctcgcttcctgagtagctgggattacaggcacccgccaccacgcctgggtaatttttgtattttagtggagatggagtttcaccatgttggctgggctggtctcgaacttctgactcaggtatccacttgcctcagcctccctgagtgctgggattacaggtgtgagccaccaagcctggttggtgctttttaaatttattttgagatagagtctgactctgttacccaggctggagtgagtggtgccatcacagcctactgcagcctctacctcccctgggttcatgtggttctccccctcagcctcctgagtagctgggactacaggcacacaccaccaggcccaggtaatttttaaaacactttttttgtagaaatggggtccctccatgttgcccaggttcatttggaactctgggcttaagtgatcctcttgcctcagcttcccaaagtactgggattataggcgtgagcaccgcgcctggctactttggtacttttgagttaaaactatagagtaggtgactgagtgaatttttaatgcgttctcaagaatttgaacacgaagagagtgtcaccctcccaggttatgccccgggagttcatgcacttgccacctggtcgctgctcagggggcccagggagtttgctcagtgccggaggactcctgggtcccggctgtgcctccccgcagccgcctgctcccttggacactcattcatttgctgtggccactgccgcccacagtccttgcctcgtagactccactcagctctggttacaaagagcgagtggtcagggactcctgacctgccatgcagggccccggggcttgtggtggctttggtgccgtccgctgcgtctgcctcttagagcatggagttctcttctcaggagggctgagctgctggagctctagtcctgccgcagagcagcccccaagtgcgcgttgcctgtccctgtggagcaggtgactacctggctgcgggcggaacagcaggccatgctctggtagtggtctgtgacagcatatcaccctgtgggacagatccccgggacctagtgggtgggatagtgagagctgcgtccacaggggaggctcagagacttgtgtgcccagtgtgccctgtgtgctgacccagctgggctctgccctgtgtggcccccagggtgcccggcgtggccctgatggcctggggcagagctccagagagccacggctggccgagggctcacggatttcacccgcccccagtgcctcaggagacacctgggcagcgaacagcttgaggtgtgcagagatgggtcacgatgggagggaggcacaaggggtgctttccatctctttggccaccagtttaattaaaaaaaaatttccatctgttttgaaaggttttatcctcttaaggaaatgacgttattaagcaacagccccttctgctcatcgtccagctgtgcccactggcagagcagaggcggtgggattccgcctgctccacaccaggaggtgccacttggcttcccagtgtcgaaggcttcttggactcagcacaccttcacggccccgtgggctgtgggtccctgggttgggcatgctgacttggagggtgatgagagatctccaggatccaggcaggtctggcacgccactggggctaggcgctgggctctgggcggcctccttgctgtgcttttctctgagggttgagggagcctgctcagagaccaccaggtgagctctgggggtccctctgggctcctgtgccctgcacgcccggttctgaccacagacctcctccatcagggtggactatagcccagagcgggatacaccacgcccatcaccccccacccctggagcccctgaccaaggcccttctgggtacttaacagtgatctgatctcaccacagtcagggattagggcctctcccggagggctggggtccatggtatgatgtgtttcaggtgagaaacaggttcagggatgtccccagcctcactggctgtgttggcagagcaggatgaaaggcagacgggaatgcagaattgggatcttgccctgaccctgtgatccgtgaggcccttgagctagagggatgcactcagtcgaagtgcccgcctcttctttgtgttagtgtgaagaggaggggtgggccctgttctattcttggctgcccacagcactaaggccagcttggtcaccaaggcatgctggaaggtcaccacaggtggcacaggtggctggggtgtgctgggcagcaaccattatgcagcagtggcctccaagcagaagctgctgttcggacacccgaggtattcccagcctccttcccctaccccgaggtttgctggagtcactggggggcagtagcgagctgcaggtgcagggtcggggtcctgggggttgcgtgtatgcgcacctccagagaagcccatgcaggcccccctcacccgttcctgcctgacctgctgttgtgtctgctcctagctctgcggtctgggacaagcacgttaactgcttcagagctcagtttcccatccgtgatagggaatgatctttatgctcccacaggctcgtcctgaggctgcagagaggagcgttgaaaagtacctagctcagggcctggctcagtgacggttagctgttagggttacatcgcatcgcaattgttactccatagtgacgaccccccggggactctggacttgttcagtcagctgagaggctgcttggccgaaaccatctcagctctgcatagtgtggcctggtggctgtgggttgcgctcatgacaacgtggagcctattcagtcggtaccgagtgtgcgtccttcctagctggcctcggcatttattttgtagctggagccctggtgggatggggtcaggtggctctaggagtctgggggacaggtgcaggtaccttcgggtgcgcctcccctgggggcctcgctttgtcagaagtatggcagggggctgagggctgactatctatttgtaggtgtcaccaagcagtccccgcctctccttttcagaggacattgttgaggggaccctgccatctgcgtcgggctggctgcttcctctgtggggggctcctcccggctgaccagcagccctttctggcccctgcatcagcgcctccccactcagcttcactgctgaaggcagggccagcctgggcaccggttcttccccctctgcccaaggtccctgcccacccgtcttccctcgccctggccgtgaggtcagtgcctttgccccgctctgacgaccaggccctgtgcgcagttggcgctccgtggtgctgagagatgtgctctccagtctgtgggccagatggggcctctgaagtggagggggccaccctctctcctgcagcctgctgtggctccccatcgcctctgggatgagagcagacccgcgaagccttgagctcctggccctccagctgtgagcccaggtgggaccacccagttacagagcgttaggcctggctgtgtaggagacgtgtgtctccacaccagagtccttgcggcactgggaagccttcatggtcctcatggtggggaggggtccccggggaggcatggagtctcgtcctaggttgctgtgtggcttcagcgctctgtacctccatgcccctgtcctgcagatgtaacacccagttgaggagaacgtggactttgcccagtgttgtgcagggatggtggggccagctggagcccacgtgtcctgccttcgccctggccaaggtgggggttatctgccctggccagctgtgccgcccgtccctgcccgccccagcaggtgggggcctgcggtgggatcccaccatgagcagtagaggcttgttgacttactggcctcccaggctccccctccaaagccaagtctccaggacggttcttgcccctgagaaggggcagtgtgggtgctgggctgcagcgagccctcttcgttccatttcctcacagtcttggggacggagggcttgtcctggagcacaggacgggattgtgctgaggtcctgggaggccacggtcatgaggggacccagtgaaggccaggagggacaagcatccctccaggtatggggagggtcaccccagcgcctctgcggatctgaccactggctgcggctcctgtgcttgacccttttggcaaagatatgcagtggtctttcagttcccccccttaggcagcatgaaaacaatttaactcttgcagaaagaacctgggaattgattcccctgtcactgatcccacaagtgtgactttgcattggtttcttggtccccttgtgccagtctccccatctgtaaaatggggtgacagtagttccacctcctatgaggactgagtgagtcaggaaccagaagcagctcccacatgagactcagaaagtgtgacaggcgtggagggtgggacccatgaagctaggcccggcaccttaggaagaagagggagctttcctgcaggtttccccggacggaatgtgtttcgtcctgtgcacctgcctgcagagcccctcgcacgctgtcgtccacaatgaatgcttggtggaagagttcacccagggcctgcaacaccatagtgctcacttctccaaattcttcttaacttccagactcgacacgtaaacttgattccaaggaaatcaagctgatcgtcaacactggactttgcaggcagctcccaaacccacatgcatatttacactaagaaatgccagttcctcaaagaatgttagcctctgagatgcatcaggagaccaggagcaaggggttaaaggcaaaccgtggcattccccaaatctgtccagttccctggcatggtcagtgtcgcggagcccgaggtggcatcttttgtttggctgctgatggcggccttcgggcttggcatccacgttgctgcaattttccaggaacagtaatcatttgaaagtagagctgcccgttttgctcaataaagggattttgtagagcgatgataaatttggcatgtctttattatattattttttcaacacttaaagaaaataaaagctggtacaaaggtatgtttgtttctgaatgtgtttccttccccagatgttcttttctgccagttctaaaatgcgttctgagctcggcctccagtttcctccctgtgaggaagaacaatgagacctttgtaaccacacaggggaaaggccgcttccctctgcagtgggcatgggggaggggctgggacgtcccacctcctcccactcgatggaaaccacgagtctgtgccagcccagccgactgtcggggggtttggcagcctctttcccatggtggtaatttgcagggtcatggctcaggggcaccgcagtctgcacctccgccctggatccgtgcgtttgctgtgtggcctcgcagtaaatgcttccatctgcgtggcattatggaccctggggcttggtactgtctgtgttatctggagtcgaacttgcccttttcctttctgtctgcctttcttgcatcaaatgctggtccccacccaaagggtagcccagtctgcggacacggcgcagaggtagagttggtggcttcacgagggtccagtggggcacagaccttctcggctgctctgtcgctttgtgacttgagactgcgtgggtggggtacctgagggatcctgagcccgcccttcccacacgtgtgcatgcacacacacatgtgcacagtgcttcagaagaccaccttagttggatttgaaggacagccaagagacctgtataaagcttgtagttagagcgtttcgatactggcctgaattaagagcagtctccatggggttgctgtctgtggggtactgtttaatgaaaatccttgtttttaaataaatgtatcctgctttagaacacccaagataaaaatctagacttcatagacaaaaatagctaacatttgttgtgtatcacagtgtgccagtgggctctaagagatgtttgatttctttaatccttccagctgccctgtgggctgggggcatccctaccctcattttacagacgaagaaactgaggctgggagaggtcaattaacttgccaaatttggtataggcaaaactaggaattggcagacggtggttccagtgcctgccttttattggtacttgaattatacgagtgttttcttccatcaataaaagaaatcggcgaacagctcccatgggtttcagtaagtgcaagccctccttgtcatcccagacctcagcctgcccattaatggatgaagacactgaggcctggagggaacagtgacttcggagccactctcctggatctgccactcctctcgcctcccatatgaacctgagtggccacatgaccctgggggagagtactcaactgtcccaaggagagggtgatgactgctggcctcccaccggccatcagcgcccactgactgacacccctgagtcagtctccaccctggaactgtttctctcactatttgcctggccttgggccgcttccgggggcttggcaaggcaggaggcgtggaaccaagatggtattaatcagaatgctatattttgttgaaaataagaatgttagtaatgggctggtttctggcggtcaaactgggactctgaaatacatatttttctctgctctgccctaaaccttctaattgtgaaaacgcacatttgcagacatcaatcaaatgtcatattccctagcagcttgtcctggatcactgagctggtcacattccacagttgctaactcagggcttgcagagtatgtgtgccgtgtgtgtgcatgcgtgtgtttgtgagagagatacatgccttctggggagccctggtgcctgtttccttccctcccaggcccctgagcttctgctccccaccccgcccccagcccctgtcagcacatgcgcggccactgcaatgagatacagacgttcgcccaattaaaacacagtagtggaggacacatggctttcagggaaaactgctttctctcaggaagatctctgctgtgagtattccatagctagaccccagctccactcaacagtggactccattaatagcctgggtttggaagaggcgatttgcttctggtaactggctccggtgcatggatgttccctcctcttctggaatctctgcccgacccagacagtgcttgtgaaccagccctggtgggctccatgggttctgggtctgggaggcaaggacttgcctggggtcattctcattctgcacggcactagcatgctggctgcatgaagccgtatcacagagacctgtgggtcctttacatctgatcatccgtcatttgtatctgtatctggggtggttagttgcaaacaattccacagtagccaaatcagaaagtcactggctctcgcaggagcgcgattggtgtggggcgagcctgggggtgtagccaggcaagcccttcaccctgatgcgcattagccttcttatccaggaaatggggggaggcgtctgggcccagggaggggagcatgccaagctggggatctccaccggtccaggattcaggcgcctctgaccgttctctgcccagtgcctcctgttcagttttacttttgtgttttccattcacttctgcctctaggccagtgtttttcaaaatatgtttcctgagtggaaatgaaaaatgttctgtgatcaggcgcagttgggaaatcctaggggagagaaagtgaactaggcttcccaccgcaggacttctcagagcctttaaaatggtaattatgctccaggccttgtgccccttacctaggcatcctttactggttgggaagagacggcaggttacgggtgagtccgggtaatggagttgtgcctaagctgataacctgacgtcaccaacactgttctgtcaccttgctttgtgtggcttcttcacagttgtcacatctgggccgtttggagtgacctagcaagtcctttcttgtctcccaggactttccggagtagccaagcagagccttcggccagttcccttgtgggccaggccctgcccgggagcacaggcaggagaacagctgcctccccgcctgccccagggcttggtgtcagggccatagcccccagctctgcggtggagcagcagggacctgcctggccatctccctgttgagggaagacccggaggcgcctgtcctgttctgtgtgctccgaggtgttgaaaccagctacctcattttctttttatcttttgcaagtgatttcttatttcctgctcacccccaaacgtgccccctgtatgtttcctgttcgcctgcttccctgacctttgaaatgggtccctgctcgggaaacttgcctggacctcagtcaattatggttttcctctgggctgttgtgtgtgtgtgtgtgtgtgtgtttgagtgtgcaagtgtgtgcattaggattagagagattcgatggggggccaggggccaacaggaatgggggtggctgagctgagaggccaagggcggttccaggttgcattgagagccgaagctggtgagtgtgaggcgggcagatgtgaggtggtgtggggagtggggtgctgtctgggtgactgggctgggagagggcaggtgggggccaactggaagaggtggtgttattctgtagcacctgatgtacacagaccttgggggtgcagctcaggctttctctctccccacccgcccctgaaggccccactctcccgccttctgcagccaccttccttttgtctgcccctgagctcctccgctcttgtggtcgttaagaaaagcttttttaatccaagttggtttgggaagaggcaaactgtcctttcccaacagtcatatgccaacctggccacatctattctggatttgaagcaaaatatggtatttattcattattgtcatgcaatgtcagcagctcgctcattcttgatggagacagcacctggaatgggagggatgggtcccggccagcattggaggtgctcggccccagcacccgggccttgctctgcaggcagccctgtctgcaccgggccctgctctgcaccaggttccactgggtggcatcagccatgcctgcccgaggaggtgaagtgcgggctctctccagtgaaggtgcagaggcagggtgagctggcgggttacggaggacgtgggcttcacctgggtccaggaggccaggtcacattcagccaagtatcatcagctgggtgtagagaccagggagggtttttaggggtgggaatggctggaggcatgaggtggtcagggtggagtctacgggagacttggtctactctggtgcggtgggattcatgagagagagcccttgtgggctgaggccaggctgtggggtagatgggagagacctcctggctagcaggtccttgggtggatggatggacggatggagggatgttgggggaattggtgggaatagatggttcagccaaggtggaaatgggggagtagagctattcctggggtgcttgaagtgtcagcaagtatcccactccagcttgagtttgcagagctttctctaaaaggcagaacagtgcttggttaaaggaaacccaagattttattattgttgtaaatgtcaagtccctcatttgaatctttagacaactgcagaattgtgtcactgacttgggtaaaagcccaaggaaaaaatgaaattatgttgccaaaattgcggtcatcgtagctgcatgagggtttgagtggccacgccaccccagtaggagagacgcgtagatgttgaatacactgtgagctgcgtgcaggtaatgaaacgtggatgtggggaaggtccctggcttcatggaactgtctacataaaagcgagctgggtgtttcctgtttcttctaccttaagaaatttccacgagaagctaaggtatggtttgccaagaatgttgttaatggcccagcaatgaatattttcagccacttgtagacacctgacttcattcttggcaaacaggtgtatgattcttggacttggagagactgaactttgctgtctcagaatggaggagaccagctcacttgtactttgatttctccctggtccctgtcatttagcctgatcagtgctttttcaagcatttccccttgaaggggagataggactttctggctagggatggggaggcttccaggcagccttaaacattgtccctgccccaccctaagtatcttgaagtttcatgttttatcataaagtctgtgagaatgttgcagactccgttatagtcatctagttttatttttttaaatgtggtttgaattttatataaagtatatggattatatctggaactaatatgcaaggcctgtatgcaaaacataatacaactttacagaaggacattggaaggactgcagtagatgttcacggataggaagacaggagatggagatggcagttgcccccgattgatcagtggattcagtgcaggggccggcagtgcgctctcctccctgttctttcctccaccccattgcacaaatgttggtgcctggcatttaaagaagcagaccaggcgcggtggtcacacctgtaatcccagcactttgagaggccaaggtggatcacttgaggtcaggagttgagaccagcctggccaacatggtgaaaccccatctctactaaaaatacaaaaattagctggcgtggtggtgggcacctgtaatcccagctatttgagaagctgaggcaggagaatcactgaacccaggaggcggacgttgcagtgagcctggatcgtgccactgcactccagcctggcaacagagtaagactccatctcaaacaaataaataagaaataaagaagcagcatgtcgaggtggtgctatgtagaggtgtcgggggtgattggcatccagcatccggaagcaaggtgggtagggtgcagaggtgactgacagcagaggctactggagcagatgggaagctggttatgagctaataagtaaattgattgagcaaataagtaaacatatggatagtaacacaagccagctttgcactttggagaaggtgcttacaaacttggacgagacagtacccagacacatagcgaaactgtaggtactgccacgcacacatgcacagaaatagagaaatagtcatagatgcagtgtgtataaaagtgtatgtaggctaggcacggcagctcatgcctgtaattccagcacttgggaggctgaggtgggtggatcacttgaggttaggagtttgagaccagcgtggccaattggcgaaactccgtctctactaaaaatacagaaattagccggttgtgggggcacacctgaatcccagctacttgggaggctgagaatcacttgaacctgggaggcggaggttgcagtggtcgagatcacgccattttactccagcctgggtgacagagtgagactctgtctcaaaaataaaataaaataaaataaaagtgtgagtatacatacacacgtacagttggttcttgttatcttgaaagttatgctccataaagtcactgggaaccctgaattattgaatactgaaccatgctcctaggggaaacatcgggctaggttcctgtgagcctcaggtcacaacgtttttgcaactgttcgatacctgacctggcttttttttttttttttttaagacagcgtcttgctgttcaccccaggctggaatgcagtggtacaatcatgggtcactgcagccttgacctcctggctcaggccattttcctgcctcagcctctccagtagctgggactataggcatgcaccacccacctgtctgatttaaaaaaatatacagatgaggtcttgccatgttgcccaggctagtccaaacttctggcctcaagtgaacctcccaccttggcctcccaaagtgttgggattacagcatgagccaccgcactcagcccataaccttgtcttatgtgtgtttctaagacaccttattaggctgagtgcagtagctcacgcctgtaatcccaacagtttgggaggctgaggtgggagatcacttgagcccaggaggttgaggcggcagtgagccaaggtcacaccactggactctaagcctgggtgacagagtgagaccctgtctctaaaaagcaccttatttactgtatattgtgattcattaacattgaattcatggccaactacgctataactcatacctgaataaagccctcatgcatattctctctgtaaggcgtggggcagcctcatgcacctaggagcactacacgcagcatatgtgcaggggacattttatacagcaaaattgcccacaaaaagcacagtgattggaaagcatggcactagctagaccgagagaaggacacttgcttacatctcgacagccgagcaagaagatggggcgttgtggcctcagttgacctcagtttggaacgtgtgatggtgatcagttttttcacactctgcaagtcagtgagtgattgcagaagtgctgtgaggtttaattgggggatataaataaatgttagcaagtaggcgagctcaagtacggaatctgggaagaggaagactgtacgtgtatatcctacctccatcagcagagaggcctagaagcaatgaccccagtagcagtgagcacaccagagcccaggtctgggtttctgaataccattctccacccaaggagtcagagcttgtccacgaagaagctggttctagggctggggcaaggaaaggtacaaccgagcatggggcatcttattgtgtaagaaagcaaagaagttctggaggactggtggggcctctgggacagaagagccagcttagaggggtgctcactgtccaaatctaggaatatttaacgtcaaaatgttgtgtacatgccttagcgaccaacccacatttaaaacaaattcctgatgagggctgtaactgtagtcccaagtcattcttttttgtagctcataatagcccataaattactataccatatgtttgcatttacctatttttattttattttatttttttgagacaagttttgcttttgtcacccaggctggagtgcaatggtacaatctcagctcatggcaaccctgcctcccggtttcaagctattttcctgcctcagcctcctgagaagctgggattacagcatgcaccaccacatctggctaatttttgtatttttaatagagacagagtttcaccgtgtggcgagactggtctcgaacccctgacctcaggtgatctgcctgccttggcctcccaaatgctgagattacagtcgtgagccaccgtgcccggcctgcatttacctgtttttaattgtgtaaaatacatataacacttatcgtcgtaaccatttgtaagtgtgaagttcagtggcataagaacattcatgttgctggtaaccactgccaccatccatctcccaccacaatttaataatcattgaaaacagactttcttgaccacaaacaatggtgcagcagaagcatcatagatcctgtctgtcctgctggctgagctgtggcatccttccttttttatattgtaaaaactgtaataaaatgccataaaaacgccagcgttgatctttgtggaacttgcggagctgactgtagatgtgttgggggtataacaggaccagggcagcccaggtgtttctgaaggagacgaatcggagggactcgctccgccaggcatcagggcagattgcaaagccttgtttttgcacatcatccgatgcggggtggacagttagaccaagaggagcccggaagcagacccaggctttggcacaggagctttggcatctggcagaactcctgtccctggggttggggtgtgaggaggtgtgagggtagtagcgtgaataactgctttgaggagctgaagctagaaggtgcccagagctgtttaggtgtcagagaagttgtttgtgaggcattgtgagtagaattaagtaacttgagtgctaattgcctctggggatcaggcctgggcatgctcaacattcaccaagtcatgtttgttttcaatgctccagctcttcctcctccaggaagcctgcccagtctacccacagccaggtctcccacagtcagcccttcctcttcttagaagcctgcccactctaaccgcagccagatcttctctgtctaggaagcctgcctggttcacccacagccgtgtcttcttcctctaggaagccgcctggtccacccatagtcaggtctacctcctccaagaagcctgcctgatccacccacaccagatcttcctcctccaagaagcctgcctggtccaccaacagccaggtgtacccatagcagctcttcctcctctcggaaacctgccaactccacccacagccagatcttccccatctgaaagcctgcctaccccacctacagccaggtcttcttcctccaggaagcctgcctgggcacctgcagtcagcttatccatccccaggctccaggcattacctgtccatgcattcatccaccttttcttcttgggtggttttgtgtgtgcgtgtgtgtgtgtatgtgtgtatatcctgccaactaacctgcaggctccttgactctggagccctgatgtcttctgtttctctgtctctccatcatgctggcactggacgcaggatcattcctgactgattaatctctagcttgtgtcaggctgcagcttgctccgatgagcagttggaggcctagtgtaatgcttggtgaatataataaggcatggactgaaaatgttgcttattttggtatagtagcaaaggattgggttacctgaattgagtcttgtttggtgtaaccatgtaaataaacagtgtaaaatataggctattgaatggaagcccagacatctgttatgaattctatatataaatattggatatgcttacatggttaaaatgagattgttggcacttgggttttcaaactcctgattctgctccgggtaggatgatcacgggtcctgggactcaaggcaggaggggccacgagctggcctttctctgacacgacttgccagaagtgggcgttcctgggagtggcagacatgcacccactagagatagatcgaatcaccccctcacattctcctaatagtgccaagaacccacagcagagtgcggggtgtctgagtttgtgctgagcaggggtgcctgaatcccggattgaagaaagtgttctacgcccattaaaccaactgggaatccaggcaaaagaagacgttcccaggggaagccagcctgcccgtgtgcatggtgccttttaaacaaattatctgcattcccattgggatgaagttcacttgcaacattactcattggtttttttgcttttgtttagttttttttttttttttttttttttgagacagaatctcactctgtcacccaggctggagtataatggtgcaatgtcggctcactcaacctccgcttcctgggttcaagcgattctcctgcctcagcctcccgagtagctgggatacaggcatgtgccaccacacctggctaatttctgtatttttagtagagatggggtttcccgtgttgcccaggctgctctcaaactcctgacctcagatgatctgcctgccttggcttccaaagtgttggcattacaggtgtaagacaccgcgtcgggccttttttgtttttgttttttgagacagagtctccttctgtcacacaggctggagcgcagtggcacaatctcagctcacgcaacctccacctcccgggttcaagtggttctcctgcctcagtatcccaagtagagctggattacagggacccacccgccaccacacctggctaattttttcttttttttccgaaacgaattttggtctgtcgcccaggctggagtgcagtggtgcaatctcagctcactgcaaccctgtttcccaggttcaagggattctcttgcctcagcctccggagtagctggtattacagcgccctccaccatgcccagctaatttgtgtatttttagtagagatggggtttcaccgtgtggccaggctggtctcgaactccttacctcgtgatccgcccgcctcagcctcccaaagtctgggattacaggcgtgagccaccatacctggccataatattcgtttttatgcatcattctttttatggcccctctcacctccgtcaggtggtgaatagactacgtttcatttatccgtcatcggttatggacatttgagctgtttccatgttttggctttgtgaacactgctgttacatgcgtgtacctgtatgtgtacatacatgagtagaggggttcagttcttttgggtataatgtaggagtggaattactggtcataggatcattctatgtgtaactttttgaggcactacaggctgttttccacagcagccagaggtgtctttaaaagcagttgtcaactgggcttggggctcacacctgtaatcccagcactttgggatgccaaggcgggcggatcacctgaggtcggagttcgagaccagcctgaccaacatggcaaaaccccgtctctactaaaaatacaaaatagctgggcgtggtggcgtgtgcctgtaatcccagctactcaggagactgaggtgggagatcgcttgaaactgggaggccgaggttgcagtgagctgagattgcgccatcatactccacctgggcaactagagtgaaactccgtctcaaaataaaaataaaaataaaaataaaaggatgatcacttcctgtttcatgaatgaggaaactgaggctctgggagatgggaaatcctgccggaatctcacagctggaggccaggccgggctttgaatccaggcaactgagtctgagtgatggtgtgtgctttgtgttggagctggcccagggctggatgaaggcaacatttaattaagaaaaccactaccccctcccggctgttacctcttgagcgcttttctatgaagcatcctgttaagcctcgcactctgtgatgtggaggtgcagtaattatccccatttcacagacaggagttgaggtcagaggggttgagtgattgtcatgggccaggtctcagccaggcttgctaacctggagtctgccgtctgctctgaagtggtcactctcagctggagagctgacctggccctttgcctttgtgatgtacggtcctgaaaaaaatatttgcagaaatagcttcataggaacaatatggaatttggaattaaaaaatatattaaaaactatatatttaccagtattacaataattacccagagacttgtctccctaatgaggccacctttactttttcaatctttgtctccctggtgctttctcataactgccattcattctagtagaaatcatggttcacggttatgctggtgtgtggtttttggtgttgacatgtcgaacgttttgttgttaccgcagtcattttgtactagttaattggtgctacctttccacggagacaatagtctagttacccctgccgctgggattgttcttttttttttttttttttttttttttttttttgctattacaaataaggcctagcaaatattgtgactcagacgttttccttctttctggtgtttcttgggacagactcctcaggggtgatccctggggagagggcgtaattattttatgttcatgatgcggcagtcaccccgtgtttctgaaaggtttgttctgcactctgggctgccagttgacattcggtttttcaggtgatctggtgggtcctggggtgtgatggtggccgggcccagctgcttcagccctcagctgtccatcccccacccacacccagaactgaggctccaaggtgcagcctcaggtgtctgcaccctgtgcatccctcatcgccccaggtctgttgccctcccttctcctccttctcaaatacgctgcccagaggtcaggctagaggtcagcaggtccatcactggatggaatgacctgggcaggccaaggtatctgggggctgtgtagctgtgacccctgagcttcagggggctgtgaacgagagaccttgggcacatgggcacatgacgtggtgggaaggcgcccagaggaccagacccgccatgctacccccacactctgctccagtgtgctcccaccccaggacctttgcccggcctgccggctccttctttcccagcaaggcctgctctgtctcaggtagcatgcagcccccgacccacttctcatgtagcatgcagccccccgacccacttcaccctgcaccatttcctgatctgcagcgtttatgatgtaacattactaaggtgtccttattggctatgtgtattgttgtttattaccacccacgtgaatacggagccattcaggccgtgtcctgggtgtctggggggccagctggtgctgggcactcgcctgctggaggagtgagtgcccatggccagcccctctggtgcctgggctgcgtctcctccttagtgtgctgcctctacaggcttttctcctgaatgtcctctttgcttttttttttttttttaagctttaaaagaagtttttgtagagatgcgtcttgctgtgttgcccaggctggtcttgaactcctggcctgagatgatcctctctcctcgaaagtgctgggattataggtgtgagctacggagccggcccttcccttctactctgctatctgctgttctctctccctcccgtcgggttctgctcctgccacgttctcccctctccccccaaaggctgggttttctttgtcagggctcctttcccctttggagaagagggggctgtaggccttggtgcgaggccctccagtgacaggatcccccatcacccagagttccacaggcctggtagggaggagggggagcagaagaggaggtgccatctttgcctgctggggaagggcagggccacccacacagagctctcccatttgctgtggaccctggggccactgccagttcctccaaaggaaagccagctccccaggtggtgggagagtgatgtggcttcctcttaaacttagaattgagtgtgtggttgcttctaagtgccttagaagccggagcggctcctggaaagagctgcctgccacagcgggccttaccctggctgtgcccacagatgtccctggggcctgccgtcctgcccggctctcctggcctcccccggtgtgggttgggaaaagcacagcaaattaaaaacacctccatctctggcctttgaagaatgcatctgaacagccgagagtgtaaaccgtgtgaaatgtggtctttccagtttggggagaagcagggcagagctggggcttttgtacccaggtttccaagagctcctgcctccctcggctgggctggccagggccccccgctgggacctcagctgtaatagggaaggttttactgggttgctggccactgtggactgcccctaagggcggtatgcctgcctttacccgggttcccctcctgcctggaagatacagcccatgggaggctgttgtctgtgggatcctccagcatcagagacactggggccagcgtctgcctggtgagggcaggcctggcaggcccggtcccccacctgcttgagcacccacggtggtgggggctcgcgcctcccgagacaatctatgtcattgttgtccaaggaagctaatttagagtagaaagttcgtgtccagtcccactctgtgcgtgtgttagcaggggactctcgggccggagctgggtcaccctggtagggggacttcatggggcctgggcgacagcactgtgtatttgtgtgtgtgttgtttgtgtgtgtgtgtgtctgaggaggtggaccagtttctcaaaaggcctgtgaccccagaaccaaggaatttcagcctgggtggatcacaccttcactggtgagtgggacaagctggggccctcgccacaggagcagccagggcatggggcacagttggcctcattcacaaaatggagtataagtgatccctgctctggcggccaggacgatgagtgggaacacaccgtgtggggctgcctggcctgggtgtgccgcgggtgtccttgttggtgatggttccacctgcttgtgcaccagtgccctctgggtctcacacacaactctcttcccagcgaaggcccctcctgccccaggcctcagtgctgcttccgtctcggaaggccccaggagctcctgcatcctgggcgtgttcctgtgtgcctgcagaccccctcgcggctgccatctcatcctttggtgcacctgttgccagacctcctggtagcgggtgctgcactcccctgaatgtgccggggcctgggggcaggacctgggctcctccctcactgagtggagggaactcagtgtcttggagttggggtgcctgaggctgggtggtgcaggtgaaatgcagacctctcagctggtgttccagagcagctgcctcccccgcccgagggacttcacccgcagcccagtcaggggtggcgcctgggtgcatcgccgcaggctgggtaggggtggagcctgggtggccctgcctgtgagctgcatagttgtcgccttgaccctgagttttcttcgttatctgtttggacctgtttggggcaggcaggggatgagtctgaagataaatgccttagctgtgaccatctccttttgtgagaggtcaatgtccagttcgctgcagttataacatcccattttttgatttctttttattttttcctttttctttttggatggagtctcgctctgtcacccaggctggagtgcaatggggtgacctcagctcactgcacctccacttctcgggttcaagtgattctcctgcctcagcctcctgactagcaggggttcaggcgtgagccaccacgcccagctaatttttgtatttttagtagaggcaaggtttcgtatgttggccaggctggtctcaaactcctggccttaagtgatctgcccgcctcggcctccaaagtgctgagatgacaggtgtgagccaccgtgcccggcccagaactctttaattcccactgaaacttgccgccttaagcaggtccccagtctccctcccctagtccctggtcccaccttctgctttctgtctcaatgaatttgcctaccgtaagtacctcatataaattgaatcataagtatttgtctttttatatctggcttatttcacttagcataacattcttaagtttcatcatgttgtagcatgtgtcagaatctctctctttttttttttttttttttttttttttttcagacagagtctcgctctgtcatctagactggagttcagtggcacgatctcggttcactcaacatctgcctcctgggtccaagcaattctcctgcctcagcctccttagcagctggaatacaggcgcgtgccaccatgccttgctaatttttgtattttttgtggaggcagggtttcccatcttggccaggctggtcttgaattcctgacttcaggtgatccacccgcctcagcctcccaagtgctgggattacaggcatgagccaccgtgcctgaccagaatctttttccttttgagactgaatagtactccattgtgtggatggagcagattttgccccgctattcatccctagtagagggacgcttgggttgcttccatgtttgtttgtttttttgtttttgttttgctgtttttgagacagagtctcgctgtgtcacccaggctggaatgcagtggcgcaatcttggccactgcaacctccacctccagggttcaagtgattctcctgcctcagacttgtgagtagcgggattacaggtgcccgtcactacgcccagctaatttttgtattttagtagagacggggttcaccatgttggccaggctggtctcgaactcctgacctcaggtgatccacccgcctcacctcccaaagtgctgggattacaggcgtgagccaccatgcctggctgcctccatgttttgctgttgggaaggatgctgctgtgatccaaggtgtatgcatatctgattgtgtccctgtttcagttcttttgggtatataacccaaagcgaaattgctgggtcatatggtaattctgttttaagtttttggggaactgccatgctgttttccatagtagctgcaccatttcacattttgccagtggtgcacaagggttccagttgctccagatcctcaccaacacttgctattttgttttttgatagtagccgtcctaattggtgcaagatggtatcttattgtagttttgatttcatttccctgatgattagggatatattaagcctgttttgatgtgtttattggccatttaatgtcatctttggagaaatgtctgttcaagttgtttgcccatttttgagttggcttagtgttttctcattgttgagttttaggagttctctgtatttcatggatattaatctcttagtgatctatgatttggaaatattttctctcattctgtgggttgcctttttactctctcgatgtgtcttttgatgcacaaaatctttagcttcccatgaagtcccgtttgtctttatttgtgcctatgccttcctgttgtttgactttcacagtgtccctcgttgccacaaagaactgtaacctaagatgatgacagcacgggtggggcggcggaggcgccgctgtcattttcctggcccaggtcctctgtgtgtcctcccatcctgtggagcatgtctcctgggaatgggaggggccggatttgagccagtgcttgtcttggcagggaggcctgtgctcggaaccatctaccccacgcgctggggtctcctgggccatgctctggccctttgtgttcccagctaccctcatagagctgcaaatctttcccctgctgaaatgaaaccaactgaactaactacaggattcagttcttgattgtcattggctgagttgagtttgttttggctttctctttcttggtgaaggtgggatgtggggttggctgggctcccccatctgcgcaggaggacccaggggtctgcagttttcagaggaatgtcagctgtttcaagccaaggcttcagatgttttttgggggtgtttgtggccgcccagcctagccctgctgacagcagacacggactgatggagctccctggaggcccttacctcctcctgtccacatcttgtgttcactcctcatgtggcttcttagtccctctgagtcgtgttgggggttgctggaccctcctggtccgacgtctgaggtgtctggtggggtgatggctgaaggcctctcctgatttctcattgagcccgttgtgggaatgagaccgttgtctgtggatgaggcttcttgcacaggcagaaggggctgagggctgcggtgcagagggaggtgaggagccagcctggccgcaggcagatcaggaatgcttggggtggggtggtggagagaagtgtggtgaggccagaggccaaggccttggaggccaggctagggggtctgaccttgttctgcaggcactggcacagggagctgtggaaggtgtctgagccaaggggtggcattccagagtgacctttaaatgtaggaatgtccagaagcagggtgggagaaacatggaatacaggggtggagggaagctgatgccacggccaaggaaacgggcctgagcttggacagtggtcaaagactttaagggaatcttgaggctctgtctggcctgggctctgaacccctcaaaaaatgtggcccgtggctgggtctgtagcgagcagcatggccagtgctgtgcctgcatgtccccgtccccttgtcaggccaacaaaggggatgtggcttctctgcagaacaggacagggcccctgtagccctggaggacgatgtgggaggttttgggcatggcaggaagggtcacccatatctgggggacagacgtaacagttggtaaacaaacaggtgctgtcaccgaatgtgggaagaaggctgttgctgcgctgcaggagcctctgaatgatgcgggccggggctgcccaggcaacttcctgacacgccttaggggtgggaggaaggaactggaggtcttgggcatgggcagggcagtaccagagtgctctgggcatagtgctccatcccagggctgtgtatcttgctggcttagccagtggcctcacggtttgcttctgccccacagcctcgccgctcctgctatttgccaaccgccgggcgtacggctggtggacgccggcggagtcaagctggagtccaccatcgtggtcagcggccggaggatgcggccgcagtggacttccagttttccaagggagccgtgtactggacagacggagcgaggaggccatcaagcagacctacctgaaccagacgggggccgccgtgcagaacgggtcatctccggcctggtctctcccgacggcctcgcctgcgactgggtgggcaagaagcgtactggacggactcagagaccaaccgcatcgaggtggccaacctcaatggcacatcccgaaggtgctcttctggcaggaccttgaccagccgagggccatcgccttggaccccgctccgggtaaaccctgctgcgactccacctgggtccagggggcggggagtgtcaccatctcttctcgaatttgcatgagcccaagttgtttttcagaaaaagggtgtgactctgaaaatgacccgtgggggggttggctcaggcctgtaaccccagcactcggtgtgactctgaaaatgacccgtgggggtgttggctcaggcctgtaaccccagcactcggtgtcactcttaaaatgacccgtgggggggttggctcaggcctgtaaccccagcactcggtgcgactctgaaaatgactcgtgggggggttggttcaggcctgtaaccccagcactcggtgtcactcttaaaatgacccgtgggggggttggctcaggcctgtaaccccagcactcggtgcgactctgaaaatgacccgtgggggtgttggctcaggcctgtaatcccagcactctgggaggccaaggcgggcaatcacctgagtccaggaattcaagaccacactgggcaacatggtgagaccccatttctaaaagtatacaaaaatgaatcgggtgtgatggtatgcacctgtaatcccagcttcttgggggctgaggtaggaggatcatttgagcctgggagatcgaggctgcagtgagctgtgatccaccactgcactccagcctgggcgacaaagtgaggagatcctgtctcaaaaaaaaaaaaggctcagctttcaagatttgttattgttgaaggaattacttccccttgagattccatagtatgttccttttttttttttttttttttaattgagatggagtctcccttgttgcccaggcggagtgcagtggcacaatctcggctcactgcaaccttcgcctcccgggttcaagtgatttcctgcctcagcttcccaagtagctgggattacaggcgcccaccaccacgcccagctaattttgtagttttggtacagatggggtttcaccatggtgtctaggctggtctcgaactccgacctcaggtgatccacccacctcggcctcccaaagtgctgggattacagacgtgaaccccgtgcctggcccatagttatgttcctttttaaaacttgcatgtctgaggcaaccgatgggttggccatgggtttgaatggttaaacacatctttgctgtgtgtatggtgggcggcctggaagtgcggacgctcaggcaggtggaatttgcaccttctcctggctttctaattgcatggctgaaaaagtgcagctccttgtctggaagcagaacctgctgggagtggttctcgggtcgttctggaagctgccctgtgtcctcctcagctcctagtctggctgagttcacctgggccttgaaggctcagggcctggccgtgatcccaggtggggagagcgtgggtggcaggaaagtttggagtcgaagtccggggtggagagtttaaggggaggtggcccagctccactggccactaggccaggtcaccccagactcccgagcagagggaacagtttgcttggccaccccttgccctcctttgtcccttttcttgcagcctgggagtgactctgggggccgtacacacaccctacctgggctgtgctaagccctggcccttgctgacctgtcaggttctgtgctgggtcaggtcagaactggttggcagaggtcttgactagaacacaagagccatttcccaccacccccggctcagttggaagccctttgcctgttagttcattcagtgtcaccacagtctctcagcatcccagcctggacctcaccggttgaggggccggcctagatcttctttgcgcaatggcacatctcagctcactgcaacctccacctcccgagttcaagtgattctcctgcctcagcctctgagtagctgtgattacaggcgtgcactaccacacctggctaggttttgtatttttagtgacacagggtttcgccatgttggccaggctggtctcaaactcctaacctcaagtgatccccctcctcggcctcccaaagtgttgggattgcaggcgtgagccactgcacccagcctgactagatcttctaggttagaaagtcccaggagtgggcggccatgcatccaggcctgccacggagcccgcctgccctcctccctgaagtcagggctctggaagcccttcccttggccatgcctgtgggacagtgtccaagctctggagtaggactgaagacccctgggctctagtcctgggccaccaacttgctgttgccctttgcagtgacctccccctgactcccatggtgccggcgcaggagccgggcgggaggggctggttgccagatcctgcagatgcccctcctctgggccgcccagggtagtgggaatgagggtgtggggtgagggtctgtcctcaccaaggctggtgttgggagctcaggaagcagagtgccatgtggccaagttcacctctttgatctgtgtggtgcttaggaagccattgactggcttctgacgagcatgggaagggctggagcctttcagagccaacaggtttgtgtgagagccaggcgtgtgtgtgtctgagcaactgagtgtgggagtggaggatgtgagcgtgtgtgtgtgtgtgtgcgtgtgcacgcatatgcgtgcatacgtgtgacctgtgtgtgtccgtgtgtgtgcatgcatgcgtgtgagtggatatttgtgtgtgtatgatgtgcgcatgtgactgtgtgtgcacgtgtatgtgcccgtgtgagcgagtatgtgcgcgaagtgtctgcatctgaaccagtctgtgtgtaagtatggggtaccagcaggggtgggacacgtggaatttatcgccaaagtattttgagtccctgaggtcaggccagagcagcctcgtgccccactacctgagaagtgcccccggcctcccaggggtgctgtgctgggcaaccactcatcctggagcccctcgtatgccctcgctgccctccgagtgggctagccacccctgcagctgcggggagccagctgacctccggggcagcctctgttccgcttggtgaactgttgccctctagccctctccccctgcactgtggctccaggagtcgcggggttactgaccttctttttggagggtcggctggtgtagcagtgtctctggctaggagggggcatctgcagtagtcggagagctgaagatagcagcttgctagaagccctctcccagggccggcctgcggttgctcaccacggctgccatggccatcgtgtcgccaggacctgcgctcctcctgtcattgcgttccctccagcgtgggtcgctgcagctccctcacctcccaaccaggcatccactgcatttgtgagccttgcgcctggtcctgctccccacgcagcgggtatagcccagtctctggccctttcagtagtgggaggagatggtaaatgaatagtatttgaaagggacgtgtgcgtagggggataaacagtgcttgggtgctgtggcgaggggcttccgtcggagctcaggtgctgggaaggcctctggtgacttttgagtcgagactggaagcagatgaggctgagaaccgtgtggctgtctggggcagcgcggtccaggcagagggatcagccagtgcaaaggccctgggctggtttggggcgggcctgtttgaggggctgtagcagaatgtagggaaacagggcccaaggtgtgaggagagacacatgaggtctcgagcagaggaggtgccagctctgactcgtgctggaaggcatccctggtggctggagcgagagtgagctgtggggtgggtggcgtgggggcaggagccctctcccggttattaccgggatcctggcgacagaaagcagcagcggggacacctcacttgtggggtaaggagtggcgagatttgggatctgttctgaagagaaaagacagctggatttgctggcctctgcatgtaggttcgataaaaagatgagacaaggttggcacggtgccactctgtgcccagtatccttgtctgtacagaggcgtgaccatgctgcatgtcatgaggaaaacaccaagacagtttgtgagttcaacaaatgttagctgtcgttataataaaaatgccctttcctcgcaccagaagtccagtctccatgcctacgtggttttgtctttttacttctttatggcttttctatgttggttgggaagtgctcagtgctaggttgggaggtgatcagtcgggaggtgctagtgatttgttgggaggtgcatgatgctcagttgggaggtgctaggtgctcggttggaagtgattggtactttgttaggaggtgcttggcgcttggttgggagttgttggtgtccagttagaggtgctaggtgcttggttgggaggtatttgattgggaggtgcttggcacttggttggaggtgctctgcacttggttgggaggtgctcggtgctaggttgggaggtgatcagttggaggtgctagatgctctgttgggaggtgcatgatgctcagttgggaggtgctaggcgcttgttgggaggtaattggtacttggttgggaggtgcttggcacttggttgggaggtacttgtgcctggttgggagtagttggtgtccagttgagaggtgctaggtgcttggttgggaggttttgattgggaggtgcttggcatttggttgggaggtacttggtgcttggttgggagatgtgggcccttggttgggagtagtctttcccatgctcagatctgagctggctttgcctgcacatctctgcgagccaactgtccctgtttggctctggcttttcttaactatttgaaatggtcctttacatgcttgcctctgaattctctcccagaagccctccccaggatcacacctgtgctgttcactcccacccctgcccctggggcaaagttgaccttagtgttgattcctgggctctccccacaccttccctttgctccagtcatttgaatgagagagtgaaaacagtgagatccggctcccactcatcagatccagtgatgctgatgacgccagccatggtcctaccctgagtgctgactctgtccctgtaggctccatgtctccggagagggagagggagagggagaggttccagcctgtcacagcgcccgcggcagcaacccctgctcgccaaatactgacttgaatgtggtcctcaggcataagtgtgggcgctgagtcctggggcaggactgctgtcctgagagggggacagtggagggtgggtttgtcctctgtcctggccacaggcacacggttgcgaggacatcttggccttcctcccggccctgctagagcccccgtcatctcctgtgccctcctgcatgctgtcccccaccagggtccttcctcagaggagggggttcctgccccggccatcatcagaagggggtctctgggtccgagcgtccacctcagtgtgcacgtggccaaaaggatcaaggccctgcagccaggggggcccctcctgagactcgacttcgttgcagtttcagcaatgcagtggccccgtgcggacatccaggcagggttgagggaaggcacatccctcccaggcccaggtacccatgtgggtggcagagcgggctctggggatgaccctctggcccctgaggatctgggccagaaagacactggcttagcatgggaggagtccccggcctgtaccagcctgacaagggctgcagtggcccccgggtctcaaattaaagccagggtgaaacccaaccccctctttaaatgcaaaatggcccttccctaaaataacacacaaccacaaccgcagctggctctgcacaaggccatgctgcagctcttttcttcggaagtcgattttcctccgtggaatttggctggcttgtggtagcgtttgagactctgcaagagcacgtccacgccaaccagtctctggtcacgactggctcgcaaattccccatttaaggaaaccagcaggcctctgttatgaaactcgggaaggaatgtgaattatgctccatgcggaggctcctgctcctgcacgttttccagcctttccatgggccacggtggagcatttggggaaggcctgtgtggattcccccccaagtccagatgatgcccctgataccttctcaggaggtggcggagggtctgggctctgtccaggctcctggggtggggacgtgcaggtaaagcaaggcgtctgccgcaggcacgcgggagccttccctggctggctgccagcaccttggagtcccaggctgccaggaaaagttcacccacacccgggtttgctggcgaagggtgagtcatatgatggccgggctcgggccctcagcagacaccaaggtgttcccagagcagccgctcagcgcctgtaacctggaacaggccagcctttcggggcccagttttctcatctgcctaatgggaatagcaattcccaccttccctttgttggttgggtctcactagatgcacaggagacagcagcttgagagggactgtttggagagctgttccatggacacccctcttaccctgtccccacggggccggaggagcaggggcttggtgatagcagcgggcgcagtcagcctctgcagggaagagggcatgtttggttcgaggctcctatgccctcttcttgttgatcttgtcacagcccctctggaaggtggagatggtactcgctcaggaacgtaccactcaaggaagcatggccccctggatggggtggcccttggtgcacctgaggctccgaggctgcagagcaccatggtgggggaggaggcggctgtgtgtctgtcatttgcctctttgctgaatggagacccccagagggcaaagcggggcttgttctccctgtgtcccgggatcctctcatgcctggcttgggcgagctgcctgtttctaaatcacttgctaaggctgaggggatggggtttgccgcccaccccaggaagaagggagcaagggagtcagcaccattttacaagaccaagagtgggaggaggctcctcagaggacattctgggcactgtcccctttctctgcgtgaagggtggacaaaacacaataggtctgccagcccttgtgtcctgtggctcatcccactggctgggatgggaactgagtcctccaagctggtgtggttcccctctggtctccgctggagtcacgcccagcctctgggcacacaccctgtggtcacctccaaacagggcacactggcactggtgggggtgggacctgccatcccagacctggtgtctgctcactttgtcttggttattggccagagatcacgtaagggcgccctgaggatgtgcttgtttctcatggatgggtgtgcttgtctcttgggaacatggagaagcaaagccacgtcgcccacagacctacccaggacagctgcagctgcaggttcagggtccatcccagccatgggttttattcttttttttttggacggagtgttgctgtctcccaggctgagagtgcagtggtgtgatcttggctcactgcagctccgcctcccgggttcacgccattctcctgcctcagcctcccgagtagctgtgactaaggtgtccgccaccatgcccggctaatttttttttttgtacttttagtagagacggggttcaccgtgttagccaggatggtctcgatctcctgacctcgtgatccgcccatctcggcccccaaagcgctggaattacaggcatgagccaccgcacccagccttttttttttttttttaggcagggtctcactctgtcatccaggctggagtgcagtggtacagtcacagctcactgagcctcgacctcccagggctgaagggatcctcccacgtcagcctcccaagtagctgggatacaagagtgtgccaccatgcccagctaacttttttttaatttttattttttgtagagggggattttgccatgttgcccagggtggctcaagtgacccacccacctcagcctcccgaatactggaattacaggtgcaagccatcgtgcctggccatgttttgttgtttttaaatagattaattttttcaaacagttgtaggttcacagcaaaattgatgagcagcaggtactgagtcctatacatccctgtcctcacacccacacagccttcccaactgtcagcatcctgtgcaggtggtacatttgttacaactgatgaaagctggctgacgcaccatcacccaaaatccacgttacacgagggttcgcccttgatttgtacattcttggtttagacagatgagtaaggacagcacccaccattccatgtcatacaggatagttccactgccctgattttctgtgctccaccattcatccctctcctctccaactcctggcaaccactgatgctttactgtctctgtgtattgctttttccagagtgtttagaactggactcatacagattggctctttcacctactaaatgcatttaagtttcctccatgtcttttcatggcttgatagatcatttcttttcttttctttttttttttttgagatggagtctcgctctgtcgcccaggatggagtgcaatggtgcgtttctgctcactgcaacctccccctcccgggttcaaatgattctcctgcctcagcctccaagtagctgggactacaggtgctcactaccacgcctggctaatgttttgtatttttagtgggacggggtttcactgtgttagccaggatggtcttgatctcccgacctcgtgatccaccgccttggcctcccaaagtgctgggattagaggtgtgagccactgggcccagccgatagtcatttctttataccactaaataatattccatcctgagtgttttgaattgccttttagagttcatttacagcattttcatggtagcaaaaaaatcagaaataacctgaagttctttaaaaacttacagcagagtacactaggcaatcatcaaaagaacaaggaatctttctatccacagaagggaaggtgcccagaatttactgttaactgagaacaagttggaaatagtatatttgattgcccagcttaaggcaggaatacctgaaaccatacctgttggttatttccgatggggagattttagggcaagttcactgtctgttgtttcatgtctgcatctatgcagacaaaaaaaaaaacagatctgtgttagctgcttctcttgccctgcccccgtcacaggtacatgtacggacagactggggtgagacgccccggattgagcgggcagggatggatggcagcacccggagatcattgtggactcggacatttactggcccaatggactgaccatcgacctggaggagagaagctctactgggctgacgccaagctcagcttcatccaccgtgccaacctggacggccgttccggtaggtacccacgcagtcctggggcacccctttcccctttgtccccagggctttgaaggcgttccttcttaactcaggcctacagactcttctctgaaactctggggccctaggaatgcaggacttctcagaacttggaacagcgtcagggtctgtgtggcatttgccacagcccttgaatatttctatagcaaatgtggcacgttcattctaagtagggcagaaaagatatctgtagcccacacccatgcacagtttttttttttttaactttgtttttttgagacaagtctcactctttcacccaggctggagtgcaatgtcataatctcagctcactgcagccccacctcccaggctcaagcgatcctcccgcctcagcctcccgagtagctgggactacagggtgcgccaccacacctggctaatttttgtatttttggtagagacggggtctcacatgttctcaggctggtctcaaactcctaagctcaagggatccttcccctcggctcccagagtgcgggattacaggcgtgagccaccgcacccggcccatgcaccaaatgaggttttgtcaccaatgagcaacaaaagctttccatcttcagagcgttttggattttggaattgttggggaggcttatggcccggcagggttgtgaacagtaaccctgtcacacgcaccacccccaccctggcctatcccagctcaggcatcctgagggcaacagccggaagctgtctcagttattggtgcttccccagtctcaccagggggccttccacatggtcagtgctcaataaaatgggccgagatgagtaggaagggttttcccctcgttggttaattgcttttagagccttctggtcagcatgcttcccagctctgtacttaattaccccttatagaaacatcccttctgtgtacaggtgagggcagtttattcactaaccaagtgctgcctgctgctagccctgtgctaggtgtcagggtcctcctgggacggcagaccccattcctgcactagtggagctcctggcccaggcagggagtggcaggtgtctgtgcagagggcagtagtgactgcatgggaggactcagtggctggattctgcaaacacaggccaacacccacatgaacagacttgagggcttgggcagctttgctcacacttgccaggcctcgtgtgttagttatccattgctgtgtaacaaaacagcccacaactaacagcctgaaacagcaaacaggttttttatggggagggagtcagtgatgaggagtggttagctgggtgcttctggctcagggtatgacctgagggtacactcaagctcctggctggcctcagtcatctgaaggtttgagtgaggccgggacatccacttccaagctcattctcaggcaagaggcctcagtttctcctgttcctcttatgctgagccacacatctcttttgggctgtttgaaaatatcctgttgtccctggaagtgcagaccagcgggtctggtttgagatttgaaatgtggttaccctgtagactgtggttcttgggagctgagtgatcttacagttatgaaggtggacaagaggatagaaaggctgcagctgggagtgccctggtcaaaggatggtgacagggacagtgagggtgatggaggttgaaacatgctaatggtggtggcggtggcggcagcgatccttccatagcacttactgttttccagggacgtttatcagttcatttaatgctcatacacctctatgaaacgtttgctattatgttttatttttatttatatttttattgttttgagcagggtctcactttgtcacccaggctggagtgcattggcacaatcatggttcactgcaccttgacctctttttttgtttgtttgtttgttttttttttttttgggatggagtcttgcctgtccccctggctggagtgcagcggcaccatcttggctaactacaacctccacctcccggttctagcgattctcctgcctcagcctcccaagtagctgggattacaggtgcccgccacacgcctggcaaattgttgtatttttttagtagggacggggtttcaccatgttggccagctggtcttgaactcctgatcacaagtgatccacccacctgagcctctcaaagtgctgggttacaggcgtgagccaccacacgcggccacagccttgacttcttgggctcaagtgttcccccgcctcagccttccaagtagctgagaccacaggcacgtaccaccacgcctggctaattatttggtattttttttgtagagacgaggtttcaccatgttgcccaggctggtctcaaatcctgagcttaagccatgtgtccacctcggcctctcaaagcactgggattataggtgtgaccactgtgcctagcctgtgtttgctattttgatcccctgtgcacagagaagcatgtgatttgcccagagccacacagctagtcccagccagggttggaacatagggtctgtagctccgggtctggtctgttctcagcctctctcccacctgcttccccgcgggattcttctgcctcgcagcggccatcgctcttcatgatgcacctggggctattcacatggaagcgtcgtgtgtgggtgacgagctctggagccacacagacctgtgcaggcccctttatctgtgactgtggcggggcaagggccgaggctgaccttccctcagtgcttctggctgaggcagagcatggcccgggagcaaccgagagtgatgggcctctggcttctctcactgaaaaatggccacatgggcgggcgccatggcttacgcgtgtaatcccagcactttgggaggccgaggcgggcggattagaggtcaggagatcgagaccatcctggctaacacggtgaaacctcgtctctactaaaaaacaaaacattagccaggtgtggtggtgggtgcctgtagtcccagctactcgggaggctgggcaggagaatggcgtgaacctgggaggcggagcttgcagtgagctgagatcccgccacgcactccagcctgggcgacagagcaagactctatctcaaaaaaaaaaaaaaaaaaaaaaaaaggctgggcgcggtggctcacgcctgtaatcccagcactttgggaggctgagacgggggatcacgaggtcaggagattgagatcatcctggctaacacagtgaaaccctgtctctataaaaatacaaaaaattagccgggcatcgtggtgggcacctgtagtcccagctactcggaggctgaggcaggagaatggcgtgaacctgggaggtggagcttgcagtgagctgagatccgccactgcactccagcctgggctacagagcgagactctgtctcaaaaaaaaaaataataaataaaataataaaattaaaaaattaaaagtaaggccgggcgtggtggctcacgcctgaatcccagaactttgggaggccaaggcaggtggatcatgaagttaggagatcgagaccacctgggtaacacggtgaaaccccatctctactaaaaatacaaaaaaattagccaggcgtgtggccggtgactatagtcccagccactcgggaggctgaggcaggagaatggtgtgaaccgggaggcagagcttgcagtgagctgagatggcaccactgcactccagcctgggcgacaagcgagactctgtctcaaaaaaacaaaaacaaaaaaaaataaaattagaaaattagctgccatggtggtacatacctgtgttcccagctactcaggaggctgaggcaggaggatggatgagcttaggagattgaggctgcagtgagccatgatcacaccaccgcactccagcctggggacagagcaagaccctgtctcagaaaacaaacaaaaaagacaacattgtggaaaacagttgttgattccttgagacgtaaacattgatttacgtatgacccagcaattccgctcctagtgtatactcttaagaatcgaaaacaggtcttcacacaaaatgtgaatggacagtaatgtcgtagcagcactgtgcacaacagccgagggtggaaatgacacaaaggtcccccagtggggaatggatgcacagattgggttctgtctgcacactggaatatggttcacccctaaaacggatgaagcactgacatgctacagcctggatgaacctcgaaaacatggtgccaagtcaaaaagacagacatcagaggctgtatattgtgattccgtttatatgagatgttgagaatgtggtagttaagtccatcaaaagtgtttgccggggctgggggcggggactggggagtgactgtgccgggtgtggggtttgcctgtggggcaatggaagtgctttggaactagacagaagtgaggctgcaccgccttgcgaatgcactaggtaacactattcactttaaagtggtaaatttggctgggtgcagtggcttatgcctgtaatcccagcactttgagaggccaaggcgggtggtcgcctgagctcagggcttcaagaccagccttgggcaacatggcgaaaccctgtctctacaaaaagataccccccaaaaattagctgggtgtggtggtgcacgcctgtggtcccagctctctggaggcggaggtgggagaatcgcttgaacctgggaggcagaggttgcagtgagctagatcacaccactgcactccaacctgggtgacagagtgagaccccatctccaaaaaaaaaaaaaaagtaaacgtatgtcctgtgaattttacttcaataattttcttaaaaaacagcacaacaaaaatgaacagaagaggtggtggatctgcagagcccacagctcccatcttcccttgccacttcatgagtgtcaccctctcctggcaactgtgctgagggctggggacgtggcgggaccctctgcccccaggcccaccctcagggagcctgtcacggggcgagggtcattaagaaataaaactgcacattaccgaccacgtcacattatgatcctgtttccagtgtccataactcattacacccgagtcctcatttgctgggcactgtaagcatctagaaaagaatagctgttctcgggttgatgccaagtttcatttactctgaaagtataaattatgagcattgtaagaggagcgagtgcacatggcctgatttgtatacagaggttaaagcgttgggcaggagagggtgctttttgccaggcatggcttcctcctttcttccctgggggagactttgccacttgactgggggagcccgtgtgtcaccatcacaggctgtgtttgggaggtgccctgtgcacgccggagaaatgtacgagggcgccagctcctggggctcttgacctggcctcacttgtctggtgaaagcaaatgggaagcctggcatggtggcgcacgcctgtaatcccagcgctttgagagctgaggtgggtggatcacctgaggtcaggagttcgagaccagccttgccaacatgatgaaccctgtctctactaaaaatacaaaaatcatctgggcgtagtggtgggcatcagtgatccagctactcgggaggctgaggcaggataattgcttgaacccgggaggcggaggttgcaggagctgagattacatcactgcactccagcctgggcgacagaccgagactccatctcaaaaaaaaaaaagaaattaattgggtcagcagcaatgactgtcgggggaccctcctgatggccctccaccccgcttccctgactgcaggcagaaggtggtggagggcagcctgacgcacccttcgccctgacgctctccggggacactctgtactggacagactggcagacccgctccatcatgcctgcaacaagcgcactggggggaagaggaaggagatcctgagtgccctctactccccatggacatccaggtgctgagccaggagcggcagcctttctgtgagtgccggctgggcgcgggggcgagggtgcgggggctggggggagcgggggcgcggggcaggggagtgggagatgcgggggcgtgggggtgcgcgggcgtgggtggggtgggggggcaggtgacccctcccgcagaagcccatgctctggggggccccctctctaaaggggtacctgctgcaatggagggggtatgtggctggctgggggacacgggcctgcagaggacccctctgcagagctcatggggctatttcaggctcagcagtggcaaggggatttccaaggaaggttgcctcgttttcaagcccagaagaagttgtctgtgtgtgtgtgtatatgtatttatatacacatacacgtatgttgtatatatatatatggttatttatatatacatatatatgtgtgtgtgtgtgtgtgtgttgtgtgtgtgtgtgtgtgtatgtatttttaatagagatgagagattttgccacgttgccaggcttgtctcaaactcctgggctccagtgatcctcacaccttgacttcccaaagtgctgggtcacaggtatgagccaccatgcttggccctgcaagtcgcgtatttatcaatgaatatctgcccagaatcagcagttctcagcctgggggccacgctgggttgtgacagaggtcccgatggggaaatgcaccagcttctgtgacagtggggctgcggctctggggacagtggcccctcccacagggaccagggatggagatttctggccaggccattatggaaggtttggacttgaattgaaatgtggggcctaggggtgccagctgttcccagagcaggacacaggagggtgggctctctggagctgtttcctggtgagaaagtcgtggtcacaaaacccatctacacttgggcagcatgagggagggagaggttcattttgatgagtttgttgttccagttatatccgtttttggggctgctacacccagctttcccctggtttgaatgaggtgctggaagcatttatgagttccgttcaattgctgttggtcatagaagggcttgggagagtgacaagcttggccacccagcaagagggacagtgttcctatggaagctgctgggtccacacatagcacaaagacagacaagccttttgcccaggagcccattgtctctggggttcccgtcactaccacacaggaggtcctgaccccggccattggagcgtggggggcagcctttgcagaggggtgtcctttggggctccgaggagctggggagggtgttctagtcataggagcttggtgggaggaagcagaggggaggatgtcactccatgggcaggtcacatctgggtgtgagggtggccaggaaggtccggctggttttggggaaattgcaggccgtctggccaggctgagggccccatgtggacgggccagcgatgaggcaggtggaatggtgcccgcggggaggtccctgatgccacttgaggcgatgtttgggcagagggacacactggaggctgtcacgggggacgaggcaggatgtgactattcagaaacaagtgacggtcctcttctggaaccttctctcactctgtcctggttttccagtccacactcgctgtgaggaggacaatggcggctgctcccacctgtgcctgctgtcccaagcgagcctttctacacatgcgcctgccccacgggtgtgcagctgcaggacaacggcagacgtgtaaggcaggtgaggcggtgggacgggacggggcgggcgggcggggcggggcctgcgggaatgggttgcggccgccgggggtgccccagaaggaacctcggcaaacccgttcgaatgatccacttggcgggtgtggtgattcaagtctgtggtcccagctactcgggaagctagttgggaggattgcttgagcccaggaggtcaatcctgttttgttttgttttatttttgcccagatattttccacttttttactctccgccttggtcctcaggcacttggtgcttcctggactgtgttgcagtgaggcatggctcttctcctctggggcaccggctgaggatctttcttccaggtgtcggttcggggcgggcccttcgggaaatcacacacgttcaggatgcagctgccttcggggatgctcccgggcctgggatagccagtctggcctctggggctgaccctgggcctggcaagcgagggggtaacgagaggtgtcaggaaagcgccatccctgggaccagtctccccgtttctgtagcgtgatggggcccagcttgcagaaggtggtgggggacagggcctcttcctgtgccggtgtcccactcgggagggcagggggcttccaagtgggctggcttccaactcaggaacagtcctaagggcagagtctcggtgtggggccccctagaaggactctcctgcatccggtggatggagaagtgtccttgctctcactgctgtctgagcacatgggggtccgactttaggaacagtttcctggtccccctgttcttgctggctagggtctgtgtttgtgtcagcggctggggtgtgtgtgtggtcgtggcgcccgtggcgtgtgggtcttttctctgctcctggcaggggtcctgcgtttggtgaggattttccaggtttgtatttgtctttctcttttgagagcagggcatctttaatgaagacatggctgttacatcaaagggtctgtccgctgtccggctgctgcaggggatggttggagagcctccccgaccaagcatcttgtttcccaagtgggagaaggagaatttgagaaatggggacttgggcggcctagtcctcacggctctggacgcaccccattcattcatctgcttgctcattcattcgttcatccatccatttgctcattcgcaggcatttgtcgaacacttgccgggtgctggcattgctccgaggcactggggacccccggtgcagacagaatcccgggcctctggcgctcgcactctgggctctggggctgggtggtgggggagacggcacaagtgagtccacgagggagtcagtgcattagaaagggtgagtgtttggacacccgctcctccatcacctctggggcccttcgctgttgaccgttcacctcggctcaaaggcaatgttgagagagaaactggacccagggaaggagtccagatgagctgcctctgagtgacctggcgacaccaggggtttggaccaagcaggttaagggaggattatagaccttgaaggggaggagtggtttgaccaggttggatgagccctttgtttacagaggaggccaggcaagtcaccagcctggggttgcccacagcaggtggcatagtaggttctagcaggtgggtctggctcccagagccatgagtttgctgctgccccatacctgggccctggtggagcaagccctggtctccctcgcagactgccccaggacgctgcctgctccctggaggagggggtgctcggctgcacaagcctcagcggagaaggatgcttggcttgctggctgcccgggaacctggccttctcagagtttgttttctttcctgcctgtctgttggtgagaagaggctgaactcgtgctggagctggaccctgcgctctgcagtgttggttgaagtcctggcggaaagggaaaagtgaggacatacgggctcatgacggcagggagtggccaccacagtcagggccgggggaggaggggagagagaatcaccggaatatggcaaaggtgtaaaacaggcagctcgggccggcgcagtggctcacgcctgtaatcccaacaatttgggagtccaaggcaggtggatcatttaggtcaggagttcaagaccagcctggccaacatggtgaaactccatctctactaaaaattaaaaattagctgggcagtagtggcacgggcctgtaatcccagctacttgggagactgagcaggagaattgcttgagcctaggaggcggaggttgcactgagccaagatcatgccgcttactccagcctgggcaacagagtgagaccctgtctcaaaaaaaaaaaaaaaaaaatgcactcgtcctggctagtctgaaaaaggtggagcatatatgttgcccaatatccacaaatatccagaaaatatctgagaagaaagcagttaatgagacgggcctgttcccctgccccgaggacacgtgtggtgggggccatgtcaggaagcaagccggcacacagatggacataggacagcctggatcgggtacggaacacagcaggggctgagccggagactcctgtactgggggtgtgccgcctgagccggcaggtcagaggtctctctcaggaggcctgagatctgaaggactaaagagggaaaggcgagaaggaacagcacgtgcagcggctttgaggcaggagcatgctggtttgggaccgacttcacgggctgtgtgacctgtgtagtcatatgaggtgagctctgttgtgacctgaaattcctaccttttgagtaaggggctgtctgcacttccattttgcagcggtcccgcaaattctgtaacgggcccggctcgtgtgtttgagaagctgaagggaggtctggagtggtctcttactctcttggtgtgtctgtctccacattttatcttctgtttttttgttcccagccctccctgcgtttttcctgtatgtgactgtgtgtctgtgtgggtgatcgaaccgtaggcttcctgctatttatttcactttatgcactgcagaagcatttgcgattgcaggaggaaatatgtatcaaagacatgagttttagtgaaggatatctttttttttttttttttttggacagagtcttgctctgttgtccaggttggagtacagtggctcacagcagcttccacctccaggttcaagcaattctcctgcctcagcctcccaagcagctgggattacaggcgcccgtactatgtctggctaatttttgtatgtttagtagagatggggtttcaccatgttggctagctggtcttgaactcctaacctcaggtgatccacctacctcagcctcctaaagttctagatcacaggcatgagccactgtgcctggcctatgcctgaacaatatcttatcaagacatgcttttagtcatcctcccgctatggggcgtttctgttctctttgtgtttttgccatttctagtcttgctgctgtgggttgggagtgggcaggtgagagctggcttggggcctggccactgagttagagggagcagggcctggtgtctgttgccaccatcgattggtgatgtctgcctaacactgtgttgcatctgctggggatgtctgccttgggagagcaatgggcatgtaggaagaggtgtcaccatctctgttcttggggtgtcaaagcaaggctgggtgtggacatttgtcgaggagtggggaatggacacagcccccaacaagcagatcgtgcagtcgtgcctgtcaggtccttgccctaacagtggaaggatcatttgaggtcaggggttcaagaccagcctggccaaatggtgaaaccctgtctctactaaaaatacaaaaattagccgggcggtagtcgtgcgccgtaatcccagctatttgggagactgaggcaagagaacatgttgccctgggagcttttgtaagggtccctgtgtggctccctcacgtatcagagttccaggaacgggtgtgggccctgaaaaatcccagactcatggctcagtgaagtcgcacagctggacaagcttggagacccccaataacttgcccaggctaccctggcttgcaaagggccactgctcatccaggggtgacggaccgtgctgggtgcctggcatccagtgggtgcccagtgtccagctgccatgtccactgtcatgcccttatcaccttcatgttgtcaccatgaccggcgccttaggtgctgtggctggtgcaggcccgtgagagctggggcaggttcactcagggtccaggtttgcctgcatcgtcccaaatcctcccatacctgggggagtgggctgtcagtgggagccagtaaaggggcgttgattctttcccaaccagaagaggcaggggctatagacttaggtggagcccctggctctttgctgctcccagggttctaacagctgggccttctgagccctggggactggctgctcgtggctggcccttcaagggcattgcgctccttctgcaaatgtaattcccagtctccatgtccaggccagagcagccctggggagtcctcagggctcattttcctgcaagcgggggagagggggggcaggccctgtggtgattagaggaggctgcctgcgctcacagggggtggttaggctacccgaggaggaggcccctgcaggctggcagggggcctggtggctctggccccagccctgggcctgtggcatggagctgacaccacagacacctgtggggttggaccgctggactagcagcggccctgcccttccagttggatagcttttccattccagagccgtcagggccgcagggctggcacgcagctccacgctccctagagactcagccgtcaggggtcacctttctctagtctttgggaactgtttttgccctcagccgtgagaggcacttttacacataactcagttggagctgactggcacgcaggagaaaaacattttgtgtcatttataggccctgcttgggcgagacctgggccgggaacgtccacatgcagccagtgtggggactgttttactctgagcctgaattttctgctttggttccagatgccgtgtgtagggtgttctgtcaaagggaggaaaaagctctcaatgagacagaaagatgcaactgggagtctggttttgcatgaggacgtgagcgtttagttcacttttttttgtaagcatggttccccagtctgacctcagagctgcctggagatggccccacccgcttcccgttaattaacaggctggtgctcggtgtggatgctggctcctcctctccctgccctgggcccttttgaagctgaagtgttccaggggcagctggtgtggaaatgagttttctagaggttttagagttgagaagaaacctaaactcttcttagaagcatttcagggtttgtcaccaggatggctctctgcaaatttgaggtggttctagaagatcttcccattttcttaatccagagggagatggggatgggcgagaaacggctttgtccttaaggaagtctgttctggttggaggacaggcacggcctagcattgaagctggtgagtcagagccggaccgtgagcggggccagaatggggcgcgggcttcagacttcacaaagcagaccacgcggcagctggggctttagtatccaaatgtcctgccctccaggtttcattccttgccgtaaaatatacgttaaaggaaaatgttttgttaaaagaccacagtcctgtcacctgagcacagtcgctttctcggttcctctgtggctttccaggctgcaggtgcccattggtattgcggccgtgcgccggcgggcatgaattagctgtgccgcctggctgctgacgggacgcctcgcctcgactgaaactacctggagctgctcacccaggggcaacgtgaagaaaacgtgaaattctgtcgctgttgcagctgacagcacggctgtgaggtcccagtgggcagaggcctcgtgcagggcacccaccagccgggatgtcagagctggccagaaggagcggtgcccatggagggctgccagtgccagagagccttccgaggtgtcacgttgggcagtgaaattcagagtcgggcagaggaggcctggggtcacacagggatctcctccaggctatgggttggtgaggtccagtgtccggggtgaaggatagaggctctgtggtgagggctctggagctggccctgggctagcggaaacgcggtaacgaaggaggctgtgctggtgggacttgtgcctgttcccgagggaggcattgtgatgatgtttaggccaagaggattcaggatggaagacatggcttggtttgtagttgggagcggccaaggagtggtgttgagaaagtgcagtgtcaggcagacccgggaccgtggcggtgagaggtgcagtgtcaggcagacccgggaccgtggtgatgaggaaatgcagtgtcaggcagcccgggactgtggtgatgaggaaatgcagtgtcaggcagacccgggactgtggtggtgggaggaggtgcagtgtcaggcagacccgggaccgtggtggtgttgaggaggtgcagtgtcggcagacccgggaccgtggcggcgaggaggtgcagtgtcaggcggacccgggaccgtggggcgaggaggtgcagtgtcaggcggacccgggaccgtggcggcgaggaggtgcagtgtcggcggacccgggaccgtggcggcgaggaggtgcagtgtcaggcggacccgggaccgtggggcgaggaggtgcagtgtcaggcggacccgggaccgtggcggcgaggaggtgcagtgtcggcggtcccgggaccgtggcggcgaggaggtgcagtgtcaggcagaccggggacttggacacctagttccacttgcgggctgaccttctattttttgtcatcgtgttgggagcttaggaagtgacttaacctctctgtgcttcagtttgtccgttggtagaaagggggtgattatacccccgctccatggggtttggaggaaggctgtgtgggttgtgctgagcagcgtgatggtgaggctgtctgggtcagtgccgagggagcgagtcttccttcggcggttgtaatcagaagtgcttccaaggctgggtgctgccaggaggagctggggtgggtgaaggggcagtggggagccggctcacacggccagcgggtgacctggggaggacggaggggggtgtgctgggcgcttcggcgtgtggctccctttcctgtggggcgaaggtcaggaggggggcagggcctggctgtgcagaatcactcagactcttaagacacatccagagtccccagccccaccccaacccaacgacccactccaccagaagaaacggggcaggtgggggccaaatctgtgagttcccaagggagactgtgtggggcaggttgtggggggcggcgctagcatggctggaaacatctcgaggttgaagccagagcctcaggtgagactcaagggtccctgggactccctcctgggtgtctgacgtttatctttcatggagttacaggcgaagacatttctgtgatgtcttgaattctgcttttcctgattttgagcaaatgaaagccagctgggtgtagggagtcaggtgccttccccaagaaggggctgagagggtggtcacaccaggaccccaagggacagggagcagcgttcccagggcacacaggcggcctcctagaggtagggatgcgttggtggcggggggggccccgcactgtgtgtgccttcaaggtggcactatttacgtggcccctgagctgcagggtgaccgctagcctgggctgtgtcctggctcccccgcccctcctgaagtgacccccatgagacagggcaggatatcccacgagcctctgccgcccagcgtggccggggctcagtgggaccatggcggctggatgctgctctctgcagctcagagtcactctcatccccagcagtcgagtgcagagcctggcctccggcctccccaccccctccacacagccccaggaccaaggcagcagctggcttcgtttctgccatgtttttccaattatgtggaatgagctaaaaacagcaggagtgaggcctttttgggagttgccaccgccatcctcggaagctgctgttcctcactgccacccctccagcccatcctctgtggaacgtgcccctgttcttttgacttttgtctcctgcacatccctcctcttgggggcctttgggcagtgggcttagcggcgtgcaccatgccactcgggccacacatccctggccggtggctctcagagctatgtccagagggtggccaggcagtgctcccggcaggcccagatgaggctggggtgcggcttggggatttgtgggccgctggccacagctcacccgacagagttttaacagatgttcgtctgtcagggacaggaaacaaaaagaagtcggggatgagtgggggcagcgggaggaacagagggggccactgtcgagtctgacgggcagactgacgctggagccgacggcaaagcccctcacgtccctccgtctgtccgggcggattagctcagaagcagggcccgctcagctcggggccgaataacgggcgtttgttcccagagtctggctgcttgtcacttatcagggaagtaggtcaaagggaaaaaagaaaggaggtcctgtggggccagtctgccgcggccgggcagtgattggcgttgactttgcaaacagaaggcagctgctgtctcagccatggaccgtgaatttttaatagcaagaaaatcagctcacacggttcaggaagtgtggaagaagcctgagtgctaactttatttttttaattgaggtataacttgcaggcaaaaaacgcacacattttaacgtgtacatttggattaactttgacagctgcatatgtctgctaactaccacacggtccagacagagaacatttctaccactgggaaagttcccggtgccctttgccatcctcaacccccgccccctccaccactctcctgacttctatcaccttggattgcgttgcctgttccagaactacatggaaatggaaccacgcagctgtgctcttctgcttttggcctgaatactcactgtcagggctgatgcaagaggagaggggcgcatcatattcctgagaacgctgtcaccgtggagcgggggcacagggggaatggcatctctgggatgggtgaagctgtgggcgcctttccacaggctcagagttagactgtggtcactggttttgtcccctgagcctcttccatgtcccccttgtgactgcagcataagcccagctccatgcggaccccagccagctccgcagctccaacagcttccctttatcttcagtggcgagctttgcgcttgcaggtgcggggcctggtgggacgcccacgttgcccagacagaacccttgtgcggctgcgggcctccttgccctttccgcatttggtgatgactccttgtttcgtttcactgaccgtgcccttgcctctgctctccctccccagttccgtgtgccctggggtcagtgatagaagacacggccctggaccccaagtctgctgagctgacacctcgggctgccgctcacctgcagagagacatagaaggctccgactcccttcctggcccccactctgtttttctaccttttaccgcctatccaatggaaatgcacgatttgtttctccctgtgcacatctgagtgtggacctccctgccctgctcgtgctgtgcccaccacctggagcacccttcccctgccccctgcccccggccacgcgcccctccatccagaccccactcctgcacacggctcctccgcccgtgcgcagccctcgagagtgtggcaggtgcaccaggctctgctctagggagcttcttcctcttcctgtgtccacgggaccaacatcgggacccaggaaacaggctgggagagttcggtaacaccttcaagaggtttgagagctgaggttctttggtcttcagtggagctggcagtgactttcttgacttttcaagagaagccccccgtctctgtgccacctctggggatgtgattgaacggaaatcagacatccgagttccagcctcagccctctgctgtgtggctgtgaaatgtaggccctgtgtgcttgctgacctgggagggtcgaaaggacggtgtctggggaaggatgcataagttgtagaggccctgcacttgtgataggtggggccgcgtgaactgctgatagccatcttctgtcagttgggcagtggcattgtcacatggttccattctaatccgttattttggctactgccactgagcggggtgggtgacaaaagtaacgtttcttgggggccactgcagcggtcatggtcctgaccctatacccaggcacgcgtcctgggagctgtgtgaggggtcgtccgtggctggccctgttctttttttttttttttttttttttaattgagacagagtctctctctgtcacctaggcggagtgcaatggcgcgatctccgctaactgcaacctctgcctgctgagctcaagcgatttcctgcctcagcctcccgagtagcttggactataggcacccgccaccacactcggcttatttttgtatttttagtagagatggggtttcaccgtgttagccaggatggtctcgatctctgaccatctcgtgatccacccaccttggcctcccaaagtgctgggattacaggcatgagcaccatgcctggccggccctacttcttaaatgggcctgaggcacatggtgccgagagctgctgaggtctatggaggaagggcgcagatgggatctgggcctggcgtcctggccggccccaaggccttctccacagagtttccatgtataccggggtggccttgcggaggggcgcagcatgcgtcaggctggagccagctgcagaggccacagacagggtgtcatgagcagtacaagaaccgctgctgtccattgaacacctactgtgtgcctgggttcagaaaggcaccctgtgcggcttttaaagaattaggccgcctgcctaaaggggggagtgtggccttctttttcatttagtcaccaactgttttatacatccacgcccctaaattcttcagttttaggcaaagatgaagggctgcccaggcgtcatttgctcaacaaaaccacacttcacttgtgaggctgtgttcctcaccagggtccccagcaagggggtgtgagtgtttagtaccacagggagggctggcgcgtggctcacgcctgtaatcccagcactttaggaactcctcacctgaggtcaggagttcggaccagcctggccaacatggtgaaatcccatccccactgcctgcctggggagtggccatcagccatgggcctgaggttgtggtggggcatgggggcagaggcaggcagtggggggccaaggaggggctggctggcaccgagggatgggagaggaagggacccgcctgcaggtcccttctgaggccggcactgacttggtcactctctggctgccctgaccccaggcagagcagcgatttcctgttttagagctgagcagacagagcccctgactgcaggccaaggtgcctgccagtgctcctggagggccatagcctctctgtgcttgctggaaggtcccaggcaccgtgcagggacagtggccggcctcaggttccagcagagccagcatcgggcccagccacttcccttgtctttgtgaccctatggtcacttggcacaggatcccgggtcaaatgctgcggttgcggcattgccccaccacttacccctgggggcagcggagaaacttaatcaattgctaaacaacaaaataatctggccgcctgccagctgggaagccactgtggccaggctgtttatggccttggatctgcgcagtggacagtggcctgcaccgtgaccccgttcatcctgcgtgccccaggccaggaggtggctcaagccctctgcctcctgtaagggcacctgagaaggaggccctggagcgggagcagagctgggggtgggcgtccgggcagcagaggccgattctcagctttccctggtctcagctttccccggatctcagctttctgctacccgtgtgaaaagaagccaggagaaccagctatcctgggttggtgccggctgtggtgggaggcctgcggtgggagcctccgggggcactggacctttcctgggtggcctgtggcctgggagctgcacttggttcggtgcagggagttgtgacatccactctgtctgcagggatggccggggccctgcggctgggtgatgaggtggatggaggtgtccggggctgccctgcctccttttgccaaaataacaaaaattatcttgttgttgtgaaaaaacctgttttcccacattggggcatggagggtattaactgtgatgacttctgagttcctgcacactggtgacccattggcagggtctcctcctggctctggcagggtggctcaggccgctgggtgacggtgtgctggccagatagttcctggggctgcaggtggctctttcgccccatccctcccatcccctttcattcttcctgtcaacacatctcagaccctgacaccgaatgagccgtcggtacccacaccccagggcaattcagtggaggggtaggtggtcgttcccccacgttgccccaggaagaggaccctgtccccggcatcctgacccacctccttagagaccgagagcctctaaggataaacccattcacccgtgtttcagaggctttttttcctcttataaaataacatttatacgttcgctgtagcaaggaaaacattataaaaaataggaagaaaatagaaattacccataattttgccacacagacttagttgtgtccatgtatctgtgcaccttttttctgtttacggatcaaaatcgacttttagggtcaggcgcggtggctccacctgtaatcccaacactttgggaggctggagttggggttggggggtggatcactgaaatcaggagtttgagaccagcctggccaacatggcgaaactccatctctactaaaaataaagattagccaggcgtggtggtgggtgcctctaatcccagctactccggaggctgaggcagagaatcgcttgaacccaggagacagaggttgcagtgagccaggatcacgccactgcacccagcctggcaacagagcgagactctgtctcaaaaaaaaaaataaaaataaaataaataatacataaattgacttttaggagattggttcaaacaatgtgtgtaatgttgtgtctgaggtttttcatttatcgttcatgcaaattccgacatcattcactcttctccagagtgtgctttttcctgcctgtgtcatcacccgtcaccttgaatgccctcgtttaggtaaaataagtaattttattcaaaaatatttgaggacatttgggttgtctccaggttcttggtcttgagtttgctgttcttgtggagccatggtggtgtctggttgcaggaacctccatgcgttccagctctgcttctgcctgtgttcttagagaggaaatgctggggtccgcggttcccgggctgctgccaggaagcctgcggtgctttacggcccttccagaagcgggagatgcccccacttaagttcagacaggcctttccacctcactggcagctctgagcggctcccttctatttgcagatgctgagaagttaccaatttccacgtttactgactgctgtttctcctgttaatttgtattttagtcttcgctaatttattgctagggttttggtgttgtccctattgacttgtatgcctttaattttttaaacaacattaatagacttcatttttttagagcagttttaagtttacaggaaattaagggacaagtacagagagttccttccacctgctgtcctcctctcctcctccccccttccctccttcccctattgtaactttctttctgatattataaaagtcactcatggctggcgtggtggctcacgcctgtaatcccagcacgttgggaggcagaggcaggcagatcactgaggtcaggagttccagaccagcctggccaacatggtgaaaccccgtctctactaaaacacaaaaagttagccaggcgtggtggcgggcacctgtaatcccagctactcaggaggctaggcaggagaatggcgtgaacctgggaggcagaggttacagtgagtcgagatcgcgccatgcactccagcctgggcaataagagtgaagcttcgtctcaaaaacaaagtcacacacgctcttgtacgagggtcatttggccgaggggccagatggctcaccatctagttgggacaggcatgagctcggaatgctttttacatatttacatggttgagaagaaaatcaggagaataagttttgggacatgggaaaatgacatggaatttgcattttagtgtccataaatgaagtttgtttgctcccagctgtgttgactgaggcaggctggcttcctacagctgcggcagagctgggaggcgggaaggagaccgtgcaggccgcagcaccgaaaatatttgctctctggcccttccagagtgcttgccgacctctgtccgacagctagaaggaaggataggacccgtccgacgtaaccactgttgacatttgagcgcgtttccttcccggcttttgtgtgagagtggcagtcgtttgcttttgtggtcgggatctgctgcacgcacggcgggctgtttgcatgaggcttccggaggatagggctgggctcggagctgcacgcagtggggcgtgtcctgcatgcagtggggctcagaagagagctgtggtgggcggggcagtgccaacgctggtgggtgccaggcctccagctcagatcagccccggcgacaggtttgggccaccctctctctggcctctgtgcagtggccaggccgtctgctctgcctggcacacttgcctctgtccttccactgaagcgctcctctaccctctgctcccggctgggtacgttgaattgtgtccctcaaggagatatgctaaaggttaaccccaggaacctgtgtatgtgatctaatttggaaacagggtcttggctgatgtaataagcgaggatgaggtcaccctagagtagggggcctatatccacggtgctggtgtcctcagagagcaggtgagcagacactgacactcaggggtgaaggctgcatggagtcagaacaggcttagtgcgatggcggccacaagccaaggaactccaagtatttcctgcaacaccagaagtggaagatgccaggaaggatcctgccctggagccttcggagggagtctgtccctgcagagtcttgacttttgattgcagggatgcatgtcttagggtgtgtgggggggtgcatttctgtgttagaagccacctggttggtggcgatgtgtcacgggagccctctgcaggttctgcgttccatgtggtcggggacagaggtgggcagggacggacggtgtcgagctggacatgtccagacgtcggccatcccttgggatggcttttttgttttgaggataaggctgcctgccaggagctgtgccctgcctggcccttgccccaagcccctggcctgtgcttggcctcgcggaaggatgtcgcccttctctcctgcatgcgtgcagggaggaaggggagaggtcagcagcccgccggaggaggctcgggcgaggggaaggtttcactttcaggcaatgttgtggggctgtttaacaaccccaaagaaaaccatttggccaaactgttagtttccaaacattttacttccttgggtttaaataaattcctaccaagactctgtagctggtcccagggaaggagttggcctctctctttatagcccggcacagtcagtcccctgcacctgcccctcccaaccccaggcctgctccccgtggccatggctgctgcccggacctctctacacacagaacctcctggaggccagcgtgggcaccagccttggcagggctgtggcggagcccaggctgctggtactctctctgcactgctccctgctggcctggctggacagagtccccaccaccactggggtcacctctgtgcggtcacagctcactcagaccttcaggcaaatgggttggatcctgcctctctcccaggtgctcagtctctgcaaaactcaaaaacctcagaggccttgcagcctgaggggtgtcagagaacctccttcgaatcagtaaacacctacagattcaccccagcagtgaaaggactgcttcgcacagaggtttgatttactcctaagtaattggaagggatgccgagaataggttcctcatgtgggactagaggccctctgctgacctagttaacagagggctagggctgggtgtgctcacccctgaaggttctaggcccatttgggacaccccgccagaacctgccacaacctgccattggtgacagctacctaaatcccagaggctcttgagctggagagcagacctctcaatctcgcaggccccccacacagaccccataaccctagtctgccttcacagtacagttcgtggcttgtgttcacggatggtgttgttcacctaaggtctctgccctgtgaccccaagggcgtccgagggcagattccaagtctgtttcgtccacccctccttccctagcagcgggtccagggctggcctgaactagcttcccacagagatactggtgggatgatgaaggcagccaggcggcagtgaaaaacgcacttcctgcatgtgctggctcctgggattgaagtgtttgaggaagcaagtgaagtgagctttcctcttgcggctgtgtgtccttgggccgggagcctaccctctctggcgttggggtccttgtcagtagaatggggcatcctcatagctcaaggggtggtgtgtgaaattgtgctattgtgttactttaatgattttttttttttcgagacaaagtctcaccccacgcgcaggctggagtgcagtggcgcgatctcagctcattgcaacctctgcctcctgggtcaagtgattctcctgcctcagcctcccaagtagctggaattacaggagtgcgccaccagcccggcatatttttctatttttagtagagagggggttttaccatgttggctaggctggtttgaactcctgacctcaggtgatccacctgcctcggcctcccaaagtgctgggattacagcatgagccaccgcgcccggcctactttagtgatttcttaggaggacagagggaacgggtggcaagacaggcttggaatgtgttttgggatcaagtgccggtttctgtctggcactgggttctctgtggggccatgatggacacactgctgaggtcaagcgtgattcgtcttgcgcttgcctggcagtctcattggaaagttctgtagacatcgtgtggatggggctcttcccggcaagcccttggggaccttccaggactgtgatctccccacagtggctgttaagcagggaccttcgtgaagtggagtctctggtcccctccaagtcatagctagacagggactcgggcatcccaagcctggctgattattcactggatgaggagacaggcccagagaggggcaggaacctcccgaggtcacccagcaggccccagaggtttcggtctcggattctccctgctcatccctgatgtagtgctgctgtggatgtggttctgtgctgggggctgtggagagcagggggcttggccaggaccccagtgagggtggcgccctcgccatgaggccgactgttggtatggggcggcatccactggggtgtggggaggaacagctttcctgaggaggaggtggcgggaggaacagttccctgaggaggaggtggcggtgctgtgtgacctgggccttgaaggacaggtccattgcaacagaacattttgggagtggagcctagagggagaaaatttgttgaaattcagattccctccccctaccaatacacaccaaatcagatgcccctgaccagatctaaatttggctctcgagatttccattgtagctgggcacttggggaaccttctaagtgctgcctctgcctctcccagcctgcctgcctcagtttccccagccctgggcccgtgtcgctgttgccatcacgtggcgccctctagtggaggaatcagattatgcactccggggcttggagcaggagtcaggagggctcctgtctttccttgaaacgttggatgccgggatcctggaacagtctctgcattcctctggcgagaaccagagcctgggcacaggggaccatctgttgtttgaaggctgcagcctgcagggcactcaggagatctggcagttggctgcagggccaggtctaggggccagggcatcgggaggctctgggctggttcagccccgggcccctttgcagattgtgacctgggcccctggcaggggcatggccacaggatgctgggaggggtctctgaccctgaccttcttggctctggcatccttgagaccagaaaggtctggaacaaatgagtagacgatgccctaacctggggaggagccacatcctgatcccagcaacctcgggaaggatctgtcaggattatggggcacccgggggccccaagtctgcatgggtctccacttgcaatttctgtaggaagctctgataaatcaaactgggggtcctaggacacagtcagaaatgctgataccgttgtgtgtggagcctcggccctgggggtcaggagcatgtggagggtgggccacgggggttcagaagagaatcctgtaccccccaccccccaaactgaagcccacttgagggccatggctgaaaggttggggggtcccgtgcgtcctgtggagtgggtggtgaggagtccttgggtttgcacgcctctgggcctggcggcgggaccccgtccacagcggatccctgggccctgttgctcagatgctctcagagtttgctgtggccacggagggagcctgagttaagcttctcttgtgccggttgtacgctgtcggtcacactggtgagttaggcagggcacagatgcccagagcagagggaactttccttgggattcaacacgtgcaagtcttaggggctggcaaatcctgccctcagctagagagggggctttatttgagaccagaatcacctgagcatcctcctgtccccagctgtgtccagcctgtcgcagggacatcctgagaggaccaggctctcccctcatccacctgcctaagtgccactctaaccctgtccacctgtgccgtggaggggcgtgacctcaagctgctcagccagcagcaggttggccctggggggcagcagagacccaggtggctgtggggtgggtgcttcgtggcgtggtctgaaacttcgttggaagtgtgtggacagtgccttgcctgttctctgtgggaccctattagaaacgaggtctgagttactgggggtcatcactgtgttctgatggcccagctgtgtgaggccgcggtgcagccccatccaaggagccagggccctgggtctagccgtgaccagaatcatgccccggaggtgtttctcatctcgcacctgtgttgcctggtgtgtcaagtggtcgtaaactctgtgttagctcttggtgttcctgaaagtgcccccgggtctcaggcctcagaacagggtttcccttcatctcggtggcctgggagcatctgggcagttgagcaaagagggcgatcacttgaaggatgtgtctggccctgcctaggagccccccggcacggtgctggggcctgagctgccctcgggtggtggagaggagggagcgatgaagtggcgtcgagctgggcaggaaggtgagcccctgcaaggtgggcatgctggggacgctgagcagcatggccagcagctgggctgcagcctggtacccggcgggacttgtggttggggctggtttgtggccaggagaggggtggcaggagacaagggggactgtgaggcagctcccacccagcagctgaagcccaatggctggctgtgtggctctcagctgcgtgcataacctctcagtgcttcagttctctcatttgtaaatgaggaaacaaacagtgccagcctcccagaggtgtcatgaggatgaacgagtgacctgtagcatgggctgggtgcgtgtcacctaacatcaccagcctttgcaaggagagccctggggcctggctgagtatttcccttgcccggcccaccccaggcctagacttgtgcctgctgaggcccttgacccctgaccccattgcacctgtctccacaggagccgaggaggtgctgctctggcccggcggacggacctacggaggatctcgctggacacgccggacttcaccgacatgtgctgcaggtggacgacatccggcacgccattgccatcgactacgacccgctagagggtatgtctactggacagatgacgaggtgcgggccatccgcagggcgtacctggacgggtcggggcgcagacgctggtcaacaccgagatcaacgaccccgatggcatcgcggtcgactggtggcccgaaacctctactggaccgacacgggcacggaccgcatcgaggtgacgcgcctaacggcacctcccgcaagatcctggtgtcggaggacctggacgagccccgagccatcgcctgcaccccgtgatggggtaagacgggcgggggctggggcctggagccagggccaggccagcacaggcgagagggagattgacctggacctgtcattctgggacactgtcttgcatcaaacccggaggagggcttgttaaaacaccggcagctgggccccacccccagagcggtgatcaggagctccagggcggggctgaagacttgggtttctaacaagcaccccagtggtccgggctgctgctgggtccatgcgtagaaagccctggagacctggagggagccctttgttccctggcttcagtttcctcatctgtagaatggaacggtccatctgggtgatttccaggatgaagtagtgacagtaagggcagcctctgtgacactgaccacagtacaggccaggcctcttttttctttttttttttttgagatggagtctcactctgtcgcccaggctggagtgcagtgggtgatctcagctcactacaacctctgcctcctgggctcaagtgattctcctgcctcagctcctgagtagctgggattacaggtgcctgccactgtgcttggctaatgtttgtatttttgtagagatggggtttcaccgtcttggccaggctggtcgcaaactcctgacctcaggtgaccacctgcctcagcctcccaaagtgctgggattacaggcatgagccaccacgcccggtcggccaggcctcttttgaacactttgcacaccatgggtcttttcatccaggggggtaggtcagttgtacagttgaggacactgaagcccagagaggctcagggacttgcccagggtcaccagcaggatgtggcaggtgtggggctgggcctggcagcgtggctccagctttccagcatgaaatctgtgaaagcagatagtttgtcggtcggtaggggagactttctgagacccgcccagcggctcagagggtagtagccaggggccttcctgggggctcataacccagaacactgatgggaaaaccctgatggaggaggcgcagtggagctgtgggtgccgatgggaagtcccagggagctgggaggtcagtagcggtgctgccctctgtggagcacttagtgggcaccaggtggtttccaggttcatggccctgggacctgaagctcagaaggtgaagtaacttgcccagggacccgtcgggcagcggcgggcagaggatttgtgggctgtggagcctgtgctcgtggcccgccctgggggttgtgagtgtgctggccggggagcttttcctgcaagtggactggtgtctggagccagcatgtcaggcagcaggcagcgggagtgcagcaggcagcgggagcacagcagcagagggcggggctcgagcagccatccgtggaccctggggcacggaggcatgtgggagaggctgctccatggcagtggctgaagggctgggttgtgccccgaggagggtggatgagggaagaagtggggtccccaggggctttagcaagaggaggcccaggaactggttgccagctaagtgaagggaacacggccctgaggtcaggagcttggtcaagtcactgtctacatgggcccggtgtcctcatctgtgaaaaaggaagggatggggaagctgactccaaggcccctcctaccctggtttcatgagtctgaggatcccagggacatgggcttggcagtctgacctgtgagtcgtggggtccagggaggggcaccgagctggaagcgggaggcagaggggctggccggctggtcagacacagctgaagcagaggctgtgacttggggcctcagaaccttcacccctgagtgccaccccaggatctgggttccctccttggggggccccagggaacaagtcacctgtccttgcataggggagcccttcagctatgtgcagaaggttctgctctgccccttcctccctcaggtgctcagctcctccagcccactagtcagatgtgaggctgccccagaccctgggcaggtcatttctgtccactgacctttgggatgggagatgagctcttggcccctgagagtccagggctggtgtggtgaaacccgcacagggtggaagtgggcatccctgtcccaggggagccccagggactctggtcactgggcttgccgctggcatgctcagtcctccagcacttactgaaccagcatctactgacaccaacatttacaaacaccgacattgaccgacaccgacatttacgacactgacatttaccaacactgtttaccaacactgacatctactgacactggcatctccaacactgacatttaccgacactgacatttaccaacactatttaccaacactgacatcactgacattggcatctaccaacaccaacatttaccgacaccaacatttaccaacactgaatttaccgacaccgacatttaccgacaccgtttaccaacaccgacgtttaccgacaccgcatttaccgacactgatatttaccaacactgacatctactgacgctggcatctactgacccgatgccagcatctaccaacaccgacatttaccaacactgacatttaccaacactgactttaccgacattgacatttactgacactgacatctactgacactggcatctactgacacgacgtttaccgacactagcatctactgacactgacatttaccaacaccagcatctaccacaccgacatttaccaacactgacatttactgacactgatatctactgacactggcatctctgacaccaacatttaccaacaccagcatctaccaacaccgacatttaccaacaccagctttaccaacaccgatgtttaccaacgccgacgtttaccgacgccagcatctaccaacacgacatttaccgacaccgacatttaccgacactgacatttactgacactgacatctactgtactggcatctaccgacactgatatttaccaacgccagcatctactgacactgatgtttccaacaccgacatttacgagcaccgacatttactgacaccaatatttactgacatcaactttagccatgtgatgggggccggcttgggggcaggccttgctcttggcactggggatgcgcagagaccagacagactcatggggtcatggacttctgcttcttctccagcctcatgtatggacagactggggagagaaccctaaaatcgagtgtgccaacttggatgggcaggagcgcgtgtgctggtcaatgcctccctcgggtggcccaacggcctggccctggacctgcaggagggaagctctactggggagacgccaagacagacaagatcgaggtgaggctcctgtggactgtttgatccaggaggccaggcccagccaccccctgcagccagatgtacgtattggcgagcaccgatgggtgcctgtgctctgctatttggccacatggaatgcttgagaaaatagttcaatactttctgacaaaaacgccttgagagggtagcgctatacaacgtcctgtggttactaagatgttatcattcggccaggtgcctgtagacacagctacttggagactgaggtgggggatcgctggagtccaagagtttgaggccagcccgggcaaaggggacacaggaatcctcgcactgcttttgccacttactgtgagatttaaattatttcacaatacaaaattaagacaaaagttaatcacatatccactgccctgcttaagacagaaaacatgggtgttgttgaagcagaggcagctgctggcctgagtttggtgattggttcctaagcagttgaaggcagttttgttttccatagatgtctgttctccctttgctgggtgcagcctcgccctgctgctgtggtcggtttcagtggcctcgtcccgtggacgcagcctcgccctgccgctgtggtcgggtttcatggcctcgtcccgtggacgcagcctcgccctgccgctgtggtcgggtttcagtggcctctcccgtggacgcagcctcgccctgccgctgtggtcgggtttcagtggcctcgtcccgtgacgcagcctcgccctgccgctgtggtcgggtttcagtggcctcgtcctgtggacgcagctcgccctgccgctgtggtcgggtttcagtggcctcgtcccatgggcgtgctttggcagcttttgctcacctgtggagcctctcttgagcttttttgtttgttgtttgtttttgtttgatttgtttgattgtttgtttttgttgtcgttgttgttgcccaggctggagtgcagtggcggatctcagctcactgaaacctctgcctccttgggttcatgccattctcctgcctcagcccccacatagctgggattacaagtgcccgccaccacgcctggctaaattttgtatttttatagacagggggtttcaccatgttggtcaggctggtctggaactcctggtctcacatgatcacctgcctcggcctcccaaagtgttgggattacaggcgtgagccaccgcgcccagccttgttgagcatattttgaggttctcttggtgccagtgatatgtacatgtgtccccatcgcccatcgtcacccattgaggtgacattggtgcctctcctcggggtggatgcctccctctgttccagcaacttctgaaggattttcctgagctgcatcagtccttgttgacgtcaccatcgggtcacctttgctctcctcagggctcccaggggaggcccgaatcaggcagcttgcaggcagggcaggatggagaacacgagtgtgtgtctgtgttgcaggatttcagaccctgcttcgagcgggaggagtctcagcaccttcagggtggggaacccagggatgggggaggctgagtgacgcccttcccacgaaaaccctaggagctgcaggtgtggccatttcctgctggagctcttgtaaatgttttgtttttggcaaggcccatgtttgcgggccgctgaggatgatttgcctcacgcatccccgctacccgtgggagcaggtcagggactcgcgtgtctgtggcacaccagcctgtgacaggcgttgttccatgtactgtctcagcagtggttttcttgagacagggtccgctcgctcacccaggcgagagtgcagtggcgcaatcacggctcgctgtagcctcaatcccctgggctcaggtgatcctcctgcctcaccctctgagtagctgggactacagacacatccaccacacccagctagtttttgtgtattttttgtggggggagatggggtttcgctgtgtgcccaagctgatctcaaactcctgaggcacaagcgatccacctgcctcggcctcccaagtgctgggatgacaggcatcagccgtcacacgcagctcaatgattttattgtggtaaaaaaacatagcacaaaattgatgattttaaccattttaaagtgaacagttcaggctgggcgggtggcttatgcttgtaatcccagtactttgagaggctgaggtgggcagatcacctgagtcaggagtttgagaccagcctggccaacatgatgaaatccagtctctactaaaaatacaaaattagccgggcatggtggcaggtgcctgtaatcccagctactcgggaggctgaggcagagaatcgcttgagcccgggaggtggaggttgcagtgatctgagatcatgccactgcacccaatctgtgtgacagagcaagactctgtcttgaaaaataaataaataaaaaaaattttaaaagtgaacaattcagggcatttagtatgaggacaatgtggtgcaggtatctctgctatatctacttctagaacactttcttctgccctgaaggaaaccccatgcccaccggcactccgcccattctcccctctctcccagcctctgtcaaccactaatctactttctgtctctggggttcacttcttctggacgttttgtgtgactggaatcctgcaatatgtggtccctgcgttggcttctttccatagcattgtgttttccagattcacccacacattgtcgcacgttatcgaatctcattcctgactgggtgcagtgggttaggcctgtaatcctaacattctgggaggcaaggcgggacgatcacttgaggcaggagtttgagaccagcctggccagcctagcaagacccagctaccaaaaaattttaaaagttaactgaacgtggtggtggtgggcacttgtggtcccagctacctgggaggctgaggtgggaggatcgcttaagcccaggaggtcaaggctgcgtgagctatgatcgcaccactgcactccagcctggacaacagagcaagaccctgtctgaaaaaaaaacaaaaaaaaaagttcctttctttttgtggctggatgacatcccattgtatgccacagcacattttgtttgtctgtttatcgggtggtgggcagtggtttccaccttttgttcctgtgaataatgctgctgtgaacatttgaattcaagtttttgtttgaacacctgttggaattatttggatatatgtgtaggggtaggattgctgagtcctatggtaatgttaggttgacttactgaggaaccattaaactgttttcaacagtggctgcgccgttctgcatccccacggcagtgtgtgagggttctgactttacctcctcacaaacgcttcttttccatttaaaaaatattcagccaggtgctctggctcacgcctgtaatcccagcactttgggaggccgtgggggcggatcacctgaggtcaggagttcgagacgagcctggccaacatggtgtaaccccactctaccaaaaatataaaaattagccgggtgtggcagcgggcgcctgtaatcccagctattgggaggctgaggcaggagaatcacttgaacccgggaggcagaggttgcagtgagccagatcgcgccactacactccagcctgggtgacaagagtgaaactccatctaaaataaaacaaaataaaaataaataaaaatttattaaaacattcatcacagccagcctagtgggtgtccatgtggctttgcctcgcatttccctgataactaggatgctgagcgtcttgtcccaggctgccacacctcagcactttgagatacgtcgcacagtccccatttgcgaacgagaaatgagtttagggaacagcagctgtgtcatgtcacacagcgagcagggggtctctgagccgtctaccccacagccgaccaagctccaatccttaccgcctcctagtgttgtggatgtagcccaggtgctcccacatttttcagatgagaacaccgaagctcaaaacaggagcgttttgtccaattggatacacgatgtctgtggtttggtcctgaagtcactttatatctcagtggtccagctggagtaggacagggggttctggggaatggggaaggtgtctcaggtgaaaggaaggaatccagattctccatactgtccttgggaagttagaagactcagagggtctggcaaagtcaacaaagcaagagaaatgcagtcaggaggaagcggagctgtccaggaacaggggggtcgcggagctcacccccaggaactacacttgctggggccttcgtgtcacaatgacgtgagcacgcgtgttgattacccactttttttttttttttgaggtggagtctcgctctcttgcccagctggagtgcagtggcacgatctcggctcactgcaagctctgcctcccgggttcatgccatctcctgcctcagcctcccgcgtagctgggactacaggcgcctgccaccgcgcccggctatttttgtatttttagtagagatgggatttcactacattagccaggatggtctcgatctctgacctcatgatccgcccgtctcggcctcccaaagtgctgggattacaggcgtgagccccgcgcccggcccgatttcccactttaagaatctgtctgtacatcctcaaagccctataacagtgctgggttgctatagggaatatgaggcttacaggccatggtgctggacacacagagggacggaggtcaggaggtagaagggcggagagagggaacaggcggaggtcacatcctggctttcaaaatgggccagggagagacaccctctgagcatggtaggacaggaaagcaagttggaacacattgagagcaaccgaggtggctgggcgtggtggcttacgcctgtaatcccacactttggaaagctgaggtgggtggattgcttgaggccaggagttcaagaccagcctgccaacatggtgagaccccgtctctactaaatatacaaaaattagccaggcgtgatggtgatacctgtaatcccagctgcttgggaggctgaggcaggagaattgcttaaacctgggagcggaggttgcagtgagccgagatcccgccactgcactccagcctgggccacagagtgagctccatctcaaaaaaaaaaaaaaaaaagataaaaagaccaaccgaggaattgaagtggggggcgtcacagtagcagaagggggatcgtggagcaggccaccctgtggtcatgcactggagctcattacctgacgatttggagctcatcactgggggcctaaggagaatagatactgaggatgaggagtgatggcgcggggcacgggtgtctttggtggccagaacttggggactgcggggtgcctcactgcaggccttctcagcgccctttatatgcttacacaggctgtttctagagggggatacattgcataagcgttttcagactacctcatcatgggtccctttctttacctctgtggccctggtggcgcactctctgggaaggtgcaggtggatgcccagacccgcccgccatccacctgcacgtccagagctgacttagcctcgagattgctgctggcacctcctgcccgggacacctcggatgtgcccgtggagatgctggctctgtgttttctgctggagtttgtgcgtcttttcctcctgcaagtggccaccgctcttgggtatgtcctcaggcttctgcggtcatggctgcttctcaggtccttgcccagcgccaggagcaaaccctcctggcactttgtcaggggtggatgcgccagtgttcctgctgtggacccccatctcacatgagggtcttggcctgcaggctcgttcaggaaacacccgctgagtatgcagtgtgtgccagctgtgtcccagcaatggcggggacagtggctgctgctggggttgtggtggcttctggggactctggggaagctgaggtgcaaggagccacggctccttgaggatgcagttggactccaggtggaagggtggttgggggaggtataaatggggtcagggaggagacacatttggaacaatgggaacattttaagatgctatgtcgggaggcaacaaggtggccaacccaggtgctgaggagcccacacagccctggacgtgttttgccgctcacctttgctggggagtggtgggagagaggattccttccacgtggtggtgtgcgcagctgggctgtgtggagctgggcgctaggaggaaggtgcttctgcggggctagccgggctctgcctttgaacacaatcaggctccaggttttcagcatcagtgcatgagaggacttcacgggcagctgtggctgatcccttgatgaattgggagaagacaaaggtctatgaaatgaggtttcatgtagatggcattagagacgcccacaacagattacagagtggagcggagacggcggatgggtctgggaggcccctcctgctggccttgactggacagctgtcctgggaatcagcttccaggccgccccagcagcctgactgacacacacagggttttagccccatcctgcgaccagctgttgccatcatcagtgacagctgggagtggcgtggttccagccctgggcaccctccccacctgctggggcccacccagggcagtcctgacactacaggttgcttggagccgcatccgagtcctgccccaccacgtgtgaagcccgagtggcgtgggctgaggtcccctgattgcatccccacttcccttctgcttcacatagctgcctctctcaccgtttttccagcctcctgggctaggaattccagtgttgtgctggctttgccccggacacctccttagccctcttcctgagtctagagccccgggggttggaagttctggccctgggacacctgcagccacactcagcttctcctgtgagcctccagcatgtcccctcaggacaagccctcacgttcttgcctccccgcccacctgggctcagccaggggaaggcctggctggagcgtctcccctctgccctgcccttctcccctctaccctgcccttctctcctctgcccgccatggcttttatatcctgtgccacaagacatggctgtgtgtgaaagtggcagggtcggcatctctgtgggtctctgaggcccacgctccagtgccactcttcccacccgctggcctgccctcatgctggagggacagcccagccctctcccgaaccccagccccatgtgcccagtgcccccggccctctcccctggaagccggggtcactccagccgtatgccatggtggggaatcctgcttccttggccttccagggaaggtcctctttccaaatggcgacacctggtcccgcctggaggctggaagctgtggcccttgtatgcccctccagggtctgtgcgctcggttgcccgagttcccatcaccgtcgtcatcatcaccatcatcattgtcatttcgcttgtctgtagccggcctggtctcccagagcagagaccctctgaggtccagcctgagttggggtctcctgctgacccctgacggggactcaggacgtaccaggtctgggtcaggagtgacccccaaactcgtgccctttgacaggcacccctgacttttgctaagtgggtggaggtgacatcacttcagcgggagtgatgggacagggtctgttggctgcactgtgctcccagggatctggggagggctatatccctgggctttggcactgcagagctgtgtgtgtttgtgtgtgtgtgtgtgttgtgtgtgtgtgtgtgtgtgtgtgtgtgtttgcgtgcgcgcacatgtgtataagatcttttttattacatgaagcaagataactgttgctgtttccttttgggttttgtgttcaacaggtggggtacttcttccctcagacaacagaactctcccctttaaacacgtgctgtcagaggtgggtcttgggctcatgtctgtttgcacagccgagtcagaggaaacacagggttcttctaaaaacactgcacagcaggcgactgtccagagtcagcctgcaggacggcagcagccctcccctcagagcacagctagggtgggctgctttgggatctcccgtcattccctcccagctgcagccggcggccggcccattccttggtgtgctggtcaggggggcgtgcgcctgctctgtcaccctgggaatgggacagaagctggcagctcggagaggacagggctggacccttgggggcctctggctggaccatctcattgtcctcagacacagcctctcgggtctagtttcattcctgaaaaacaagtgcacagaactagagcaggagtcgagagctacggcccccgggccagtccagccctgccacctgttttcacaccatgctcaagctgagtgggttttacattttttattacttgaaaaaaaaaaagccaaaggaggtttcatgacccatgaaaattatatggaattaaaaaaaaaaaattatatggaattcaaatttcagtgtccataaataatttcttgagacaggtctcgctctgtcacccaggctggagtgcagtgctatggcatggctcgctgtacccttacctcccaggctcaagcgatcctcctgtctcagcctcctgagtagctgggactacgggttgtgccaccaagcccggctaatttttttttaattttagtaaagacagggtctttctatgtgcccaggcttttctggaactccatcttggcctcccaaagtgctgggattacaggctcggccacggagcccagcctgtttttgttttttcactgataaagttttgccgggtgtggtaggtgtgcctctagcgatttgggaggctgaggtgggaggatcgcttaagcccaggagtttgggctgggctcaagtgatcaggaggtgaactatgatcatgtcattgcattccagcctggggacagagcaagaacctatctcttaaaaatatatatttaaaaagtattgggtgtggtggccacgcctgtggtcccagctacttaggcatctgaggtgggaggatggcttgagcccaggatttgaggttgcagcgagccaagatcgtgtcactacactctagcctgggtgacagagcccgaccctgcctctttaaaaaaaaaaaccaaaaaacatgtattggaacacagccatgcctgtcagtcacgtgctctccatgctgctttctgctccagagacccttatggcctgaaagctgaaatattttctatcctttacaaaaaagtttgctgacctctgtcctggaaaattcatctccaagttctcttccggcactggcgttcctgggtgtcctaaatttggcccctgttatttctaactctgttttggctctgttccctcccaggagccaggacaggcacgttctctgcatctttcccctgacgcccagaggcttggctcggctcaggcattcttggaaatatctggctccagaaaggcagaggcctcctgagtcggcccagagggaacctgccccaggtctgggggaggccgacccagcagagtggcttttgccgatgggttgggccggtcaagatgtgctgaaagttgtctcagaaggccactttgggattccttcctccagtattagagcaactgagagctgctcatgcaagcctgatgttttcccagttggccgggtccaccgggtgccctgggattctgggatcgggtggaaagtagggggcttgggggagtgtcctgggttctggaatccaggtggcaagtgtgaggttcagggagtggcttctgagccaccataggggtctctgtgggaggctctgcccaccaggagattccgcaggccctgccggcccagagccagcgtcttgcgcttgccgaggctaagccagccccagccgggtggaacagcccgtcgcctcctctcactttgttttggggccactgggagtgtggagcaagggtagagagggaggaagtggctgccggccgctgcccagcaccttgtttgccttgggccctctgtgggctcctttttattgctcttcaatgaagccagggaatggacttccttgcctcacttcagttcaacatgtctggaagtttggtattaaaattaagaagtgtggaaatagagcaagaagagaaaaatctctccaagagataatagtgacctctgagtgggcgcggtggctcacgcctgtaaatcccagtactttgggaggctgaggcgggcagatacctgaggtcgggagtttgtgaccggcctgaccaagatggagaaaccccgtctctactaaaataaataaataaataaataaataaatacaaaattagccaggcatggtggcgcctgccataatcccagctaaggcaggagaatcgcttgaacctgggaggcaaaggttgcagtgagcaagatcacgccattgcactctagtctgggcaacaagagtgaaactccgtctcaaaaaaataaataaataaaaaataaaaatagtgacctctggccaggtgtggcagctcatacccgtatcccagcactttggaaggaaggccgagatgggcagattgctttagcacaggagtttgagccagcctggccaacatggtggaaccccatctctacaaaaatagaataaaatttaagaggaatagtgaccttttggtagatcgaaacctggattgctttctttttctaaatgctgattctttctttgtggtgtttgtgttctgtgccgatgtccctcccccagccctgttattgtgagggaagaaggggaaagggttcgcccgctactgtgagcccctcctctcacgctgggtgtcctggagaagcctgcacttcttcattgtacgccagggctgggtccctccctggagtggttcgtgctgctgggatggggccaacccctcagatgttttctgagtgtcacacacaggtgtgtcattcatggcctttgcgtgtcttcctgttgtggaggcaaaaatgtgaagaaccctagatattttgggaccagggctccatcacctgctgttcattgcacaccggagcatccaggcatggtggagagctcagacttccaggcacggtcgcaggggctggtctaaccatgttcccgccccctgctcgtcagaaccgcctgttgggagctgttatcatgataccatacctgggccctggctatccgattctgacttaattgctccaggttggggccaggccgttgtttgctgttttgtgtttcttctgtgacgttagccactgggctaatctgagcccctcagttacaggtggagaactgagacccatgggggtgcaaggacttgccgaggacccagagccccttgggggcagagcgaggcggggcctggctttgggtcccagagcttccagtccccttcccgctctcctaacagttttttttttgagacaagatctcaccctgtcacccaggctggagtgcaatggcatgatccggctcactgcaatcttcgctagctgcgttccagcgattctcctgcctcagcctcccgacagctgggattacaggtgtgtgccgccatgcccagctcgtttttttttgtacttttagtgagatagggtttcaccatgttggccaggctgatctcgaactcctgacctcaaatgatcccctgcctcggcctcccaaagtgctaggattacaggctgggatcacactgtgcctggcccagcagctttgtcctgtgccatccaacaacagatgaccgaagtctttgtttcttaacatgattccatctgccttacagttttgccacctgcaaaacagaggacttgtcgcttttctggtagctggaaatgtaatctggtagcaggaggcctgtggaagcttgcctttaatggccttgttctctttcatcctgtcctgagagccggagaacttggatgttgcacctaactcaaccttctgttaacatacagttctgcaggctcatggatcatcagaaccacgtcctatctcacgcggtgtatgcttccgttggttcaggtgtttttaccttgacagtattttctcctcggtggctttgcggtggttgcttttaatcagcattgactcttcaagaaaaatatttagctgctacatccagaggagacagggtggaaagcatctgagacctgcaggctcagacttagaaccagaagtccctcagagttcatccggccctgacccagcgggaaatgagttcacagagaagcgggagactttgccccaggccctgccgttgctcataactgccccaggtccttacatttgctccaggcctgccccaggccctgcagttgctcataactgccccaggtccttatatttgctccaggtctgccccaggtcctgcagttgctctgtgtggtgggtgtgatctggagccctccgcccatgctgcacctggggcaggcattgctaattgatcccaggactccttcctgcggagcacgcctggttctccaggcagccgctgcctgtcagcctgcagtggttcgggagaggacacctgctgcctggtctgttccaaatcttgcttctcatcccagcacaggtagggggtgctatgggaagggatcctcagttggccctgtcactgctctatcagctggggacgtggcatcctagtgaaacatcatggccgggcgcggtggctcacgcctggaatcccagcactttgggaggctgagggggtggatcacttgaggtcagaagttcgagaccagcctggtcaacatggtgaaacccattctactaaaaatacaaaaattcgccaggtgtggtggcgggtacctgtaatccgagctaccgggaggctgaggcaggagaatcgcttgaacctgggaggtggagcttgcagtgagccgaatcttgccactgcactccagcctgggcaacagagtgagacgctgtctcaaaatctcaaaaaacaaacaaacaaaaaacaaacaaacaaagcgtcatttatccagcacccctggggaacatgctacctggtgttttatggtacctggcaaggtgcaggtgaagttgctgctcttgggcttgaacccgtcttgtttggggcagctcaggccccaggcagggtccgggttggctctcgtggtgtggccctggcccatccagacctatatttctgccgtcctgcaggtgatcaatgttgtgggacgaagaggcggaccctcctggaggacaagctcccgcacattttcgggttcacgcgctgggggacttcatctactggactgactggcagcgccgcagcatcgagcgggtgcacaggtcaaggccagccgggacgtcatcattgaccagctgcccgacctgatggggctcaaagtgtgaatgtggccaaggtcgtcggtgagtccggggggtcccaagccatggctcagccatcagacttgcatgaggaggaagtgacgggtccatgcctgggcataagtgttgagctcagggccccgacctggggaagggcaggacaggaaaggtgacagtatctggccaaggacagatggaagggaccaagggagctgattagggagtggttatggactaggaatgtcggtaacaatgttagaaagtgactaacatttgttgagcacctgctgtgtgcccggccctggccgggagcctcgtgcccacagtgaccccgtctgcaaatgtagttccttgccctactcgcactggggagaggacgcagagccgtgcaactcacaggtgccaagctcaggactccctcctgggtctgccgggctgggctgtgcttgttgcccctgtggcccacgcatgtgcaccttccacctgaaagcaggatcttcaggacgctccccgaggaggtcgttgtctggcacaatgatttgtctcttccgaaaaggtgacagagttacactggagagagcagcatccaggtgcggcagggacaggcctgggctcgcgggcagggactctgtgtcctgccggggtcccacactgcacctgcttgtcagggcactcagtcaatctttgctgatgaaggatgagaggacagaggacgtgatgcttgctgtgcattgcctgcagtcctgggtgagatgcccgggttgactctgctgcccgtcgggtggagtgatgtcagatccccggctttaaaatacgagggagctgggaattgagggagcaggttgggcagaaagcacagccccgtggaagcctggagctgaggcagtgtgggcgacccctggagagtgagtgcttccttcatggccttcatcgcaccctgcagtcctcatgtaggggatgccaccatgaatttagttttcccagcctcctttaaaaacgcgttcatgctggggccggggcaggcagtggctcacatctgaaatcccaccactttgggaggccgaggcgggtggatcatgagtcaggagatcgagaccatcctggctaacaaggtgaaaccccgtctctactaaaaatacaaaaattagccgggtgcggtggcgggcgcctgtagtcccagctactcgggaggctgaggcggagaatggcgtgaacccgggaagcggagcttgcagtgagccgagattgcgccactgcatccgcagtccggcctgggcgacagagcgagactccgtctcaaaaaaaaaaaaaaaagtaaaaaaaaaaaaaattagtctgggtgtggtatcacgcgcctataatctcactactcgagagctgaggcggagaattgcttgaacccaggaggtagaggttgtagtgagcccgtatcgtacactgccctccacctgggcaatagagcgagactctgtctcaaaaagaaaaaaaaaaaaaaacatttatgccaggtgtggtggctcatgcctgaaatcccagaactttggaagactgagcaggaggatcacttgagcccagaaatttgagagtgtcttccctgggcaacatagagagactcatctctaccagaaaaaaaaaaattagcccggcatggtggcatatccctgtggtcccgctacttagggggctgacgtggcaggatcacctgagtctggaggcagaggttgaagtgactgagatcatgccactgcactccagcctgggtgacagacagagaccctgtctcaaaaaaaaaaaaaaaaaaagcatttactatccaccatggaaggtgagactgacctgtgagtgattttcaaagaacaaaaaataaaccccagagataagacaaaagggtgcctccatgggggtgtatttaaagctgagaaattgggcttcttccccctcccctctcaccccgtggtttgctaaagagatgggaaaaaggattctttttttggctgaaatatttaacactaaattaaagccaatttaacagcactttggttgatgagtgaaattaacagactggccaaaaataaacgaacggttgtactatgtgaaaaagaggcagctttggccatgctgggccaatgtgagttttcagggtgctgggaatgtctgtgaatcggaggaagggcctagctgggactctcaggagccaaggcctgaggggcaacttgcctggtccctgccctgaggcgttcactgctttcttcctgggccagtcacaggcccggaggctggaccactgggctggcactcttgccgagctgctccctgacttctgaccatgctcctttcagcagccttgctgcactttagtttccttgaatgaaaaatgggatgagaatagctcctacctccaaggtgaatggagtgagttcggacaggtgactccctggaccagtgcctggcgcctgacaaggtccagtcagagcccgcactgctgttactgataccctggctgtaccaggggagaacttggttgccattgccaggtgttctcccaccacccccactctgtccctgtttgatgtgtggcgggaataaagctgtgcacattggagcttttggcacatctggctttcaggtgaaaggtgcgtgtgtgtttgagggtttagcctggccaacccagccagaggtcggacctgacctgggggtgagtcctgagctcggcacccctgagctgtgtggctccggcagcattcattgtgtggcttggccgcacccctttccctgctgggctgttgatgtttgactggagcctctgtgttcgcttccaggaaccaacccgtgtgcggacaggaacgggggggcagccacctgtgcttcttcacaccccacgcaacccggtgtggctgccccatcggcctgagctgctgagtgacatgaagacctgcatcgtgcctgaggccttcttggtcttcaccagcgagccgccatccacaggatctccctcgagaccaataacaacgacgtggccatcccgctccgggcgtcaaggaggcctcagccctggactttgatgtgtccaacaaccacatctactggcagacgtcagcctgaaggtagcgtgggccagaacgtgcacacaggcagcctttatgggaaaccttgcctctgttcctgcctcaaaggcttcagacacttttcttaaagcactatcgtattattgtaacgcagttcaagctaatcaaatatgagcaagcctatttaaaaaaaaaaaagtgattataatgagcaagtccggtagacacacataagggcttttgtgaaatgcttgtgtgatgtgaaatatttgttgtccgttgagcttgacttcagacaccccacccactcccttgtcgtgcccgtttgctcagcagactctttcttcatttatagtgcaaatgtaaacatccaggaaaatacaggaagactttttttttttttttttgagacagagtcttactctgttgcccaggtggagtaccgtagcgtgagctcagctcactgcaacctccgcctcccaggttcaagcgatcttctgcctcagcctcctgagtagctgggactacagacatgcaccaccacacccagctattttttttatatttttagtagagacagggtttcatcatgttggccaggctggtcttgaatcctgacctcaggtgatctgcccgcctcggcactcccaaagtgctgagataacaggtgtagccaccgttcccggcactaggaaaacttttgccttctaaagaagagtttagcaaactatctgtgggctggccttctgattctgtaaagaaagtttgattggtggctgggtgcggtggtcacacctgtaatcccagcactttgggaggccgaggtgggcagatcacctgaggtcggggttcgagaccagcctcacccacgtggagaaaccccgtctctactaaaaataccaaaaaaaaattaaccgggcatggcggcgcctgcctgtaatcgcagctactcaggaggctgaagcagagaattgcttgaacctgggaggcggaggttgtggtgagctgagatggcaccattgcacccagcctgggcaacaaaagtgaaactccgtctcagaaaaaaaaaagtttgattggtgtaccaaagcgcatttgtttatggattgtctgtggcagcttttgttctgccgagatgagttggacagatctgtatgggctctaaagcctaaaacatgtgccatccgcccctttacagaaaagtgtgctgacctctgttctaaagtattggacaactacaatgtttgctcatttattattcatgatttgttttctgctttttgttgttgttgttgttgttgagatagggtttccc

SEQ ID NO: 5049 - DNA, 24742 bp, Homo sapiens
gcagttacccccatgctgctgttctcattattgtgagtgagttctcatgagatctgatgttttataagtgccaggcatttcctctgcttgcacctctccttcctgctaccatgtgaagaggacatgtctgcttccccttccaccatgattgtaagtttcctgaggcctccccagcctgcagaacagtgagtcaattaaacctcttttttgttgttgttgttgttttgttttgtttttttttaaataaactaccaagtcttgggtatttcttcattgaggtgtgagaatgggctagacaccttttctatattacaccatgctcttccacggtatgaatgaataagcttggattcatggccaaactgggagtcagaacaaagagggaaaaccctcttgcctgcaatgaaccatccttgcctatttattcatgaataaatagacaaaaaggatttttctacctcaggaaaaaacaagtgtttactgcaacaagacttcctttcaaatccacttgctatgactctgtccttctctttgcttgaactagggtacatgaatctcaatgtaatatagggatgtagaaaagtataagaaagccccagaataatcaatagacctctagtaagatagtcacattgctcaatatgcaaagtgacaaatactctaagatactcactacatgttaaaaataaatacagatatattgttcaggatgtattcatcaactacttaactatgtatctacccatgcatttaataactgtgagcatataccaggcctccattctcatggagtttgtattctactggtagaggcagataataaagaatgagaaattcaaagtaatttaaaaaataacacaggaaaggtcatagacattttggtctgggaggagatggcactatgtaggctgattacctgtgagggtgcactcactcacctcttgacttgtgaagaacatactgaaatgtacagggtgtttgggaggaaaataatgagatgcacgggcagtacttaatgtgaagacctcaccatagagacaggaattaagtcacctggagccagagaataccctttatgcctttgcttaaaagcaccattttctgtactatataccacaagacattggtccatggcacattaatggattctggactggtaatgggtgtccaaggataaaaggggttgaatgggtcaaaaagttgggaaacattgagtactctatctcctttcatagatgcaaataaacattagtctaatacatgttctaaggagtccttagaaaataaatctgtttttcctgtttaactatttgtttcttttacttacctgaacagagcttttttttcttcctagtaaaaactgttgttgtatataaggtaccactgattataaggtgtaccattactttatttgccctaagaaagaaaaaaaactctgccaattataattgtactatattgtcaattatatgagaccattctgctttgagaggtgttgacatgaaaaaaacatgaaacttaaaaacttgagatgttggatggaatgaggtttggtttttagatatgtcaggttaatgggaccttttttaaaatactatgcaatggaaattataggattctaaggttgtggcataaatacaacctgctgatcacagaattttgtgttcctcttccacagtatagtattggtgctgtgaagtggtgctcaccataagtgtgtgtgtgtgtttaagttttgggtagggggaagagccttgaagcttagaagatgagatcccttgcaacttggtattgtgttgggtctagttttggtcaaatgcaatgagagcgagataatgcatgtcacttctgagcagaggtagttaaatacatgatatcatcccctacttcttcacattctgcagtaaacttggaggctgcatgttgaatatgaaagtataatgaaataaagaagcctagaaccaggaatcatacctggggtaatccaatcagaaatatcctcattggtgtttcatgagccaggaaaacttttattaagtcacaataaaatctggaagtttatacacaattagcttagtctaacacttgtcagttttgtgcatatttcttacagcatatgcattactgccaaataaaagcaaacacttctaggtccctggcgaatatgggattcctccattgacgactgattatgggtcctgagttgaacttgctctgcatgaaggatgtaggcgatcaagtgcttgttttgcctctggccaaatctctaccactatgcttaagatgcgattaattatgtacacaaacccccatgacacacgtttacctatgtaacaaacctgctcatcctgcacatgtactctgaatgtaaaaataaaagtaaaaaaaaagaaaacaagaggtggttattattctactggggagaaattataggcccataatggtaactaatcaccacggtcttacctcattataatatgcatcggtaagttcatcaacataagcaagttagatctgataaccaaggggcttacagttctaatttgtatttgacacatggtctgccttctggaagagcagcatagaacctagatgttttgattaaggtcagtaaatgattgagtgttaatcccattcatttcccaggaaaaggaacctctttacaagtcaccaccagggattctccaatcacacataggaaaaatttccaggaaacttctataaaacacatgtattaacatctccgaaaacatagttgaaaggacttccctggcccttttccttagttcctcatctagactatcaagcggtttcctctccaaatgatgggaaaaagtgcatttgtctattacacacttgtattactctattcacttaagcactgtgtcccataatggggtctagttatgtctggcttgaaatgacccacatatttgtttctcattcttagaagtggagtgtttctgtatgtgtatatgtgatgggggtaggccaggagattttttatctggcaatacccagcctgaaatcattattagcatgacatgagttaaacgtatttctattttgaaagatgttttcaacagcaggatgaagaatcaattggaagagctggtacattgaaagagtgaatctagactttgggaggcttcttaaagtatattgaactagtctaggccgtgggattgttcaatagtaatggtagtagaaatggcgactgacattttggaattattttacagataaatttctacaacttggtggaacattttttaaaatgtaggttttattattcggctatggtaaaacaacagatcagaagatgatgccactggaaatatagtttgttgtttacagttcctagaagcgggggcatgccacaccatgcagggccacattggtagcaccagagtccgtcaggagcagagggagcaagaggaaattataggcacaagcttttattgttgttactgcagaaaagcaaggcaaggcagggtaagcagggataggactggctagtttgaataacctcagtgggcttggggtagagggtctgtctctagttgtctggtacctggacctgtgatgattagggctgataacagtgtctacttgggtgtaaaagccaggtagaggaggtggttcagaggaagggctcggattgcttagtgtgcataaggcatgctccagagcaaatcttttgctattttttagaacaactagccctggtaagtgcagtctcttcccagatgccagaacatcaagaacacagaaaaaagacaattgggttaatacatgtttagcatgagaaatgaggaagtaagggaaataaagtaaagagatttccaccttggatgactatgtcaaagtgaaacaccattaactttccagggactaaactttattgagcacctactctgtgtcaggcactgctctaaaatctttacatgaatatctcaatactcagagcaaagctttgacatggaggttgtttttatcttaactctactgggtgttgatggagtctacaagagtttgtgcccagtccaccacaaaatggtccctcacagctggtttttgacacgttggattggaagtgcttggaggatattacagtagaactatctaggcttagcatacataatattcctgttttaaatcaggttcttatttaacagaaacttacattcacttgctactttccagacactgtcctaaaagctttacaaatgccagttcatttaatccaatacaatactttgagatacatattatcatcttcattctatccacattttcaatcctcacatagctctcatttatggaatgtaatgatgatgctctagactagacgttttacgtaagtagcttaattcagtaattcaaaacacatgcgattatcttcgttttaaagaccagaaaactaaggttggtaggtttgtataatttgactaccattgcgtatctttattttaatacatttttaaatgcaagcttctgctatgattaaaagtgattaccacattttacagaccagaaagtataataagtgttggtgaagatgtgaaaaaatgagaactcctgtacaccatttgtgggaattaaaatggtacagatgctgtggagaatcatatggtgggtgctcaaaaaattaaaaatagtttaccacatgatccagcaatctcacttctgagtacgtatccaaaagaattgaaaacaggactttaagagatatttgtacaaccatgtttatggcagcattattcacaatagctaacggtggcaacaatgcaagtgtccatgaacagacaaatggataagcaaaatgtggtctatactacaatggaatattgttcagctttaaaaaggaaggaggctttgatctatactacacagaaagaaccttgaggacattatgcaaagtgaaataagccagtgacaaaaagatacatactgatgattccacttctaagagctgcctagagtagtcaagattatagagacaaaagtagtgctagattcaagggcctagggaaaggggaaatggggagttatttattaatgaatagtggtgtgattgtacaaaaatatgaacataattaatgccactaaattgtacacatacaaatggtcagataataaattttatgttatgtcatgttatgttatgtgattttaccataatacagaaatgaaaaaagaaaagaaagaaagtaaagcttagcggtttacatgacttgaccaatgcctcaagccatgagtcacccagctgagatctgaacttcagtatattccattctgaaatcccagcttttcccaatcttcttgtacttttcaaactgtgtttcagttgaggtttattttcagtttgtatgtgagtttcttcacaagaaggggcgggccaaattgtgtcctgcaaaaacctacaatcgaagtcctaacccctctacctcagactatgactgtatatggagagagagccttgaagaggtatgtaaggtagaatgaggtcattatggtgggccctaatccaacataactggtgtcttataagaaggggagattagaattcagacacacttgctgacaccttgagttcagactgaagcctctagaattgtgagaaaatgaatgtctgttgtttaagccacccagtctgtggtattccttatggcagccccagcaaactaatacaaatagtgtttccacagctgaaacaaaatggaaaatcaccgtcatcctagagagttacaagggctattttaatagaacctgattgtttcctaaattcaccaagcccaggcagaggtcagatgactaattgggataaaagccaactagttcctcttgctgtttctttagccactggtctgcaggcgttttcttcttctaacttcctccctgtgacaaaagagataactattagagaaacaaaagtccagaatgctaaggttgccgcttcacttcctctcaccctttagcccagaactgctttgaatacaccaattgctgtggggcgctcgaggaagagaagacaccagtgcctcagaaactgctcggtcagacggtgatagcgaccacgcattcacagggccactgctgctcacagaagcagtgaggatgatgccaggatgattctgcctcgcgcctggctgggactctgatcccagccatggccttcctctcctgcgtgagccagaaagctgggagccctgcgtggaggtatgtggctggagtcagctcctctgaactttcctcacttctgcccagaacttctcactgtgtgccctggtttgtttatttttgcaaaaaaaaaagagttaaattaccttaaagactcaagaagccacagagatcaaataattcattgttcagggcactagaggcagccattgggggtttgttccatttggaaattttgagtgctaacagggcatgagataacatagatctgcttaaggtccctgctctgctaccttgtggctctgtgagaaattatcaaacctgtctgagactagttttcgcatctgtaagagaattataatacctcttcactagagagtaagcagactgcttcagtgtcatttcttcccactggtggtctttacctcagcttcaagcagtcaccctgctcctttcaatctcaggaaaaagatggcttttgtgttgtgtctctagagaaagaactttctaagtgggtgtcagacttctgtatgcagtaatatatttagtccagaggatgaaaaaaataagagaatgaaaaaggaaaagagagagagagagaaaaaaaagcaagagggaaatatgtataatgtcagctaatgcaacagtttctttcttagtgaataccaatcagctggttggtaatcttattcatgatggatctcttttgtttttcccctggcagacttcacagttgctttagaaacccatagtagagccgaacagctaagaaaatgattacagtgaggcagggtcagaaactcaagagagaaaaagccagctgcagtcctgaagttgagatataggagaaaatcaagtaatatttagcaaagactaattcattatcttgaagccatccttccctcaattccctgcccatagtcctcctccttgtcctcttctctgtatccctctgcgttaggttaatggagatagattttctaattaggctcactgcgagataaaaccacagccaacttgacttcttttccccatgtaccttttcctgtcagtccctgaagcctgtccatccctcccatccccttagttccactgtaaggcaggccctcatttcccctggcattgactcttaccactaactgctttcctgattccagtcttcttcctttaactcattctgcacgttcttgttgttatgtacttgcatttgttgttattatttttccttaggcttcaatctaacaaattacttccttaaaaacttttaataactctccattgccattagaacagctttctaccacagggccttgcactggctatttcttctacctagaatgctagatcagtgctatccattggcaatatttgtgagccacatatgtacttttaaagtttttagtagcctcattaaaaaaagaaacaagtaatttaatttcgataatagttttatttaacttagcgtatttaaaataatgtttaaaatttaatatatatttacctattattgatatttttacattccttgtttggtactaagtctggatttagtatatattttacatttaccacacttctcaatttacactattcacatttcttgtgttgataactgtgtatggctagtgactaccgtattggtcagtgcagcccaagtccttttctgctttaatcactccattcagatctctgattaaatgtcccctcctcagggcagtcttcctgattgccccatgtagagctctccagcctcacttatttgcctcaaatccccttatactgttaatatttttttttctagagcacaacattttatatttttgtttgtttattttctctcttccctttgtaatggaatcggtaaggaggcaggatcattgctggttttatttaccactattttccagtggccagcacacagtagccgctagatgtgtaagtgataaatgattgaaataatgctgcaggacaaagtctgaggccctcctgatctggcttgccctcttacttagatttcacactcccaccactcaccagctaatctgagtttgttttccactctttacgtgctcacgtttcctctccttaggacatgtttttcttcccctttccacatatctaaaccttactcatcttcaagacccactttaaaatcttccttttctgggaagcctttcctgaatccagacttgatcctgctttctctgaaccacagggcatattttctaagcctattttatggccccttgagatatgttagctttgctcctatctaaactcttactctagactgtgagtccattgaagtctggactgcatcatatttttctttgtaatgcccacagcacttggcaggaaatgcctacaatttgacttaagtaaaccttcatttaatcagttattcaatcagttagtgattcagcaaatatttttgagcaccaaccatttgccagacaccattctgagtgctggagacaaagcagtgggcaacccatcaaacttgcaatggaatacaggagatgaacaatacgatgagaacaatcagatagcaacataatgttagatggttgtgcttcctgtgaaagggaataaaagagggcaaagaaaggtgcctggcactgtttctattagacaatattgtctttgaggctccatggcttgcaacattaagcagacatacgaatgaagatctgcatgtttgaactctgactttgcgcatattacttatttctttgaatttccattttcctcatctttaaatgcttatttgaagattaagtgaaagatataacaaacaagaactatgcaggcgtatggtaagggattaatgatagatgataataataatgttgacatctattgatcacttatactgtagcgggcttttaaataaactctttaaaaccttatctcatttaatccttcaaacattctattggtttcaaacaacagaaaactacaatagctggcttctgcaaggaattttgttggaggaaatgagagcattcagaaattagatggagcgttagagaattaggcttacaaagaatgtgggaaagtaggctagaaagcagtgtaaaacaaagacagcataaagcacttgaccttatttactaggttccaccatgggaatccatgcctctaaagatttccccctatttctacatcactttgctcaagggtcaatgagccaaggaaagaatgcagttgtcaaaatctgggccatgactaaggaaggtctggacatcttgactgccgacagtctccccaatgatatggagtatttagaatgatactggatattttatttatttttgtattttcaacttttaagttcagaggcacatgtgcagagcatgcaggtttattacataataaatgtgtgccatggtgatttgctgcatagatcatgaaaatatggaacgcatcatggattgtgtgtcatccttgtgcaggggccatgctcatcttctctgtatccttccaattttagatatgtgctactgcagcaagcacgatattggatattttattacctacattttacatatgtaaaatgaggctcactgaggtttttcttttgttcgttttattttgttttgtttttaaagcttggccctaaaccacacagaagagctggcatgaaacccagagctttcagactccggagctcagcccttcaccccgattccattgcttcttgctaaatgctgccgttttatcacggagttagaatgctgagcacgtagtaggtgctctttactttctaatctagagtaagacaattttaagcatgaattgagtgaatggatggatggatatatggatggaaggatggacagatggagaaaggttgactgaattttgtgcttgcacaaaaagaggcccctctccaccatctctggttaggagaggggagttgggagaccatgcagtaaagatacttcatgtcatgtgtaatcattcaggtggttcctaatattacttatcaatgcatggagctgaatttctacaaaatccccgaaacctccccttctcaaccaagaacctggacctgagctttaatcccctgaggcatttaggagctatagcttcttcagtttcccagaactgcaggtgctggatttatccaggtaatgaatcacttttacatactgcacaaggtgaggtgttcattgtcctatcatttcattattggactgaaagcttggtttgtggagtctcatcttcattcacttattcattcatacaacagatgtctattaactatataaccttgagcaagctacctctattctccaggtctcagttttctaatcgtgaagtaggcagttggctgagacagcttctaagggcaattctaattttaggttttctttaagacaggagagaaaattagcttaaattctttcataagcagctatttattgactacttctatatgttgtacactctgcaagaagacaggcatatattgatatataacacacagccccgttgttaaggaggcatatcttcttgaaagagttaataccttaaagtcctgggtatggtctgggtacatagtatatagtcaacacattttaattatgattttttggatctggaaactgaataaagatagcgacatataacagtaggtgataaattatgtttaaactaaaggtaactaatgtatttttcagaagaggggccttctctgtggtgggtagtcaagaaagatttcatgaacgcataagattcaaacaatgtctagaatattaaaactagtgtacaggatagggaattaggaaagacaagtaacccaaggagaaagatgtcaagattaaaggaaaacatctgctgtgggcgggaataatggctaagattttcttttctgatgcagggaagtatatcgtttgttgtggcagtgaaatgtcatcttgatattttaggggaaccaaattctaaaagggttttcatcatcgggccttatttgcaaatcgaactagataatggatcatgttctctgcaatggtttgtaaaactttcaaaacattttacatattttttattatagaaattattgataaagactaaggtcacatataaaaatcctttttagagcagacatttctgtagaagagtgaacatatgacctattatctctaatttggatatagataggatgtaacaaaggagtaatggaacaattcaaaggcagtgtatagtgcatagagtcctgttggggtcagaagacctgagccaagtttacccccaacattataaccatgtaaccttaggcatattacttcatctcccttaatcttagttttcatatctatcaatggaaatgatgaaacttattctgctggattaaatgtgataataaatattaatatctgtatatatttaaatttttataaaatatattttataagcataaagtattcttacagaattcattaggtttttaaaataatttcaacttttatttttgattcagggatttacatggtttattgcgtaatgctgaggtgtagggtacaatcgataccatcactcaggtagtgagcatatacccaatagttagtttttcaacccttgctgctttctctctatcccctctctagtaatcccagggtctatttttgtcatctttatgtccatgtgtactccatgtttggatcctacttaaaagtgagaactcatggtatttggctttctgttcctttgttaatttgcttaggataatgctactagctgcatctatgccattatgttctaaatttcagtttcctgcatgaaaattttgcaagtactctattaaggtagaccacctctccctttttttttttttcaaacaagaagtagttttcaccaaacaatgtctcttatgtaattcatcttcaatccactggatacccaataaattgccccagaaaccttaaatctgtgcttacagagaggccagcttcccttcttgttaaccataggagattctgaattagggcaagcacaaaagatagcacaatagacatcctttgcctttcgtacagtgttcacatacagtaactcaactagtcttgtaagaatgctttgtgatagacaggcagccttctttcccctatagaaatatatatatatttctttttataggtgaggaaacgaagcttgaataatttaaatgacttatatacattatcattgcttgttagccacagaccaagatttaagttcacatctccagaatccaacttaaatgttttctttgtcttaatactctattctctaaagtgattatcaccaatgtaatgatatagagacacagcaagaccctttcctttcacctaatgtatagagcaatgcagagatagaatgatgggctataacaatcatataattaaagaaagaacttcaaaaataatcaagttcagctgtttgatttataaatgtgataactaaacctagagaggaaaagaggtactcaagatcacacagtaggagaggactgcagaaacacaaacccaagctcttttgtccactcttccagcgttctttctactatactgcctatccttttctagttaccaataaataacaaaagcttggaccacaatgcttttattgtctaggaaactctgaagaagctaaataaaatgggtggggaatattgtaaatgtaattcaggctggattaaaaagaacttatttgtacattgtaactgacaagcacctgcaatgctgaaaggaatttttcttggcttgctgtttgctggctgcatcaaagccctgtctctaggacatgtctctgaacatgtgtgtagcatggctttcatttcttttaggataaaattcaaaaccctttatctggttggaaacctctgcctaattgggaaccttctttctccacaactccatattgtacactccaattcatctctgttctccaaccatggaagctatttgtcatgattcctccttgtgtcatttttttctgtcaaccttggggcttttgtgtttgctgttcacttcacctccttttattgttaactctactcatctttcaattttcaacttaagtgttctcagagaaacctactttgattttcttgtccacaacggttctctggatgtgaactcttatagcacataattttcacttttttccacaaactcgctcctatcacctgttacaagcatttacctctgataacaagaactttcaaatactagctgtcatgtaagcacttttcataaacattaagagtatctgtgacacttatgtgtatgtttcgtatctctgaaattgatatttaccagtcatttatcttggctaccaactaacaatatccatattatctgtaccaatcagatgtataatcacaattttgtgtgacagaaaatggtaaacttgatccaaggctattacatgctttatcaactgcacaatctttatatatgtcaatattgatctttaactgatttccttcttatggattttctcctctgcttatcatgtatgccaacatgacaaaaaagagcctatcattgcagccagtatgataatactcagtctgtggggctcttatttgcttattccatcatcatctgtcctgcttgatgtctttgcctatgcacaatctatgacccatcacatctgtatgaagagctggatgactaggattaatattctattttaggtcttattcagcagaaatattagataatcaatgtctttttattcctgtaggtgtgaaatcagacaattgaagatggggcatatcagagcctaagccacctctctaccttaatattgacagaaaccccatccagagtttagccctgggagccttttctggactatcaagtttacagaagtggtggctgtggagacaaatctagcatctctagagaacttccccattggacatctcaaactttgaaagaacttaatgtggctcacaatcttatccaatctttcaaattacctgagtattttctaatctgaccaatctagagcacttggacctttccagcaacaagattcaaagtattattgcacagacttgcgggttctacatcaaatgcccctactcaatctctctttagacctgccctgaaccctatgaactttatccaaccaggtgcatttaaagaaattaggcttcataagtgactttaagaaataattttgatagtttaaatgtaatgaaaacttgtattcaaggtctgctggtttagaagtccatcgtttggttctgggagaatttagaaatgaaggaaacttggaaagtttgacaaatctgctctagagggcctgtgcaatttgaccattgaagaattccgattacatacttagactactacctcgatgatattattgacttatttaattgtttgacaaatgttcttcattttccctggtgagtgtgactattgaaagggtaaaagacttttcttataatttcgatggcaacatttagaattagttaactgtaaatttggacagtttcccacattgaaactcaatctctcaaaaggcttactttcacttccaacaaaggtgggaatgctttttcagaagttatctaccaagccttgagtttctagatctcagtagaaatggcttgagtttcaaaggttgcgttctcaaagtgattttgggacaaccagcctaaagtatttagatctgagcttcaatggtttattaccatgagttcaaacttcttgggcttagaacaactagaacatctggatttccagattccaatttgaaacaaatgagtgagttttcagtattcctatcactcagaaacctcattaccttgacatttctcatactcacaccagagttgctttcaatggcatcttcaatggcttgccagtctcgaagtcttgaaaatggctggcaattctttccaggaaaacttccttccagattcttcacagagctgagaaacttgaccttcctggacctctctcagtgtcaactggagcagtgtctccaacagcatttaactcactctccagtcttcaggtactaaatatgagccacaacacttcttttcattggatacgtttccttataagtgtctgaactccctccaggttcttgatacagtctcaatcacataatgacttccaaaaaacaggaactacagcattttccaagtagttagctttcttaaatcttactcagaatgactttgcttgtacttgtgaacaccagagtttctgcaatggatcaaggaccagaggcagctcttggtggaagttgaacgaatggaatgtgcacaccttcagataagcagggcatgcctgtgctgagtttgaatatcacctgtcagatgaatagaccatcattggtgtgtcggtcctcagtgtgcttgtagtatctgttgtagcagttctgtctataagttctattttcacctgatgcttcttgctggctgcataaagtatggtagaggtaaaacatctatgatgcctttgttatctactcaagccaggatgaggactgggtaaggaatagctagtaaagaatttagaagaaggggtgcctccatttcagctctgccttcactacagaactttattcccggtgtggccattgctgccaacatcatccatgaaggtttccataaaagcgaaaggtgattgttgtggtgtcccagcacttcatccagagccgctggtgtatctttgaaatgagattgctcagacctggcagtttctgagcagtcgtgctggtatcatcttcattgtctgcagaaggtggagaagaccctgctcaggcagcaggtggagctgtaccgccttctcagcggaacacttacctggagtgggaggacagtgtcctggggcggcacatcttctggagacgatcagaaaagccctgctggatggtaaatcatggaatccagaaggaacagtgggtacaggagcaattggcaggaagcaacatctatctgaagaggaaaaataaaaacctcctgaggcattcttgcccagctgggtccaacacttgttcagttaataagtattaaatgctgccacatgtcggccttatgctaagggtgagtaattccatggtgcactagatatgcagggctgctaatctaaggagcttccagtgcagagggaataaatgctagactaaaatacagagtcttccaggtggcatttcaaccaactcagtcaaggaacccatgacaaagaaagtcatttcaactcttacccatcaagttgaataaagacagagaaaacagaaagagacattgttcttttcctgagtctttgaatggaaattgtattatgttatagccatcataaaaccattttggtagttttgactgactgggtgttcactttttcctttttgattgaatacaatttaaattctacttgatgactgcgtcgtcaaggggctcctgatgcaagatgccccttccattttaagtctgtctccttacagggttaaagtctagtggctaattcctaaggaaacctgattaacacatgctcacaaccatctggtcattctcgagcatgttctattttttaactaatcacccctgatatatttttattttatatatccagttttcatttttttacgtcttgcctataagctaatatcataaataaggtttttaagacgtgcttcaaatatccatattaaccactatttttcaaggaagtatggaaaagacactctgtcactttgtcactcgatgtcattccaaagttattgcctactaagtaatgacgtcatgaaagcagcattgaaataatttgtttaaagggggcactcttttaaacgggaagaaatttccgcttcctggtcttatcatggacaatttgggctagaggcaggaaggaagtgggtgacctcaggaggtcaccttttcttgattccagaaacatatgggctgataaacccgggggacctcatgaaatgagttgcagcagaagtttatttttttcagaacaagtgatgtttgatgacctctgaatctctttagggagacacagatggctgggatccctcccctgtacccttctactgccaggagaactacgtgtgaaggtattcaaggcagggagtatacattgctgtttccgttgggcaatgctccttgaccacattttgggaagagtggatgttatcattgagaaaacatgtgtctggaattaatggggttcttataaagaaggttcccagaaaagaatgttcatccacctcctcagaaacagaacattcaagaaaaggacaatcaggatgtcatcagggaaatgaaataaaaaccacaatgagatatcaccttataccaggtagaatggctactataaaaaaatgagtgtcatcaaggatatagagaaattggaacccttcttcactgctggagggaatggaaatggtgtagccgttatgaaaaacagtacggaggtttctcaaaaattaaaaatagaactgcatatgatccagcaatctcacttctgtatatatacccaaaataattgaaatcagaatttcagaaaatatttacactcccatgttcattgtggcactcttcacaatcactgtttccaaagtatggaaacaacccaaatttccattgaaaaataaatggacaaagaaaatgtgcatatactacaatgggatattattcagcctaaaaaaagggggaatcctgttatttatgacaacatgataaacccggaggccattatgctatgtaaaatgagcaagtaacagaaagacaaatactgctgatttcatttatatgaggttctaaaatagtcaaactcatagaagcagagaatagaacgtggttcctagggaaaaggaggaagggagaaatgaggaaatagggagttgtctaattggataaaattatagtatgcaagatgaattagctctaaagatcagctgtatagcagagttcgataatgaacaatactgtattatgcacttaacattttgttaagagggtacctctcatgttagtgttcttaccatatacatatacacaaggaagcttttggaggtgatggatatatttataccttgattgtggtgatggtttgacaggtatgtgactatgtctaaactcatcaaattgttacattaaatatatgcagttttataatatcaattatgtctgaatgaagctataaaaaagaaagacaacaaaattcagttgtcaaaactggaaatatgaccacagtcagaagtgtttgtactgagtgtttcagagtgtgtttggtttgagcaggtctagggtgattgaacatccctggtgtgtttccatgtctcatgtactagtgaaagtagatgtgtgcatttgtgcacatatcccatgtatccctatcagggctgtgtgtatttgaaagtgtgtgtgtccgcatgatcatatcttatagaagagagtgtgattatatttcttgaagaatacatccatttgaaatggatgtctaggctgtttgagatgagttctctactcttgtgcttgtacagtagtctccccttatccctttgcttggtggatacgttcttagaccccaagtggatctctgagaccgcagatggtaccaacctcatatatgcaatattttttcctatacataaatacctaagataaagttcatcttctgattaggcacagtaagagattaacaataactaacaataaaattgaatagttataataataattgtaataaaagttatgtgaatgtgatctctttctttctctctctcaaaatatcttacgtactgtactcacctattttcagaccataactgaccatgaaacctgggaaagtgaaacttggataagtgaggaactaacatacatacatgattgtttatctacagatgtatgcctcagttcttagtatgcttgaaaatgtatgattttgtgtatatccgtgctacatgtaagtgtggtctattcatatttgaatatgaattctgcataagtgtgtttattcaagcaaatgtacaagctctgagaaggaagatcaacatacaacttggaatatttcaaggccgaaatattcaaggcgacattggcctccttcctatcagttccctctcccagatggaaattctagaaatggcagggaggtggacaagcagggaaagaaattatatgcatagaacagaaggagaagaaagagtaagtcaggcctcagccagcctctttttagctctttaaatcctctggatttaagagggataagggtggaataaggataaattaatgccaattgtaatgccttaaatttgtgtgataccttaaacttgaaacatattcacaaaactatatatttgaatatctcattagctgagtaaggtagaaatcataattaactttttccattttattgatgggaaagctgaagttcaatgaagtaaattttcaatagcccacagagtaggaaagtgacaaaacctgagcctgggcctccaggtcaccaaggacactttctttcttccacacccaattgcttcatgcttaaagttggcaaaacaggagtgaaactcctgcagttttctgtgtggttgacactagcaagggtttctcagttgaagcatgaatcattaagccaatacatatgcatatatgttatacataccaaatgatttatttataccctatctttccataaaggacttgaaggagcttcaaacaaaggatatgtgaacaataggttaatcaataataagtagaaaatctggacatagaataaaaagaggagagaaagacaccagaatgagcgttaatacagtgctttccatttttctggtgttttgagtagcgtggcttttgagaaagccaaaactcaaattcactccttatcaactgtgtgccttgggctccatttctcgagagtctacttagctccaatgtaaaataagaatagaactatgactttgtaaggttgcttaaggattgaaaatcatgtattatgttcaatacggggacactgtccttatgggtgagtatcccctaagactttattaagagggcactaggagaagcactgggaggtcttctcagtaacacactaaagtaattgctatttttccagcctgtggaaccacagaagtgactgtaactaaattagacatttctttctgattcattctctactcacgggattgtcagaccccagtcttctttggactctataaactttttagaaatcatcagcaggctcctggagaagcttaaatgaactacacaatatgtgacagtgaactccctgggagagtgaaaaccaaagtctaagccagtgtcccatttacttgtgtgattgtgggcaagtcattcaagtgctttgaggctcaggtcttaatcatgaaatggaggtaataataccttgttggcagacctcacttggttaaaatgataatgtgatagttacaatagttacatttaattgatcaattgttttatgcaagggctttatttgtgtatctcagtttgtcacatcaatgaattagaaagatacgaaagtatttccaatttacaaagaggagtctgagtctgggagtcattctgtcatgtgtccactgtcacctgctcattggtgcagcactgagattaggatctaagtccacttcaccgcagaagcagggcttctaaatactgtctatggcaagagcaccctgctctcacaaaatgcataaaacttcctatctcaccattatattttgactgatattaaacaaagagaagtattattattattacttgtttttatttatatacagctgtaagagccaggaaaaatgtgatctaagttatgtgatcaaagattttttaacatgaacaaatcaggcccactagatgatggcctttctttgaacaacatgcctagggttgcttatcatgtctacagttggtctgacttcctgacgggcatcacagacttgtgattaaacacgaggttatgggggaagttccaaaagcttaggactttccagatggttggaataagatcaccactctggctgcccttatggagatcaccgaacttttcaactcaaagtaaaatctgtggataaatggtcgatcaaaaggaaccaactatattgagcaccatgcgtgatcatctgatcgtactgctaccttgtgagttaaaggctactcttctcattttagaaatgagaaaagagatgccagagaggacgagtaacttgccttaggtcacacagcttatattaatcacaataacatttccgcaccttctgtattttttttaagttgctaagcttttggtgcatgtctggcaccgtttagttgtatattatttcatttaattgttaaaatgaccttctgatgcaggtatttgtagcttgccattccacagatgaagaaacagatgaaaggactgaattgttcaataggaaggagcaaatcaggatatgaacttgggttggcctgattcttggggctgcattctttccataacatattgcttgctgtgatgtcctgggctactctgccaggggtggttagtggagtgaatggagataatttagacaaggtcagtaactcccatgccatctagaaattaaaagtttaaaaggcaggtctgcaactctccttgatttctacagaaataaagatgatccctcctgtgacagtgctagtgacaattctgagtgtaaatgcgctttttggcacaaattgtcctgtcctaatagtcttattataattataaaataatgggtttctgaaaggctgcaagcagttctgggaatggcaataaggtttagaaatgacgtgatgtttatgagagaagtgttttgttgaaaattaaactcactttaggagaaaggattgtgttgtatgctcctaggaaactatctcactatgtaattaaataaaaccagccagttaccaatttgagctcttgactcatactaacaacaccccatttcccagggccaagcaaggcaggactgacctgaaataacccagcctgactctatccacagccacccaggaccttgcccctccgtcttcctagggctcggccgtgagatgctagtgcatgaccctcctcttcctgggactgtccttgtctttccctttggactctgggaggtctgttctcctcccagaaaggaataaacactctttctatttgtgggattccctaggagacactatataaaaaatagagttaaaaaaactatttaaaaaaaagacaacttcatgtctctactctgacttcatctttttaagatgggtaacaaagactctcttcaaggttagaaaattttattttaattttttagatttagagagtgcaaatgcagttttgttacatgaatatattgcataatggtttagttgggctgttagcgtaaccatcaactgaacagtgtactttgtacctattaggtactttctatcccttaaccccttcccacctttctgagtcctcaatgtctgttatttcattctccatgccatgtctacaaattatttagtttccactcataagtgagagcatggatggaactggagagagtattttctatcccaagatcggttccttgatcttgtgtctccaaatcacttgctctcctcttacatcttttctatcttcttctagcctctttttgcaaacttcattttgacaaagattccaggcagtctacagctgattttatttcaatacaacgattaaaatggaaaccatatagaagatgacaaagttgagcaggtcccaaactctcacttttaaacaaatgcttggcttaaaatcacttaatgactttcattctgctatctatgtgtctgtgtatctaggtactaattattatctttatgatctttattgctagaaattctggttcaatatcagaggttagtcctaaggatttatattttaaaatattctcccagttttcgtgcacagacagatttgggaattactgtataatggaaaatggagaataaccacccacatttaatatggttattggttttgttcttgaatttattgctaagattcatgatagcccaggcaaggtcagataatgtatttttattttacctgtatagttgattcttctcaatcccactagatcagactctttgggatactaggattggctatttgatggtgagctcactacatccatttagatgttgtgtccatgcaatcattttagtctcctagtttctacctatcacgttgtcattttcccttctttatcatcctgggtagctggaccccacataaatatataccagaaaaatgttgtggtcttttctaaactctctgaggcactgttgtcaatgtgatgttgttttttgtttccagtccaaaatatatcaaagtaaaatttactccacttttgctaagtattcatcttgccttgagtactaagattccaaaaatgactttccctctgaaaaacacaggatttccttgcgaaaacttgctgggccactgccaatcttcccgaaactcctttttccttatcgttgaggggaattggggaagtgatcactgacggttgaaatcagtagttttggtctttaagctgagaccctgagtcttctgaggagtctactgctccccgtgggaaacacctgctgtcaaaattttcctgcttgcaaagagcacttttgaaattaatgcaggggatgaatatctggctagtgctgtgctcagctgagttattaatagggccttctgatcctctctacacatcatctttggctgaattagctgtggtttcagcacctgagagtctagaccactaaaggcagggaatacctttgccagtttctggcatattaacagctgagatcagaaagtgaacagcgatagaggtagtgaggtttaggattcaggtctgccaccgggagcgcactctgggctcaggtctctcatttgtaaaatgggacatttaggtcagatcagcattttcaaagtgtgacatgttagtaaataagatgattttatgtggttgacagatgaatgtattaccttagtggttatatgtttattttcatggttacttttatttataataaattttgtgactagcaagaatcaattatctctttaaaatatatttaagtttaaaatgtgggccaacttaggaaaaaacgggatgaaatgaattatataaaaggtatgcagatttggaaaaattttgaaggtgtacaagaaagattggcagtcagaaaggaatgaaccaaacggctgctgagggtcaggccagtctctgacattctagcatgttcacatctccagggctgtttccttacctataaattgtggaattggagtaaatgtccattccaggaattctattctatgattagaggtgtaacttcatctccagattttccagcatccttaacatgtggttttagcgttctaaacctgatgatgctattcaaaacgggagactcattcgtcaagtcatgatgtatccatgtatttataatatttccctgttccctcatttctgaaaaggattaagctatcaaccccattgagttataggtgaaaggtgtggaaacaagacattgata

SEQ ID NO: 5050 - DNA, 22751 bp, Homo sapiens
cacacactggggcctgttgcggggtggagggcaaggggagggagagctttaggacaaatcctaatgcacacagggcttaaaacctagatgatgggctgatgggtgcaggaaagcaccaggcacatgtatacctatgtaacaaacctgcatgttctgcacatgtatcccagaacttaaactttttttaaaaaaagaaacataaacattaaagcagaaatgaaaaaatagagactaaaaatacagaagatcaacaaaacaaagtgttagttttctgaaaagataaaatgaacaaacctttgctagactaagaaaacagagaagatcgaaatgaataaaatcaaagatgaaaatgaacattaccactgcgtattttttaatccatttttgacgcttcaacctttcctgtttcatgcgagatgagatcatcaccacatcctactctagtcaaataagaaaatctaatcttgagttaaaatttattaaaattctttaatgatagaatttcttttctatggacactgaaaaactctttctactgctatataccaaatatttatgtcccccaaaaattcatttgttgaaaccttatcccagtgtgatgctatttggagatagagactttgggaggtgattaggtcatggggctcgtccctcatgaatgggattagtgtccttataaaagagattctagagagctcccttgcctctcctccactagagaacacagcaaagatgggcatatgtgaagcacaaagcaggccctcaccggtactgaatttgttagcactttgatcttggacttcccagcctccagaattgtaagaaaaaatttctgttgttcataagctacccagtttatggtattttgttatagcatcccaaacaactaaaacaactatgtaccaagaaactgatattttagttcccaggactatgccatgggttaattcattcattcatcaaatatttatttagtgactactgaggaaaagaccctttaatgactgtggatacaacatataaaaaacaaagatcaattttaaggtctagtagaacacatagttagtggatgagacagaacaaaactttaaaatacgtgaagcaaaaaaaaaaaaaaaatacagataagtagacaagtaaaaataatatttaaacatttaaaaaccattctttcaataatgataattagaccaaaaaatcattaggacaatagaagatctgaacaaagctacaatcacctcacccaattgacatttatagaacactccattccaatagagcaaaacgcacattgttttaagtatatatggaacatttatcatgatgggaccatatactaggacatataacaagtattcatattttaaagtactaaaataatatagtatattttctggacacacagaaattaaattaaaatcagtaacaaaattgtatctggaaaatcctgaaatatttggaaattaagcaacttttttttttttttttttttgagacagagtcttgctctgttgtccagctatttttttgtatttagtagagacggggtttcaccatgttggccaggctggtctccaactcctggcctcaagtttccaccaaccctggcctcccaaagtgctgggattacaggtgtgagccactgcaccccgctaaacaacatacttttaagacatgagccaaaaacaattacctaacaaaatttgtggtagcaggaaaatagcacttgaagggaaatttatagcttcaaatagttatatgtgaaaagagctttcacttatgaagtcaagataataaaagcagttaaactcaaaataagtagaaaaagtaataaaatggatataaatctctagctagactgatcaaggaagacaaataaatacaacaaatcagaaaagaaagaatataactacaggtcttgcagacagtaaatacatagataataaagagtattattgttatgggttgaactatgtcctccaaaaatgtatgtttaaatcataaccccatacttgtgaacgtgaccttatttggtaacagggttgttttgcagatgtaatcatgtaacatgagatcattagggtgggccctaatccaatatgactagtgtccttattaaaagagaaaccacatgtgaaggcagagatacgcagggagaaattcatgtgatgacagagtcagaattgaggaagaagctgaaagtgcagtaacaccaggtactgacagccaccactggatgctagaagaggcaaggaaaactccatccagagtctcagaaagagagtggtcctgttaacacctaattttggactcctggcctccagaacagtgagagaataaatctctgttgttttaagccacaaatttctggtaccttgttacagtagccctaggaaactaatatgactatgaagaacaaatgccaataaatttgacaatgtagacaaatgaaacaagtttcttaaaagacaaagattacaaaattgacagaagagacagaacgtctaaatggccctgtctgttaaagaaatagtattctaattaaatacattctcccagagaaaagctcaggcctagattatttcactggtaaattgatcaaacatataaggaaagaaaaatacaaattctgaaaaaaaaaactttcaaaaatagagcatattaaaaaatatcccaaatgaatatataagaccagtgtcttccctatactgtaacattaaaaatttttaaaaaatagaccaatatctggggccgggcgcagtggctcacgccttaatcccagcattttgggaggccgaggcgggcagatcacctgaggtcgggagttcgagacagcctgaccaacatggagaaaccttgtctctacgaaaaatacaaaaaacttagctgggatggtggcacatgcctgtaatcccagctactcgggaggctgggcaggagaattgcttgacccaggaggtggaggttgtggtgagccaagattgcgccattgcactccagcctgggcaaaagagtgaaactaggtctcaaaaaaaaaaaaaaaattgaccaatatcttttatgaatataacacaaaagtcctttaaaaattacccaattaagttcagcaacatataaggaatataattactgcaaccacatgagatttatctaagaagtgcaagttttgtttaacatgcagaaatcatcaatgcaattcaccatattaagtgacaaaatgagaaaggctatgtaattatctcgattagaaaaaatgtataaaaaatcaactcccattcatgataaaactgttaatatattaagatagaagaaaactgcctcaaaatgatctagagaatctgtgaaaaaccaacagctgacctccacatcacagtgaaaaactaaatgcttttctctgtaagactgggaacaaggaacgaatgctactagaatcagttctctttaacatggtcctggaggtcctagccagtacaatgaaacagagaaagaaaagaacgaaaggaaaagtaaaactttccatattcttataggacatgattggaacatagaaagaaaactcttaaggaatctacaaaaaaaaattgctagaaataagaagtcacttagcaaagtgataagatatgaggttaatttacaaactcaattttatttctataaataacaacaaatactttgaaaaatattttaaattccatttaaaatatgatcaaaaaataattttacaaaatatgtgtaatatattctagccaggtgcggtggctaacacctgtaatcccgcactttgggaggccaaggcaagtggatcacaggaggtcaggagttcgagaccaccctgccaacatggtgaaactccatctctactaaaaatacaaaaaaaaatttagctgggcatggggtgtgtgcctgtagtcccaactactcgggaggctgaggcaggagaatcacttgaacctagaggtggaggttgcagtgagacgagatggtgccactctactccagcctgggtgacaaataagactccatctcaaaaagacaaaaaataactgggtaatatattccaaaaaagtaccaaatgctcagagaaattaaagaaatgagaactaaatgagagataaatcatgttcattaatctagcactcaatattattaagacgtcaattctctcagattaatctatagagtcaacgcatcccggccaaaatcccattaggcatttttgaagaaattttgagaaaatggaagaacctgaatagccagtatacttttaaaagagaatggatttggagaattggaacatttgatttcaaggctactatgaagctatagtcattgagacattatggtactattacaagaataggcatacgaatgctgagactgaatagagaatccagaaattgacccacacaggtaggtcaattaatttctacaaaggcaccaaagtagttcaatgaagaaaaggaaagtctttttaacagcttgtgaaaaacacctggatatccatatggaataataatgaacctcaactttttctcacttatatggaaaattaacttgaaatggatagaagctaaagataaaactatcaagcttctagaagcattataggcaaagatttcttagctctgtgctcttaataaaggcaaagatttcttagctagaattaagaagcatgaataaggaaaaaatgatgttaggcttcattaaatttttatgtattatttttccataggttattggggaacaggtggtgtttggttacatgagtaagttctttaggatgatttgtgaggttttggtgcaaccatctcctgagctaaaattttaacacttctgctcttgaaagacaccattaagaaaatgaaaaggcaagacatagcctgggagaaaatattcaattatctacatctaacaaaggatttgtatccaaattatataaggaactcttacaactgtttatcagaagacagatgaacccaaattttttaagtgggcatatgaatgttttacaaataacatatggccaataaacccataaaaagatgctcagtatcattagtcttcaaggaaatgcaattaaaaatgacaatgagataccactagacagctactacaatggctacaattaagaagcacaatatcaagtgttgaaaatgatgaggagcaaatgtaatcttcatatgttgcaactggagagtaaaatgatgcaaccacattggaaaatagtttcgaagtttagaagtttttttataaagtaggccaggtaaggtgtcttatgcctgtaatgacaacactttgggaggccaaggtagagtattgcttgaggccaggagtttgagaccagcctgggcaacatagagaaaccccattataaataaataaataaataaaagtaaacatacacttaccagagggcccagcaatcagatcccaggtatttactaaaaagaaattaaaacctgtccacacagatacttgcacacaaatttcatggcacctttattcacaatagccaaaaactggaaacacatcaaatgtccacaggtaatgaagaaataaattgtggtatatctgtacaatagaatactacctagtaggaaaaagacgaaatgctgatacacaaaaccatagatataattcaaaaacatgctgcgtaaaaataagcagatacagaagagtacatgatgcattaaattctagagtagggtaaactaatttgcagaagaaagcacatccctggttgcctggggcaaagtgggtggcgaagggcagaaaggaactttagagatgatgaaaatattctatatcttgatttcatactgggtaagatatatatatatggtgtgtgtgtgtgtgtgtatatgttaaaacccatattcctcatgacttaaagtgagtgcttttattgcatgaaaagtataactcaataaagttaatttttaaaatgtcaaggtcaagaaaagcctaaagaactgtttcagattaaagaagactaaagagacattacaatcaaatgcatgaattatcctgaacatggatttttaagaaatacacataaatggcattattgggacaatgacaaaatttgaacatggattacagattagatcatagtactgtactaatgctaaatttctgagtttgataattgcactgtgattatataaaacaaagcccttgatcttggaaaatattagacaaagggacatgaagtcctcaatttattattaagtggaagatagaaagagagaaattaaagcagagcaaaatataaacaactagtaagtatgagtaaaggttatatagaagttcctgtactatgcttgcaactttcagtaagtttgaagttatattttgtagcaaaacaaatgtttaaaagatgaggtaacttctagatgggaagaaaaaaataactacattctagttcacaatgctttcaaaaccagaagatgctggaatgatttatcctattgataagaaaaaagacccagatataatatcagagttctctaactggttgtataggtagttctgagaattagaaagaataataattcctcagggacattaaaggaaggaacaaccactctcaaaagagaaaatctcctttctccaggaagaaagatggcatctgatctttaaagtcatagtccaaaataattttcttttcttcctgttcatctttatcttttgaagaattaactaagtcccacagttaaaagcaatatttataatcagaaattattatgggaaacaaaaaaagaaaacattccattttcacctttcttcttggcgcacaccgaatcagagaaaatagagtctattctcttcccacagatacaatgtacgtttgaatgcaatcaatagttgccattcttgttgaggtcaaaaatgcacattctctctcccagaagaaaaacgcattattgtagaattactgtagaacagaaaacatatgtagtaactgtttaattccaaagcttacaactgcataaaccatgattttaaaaaattctgctgctaaatgtctagaatatggaaatgcttatcataacttcatcactaaaatattttcttttgtcttagtccattaaatagaatcatgacctcttaatcacacccacaatctcccattttatccacaccgacaatttttggtcagaaggcaaaagtaccttgcaatattgcaatgaaattagatatattgctttcttgtgctaattttttttcaataaaagtgagagattaaaaaagaaaatggtggccaggtacagtggctcacacctgtagccccagtactttggaaggctgaagaggctgatcactggagcccaggagttcaagactagcctgggcaacatagtgagatcctatcctaccaaaaaatacaaaaattaccagattatcagggtgtggtggcacacgcctgtagtccagctactcaggagactgaggcaggaggatcacttgagcccgggaggttggggctacaggagctgagatcatgccactgcactccagcctggtgacaaagtgaaatcctgcctctaaacaatttaaaaaagagagagagagaggaattgaatatctgtaacatagataaccagggctatgtatatatattgtaagaagaaaagggaagaattggaatatagtcagagatgagattgtcgattgtgttttctctccgggaagaattggaatatagtcagagatgagattgttcgatgtgttttctctcctttcctcccccaccctatagctaagagttattagctaatgacaatttttgaaaaatatctaaagcatgacttctattttagcaaaatggttaagtgccagaactacttcctattaaaaacaatttaaaatactgaataaaaaatatgttaagccttcttgactacttcataaactgttaagaagcagattcatactcaggctgaatattaagtaaaggtgggatgcagaagggcaagtgaagcactgaagatcgtttttcccttaatggatgtagtaggctgaatgaattccactcaagatggagattctaagtagaagataagctacgtaggactgagaaccaaagggatatacattcagtataaaccacctagaattgtcttgaaccttggatctaagagaaaagcccccacttaagaactcaaaatcaaaaagcatccgtatatgtttgcatttgcgtattacttaagaaagttcaaatctgctacaggaaaataaagaaacaggtaaggaagataatgaaaccaagtagtttgtgaggcataggtagaactcacaagatgtgttaggtgtgaaaggtaaaattagtaacatatgagatgttagatatagatacgtaagtaaagtatgtgagcccgaacatagacaaaaaaagaagggaccaaatagacactaaacatacacaaaataaacagaggctcatacaaactcaacattcttgaggtcttaaattcaccacccattggtgataccattctggcctctgcccaagaaacacaaattaaatccacagctgctcatcagggtaactgaaacttacagctgtggccaggcttacacattcctgtaagagagaatcttccctgtagacaacatgtgtgtgctggccacaaaaactttgtgtctgttgggaccccttactcacacgacagatgtccccatatcatcatcaggagaggattatgcagcagagagagtcaggtcgtatgagactgcataacccaagattcacggttatgcacaacccaagattcagggtgatcccttcccctgcaccttatcccaagtgcatcaacttatcccatctctttccctttgaactgtgcttgggttttacattggtttagccaactgtgatttgatcatcttaatttggcctgtgagccttctgttctctgacctctggaatagtttgcctgggagtgtgcttgaaggatatgattactcaaggtaattccctctgtgtgacatcttttgcaggtttgcagcccagaactacaatactgcagaacccacacttaaaattataataattaggattttttaaaagtcaatgaatagttaaccataactaaatgtaaacccaagagtttactaataatgtacttcaaaatagaaggtcatagtgaaggtgtgtgtgtgtgtgtgtgtgtgtgtgtatgtatatataaaatacatatgtttatgtgctatgtatgtataaactaattacataaagtaactcaaaataaattttttgctactcagaatactcatttgtggttgtgggagggatcattatggctgacttaggatggtcaatcacttcataccacccaccttcctttatgattttatttcattttatgtacctcataaacatatttctgagcacgtatttagcgtgatacttttaaaattattattaactctttgtgctcatctcttccttttctacctatacttcctaaaacactcttacccattgttctaattgtactaaagactcctgcttaaaaatgagttaaactgtgtgaaatgagaaaagattctcttagacacaatcatttcacccccgcccccccaccaatgttacagtttgaatgctttccagaacttacattccaggagatgtgccattatcaatccatttccacttactttccctttcatctatgataatccaatccagtaattattttcataaatctgagattgaatgaaggcctataaagaaacaaaacatatcaggtgactaaattcccatctgttcgatgagtgagaacaaggacggtcaaggggccgactgtttctatggccagtactctgctactctccacatcatccttcacccttttccctagaaaaacctctcttccctagatccctgcctttccatttcccaaagtattttcccctcatattaatatagtattcatttatgttaaaaaatggctgtcagtatcactactatttaaaacatggaaaagtttaatatccaaatatctaccaataggaaagttgttaatattttataatgctttatgaaactatccaaaatcatgctccagaagaatatttaggatgagaaaattgatcaacacttaatcttaagtgaaaaaaggaatcctcaaaacaaatctattaaataaaaaggtgtgtgtatgataggggcgcagtaaaatcttaagccccataagaggaaccttgctatagttccatagttggaatgggtgaagtatttggaagtatttactatgtctaaatgtaatatatcaaagtgacatattacataatgtctgattaagtgactaaatatatttaaaatacaggtttaaatgtaacttttactgtatcatatgaaattatttcataacttgattcatgaattcttttatgctatgattttttaaacattcattagatttgcatatacatttttgttgttttcctaaacaataaataaaagtttcaggctaatctttgcaaacatacctctaaaaaacatattttgagtatttggataactttcattagtaacagtttttaaaaattttaacataattgttttaaaattcaatattgttatattcaatattgttatcactattattccgtttgttacactatatcactatattttctctttttacaattctgttttaaagatacacatctgagataatatataagaatgttaaaaaaaagaaaaagatctcaaaaaaaaaagaatgttagtggatgttacctatgaatgcaatgaaaatcactattgaggctaatttgtaaagctgtatcacttttacgttcctcattattatctccattttgaagataggctcggagaggttaaaaaatactagaggtcatccatctccctttctaaggagtctgcagtataaccactgacaggagatgatttgcaaagacccaaacagcatccttaataataatggtcatcataatagataagtattgaatatttagtaagtagtagaattatatgaccattagcaggcattgtttcctggagcctcttaactacatcatttttgctcacacgacagacacacacaaagaatagttgaagctctcactctgggctccagcctgtcttcaatatcttaggtccaacattgagaaacagagccaagagaataaaagtgaatgtaaaatacgagttcatctttgtcatctatcttcaaaaggatgatctacaatgttgacaagtctgtttacatcccttccagtctttcttctgcatggtaaataataacagtttactccacaacaggacccgtggtcttcagagaatttgcctacaattataaggtgaatcatcaaacttcttgtcatctggtattctgttaaccagaggaatatgttatcagcccatcataactaaataaaatcccaatagcaatcaataattataatacaaggtcatcaagattctggaatacaagagataccttcactccagtgtccaatgcagcattattccaatagccaagctatggaaacaacctaaatgtccactgatggacgaatggctaaagaaatgtgttatatacacagaacggaatattattcagcttccaaaagaagtaaatcctgctattatgacaacatggatgaaccttgaggacataatgctcagtgaaataagccagtcacagagaacaaatactttattattccaattataggagggatctaaaatagttaaactcacagaacatagaatggtggttgcccaggattggagggaagttcaatggtataaagtttcagtcatcaagataactaggttctagagatctgctgtacagcgtagtgccaatagttaatgatacttattgtacacttaaaaacctattaagagggtagatctcgtgttgttaccgcaaatacataataaatgaaaggacatgaggaaacttttggagatgatggatatatctattactctgatgtggtgatggtttcatttctgtccaaattcgtcaaattgaaaacattaaaaatatgcattttgtatatcaataatacctcaataaaattgtctaaaaacaataaaattgaattaagttttaaaaaagattctagaatgttttctaaataaaagaaaaattttaaaactttttcttttctcctatattttatactatattaaacttttaaaatactactcagcctttacaaatagagtggtaaatttctactaattatcatacctaaatgagattaaatatacaaaaattctttgtaactctaaatcctaaacaagtatttagtagttgttgattaaccgggtcaattaattccacattatgcaagataatagagtttactgtatgagatttaatatttttatatcttaagtgcttcaacggtatcatcgcacagagtcgcacaaacattaacactgtggcaaatcttgcagagtgctacagggagtacatactggtcacaaatagaccaaatatgtgaaaccaaggcagaaggaaacacacacgtgtgcacgacacacacaattatctttataacagcatccaaataaaacccttgtgcccattttagcacaaatatatttttactgaaaacctccatattctatgtcacaaaaagtgcaagtctttaatttgctcacaggaccaaaatgatcagaattttcaggggatttacatacgagttcatcttttgggagcattaataatgtaagatgtgccaatgaattttggaactgtaggcttttactaatctaaacatggatcctggggtcccaatcccacatttgaacaagcaaaacctccaagatacccacactacatctaagaggcacagattaaaagttgccagtagacctcagaggtcgctaatactatcataagcctgtttattaggcttcaaggattaggaggggaagaaataatgcaaaatcatgcaatctttcattcaagatttcctttgtaccttattttgcaaaactttaaaaacgatctcattttctctatgacatctgttcttttgtataggcgtgaatccagttcctttttctgctgaaagctatttttgagaacgtcatattttaaatcttatttgtcaaaatctgctcttttaagtagttgtcattttgcatgatgtacttttcatacagtttcttagaatttcctgccgttgatgtttttcttgaatacactgaaagactaaattaatggcatagatataatacaaataagtactcataataattaaatattgaaatttaagcaaaagaaaaaatttcactctgacaaccattaatcattactttaattagtcattactttattagtaatttgacatttagaaagtaacacctcaacgaactggccataaaaagggaaactaaatttctcaccattagcaacttaagtgtaggataaataacatatctgaataaaattagaaggtgacaccttacttctcagtttagtttatttttaataactcatcatttacaaatagcactaaagtaaaagtcagtttgccaacatttaaccacatatcttctgcatatgaaaattgaactaagaaagaaacatgaagtgatagcacaattattattggggcagatagactatcgcagcagaaaagagagtaagatccagatacgtaattttatctgaatataaaatatcagtatttttttcaaaagatatgaaggaattcaaacaaaaggtaaagcttgaatttaatattaataactgcatgtgtagattctttcttttactaaaccatttcgtcattacatactttgagaatgtcaagagaaagccataatttcttttgaacagttgtctctcaaagaatgtttatctagattcacaataatcaaacccaaatggcagaatacatgtattactaaatcctctatgagaggaatattaccatgtattatacacagtgagacagctcatcacagattcagagtcaaggtaagtaaattaaaaatgacactgtcatatgcccagaaaaaaattaccaacaaaggccaggccacctgggacattctctgattacagacggggaacaatggacggagcatggttaatattgcacaatcagtggttactgctgctactcggacgagaaagctgtattttattactcacttttgtcaccaacactgtgactatcatcagaagaagtaaacagaggatcccaagagtcacgcaatgaggtgccagggcactgaaaattctttaaatacaaaaataaggaaaataatcacaggggaagagcttggctcactactaatcttgacctgagaaaccatttgaaacaaagagaaatatcctctaaaactctgacaaaaatatatcacacaagtatatttaaatttgtaatctgaaattacatgcatgcattgtagaaatcccgcacacaggaatagttctataggatttaaaagtccatcccacataaaagcaccaatagcagtagacacaaaacatgtagcaaaatctagctaacgtgtgtgttccttcctgtgatcacaactaatcatgaagagaaaggaaaaagcatcaataatgctaagaaattagtagtcaatagtggatattctgaagctgcaaatgtggatggtccatctttgagggagtttctagaaatcaacttttctttctttttcatcaattctattttctctaaacaatgctatatttatcctttagcttttgagatcctcagtgtctgaaagtgtatctctgattatctctatattaaagcagcaaaagttattctcaatgcatagtttaacatgaccacatttgaagggagagagagagagcatagaaaaattagaatgccccttttgatcaaacattgttactgcatcattgccattaagatttggtaaatacttaaggcacataaaaatctgctatctgcataaaaatgttgtttttaacattgatttttcatttcttacacttccctcatacttttatttctctaggaaatgtcatgttttcttcagatctagtctgtcctttgtatcaaggcctcacaaattcttcttgaccacatttaaataaaaacattctactagtttccaaatttaaaagaattcactcatttctccattctcacaacttaaaacaaaaatacttctctactctgccccattatagtttcttatcaccagccaagaacaagaagtacagataggaacttttttcaaatgtcaaaagtttgacaatccataagaaacaggtgaatgtaaatgcttaaacgcatacctttgtcatcagttttcccaggcctttgagtatcatcaggccttaatctatctgtgactctgaaggagactgcaaaaatctcagggttgaataaatctctccctgatcatcatctttagagtaagaaggtaagttttgcattcaaatcctgaaataggatggtttctgtgaaagaaaaattaaaatgtcagccaataagaacacaccaggatttgatgctgagagattatgtgtgcctgtctgtgtgtctattggcgtgtgtttattaactaagtgcctaaagcattagagtgagcctcatttatagaagaaatgaaaaatctttcaatacttttgttaaagtcattatacttctagtgatcacagccatgataatgagaaaatacagaaatgatgagaaaaaatctaccaatagattattgttctattcacccagccaattttgctcaaaatattcaacataatatacaaatgttaggtaaaattgataccactgcaaatcactgaaacactttatgagttaacaaacaaaaaatctaataaattctggaaaaataaaaatatcttggcttttaaaaactacatgtattctaatatacatgtaaatataacaaagttcttgcattctttccaactatactgactctatcagagtgctttccaaaatgtatcgcatataccttctacaaaagaattattgagggttaatattgcaaattggttaacatgccagactcagtgccttttgcaagatgtacaaataaaaatcacttcggttggagcccagataaatgtattttaaatctcaaatgattcctgtacgttaaaattttagaaataatcttccggtatattgccagagaagcctatgtgaaataacagttgtcaacaggcagtcattaatgtccataaaagattctattgattaatgaatgcaatatagaaaagaataattaaatagtaaatacctaaaatttacttcttatgttagtcatataaaaagatgatatccaagaaatgagaaatatgaaaaaacaaattgcacatgtaacctattcttttctaatttttttaatttacaaaattttctaacctagtcacattttccctaattcctaagaaaaagaagtattttctattatagagtcattcaagatggataaaatatgtaatcattagacttaagtaaaaagtaattaacccctcaaatctctattctttattttgatacacaaagcaaaaatcacagcatattgagaaagagaaaataactttttgttaatactggatacaatttccttcaaagtagtgcagcattaatacaatcagtagcgaatgctttcctatctttctgttataatgctaagtcatttgtagttaaatgccgtatttctagaattagtaagataaggataatctggtagaaagatctgagaaaataaaagtggatattacctgtatctgtgtatgcagtggtgcaggtggagaaaactgatttcaaaatgagggagaagctggcctttcggtcctggatcccttaggggctataacatgaaaggcagaaataaattctcttcgaatgatctgtaactcaaaattttctgccccacctcttgaccaaagtgataagaggaaattgtatctgaaagctggtactgacgggaaaggaaagatagtcaaaagctgcatattcctctatctcactaaccaaccacttagtactctttgcaaaataatgttcaaaatcaatatttgagggctaaaagataaaattttgtacacatctttggagaaaataaaactaatatcattaacaaaaactaacgtactttagagaaactgctggtaaaagacattactgaaatgtctatgtataaaatatagacatataaaagaagtgtaatgattgaactacttagctcttagtttaaataacagctctctgttggaaatgttctcctatatgtcattattttttaaaagttcctttttctatcgtttatttcaagtaaatgtattttttaaattactttaaaagatccgtaattcctctataaattgtggcatatattcttccagttttttttctctgtatgttgtgcttactatcaaggtggtatcattccttacacagtattttttatttattattttctaataaataatatgtattcattatttcaaagaaattcatctgaaatgttattttaaaaatattactcacagggataaacatcatttatttaggcaatcccctactattggatacttaaattgttttcaattttttctttgtaaaatatatttggtctgtactttttttttttagggaaactttttaagcataaaatgtatgtcaaagggtatatgtatttaaagaactctaatatatatcaccaaatgccctccaaagagatgttccctttgatgttccatcagttgtgtgtgaaaatgtgcacatttgatttttaagaaaaagatactggcaaattatttctctacttgagttttcccacgaaatctcacttataaaatctatccctaaaaccttccagcaaggcctcacattttcacctatatcgaagactgaaaaaattcatttttgtcactccaccatgaggcagaccctgccagaatgtactcagactctcattgacttccacttttattggattcagtctttttcaatcttctgattacagttcaggaaaccaacttaaattgttcaaatcaggtgatagtggttaataaggagtgtgggataagaggcacagaacagcaggcgaaattgctgatacagggacatgtagtccctgaagtcggcacatcatcatgtgcaggccatcagatgaaacatctcccagaggctaattttactcaatatgtaggcaaagtttcatgcatggagtttggacgcttcaggaatacttgctgctgggcatttcttctttccctccatcctggattggcttcgtcaatcccaaatcagagtaaagacggccatatccctttatctcaatgccaaaataataaataaaggaagttagttctgtgagagagataggaagtgggtgacagggtcaggggctggggtgtagtaatagcggatgttgaaaagtgacagagatactgtcacgtattggagtacctcttgtgcatataaccatattaaaacctccaacattgacaagtattttcgtccccattttacaaatgaggaaactaaagtgaagaagtcattgacttgcataaggaaacattattgctaattcttcattcctgtttaaaatctggctgactgaagacagagcacaatggaccgtgaattcagaaggacccgggcttccaacaaggtcttgccacaaagcatgaatcctggaaccaggcaaatctggcttgaaatgctagcccctgctcccatgtgtgacttcaggcaagttacttcatttctctaagtcttgtattcaccatataaaatagtgatattttttgccatccaaggttgctatgagggttaaatgaggtaagatcatctcaaagtgtctaactacaacctggcatatatatggtgggctctcataaaatgttaaaattgttacttgaagtccaagattcaaattgttcttatctataaaaatttgaacaagtcaccaaatcctcaagcctcacttttctcataggttcaataaaagtatcacacgcttcatagctaggactaattaaatttagcactacagacaggatttcttacacttcaaaataagtaatgttttcttgtttgtttttcttcccctaaggttctaataggggaaacaccaggactgcatgcagaaatcctgacatgttatactgagccaggttctctatcctgccatgaggcttggctgctagtgccaccatcactctagagaaaccattccgtggctgcatatcttactgccccatcagatagatactggttatgttgaggcatgtttctgttttgatttacatccacatagctgggagaaggtgaatagttctcaggatggagactagacaagtgcagagcacaattttttaactttttacatattgtctcctctatcataatataaagtccacaagtctgtcttattcatattgaaactgcagcacatgtaagaggcatgatgcctacaagtgcacctcatgaaccaagggatcaagttaaaaggaactgactataaaatctagatttcttcatagttttgaaaagagcagaatgaaactgacgacgggaaagccaaattttctagctgctcccctgttttctctttttaccaagctctgaattgctggaaaaggcaaatttctcctttaaaggaaaacacaatcacaccagaagataacagtaacttcaaatgagattgaaactccctacctggccttttgattaagaggcacaaagttggaagtattaaactttatcacatccagttaataaaacagaagagaatatacagagttttgaatgttctggtactttgccttccaaattcacttttgtgcaaaaatgcacataacacacaaatatgaatatatgaagtattaatttgctcatcttctggctccttcctgcaaaagccctttttatttaggaaaccacatattttactcattcctttctgacctaccgttagctagaagcttagaacagcttctagtcacaccttcaaaccttcgggtcacatgtcaaacctcagtggtttatcatttcacagcagcacactgctcttcctgccccagactaaatgaaggatgtctggaaaaacccctagcatgcagggaagatggtctgaatcacttcatgggaggactaacctcacccagacaagttgccatctccttttttatttgttctaatgccaacttttatcccactgcatgacactgaacttcctggctcttatagtaaagaaaaagataaacgaggccgaagcaggcacaaggtcaggagatagagaccattctggctaacacggtgaactccatctctactaaaaaaaatacaaaaaattagccaggcgtggtggcgggcgcctgtgtcccagctactccggaggctgaggcagggaaatggcatgaaccccggaggcggagcttcagtgagccgagatcgcgccgctgcactccagcctgggtgacagagggagactccgtctaaaaaaaaaaaaaaaaaaaaaaatctctagcttgagattttctgtttccctaatcacccgtttgtctttcttgtctttacagtaaaatacattcaaatgctctaagtttaacatacatgtcccaactgaacctctagtaattgatcaaacagcaaccatccttcctcttatttctgaaaaccaaacaagagggccacctcaggaactaagttaactatgatgacataatggcaaaaaaaaaaaggattcccgatggcaatttaagagaaaatagttaagctgatctgtaattaagcttctgattcttaaattagtattctctccaccacatcacacagttcaaattaggacaagtagatgccagagattttgagtggtagttatccaactttactgatcatcatacggaagtcgccaaggcagattctgaactcaccctcaaatccttcatttacctttgttgtttattaaattttaaaattttctattcgacttcattatccattcatgctaggaatccagttattaattaaggggtcagtggttaaacttacagcacagtccatgctcataggttcacacatttcaaacaaaacgaagtagtctaacaatagaatatataaatcatctcagttacattaatatttacttaaaaatatccatacaaatagactcagcctgataccaatgaaataccaaagataaatatctaaaggcaaataatctaaggacagagcaagacagcaaccaattcaacaaacttaaaaacacctactatatggaaaagactgtgctagggttctgcactatctcatgaatggggaagggtgggatgaggtgcagacagtacttggaaaaagtctgattatttcaagtggtctctttttaaggaaggaggtaaaaggaacataacctgagcgcaataaaaatctagtttcatataaactagtattatacaaaattcagtttctaatgatcactgtccatcagcaacttacaatcaataaaagacagatcaaagtataagaaaattgtagacggtaatattttcctaatgacctatctcccatcttggtttaaatatgagaaattctagtagatagtggggatagagctaaataacgaaaacgtaaggaagttagagaacggggacaaagacttaaagatttttcaacgtaagactatttctcctcaaccttgttcagtttttaatggatcatcttattcaacaggagccacacctgttttgaggaacaaccaacaactgtgggcctactggaagttcaaaagacgattgtcctgtttctgaggttgacatctaaatgcaagaaaattacaatacgatttcatactgcacatcatcaaggtctacaactggaacagaaacattttacatacaaaagacctgaagatgatgcgtacttgcataatgaagtggaaatcatttgactttccatggcaaacctgaagacaatggcatgcattttgaggagtgaaaaggaccatctagtgctccatggcaaacaggttaccagccatgctctagagctatactgtccaaacggtagccgctagacacgtggctatctaaattaatcaaaattaaatagcactacaaaaaaagtagtttattggcaccaattacaccagttagtgaaaaaccaagatttattataatagagatattacagtaaaaaagatgttaagtataaatctaggtaggggtaggcatataggtgttcactttatagttctcaagagtttttaatgtttatccttttcacgttagaaaaaaattgtttaaatagcaccataaattcagttatacaggcacacctcaagtaatcagtaggcctcatttggccagttgctaccctattggactgcaatagaacgtttccattattgcaaaaaagttattggactgcccgactctagagcctacctctcaggagtcctggcaagccttcagaaactaattattccacccaaaattcagtgctaactgttcctagggcaagtggattataactactggaacagtgcaactttttaagagtggggctcagatggaagaataaaaggaaacaaggaacatggttactaaaagtaatgaaagaggaatctatcagaaagaggttgaaaggaactgggaaactgaagtgagactcgtggtcaatagggttaaaaatatttatgtacattcatacatacatatctgtttgtctaaatgtttaacaattataaagctgaaaactcatttagttctcccccctcc

SEQ ID NO: 5051 - DNA, 20304 bp, Homo sapiens
  misc_feature 18801, 18802, 18803, 18804, 18805, 18806, 18807, 18808, 18809,18810, 18811, 18812, 18813, 18814, 18815, 18816, 18817,18818, 18819, 18820: n = A,T,C or G
tatgtttataaccctgctatagtatgtttaacaagcacaaataccagaacttgtcctactgggtgataaagcaattacaaattgcaaaaaaaagagggaaactatgggagtagccctcaattatctccgaactgatttacccattcactcacctagaactgcattaaaaaacttaagcagaagagtattttattctcttcgcaaaaatttgttcttgtcagtatcaaattaagagagtaaatcaggacttatcctgattaacatttatctccttttacaactatcaaagaataaacaacagtataaatcctctttttgtgattatagtttcacattgtcaatattccctctattataagcttgaaataacttactggaataatcattcatttctaaacataaatgaaatacactaatacagtgatttataaatatatttggtatgcttagttttagaatacagtatagtatatttattttggagatttaattacagaaaaaaacttctgaatagataacatggttcaaaatcagcaagtgcaaaaagtatacactgaaagttcttgtccctttgtcctgcaaccctgaggtccctttgttggaagcaatcagtattacgagtttcttgtatatgcttctagagagttctccgattgcaaacaactgcaaatacttctgcacacctttgtttttacaaacactagcatatactctgcacattaccattataattgtactacatttttctcgcatcacatatgctagagttgttcccaacacggaacattgtgcacaaagagcatattcagtcatcttttacagccacgagcagtccactgtatgcagctatcatgatttatctaaccaatccctactaatggacattaggtgtttctaatttttagctatcacaaacaagtagcattagtatgctttaaaataaacaatacggccaggtgttgcgagaagtcagggaccccaaacagagggaccggctgaagcctggcagaagaacgtggattgtgaagatttcatggacatttattagttccccaaattaatcttttataacttcttatgcctgtctttactgcaatctctgaacatgaattgtaaagattcatggacacttatcacttccccaatcaatacccttgtgatttcctaggcctgtcttcacttaatctcttaatcctgtcatcttgtaaaccgaggaggatgtatgtagcctcaggaccagtgataattgcgttaactgcacaaaattgtagagcatgtgtgtttgaacaatatgaaattgggcaccttgaaaaaaagaacaggataacagcaattgttcagggaataagacagataacttaaactctgtccgttggtgagccgggcggaacagagccatatttcttttctttcaaagcaaatgggagaaatatcgctgaattctttttctcagcaaggaacatccctgggaaagaaatacacgcctgggggcaggtctacagacggtcccccgggcgtggccatcttttatggttgtagactgtagggctgaaatagacctcagtctcccatatcgctcccaggcttattaggagaagaaattcccgcctaataaattttggtcagacaggttgctctcaaaaccctgtctctgataagatgttatcaatgacaatggtgcccaaaacttcattagcaattttaatttcacccagtcaggtggtcctgtgatctcgccctgcctccatttgccttgtgatattctattacttgtgaagtacttgatgtctgtgacccacaacctattcgtatactccctccccttttgaaatccctaataaaaacttgctggtttttgcagcttgtggggcatcacggaacctacagaatgtgatgtctcccccagacgcccagctttaaaatttctctcttttgtactctgtcccttatttctcaaacctgccgatgcttagataaaatagaaaagaacctacgtgactatcgggcaggttccccgaaggccaggcacagtggtccaggcctgtaatcccagcaatttcacgagggagccaggtggatcagctgagcccaggagttccagaccagcctgggcaaatggcgaaatcttgtctttacaaaaaatagaaaaaattagccaggcatggtggtgcacacctgtagcccggctacccgggaggctgaggtgagaggatcacctgagcttgggaggttgaggctgcaggagctgtgattgcaccactgcactccagcctgggcaacagagactctgaatcaaaaaataaaataaataaaacaacataacataaaaacaaaaaacacacctcaaattaccagctaggtatttacgtttcagacccagatcaattgcaaaatcaatgttcagctctcctggaaaagtctcatgtatggacctgacctctatcagttgattgtcttagctcaatcttacaatttggttactccataagctcactcatttggttaagtaaacaatgtctacagttctaacaattattttactaaaatgcataattatgtgatagttatacatataccaacctgttatgtgagacaactgacctgcaagtagtccaaggccagtgaatcaattactgcttgtacattgtgtgcatctcttcttgactcctaggaataactatgaggtctggggggggaaaaaatcacataatttttatccatgagaggccaagttttcatctcattgtctctgactaggctactgaatatgctcactgctataaaggctctgcccaaacagaacatgctgtaaagtacagataaagttaataaccctgaactctacacagcagaatctttactggttgagtatttattgattgaaccgattttcaatattagactggttgaatacggttgaatatttattacaccatatatatatatatagtatatagatatacatgaatatgctttacaagaagcaccatgttaaggaagataaagtggccctaaattcaaagacagctaatagtctaataagggagccaagacatgatactttaaccataactatgggctactttctacgaagaaaaaaaaaacacagcaggcattcaaggagcgtcttatatatacacatatgtatgtttatttattatttattgagacagggtctcgctctatgcccaggctggaatgcagtggcgtgatcttggctcactacaacctccactttcccggctaagcaattctcttgcctcagcctcccaagtagctgggtttataggcgtgcaccactatgctggctaatttttgtatttttagcagagatggcattttgccatattggccaggctggtatgaactcctggcctcaggtgatccacctgcctcaagtgatgagcctcccaaggtaatggattagaggtgtgagccaccgcgcctggcccttatatgtccttttgaatagccaactagattattggtataaagatttaaaaggtcagcacaggctggacgtggtggctcatgcctgtatcctatcactttgggaggtagacgggaggatcacttaagctgagttggtaccaccctggcttgaacatagtgagatggtgagcaagatgaaaggacatatgcgcttattaactgtcttgtaaatgaggttcatcatctacaagcatcaattcttatccctagcactggttaagtaacgaatccaataaattcccaagctccactcaattttacaacctttgaaggtacatttacagaaagatgcaactttcacaaggcagtagccatgattaggttaagccgtgattatcaggagcctcaaactgatctgctcaaggccgttattatgagtgggttccacagggtattccttaagaatacaatattataattatacaatatgtgatattaaatacaatttaatatacaatattattttaatattgtatattaatatagaatttaatatgcaatattaaaaaaagaaacaagcaagagaaaatgaaattttataaatatcaaagaatctaactaaaggactaaaaacttttgcctaagatataggcaaaattactcctgcttttagtattcttacctggtaccttttctccaaaatagactgataaagagcaataaaaacattagcatcacagtcttgaagttcatgtatctcagatgtatatgacacttaaaaagaaggttattggcaatggttacccactctgttggaaaaagggggaaagatcagtcttaaaaaccaccagaaaaaaatcacacagacatttaaaaatccaacaacctcccccccaacaaaaacagacactgaactttgcagaagataaggaattgattgttagagaatttcaaagaccctttaggcatggtttttaaaaagatgtatttaattcttgggatgatttccagagtgctgtaatttctacatagtcaaaactatactgcaaattaattgatactgttgcagcctaaaatcttaagttacttatataagccttacatgggtgttttagttaaaacatatttacaagtaaacaggaatattatgtcataaacaacagtttaatgtaatccgaggttaccagaaactcattaatggaggctgcttcgcacttgcaatagtattgtcttgtgtttacccaattatcttgtgcaagtcagggtttctctggtgccggaaaaagtgtgattaaacttaggctgttaagaactggtataataacaacatcaacggtaatgcatttgtagtttttcttttttattatatcgatctatatgaaagaaaatatgggaagtacatgaagtcagaattatcaatactgttgacgtttcctgcgtaccacattctcctctcccctagatatgctgggatttgcaaagtttaacggtttctgtaccaaaagtaacttagcttaaaatactgttccttgaaatgcctgggaattggtaggaaagcactttcaatcggtattagaaacaaaatctccactatgttctggacacgtaacgttctggaaacgaatgagagtgtattttccatcacataatccccctccccacgcccatttctcacagctggccaaaccatgacaactggttgtacgcagtccttgtgaaaaggatgaaagcgtcctagacaaccaaattaattcgctcttaaaagcggtgctagacaaagcccatgactctagagggcactgaagagaaaaaagcacaatattctacaggggcatattctactattctgcaggggcataataaatcttaagaatgctgtcctttaaagaccaatacaaaagcaggtacgacctcagggcccatagtgcaagggcggaggcacacggacagcggctagacgccccacagaaagacaagtccggggacgacccttctgccgctctttttacagccaggacccaagtgtcctaccggcctcgccccagtgcctctctcctcccacagcatactgctgttccacggcctcgaagcgaagaggtggtgaagctgagagacctatccagggaacccgccagcgcgacgcggcgtctgaaggtcacgagccccgccgacacccagacccagtccgggctagcccgaggcctccctggaggtggacggtttcagtccacaatactgggaccccagggagacactcaccagcatccgagcctgccatgtttcagaggcagtcgccgccggactccgacgcggccgggaaggcgacggtgtcctggaaggaccgatccaccagacccgacactggggcgcggacgcacgaaccaaagcgcggggaaggaggcgtgaaagaggacggacgttaaaagagcttctcgccgctgattggtcatcagaggagcacttcctttacaggacgtgaaacgggggcggtttgggaagtttagagaccattctccgccgaccaaaaccgtcaaaggattatcagacacgcgggtcggacggtccacatcagccggcagcccgggcggtcccggggtgcgagcagcgcacttccggtgagctatttcgttttgtatccctccgccacgtcaacgggaaagtagtgcggaccgctctctcggtggtccggggtggtacagccacggacaacgccaggccccgccttccccctcttttggttacagacgtgagggctctttggagcgtaaacatctccgagtggcgagggtgggcggggctgggcttgggaaagggcggggtggttgcttgaggtgtggaaagaccagaagaaggtgaggtcaagagagtgcagaatgaggcatccaatggtgggtgggccctgacctgagagagtggcgcggggaggggtgaaagcgcggcatcctggaacgccagcgggcgttgcggcctatgcgcgaggggcggggcgattaggtcatgagcggctcccagcgttccctgcggcgtaggaggcggtccagactacaaaagcggctgcggaaagcggccggcacctcattcatttctaccggtctctagtagtgcagcttcggctgggtcatcggtgtccttcctccgctgccgcccccgcaaggcttcgccgtcatcgaggccattccagcgacttgtcgcacgcttttctatatacttcgttccccgccaaccgcaaccattgcgccatgtcgggttattcgagtgaccgagaccgcggccgggaccgagggtgagtttggggccgagctgtcaggcctggcgggtggggggatgggagggcgggtcagggtggcggccgggggggctttgcggcttggacttggcctttccgggctatcttgggacttcctttcccgaagcttgcgccattttgatattcacgtcacagtgattggaagagatttgacggtgtagtgtttcaagcttgctttttgtgtggggattggggagctgtcggggcggctgccatttggtagtgttgagggagttgagagggagcgtattgtgcggatgaaagcgggacgcttcgaggcagcgaaggaacatctgttaggtgcggcgtttcgggaggtgtttttggggtggccgggcatttgtgggagcgaggggaccacttccaaagccctggtgctgttggggtaggagggcggccgcatcagccatgtggctgagtcgcgagtacaaaatgccggcctcggacatggcggcggcgctttgttaccccgcccggcggaggagctcaaaatggcagcgtcgagaaaatgtggcgcaagagaaatgcgagacaaagggggaagcgccgccccagcgggaacgccgcccggccgactcgcccgggccgggactcctcccccggtagtcgccggctcctccttttcttttttcctgcttatataattttgattcgttgatccggagctctaccgcggcgttcccccagctgggtttctagcagaagtgtttctgagaaaacccttgttctgttatcgctgactgtactgtttaggtcttaccactaaagctgtttggttccaaaacggccatatgagtaacatcgtcgtgatgccttcggttcatgtagccttgttattgctgatagtgaattgctaggctggtggggaagatacagtaaccacaagaagtggtgtgtgccagaatcccaaattctggcatgtgggtgacaatttccgacatgataaatccccggcttccgacatgataaatcccaggctgtttacatgactaagtaatgtgtacttgggactacgggaaatgttaactgtggctgttgagagagagagaattttcacgaaggacagtgctaggtttacctctcgaagtctgttttcagtggtttttagttgtgccaatggatgacaaatctatacagaaacctgggtatagccatttgaaaatgtgataacgttttttttcattccaggtttggtgcacctcgatttggaggaagtagggcagggccttatctggaaagaagtttggaaaccctggggagaaattagttaaaaagaagtggaatctgatgagctgcctaaatttgagaagaatttttatcaagagcaccctgatttggctaggccacagcagtgagtaaattcatgtggcttcatcaggctgtaactcgatcgtggattctagaaatgaaattctgacaggtgttttgcaaataactcaattttggtagagttacatgttctacttcataattgggaaaggtgtgactcacttttggatataggtggctttgggatttttattaaattaggttgagtataacaataaattttttttttcataatagggtgttcataggtggtccagattaaaatgaaggctactttaaactagttactaaattatgaagttaggggctttcaattacgtatttagctaggggtggtgtcatgaattttaagactgttataatttgtttgcagcaagaggtggaaacatacagaagaagcaaggaaattacagttagaggtcacaactcccgaagccagttctaaatttttatgaagccaatttccctggtaagtgctacttttcagtctacctacccgtgtttttgtttccacctaccccctctttttcttggcatcactaattttactaaatatctgttactaattatagcaaatgtcatggatgttattgcaagacagaattcactgaacccactgctattcaagctcagggatggccagttgctctaagtggattggataggttggagtggcacagactggatctgggaaaacattgtctgtaagtttgggagaactctgagttgatctgatatatgcaagaaaatgtaatggtaatttaaaaacgagtattttaatggatttctgtttgtccccactttcaccctaaatagtatttgcttcctgccattgtccacacaatcatcagccattcctagagagaggcgatgggcctattgtaagtatatatttttactttattagaagcataatgtgtagattttagactacatagctaaagatgtaatcatttgtgtggttttatatagaggttagctcatcctattcagctggagctgttttgggtattggacacacatgaagaaaggatctgctagtataataagttagcagtttaaaactagtatccaggttgtgctgaaagctgtttctctttccttagtgtttggtgctggcaccaactcgggaactgcccaacaggtgcagcaagtagctgctgaatattgtagagcatgtcgcttgaagtctactgtatctacggtggtgctcctaagggaccacaaatacgtgatttggagagaggtatgtaagaaaagggttttatttgtcattggtgctaaatatcctaggtattgtagttacacttacgatttaattaaaggtgtggaaatctgtattgcaacacctggaagactgattgactttttaagtgtggaaaaaccaatctgagaagaacaacctaccttgtccttgatgaagcagatagatgcttgatatgggctttgaaccccaaataaggaagattgtggatcaaataagagtaagttcctttgaaatatgtgatcaaactgaattgtgttttcactcttaagagtctgatactaattttccccccaaaatccattagcctgataggcaaactctaatgtggagtgcgacttggcaaaagaagtaagacagcttgctgaagatttcctgaaagactatattcatataaacattgtgcacttgaactgagtgcaaaccacaacattcttcagattgtggatgtgtgtcatgacgagaaaaggatgaaaagtaagttttattaactctgttatatttgcttcctaacaactttgtgtaaaattgagggatcattgtttggtgagttgttttaggttatttcagttggtgtgattcatttagttagcctactaatcctgaaaatttcttgaatccttcaaataatggctgtcacatttatagctttcctatagaaggaattcatgtgtcccctggttgacttaaggaccaaggtcgaactgctcgataagtggattagcaggcgtttcctctttgacttccagccatgtaattgaacttaatgttttgctgaccataaatgtgtggccctagcaatggtcttttaaaactaggatttttcctttctctctcctattattagacttattcgtctaatggaagagatcatggtgagaaggagaataaaaccattgtttttgtggaaaccaaaagaagatgtgatgagcttccagaaaaatgaggagagatgggtatgtgtgagctcctccattgaagcagattgattaaacagcttaggaaagggcaaacttggatcacgagcagtggatttttttcatatctgataggaatttaactttttcatttctggcgaaattaaagagatctgtgaccaaaagtggtcaagactggagtctgaggttttcaatgtgagtttaataacacaacttgtcttttaacttaggtgcctgccatgggtatccatggtgacaagagtcaacaagagcgtgactgggttctaaatgtaaatatttcaaatgaagtatttttcccccttacttaacctagctagaattctgctcagtaattgatcatgtatatgccttcctttgtagaattcaaacatggaaaagctcctattctattgctacagatgtggcctccagagggctaggttagtacaaactcgcattcatggcttgtttcccagaagatctccatttaacttttttaaagaaagtttattgctttctttaacctgattttttctaagttttttttcacataaaggtgctgtctttgtggcaaggcctaggcatgcaatcggaggactcgagggggatggaggactagtgatcggctggctgcttccagtcgatagagaggtgaaaaagctgaacgtgtgccagtaatcttcaaaaggcagaacatatcaccttgccccgtaaactgttctctccgagggaaaaaatggaagttatcctcacagttcactgcgtggtatttcttctgtcccatgctttgcatgactgccatggtacagccttgtttcaaacgttcactgtgatctgtgggtctttgagtttcagtgagtttgctgaaatgtcgaagaagtgttccaaacttcaatgttcaatgaaatttttgttcaagtttgaaatggagagagcagcttaaaaggtactaagccttttacaaattggtgagtactggcacatgagatctagagcagggcaacttctcacacatagtaagtgggaaaagaaagtgctttgaaagttcctccctcaccacacagtagtcgtcatgtcgagacctgccagagagagacacattctcaagtgaatcctgcttcttggaagcgcttgcctagacgagacacagtgcataaaaacaacttttgggggacagtatgttttcttgcagctgcggttgtaaggtcttggcaagacaagcagtgtggccagaatttgaacttctgatgaatgtgtaatgcaaaggaccttgtacatttttttgtttcaaggtctcaaaatgagcacatgaagaggttgctgtgaaactttaagtggccctactgcgcagaacattcagatgtcacttgatgatctgtaagggaacttgctgatttgggaatgtgcttaggaacacacattccttttgacagggtctgtcactgggtgggtgatgaattatacagatgactgtgcttttttttcttttttcaacctcaatggtattcctacaggaaatggataaccatttaactgtattttttgcagcccgtaccttcttgggaatacaattgtctaactttttattttggtctggctgttgtggtgtgcaaaactccgtacattgctattttgccacactgcaacacttacagatgtggaagatgtgaaatttgtcatcaattatgactaccctaactcctcagagattatattcatcgaattggaagaactgctcgcagtaccaaaacaggcacagcatacacttctttacacctaataacataaagcaagtgagcgaccttatctctgtgcttcgtgaagcaatcaagcaattaatcccaagttgcttcagttggtcgaagacagaggttcaggtaaggagactgataggaaatgttggtagttacgagtcacatcgttgtctacaaatccatttaaatgtattggagggtgagtaaaaccttgaatgtgaaaacttaagctgaaaaattgtaaaaactttcacgcctaccatgaatagatctgtttctttctgtccacaatgatttgtgtcatagaataattgatcaatttgcaattgttttcttgacaggtcgttccaggggtagaggaggcataaggatgaccgtcgggacagatactctgcgggcaaaaggggtggatttaatacctttaggacagggaaaattatgacagaggttactctagcctgcttaaaagagattttggggcaaaactcagaatggtgtttacagtgctgcaaattacaccaatgggagctttggaagtaatttgtgtctgctggtatacagaccagttttaggactggtaatccaacagggacttaccagaaggttatgatagcactcagcaatacggaagtaatgttccaaatatgcacaatggtatgaacaacaggcatatgcatatcctgctactgcagctgcacctatgattggttatccaatgccacaggatattcccaataagactttagaagtatatgtaaatgtctgtttttcataattgcctttatattgtgtgttatctgacaagatagttatttaagaaacatgggaattgcagaaagactgcagtgcagcagtaattatggtgcactttttcgctatttaagttggatatttctcacattcctgaaacaatttttaggttttttttgtactagaaaatgcaggcagtgttttcaaaaagtaaatgtacagtgatttgaaatacaataaatgaaggcaatgcatggccttccaaaaaaaatatttgaagactgaattaagtggaaattgtactttattttatataatgtcatgaaaactttgcttaagatggtctggttttttttttgtttttgtttggttttttttttccagaaaacaaatgactgttcctttttatttaatttgggaggcagggggaatcagaaggccctctttataatgagctattcatattgcaggagtcagaatgaattgatacaggtgaattttagttacaggctaaattgcataaaagctttgtcagcttccagcatcaggggagtcatttatagcctttttccttatttgctagtatggttaaatgagaaaatagtaaaatagatacaaatcatctatatagtgtgagaacgtgggtgactttttcaaagtttataatttaaaaagctcaaataactggctttttcaagagacttatactcatgctcttggctatactgtgaattactaaatgttgaacaaacctgtgaaagacatacattagccctttaagatggccaggagctaacttgagtctcctttactgaatttcgttcttagtgcaggttacttgtagattctagtcttacaggctccctggggctcttaactagtcacactgggagtcatgaatgtctttccaataatcagggaattctagagatcctcaaactgtaaggtctattcatactcaacacaaggaaaaacctcattaaaattaatgactaatcaggaggcaacgtaaccaaaagcacagtgaatgaagttttcatggtaggttcaacatgggtttattgctagaaagatccaggggatagctttagtttaacttcggctcaccaacgtaactttctaatcatttatttcagtaatagctagaagtggtctgaatgttttcccagagtctgatacgtgtttttttttgccagaagagaggtcttcggagacttcatttaaattctgattattaaactgaggctttaattgatgttaatgccttagtcaaatgtaaagttagaatttgctagggctgggatagggagtgatatttctaggacttgacattgaaaactaattcagcctgtagtaacctggatggttttcaatggcatggttagtaaattcatggttttaaacttagaagcagctttcgggggagagggtaggttggagcatttttacatattttactgtttaatgtcttaaccgtgggccttttaatttgtaaacactgaaagattgttgggctgtggaaaacatttacctatttaccttggaagttttaaaagacagtccctttttagcatgtgtgttgtgtccagcctgtggtcgtcttaactaataaatgtgattttctccccattctctctttttatttatttgcgtataggccttttacctggtgtgagttcctaatgtggaaaacacctggcagtagtacccagctttgcagttaattactatctagctggctttttttaaacccttgtatacacttgtaaagaagaactatttcctgaacctggtacagcctttactaatgataaaactttactcctgaattacattaactcaattgctaagctgttaccctcttaatcaggtagtagtttggtagtctcacagtgaaatgtagattgttcctttttcctgaacctctttaaaggttttcgtaactgaggctggtataagaaatcatggactttggatcaaacttcctcagtctgggtataccacttttccactttctgggtaggtcttaaggtctgacctatttaaatagaaactgcaaaatcagaaacctgcaatttaatcatgagtctcttataataacagtcacaagtctcattgttttgatgaacccatagaaggggcccctggaagaattgcacgtacgtggttttctctgacaccaggagggtttaagacatgtcagggccccttgtttatttctagtgcattcccaggtgaggcagatgctgctggctggggactgccctttggagccactgcaatatttaaagtgaccataccactaccctagtcacgaagcctatcgccccctccccggaagcttaagcgtcaagacaacggctctggggttaggcctaggccacctggcgcagcatttgcctagttaagaaggcctgggcttacaaatcaccgtaaaggactaaaacttttaaagggaaaccaaatgccaaatttagtccaagtgcttgattgaggtgtatatagaagtgatttggataatactgaagtattttaattttctggactgcaaaacagtggcagaaggagtgactcaagtggctacaccacggttataaataggtgggaataacctttactggtgctacgaggaaagaaaaaagtcaatctgaagggaggggcgcgacgcgaacggcaagctagcaagaaccatccgagccggcgtccgccatggtgggcgggggacggctgcggccggaacgcaacatgcgcttccggggtggggcctgccgcccgcaagcacgctcacctccgttgcgcctggccgtggcctctccggattctgttaacggtagtggtggcttgttgggatccgttgagtgtgggagagtgtgctctttaacttcggagagagatgcgctctcgtgtagccgtcagggccgccataaggtctgcaggtgcctgttgtctgggtttgggggtcgagtagatgcggggcagcggagctgttgacggaaaggagtagccccaaaggagggcatgtgaagtcgcacgcggagtcgaggggaacggcgagcacccagaagcccccgggtctggagagggaagcgaggcgctgtagagatctgtcagagaaggcatttcctaagtggaagcaagcagcagcttagccgggatctcttctgagtgggtgccaccccggcttcggacccttgggcgtagagttgcggaagaactggccgcagaatggtggacctcggtggtggtgttcagggagcaggtattcccggtggacccctccaccacaaaccaggccctttgctacccggggacagtgccttcaggttagtttctcagaaactctacgcgaaatcttgcaagacaaagagctgagtaaggaacagctagtagcattcttgagaacgtattaaaaacttctgggaaactacgggagaaccttcttcacggtatgttcacgatttcatgcttcaaaacaggtgtcgggtggaaaggcgaggcagtcttgctggacttggggattgcaactggccctgtattcccatgcaaggaagttagttagttctcatcttttgaagtagtcggatatattaacagtgctctaccctggagaaaactggtccatggaatcttgctgttccttaaacaatctgtccgaaggacctgggaacgctctcaatttcacggggcacttctgaacacagtgctgtcatttagtgcaatgtagtctaagtgcataaggaactacaagacattttgaacttttcttagatttattctaagtaaaaatgttgaaattataattctgaactatttcatgtatatcataggataaatcaaggccaggcgcagtggctcacgcctgtatcccagcattttgcaaggcagaggcgggtggatcacctgaggtcaggagttcgagactacctggccaacatggtgaaaccccgtctctactaaaaagacaaaaattagccggccgtgaggcgagcgcctgtaatcccagctacttgggaggctgaggcaggagaatcgcttgaacccggaggcagaggttgcagtgagccgagatcacgccactgcactccagcttgggtgacaaggcaaaactccgtcttaaaaaaaaaaaattcaaatagttgggttagttgttattaggaacaagatattcattgtaaaagaagagataatatgtaaaagaaggtacgtataaactaatgtaaatatggattggtaaattaaatatgaattggtaaattaaaattgaatatgggtctcacctgtcacccagactcgagtgcagtggtgtgatcatggctcactgcagcctcgacctcggctcaagtgaacctcccacctcagcctcccaagtagctggactacaggcacatgccaccaacccagctaatttttgtgttttttgtagagatgaggttttgccatgttgtccaggctggcttgaactcctgagcttaagcaatccgcccatcttggccccccaaagtgctgggattacggtgtgagccacagtgcccagcctcatgatttttaaaaatatatttcctaactttcttctttaaagttcctagaagcaatgaccctcagtagcaatgagcacacctagtgcccagatctggttcctttttttttttttttttgagacagagtctcgctctgccgcccaggctggagtcagtggcacaatctcggctcactgcaagctccatctcccaggttcacgccattctcctgctcagcctcccgagtagctgggactagactacaggcacttgccaccacgcctggctaatttttgtatttttagtagagacggggtttcaccttgttagccaggatggtctctatctccgaccttgtgatccgcccgcctcggcctcccaaagtgctgggattacaggcgtgagccacgcgcccggcctccagatcttggtttctaagatgaaccagtactgggagaaatggctgatccgggtctggggttagggaaagtacaaggtgagtttgaaacactttatggtgctaaaaacaaagaattgcttgaagactaatgggtcatataaaaaggtcacagatgctggcttgagggggttgtcactggccacatctaggacaaattgaacattaagatacatattaatggtaatgatcataacacattgactaaaatctaagagtcaatagtattaatcaaaaacaaataattaccctagaggtcgggggcggggggaagaggtagagaaagcttatgtttttacagaagcttggaataaatgtagaaggaaagatacattagaaaattcaccatttcatgatattgcaaacccgatatcattgattcaagcaacagtcatcaatggattctaaaatactgggtgaaatatgttggggagcaggatattattggggagtggatatttactaccttaaccaagtaatcaatttggtgtcttcagtagtggaataatttgataacatgttcctcatgttatgatgcaatagatacacacatctactatgtagtattttgctaaaaatgattagccgaaattaaatcataggaaacaatcagacaaatcccaaatgtgagacaatctatgactaacctggactcacatcaaagtcagtgtcattaatagcaaaattaagggggaaaggaggcaagggaaatgttctagttcaaatggatgaaagaaacctactcagaatgcagtacatgaatcttaactggaaagagacagtaaaagatatttggggtgaaaattggaacaactaaaatatcaccatatgttagatatattgtggtattatggttaactttttatggtgttataatggtatataggaaatattttatttttagaagatgtatgcggcagtatttgggagtgaacaagaaaaaaatgtggcaaaagttgataattgatgaatctaggtaaagggtatacaagtgttcattgtatatggatgtttttattttttcaactttcttatagatttgaaaatctttgnnnnnnnnnnnnnnnnnnnngaaatgataccactctcttcttcagataacatgttattctccataagtttcttcctgttgccttttgatgcaaaccaggcttcccatagctgtcttaggcagcaactagttggctgattaatacttcctgacagttcatgtaaacaacaggtccagttgtctcagacaaattaaccaataagattcaacagtaatatttttaattaagttatggtgttgaggcaatcagacccttacatctttaaagtgtctttttttgttcaattttaaaactatgaggccgggtgcagtggctcctcctgtaatcccagcactttgggaggccgagttgggcggatcacgaggtcaggagatccgaccaacctggctaacacggtgaaaccccgtctctactaaaaatacagaaaaaattagcgggcgtggtggcgggcgcctgtagtcccagctactcgggagggtgaggcaggagaatgcatgaacccgggaggcggaggttgcaatgagccgagaccctgccactgcactccagcctggcgacagagcgagactccatctcaaaaaaaaaagaaaatcttcaaactaaaaactcaggtgaaactacctagaattaagtggtgatctgtctttttttgtttttttttaagacagggttcactctgttgcccaggctggagcacagtggcaccatcccagctcactgcaaccttggctcccagactaaagtgatccacctcccagctttccaagtagctgggactacaaggcacaaccaccatgcctggcttatttttgtatatttttagagatggggttttgctgtgttgcccgtctggtctcagaactcctgagctcaagcaatctgcccacctcgacctcccaaagtgctggattataggcgtgagccaccaagcttagccaacatctgtctttatgctgtgttaacgtattactactattaatgtgtctattgacaaaaatgatttgggtttgtggactagatgtatcaatgattgatttatcttttgacaggtgccttggaacactatgttaattgcctggatctgtaaacaagaggctaccttatggccttgctcagattggagtgtgttttcatcctgttttgacactaagcagatacgaaatggtgttaaaaggtataaaaagtggcaaataacttggcctgtatttaaatagtcaaaaaccagtcatttccacttgggataaattatataattttcagtaagctaacttcctgatacgttttatatctaaagtattggtgagaagactgaagcttcgtagtatggtttactcctccgagaacttcaaaccagtggcttgatttctggttacgtcatgactccagtggtggagaaaggtactgcaataattacctttaatttaatagttaatacataattgtcttaatgtgtcagtggtaattcttctgacatacaagaaattatatttgatgtagtagctat

SEQ ID NO: 5052 - DNA, 19573 bp, Homo sapiens
tttaggagatctgcctccttttatttatttcattgcctgtcatgtctcgctttgttgcgtttgtttttgcttttgtttttgtttttttttaagacggagtttcactcttgttgcccagctggagtgcaatggcgcaacctcggctcaccgcaacctctgcctcccgagtttgagcgatctcctgcctcagcctcccaagtagctgggattacaggcatgtgccaccacacatggctattttgtatttttagtagagacgggttttctccatgttggtcaggctggtcttgaactttgacctcaggtgatcagccacctcgtcctgttggcgttttttaacattttattcatcctaagccctctagtgtacaactttggctttttatcaaggcatccagaagcttgcttctgcaagttcagctaagtaattctaaaccaaaaaagagtaatttttaaaaattattatttaggcgggcgcggcggctcaagcctataatgccagcacgttgggaggctgaggcaggcggatcactgaggtcgggagctcgagaccagcctgaccaacacggagaaaccccatctctactaaaatacaaaattagatgggtgtggtggtacctgcctgtaatcccagctactcaggaggccaggcaggagaatcccttgaacctgggaggcggaggtcgcggtgaagcgagatcacgctgtgcactccagctgggcaccaagagcgaaactccgtctcaaaaaaaaaaaaattatttagagcccattagatccgcaaaaactaattttaaacaaaagtgattagtttcccacatctggggatatgatcaattagaaaatggcatgaggaagatagctttgcccaagctggtgtttcattttggtttttgagacattgctctatcacgcagggtggagtgcagtggggcaccatcgtgctttctgcagccttgacctctggggctcaagagatcctcccacctcagcctcccgaatgctgggcccacagccacgtgccaccacacccagccaacgttttgatcttttgtagcgacctctcactgcgttgttcaggctgcaagctgttgtttcaaacagatgaagttggaaagttctcagcttctccagagttgtttttttgaatcaaggggttgtggagcctacatgtaaatacagtgtgccttgagttaaatctccgggaagacttagaacggccgtgttgccagagctctctagttagcctgcaggactgtctgaagtccgtgtccgtctgacatgttaccggaattaacaacctagggacggtgagtgctccttcatgtggctttctggctctctcacctgccactcatgccgctgtgacttagcagccagagttttcaggagacctccaacgtgtccgttgaaattagggtaagagttgagaagtttccctgtttgttctaagagttcttaccccaacctcagggaaatcaatagtaaatttactctgacttcaatgataataaagaagtgcccttgcctcatctctttatataaagcaatagagccacatggttcaaaaatgaaaacaatatgaaaaggtatgtaaaccgggtaagtgtctgagacaagtctcgcccatttagaggtttattttgccaaggtgaggatgtgcctgagacacaaccacagatctgtggcccccgcacactttccagagaggtttttagggcctcagtatgtgggatatgacgacgtttctcttcaaataatctgatcaatttttattctttaattcatagcgccccgccccctttttctccttttccctttttgccttttgagatgcccaggcacgccacagcaccaggcgttatcagtaccagctcacattcctttcttatttggaaagaggactaactttctagctcattacagacaccccttccccttcctctcgctttcttttacgggcccaccctatctaaaaaaatcaaatgtttagccaagcgcgattatttagattgtacgacctgaccccggccaatggggaaagggtagaggggcaggacttgtgcaggaacaaaggctctcgtgcccctttgttcaggtgtgctctcatgacaactggccaagaggcacccctctgcacagaagtaaaattgctttgctaagaatcctttgttcgagtgttcatttccttaggattttgagcattattcctaacaagtatttaaaagggaaagagcaggaaggagggaagagggaaaggaaaaatacaggagggtaggtagggagataagtggttacattttattaggctttgatcagcgctcaccaaatctacatgtcacagtgaaaggagggggtagggaacagtcagttttgcattcagctcagtaaatctacatttagcactcaccaaatctactgttacagtgaaaggagcaggcagaggaacagtcagttttgcattcagctcagtaaatcacatttagtgctcaccaaatctacatgttacagtgaaaggagcgggcagaggaacagttcgcattcagctcagtaagtctacatttagcactcaccaaatctacatgttacagtgaaagagcaggcagaggaacagtcagttttgcattcagctcagtaaatctacatttagcgctcccaactctacatgttacagtgaaaggagcgggcagaggaacactcagttatgcattcagtcagtaaatctacatttagtgctcaccaaatctacatgttacagtgaaaggagcgggcaacgaacagtcagttatgcattcagctcagtaaatctacatttagcgctcaccaaatctaatgttacagtgaaaggagcgggcagaggaacagttatgcattcagctcagtaaatctactttactgctcaccaaatctatatgttacagtgaaagcagcaggcagaggaacagttatgattcagctcagtacatctatgttttgtctcggctggtgagggatggtttctggtgttgttttgtcccttacctatgaagataagctgttaatttatattgtcaggtgagggagaccactggggagatatgtggccttctgtcttgtagcttatctgtttaggaacaaaaggaagtttttgcatattccatgactcaatttccaagcttaacttttccttttcgcttagtgaatttgtcccaagattttattttcctttcacagtataccccatgcccatcaatcccattccccctcatcctataggtaacctcttcttaagcaaatacaaatagataaatccttattttctgttttttttttaaaactttattttactgttactttctgctgtcctaattatggcacatttttctttctaggttctgtgatttacagagtggtctggctatgtggacagcttctaaattgtcccacattttggagcaagatgtattatttttacaattaatttacatttaacatgaatcatatcctaagtgcatcagaatgtcttcataacattcgccaaagaagagagggcagcactgcgttctacagtgtggctctcacctggtccacagttaccagaaatagttctttcgttgctggatgtcctgggtgggcttcattctttagtaatgtactttgtctacagcaacttcctgcactatgtgaacagatcttgaagacacacagtgaggtttggtttcctttgtcctcttaagttttatggttgttgcttctattgtttattggtcccagtgagaactgcagctgacctgatgcatgatctgtgaagatagtttctattaaagaagaagtaccaggaaatcccatatgccacgtagacctgcctttctggataccatttactactccatactccagccgccatgcacaatgttgtgtatgaggctcctgtgatcattaacaggagtagaagctgggctcagacactctggacttgcataggtcaaggggtgtgttgtgctcttgcaacaaatcccacatagacatccattgcatattgtcccaccgtcccctaagcagaaaccagggttaagtacagaatagtcccggaacattttggttgcccggccttaggtgagcctttctggggctgggattttgacaccatcgctccattgtttctaaactgctgtgttctggcgcatcaattgtttcatcacattatcatacggaaagcttggtctccctcaaaacatgaaccgggtaggccctgtgttccagtgggggttttggacttgactttagtgtttaggaggacagagtccctctcccctctgtggtgctgggtattagtaaatcagccttgaagagataaggggctggggcctcaacctcccaagaggcttcactggagaatggtctcctgccctcagatcttgggcatttccacagcacactgtcccctcgtccttccaaatacctacatacgctcttgtaataggagagctgggaactccacccaaaccatacaaaaagttagtctgtgtatttggacgcctccccagcactcagtcaccgagttctcctttccaacagcagtcactctcatgcagtttaagtgatttattgatgtctcggctagcttgcgacagtttcaggacatttcagccatcaaggtctaagaagccctttccattcccaggagccctcagccagcctccttcttcctcatctcctcactctggccgcgtagcccctctggcgtccatcttggacgcccctttgttcgcgctccacgccccccacttccttcttcgtagctcctccactttggccgcgtagcccctcatggcgtccatcttggacgcccctttgttgcgctccacgccccccacttccttcttcgtcagctcctccactttggccgcgtagcccccatggcgtccatcttggacgcccctttgttcgcgctccacgccccccacttccttcttctcagctcctccactttggccgcgtagcccctcatggcgtccatcttgcacgcccctttgtcgcgctccacgccccccacttccttcttcgtcagctcctccactttggccgcgtagccctcatggcgtccatcttggacgccccttttttcgcgctccaagcctcccacttggccctgctctcacgtctgaggccggagggccggggatgtcgcagtcgccctgggtggcctgttttacaagccgtagaccagcagcttctcctgatcgctcacgggacccttcagctgcttgaggccgcgcagctcgaactccacttggcacatggggtggtggaggcggtccctggtgctagagctggaggtggagagttggagtggctgttactactcgatctcagggggaggagacaggacgcgatgtttgtgttttgtcaagcacagattgcaagctcggggtccagcgtaaaccccccatgtttgggctcacacggcgcattttctggggaggaccagccgtcaaaaagcgtctagatccggaacgctgctgtctggagggggcggcgcggcaggagcgcgttgagggactgtagtggcgcgagctgggcgggtgggagtggaagcctcgcgtggtgcggccgcgctgggtgggggcgtcccgggggaggcgctcggtgggggtgaactgtgtgcggggcacgcccggggttccgggtgagggtgaatgcggggccggggaatcatgagcccgacccgctgggaccccggagaggggccgggcaggggacggtgcggaggggtctagtgagcgacgtccgggtacctgaggctggtgggagggctctgccggaaggcggcgctgtgcgcttggcgcgctcgttcgtgagactgcgcgtgcgcggcggaggctgtgggcggggccgggcggaggttgtgagcaggcctagcgcggccgccgtggctcctgcgtctcccatcgtgccgtgcgtcccgcgccgcgttcgattctcggaggggagggggcgttagccccgcgcagccgccggcgtcgccgccatggacctggtgggtgccgcggctccccggccccgggctgcgtccagcaatgcgccaccagagcggtctgccccgtcgcgtctcctcctgtcgcgcacgctcgcgcgggcccggaccgaaacgtccccgcgtcggggcgggtctaggggtcccggggtggccttggcggggggtggtccgggtccgccgcgcgttgggccgcgtcttgccgcctccggccccctgcgcttgaaaacacggagcaacgtgaagttagagcccttggaagcgcccggggctcgcgcacgtgctttgggaaacgggtccctccgagcacccctgggcgccccgacggcctcatttcctgaacggcagctgcgttctgagcaagtgtcttaacgctccaagtgtcttacgctcatgacgtttcctcatcgacagacggggagaatggaagtgtgtctccccactgagttttgggcgactttgcattgagatcgcgaggtacagtgtcccttgtggggttgcgcgggtcacacccgcggtgggggcggctgcgccctgaggtatcactttgtgaacctgcgtgcgtccggattcagaatcttacaggcaaggttgggagggagcccataggaactagatgctccctgctaaatcttggcacacgctgctaagccaggaggctgttctgggagagctgggggtgaggcaccccgagatgtgtcagcagtagtggctggggggaaatggtctggtccccgcccccagacagcttttcaggagcggaatggcaagctctaagggcttggagcccctcagccgtaattgcttcccagccccaccacattcaggtgggacaccctcagcaaatcgtttctgcgcctcagtgtccttatctctagagcaggaatctagtcctcaaaaggtgattgtgaatagaagagatcttacctgtgtaccacctagcacatgtctggcatggagtaggtgcttaataaacctaagaagcgggctgtggcaagcactagtaaccatccatgatagagtaccggagtattttccagctagtaaccgccctgggacttactcttcaaactgtgcgtacttaatgcgcctggaaggcaggtgtttagggccaaacatctgccaactaagccaataatgcaataaaattaaatttacagcgtcaggagggactatattttggaccctgggagagcctcctgagccagaaagaagggcggtaacccccagggaggtcccctcgcagcgtaaccctccctgggagtcggtctcagccactgtgagatgagatggattgcctcacaagtgggttacatagtgctgagcccttggcctgctgccgctcccataaatggtgggggggtaagatggtccttagtctcctggagtcagtgttttctctgctggtgtctggcctggaaaatggggaatatgagctcttgggggcatgacagactgaggaaggagtagcatctctactcctgggaaaggggagatgactcaggaatgaggaatagggagcagtgtttgcaccctgttttagtttctgggccaaaggaaacatacctgataaagacctacatcctttgatgttttgagctgggggaggcaaagaatagtgacaagattctggtcttgccaaccatgaaaaggttggggaaaccaacatttactgagcacctaattagactctgtaactggattcttactgtactctatctcatttatccatcatagcgtcccggggagatggggtcaggagatagcagtgcaacccactagcaagggcttgactggtatatatcacatgatccccaaaggcataacatgagtctgtattatccccacatatgcagaaggaaggcttggagaagcaatctgaccaagatccatccctttttttttttcggagatggagggggagtctcactgtgttaccccagctagtctgaactcctggcctcagggatccacctgcctcagccccccaagtagctgggattacaaggctagccactgaacctggccagaatcacatcatttttaaatggctgaactaggatttaacccatgtctgattaaacatcccaagatgttttccatggtaagtctgtgtcaatcgttagtccctgaaggaaggcttaatctagcacagtattttctgtatctactccctggtttctccacagagctagggccatgagtaccttgtttttgactggaaggagctgtggggtggaccgttccctgaaagctagaagaatgtttgaagcctgttcccaaggcaagtttataaagagtgaggcagggcttgtctgattccttctgtgcccattgctctgtggctatgtgattgctctgtcccattaccctgtggctgtgtgactgctgctgtgcccattaccctgtggctgcgtgattctgctgtgcccattaccctgtggctgtgtgattgctctgtgcccattatcctgtggccggtgatcgctctgtgcccattaccctgtagccgtgtgattgctgctgtgcccattacctttggctgtgtgattgctgctgtgcccattatcctgtggctgtgtgattgctctgtgcccatatcctgtggctgtgtgattgctctgtgcccattatcctgtagccgtgtgattgcttcttgcccattaccctgtggctgtgtgattgctgctgtgcccattatcctgtggccgtgtgatgctgctgtgcccattaccctgtggccgtgtgattgctctgtgcccattaccctgtggcgtgtgactgctgctgtgcccattaccctgtggccgtgtgattgctgctgtgcccattacctgtggccgtgtgattgctctgtgcccattatcctgtggccgtgtgattgctctgtgccattaccctgtggccgtgtgattgctctgtgcccattaccctgtggccgtgtgattgctcgtgcccattatcctgtggccgtgtgattgctctgtgcccattatcctgtggccgtgtgatgctctgtgcccattatcctgtggccgtgtgattgctctgtgcccattaccctgtggcctgtgattgctgctgtgcccattaccctgtggccgtgtgattgctctgtgcccattatccgtggccgtgtgattgctctgtgcccattatcctgtggctgtgtgattgctctgtgcccatatcctgtagccgtgtgattgcttctgtgcccattaccctgtggctgtgtgattgctgcgtgcccattatcctgtggctgtgtgattgctgctgtgcccattaccctgtggctgtgtgttgctctgtgcccattaccctgtggctgtgtgattgctctgtgcccattatcctgtggcgtgtgattgctgctgtgcctgttaccctgtggctgtgtgattgctctgtgcccattacctgtggctatgctcccttcatctgtcatgagaagctcagctgtcatgtcctgtggtacatctcagtggcccctgtagtttgtactgtcctcctatttctaaacccctctccccacatccctgctggcccagcctttgctggagggtctcgcctcagcagcccagctttttcttttcaccacttttcctgaaggatctcattcaccgtcttggttccggtgatcccctctgggcagatcctctcagaatcacatttcccagcttacttccctcctgaacttccacctggcatttccgtgctggaggacatctgtaccttgatggccaaagctgaactcatctttcctcacacctgcctgattctcctccattccctgtatgtgatgtcacctggtggcctcccagttcccaggctgagagctcggaagccattctggattcctcggccaagtccttctgactccagctgtgcagggctcttgtagtcatcccttctccccgtccgctgatgtcctttaaaacccttgtcatctaaaccatgacagcctactaacagcagtggccatctggaaacattttcactatactgtctatttggcttgtctgtgtgcaggacccttgaacatctgtgaagaaatgactattctgcatgaggcttcttgctggccgagcagctgttccaccctaaggcactggcagaattaacaaagctgactgggaacgtgttggacggcccatcgtggaggccttaagggagatctcctcggctcagcacactcccagccctttgcctggaagaagaaagccctgatcatcatctgggccaagttctgcagccgcaccccgtgaccccgtccgacacagagacacggtggcaggaagacctgtcttctcggtgggcaacatgatccccaccatcaaccacaccatcctcttcgagctgctcaatccctggaagcttctggactctttatccagctcctgatggccctgcccaccaccatcgccatgcagaactagagcgctttctggaacatgtgaccgttgacacttctgccgaagactggccttcttcctggacgtctggtgggaggtgatgaagcacaagggtcacccgcaggacccctgctctcccagtttagtgcaatggcccataagtacctgcctgccttagatgagttccccatcctccaaagaggcttaggtcagacccagacgcgtgccccaccatgcccctgttgccatgctgctccgcgggctgacacagatccagagtcggatcctgggcccggggaggaaggctgtgcgctggccaacctggctgacatgctgactgtgtttgcgctgacagaggacgaccccaggaggtgtctgcaaccgtgtatctggacaaactggccacggtgatctctgtgtggactcggacacccagaatccctaccaccagcaggcgctggcagagaaggtgaaggaggcaaacgggatgtcagcctgacctcgctggccaaactccccagtgagaccattttcgtgggcgcgagttcctgcaccacctgctgcgggagtggggggaggagttgcaggccgtgctccgcgcagccaggggacaagttacgacagctaccggctgtgcgacagtctgacttccttcagcagaacgcgacgctctacctgaaccgcaccagcctgtccaaggaggacaggcaggtggtcctgagctggcggagtgtgtcagggacttcctgaggaaaacgagcacggtgctgaagaacgggccttggaggatatcacagcttccattgccatggccgtcatccagcagaagatggacgccatatggaagtgtgctacatttttgcctctgagaagaagtgggccttctcggacgaggggtagcctgcctggggagtaacagggccctcttccgagagccagacttggtgttgaggtgctggaaacagtgatagacgtcagcacagctgacagagccatccctgagtctcagatcggcaggtgatccacctgatcctggaatgttacgcagacctctccctgccaggtaaaaataagtccttgcaggtatcctgcgttcctgggggcgaaagggcctctctgaaaagttgctgcttatgtggagggttttcaggaagacctcaatacaacttttaaccagctcactcagagtcctccgaacagggcttggcaaaagctgtggcctccgtggcccgcctggtcatagtgcaccggaagtcacggtgaagaaaatgtgcagcctggctgtggtcaatctcggcacccacaagtcctgggccagattctcactgccttccctgcccttaggtttgtggaagagcagggtcccattcatctgccactttcatggtgtcatgcctcaaagaaaccgtctggatgaagttctctcacccaaggaagaaaagcaatttttagagctcctgaactgcctgatgagtcccgtgaaacccaagggattccagtggctgctcttcttgagccagacgaggtgctgaaggaatttgtctgcctttcttgaggttagatgttgaagaggtagacctcagtctgaggatcttcatccagctctagaggcaaacgcgtgccgagaggaatactggctccagacctgctccccgtttccatcctcttcagcttgtgccagctcttggaccgcttcagcaaatactggcagcttcccaagagaagcggtgcctctctttggataggaaggatctagcgatccatatcctggagctcctggtgagattgtatcagccaatgctgagaccttctccccggatgtctggatcaagtccctgcctggctccaccgcaagttagaacagctagactggactgtgggcctgaggctgaagagctcttcgaggggcacttcaagtgtgaagtgccagccacactttttgagatctgtaagcttcagaagacgagtggacctcccaggcccacccagggtacggggctggcacggggctcctgcctggatggagtgctgctgcgtctccagcggcatctcggagaggatgctgtctctcttgtggtggacgtgggcaatcctgaggaggtcagactgttcagcaaaggctttctggtggcctggtgcaagtcatgccttggtgcagccctcaggagtggcagcgccttcaccagctgaccggagactgctggagaagcagctcctccatgtcccttatagcctggaatatattcagtttttcccctgctcaacctgaagccctttgcccaggagttgcaactctccgtcctcttcctgggactttccagtttctctgcagccatagctgtcgtgattggcttcctctggaaggctggaccacgtggtcaaactcctctgtggcagtctgacccgcctcctggactcagtcagggcgtacaggcagctggcccttgggttcaaggaccagagcaggacctgacccaggaagccctgttgtttacacccaggtgttctgccatgctctgcacatcatggccatgctccacccggagtctgtgagccactctacgttttagccttggaaaccctcacctgctatgagactttgagcagaccaacccttctgtcagctccttgctccagagggcacacgagcagtgcttcttaaagccattgctgagggcatcggccctgaagaacggcgccaaaccctgttgcagaagatgagcgcttctgacttggcgtggggagctgggccccaacatggcgggtctgcagaagatcagcacttcttacctgtgcgggagcgaaaaagctgggcttcaacatggcaggtctgtaggggtcgacccgagcagcctggactttacagttatgtgaaactgtccacaaaaagtcatggcaatatggtgtaaagaaaatagtttcttgggtatttgtaacgtacaaactatcataaaaattccctctttcgcatctcactttgtctcttctaagtcggcctcagcaatagcccaggattaatatgctctgaaattgggtttagtgtcttcaagatcaaatccagccgggaggaacatgttataactggacttttccatcctagattttggcaaataagcccaaagttgaaaccatgtgatggaaaaagcattacatggtacgtataacccccttcaagagttatttcgtcttttaatgttttttcttgaggtatcttggaaaggacagcagcttggaaaagaatccagtccagccctgctctgcctctggccatgagactgctgtgcccgagaggcctgcacaattctaaaatgagggattggaggaccaagataaactcagtggcgaggggctaggttagtgacctcaagaaaagggtcccctctgaattgaggagtgtgtagtctttgttgctcagactagccttgaaccccggactcaagtgatcctcccacctcagcctcctgagtagctgggacaataagcacacccattcccatacagtcttaactccatctattcagtcacccccaaaggggctactgtgaagacagacctggcaaacccagcagagatgtgctgaatggatgggtcacgttagcttttgcctcggaggggttgtcaagatttggatgaatgaatggtttggataagggaatgatgtgtgcagaacataaaaaatgagtttgggccaggtgcggtggctcacacctgtaatctcagcactttggaggccgaggcgggaggatcacttgagaccagccaacatatggaagccctgtctctacaaaaaaaaaaccacaaaaattagctaggtgtggtgacacacagctgtagtcccagctaccagggttctaaagcaggaggctcacttgatcctgggaggtagaggctgcagtaagctgaatcagaccactgcactccagccttggtgacagagtgagaccctgtctaaaacaaaaaaaaaaaaattgagagtgggctaggcatggtggctcacacctgtaataatcccagtgctttggaggctgaggcaggaggatcacttgaggccaggagtttgagaccagcctgggcaacagaataacctgtctctacaaaaagaaaaaaaaaatgagtttaaggtgtctgaggtatgaggaactatgaaaattggctggggacatgtttaatgtgtgagatgaaagggggaaaaaatatgcccatcactccctccatatccacaccctccttcacaatggggcattactcaggttctcccaggtaaagtaggcttggctccctgaccaataatcggtcttccactctcccaattcctataagattcacttatgaagagaagaaacggtctcaagttacgtgtgaccactacgcttgactctgggaaccttcaatgtattactgagaccatgaaccacaaaaataggtttgagtgagtgtgagctagacctttctggaggctgaaagcattcacacacacacccctctgctagttaatggacacagaccttgagccacagcacacggcagccagtcgagctaggtcacaggatgatcttacaggacactgatattgatgtatttcacaaatgagaataagttgggaatgttagtcaatttaatcaccgtaagggtgacttttaaagatacactgatagttaaaaaaaaaagacattaaaaaatagcattttgttttttaaatggcacccattaaagactcaacagtcaaaatagacaaatcagtcctttagacgttcacagacaattgaaaggcactttaaaaatccacttttaaactaccacttgagaacacatggtagcacagtcttaaattcatcctagttgatcggaatgatgaatgagtgttggcaccagaaaatcctgcttgcagaagggggcgcaggtgtcgtccacgggacagccactggccaggctagctgccgcctcactccgcagccttctgtggctaatggcaggacggacacacaggaatgggctttggaccacaagctctggcatatcgggagcaaagcactcaagtactctgcagtctagatgacacatttcatggtttggaggacagaagaggtttccacatcacatgaaaaggacagtgtcacagtggggttacccagtaaacagctacaaagccatcatttcacgcttccctgtagttttatgagctcgccctctgcatgtggataggggaaagccgggcatgaaggggtgtgtgaaaaagaacagcctctgtgactgactgcagaagctcacaagtttgtcactgtcagacttagcaagtcagcctgcaaaggttgtgctgattcttggccacactacctactcaggttcccatccatgcctcctgcctgcccccacccccaccccaccagtgagacttctgattggaagtctatagacataagaattcaactctgacccaggatgagaggatgaggcaaagaaccaatgggttatctagtaaacgatcaataactacctcccacaatgattgtcccaggccaatgtcacaagacgacattacttccaagaaccaagtctcccttgcttctgcgggcccagtgccacgggtactgtcctgagtggtttggaaggtgggagccgctgatacagggacaggcagatgtgcagacacttaccaccctggtccaccgatccaccccatgcttccacctcccagagctcttgagataagaccttaagaaggatccttgggctgcattaaaaccactttgctgtccgtggaggtctgacaggacccaatagttgttactacaaagtgcttttgcaaatagggcaagttagaagaaggaggtaatatgaatattctttagaaaactcaaatccatcggcttatcaatacccaaagtctgaggctacccagggcacaatttgtccatggaatgctgagtggaggaggcagctggtgtgaggctgcgcctgactcccaggacatttagccatcctttttggcttggggagtgtcaaagagccggactgccttcctgcacacagacagaaccagtagatctgaggagctacgaggaaggcattggccacgttgcagtagatgggatgctgaagggtacttggagcaggcttagtccctgctggcggccataggaccagtcatgaaggggaagagaaggatccggcaggaaaggaaggtggccagcgtgaggattccatcaccttgtacagaagggtgtgctgctgctttagctgcaatagaagaggaaggaaaaaggaaggtcaccaagaagctgggcatcagggagcgacgggcccaagtcccaccacagtaaatccacacaggtgcaggtgctcatcaagaccttggctgtcagattccctggcgcccagacgttgtctagttttctaacacttggagaagacattcttgaacactatcatattgagatgtgaaataacctcattttctccaatagtgattttgaatttgacccaggccacccagctgacagagtacaggaaccgtggattaaagtatgtgtgtaaccagggaaaaaatagaatgagctgatcaaactatcaaacttagatcaaacctacaatttcacccccactggctgagatgaccactgacctttaaggctgttgaaggatctctcatcccactctcctggcactagggatttctcacacccaccatctccgaaggaaaagcagaatccactccctcccacactctttctgccattcattcatgcatgcctgaatcagaaccctcactctctctgccattcattcatacatgctgaatcagaaccttcactctctctgccattcattcatacatgcctgaatcagaaccctcctctctctgtcatttcattcatacatgcctgaatcagaaccctcacactctctgtcattcattcatacatgcctgaatcagaaccctgcccagcgacacaaacggagtgctcagttctccgtgaagatgcagccgacaaagaagtccccaaggtctccccggagcctctgcggatgagaaacgaaaaggggaagtaagtggaggttaagaaaccaccagaaggaaaattccaacgaggctactgaaaagggtaactgtgacgggcaaaggacgctcaataggcaagcgcagactatgtaccgctgcttccgtggcaacagcactttgatggtccaagccctaggatccagaggcaattcagacaggatgacggcgtcccacaccaagctctgaattttgatgacagccggaagaaggctgcaagcctacttttgtgtatcgaacttagtcatgccaagacactcagcctgttggttcaataaaatgtgccaggccctgtgctagatgttagggtctcaaagcaccctagatttctggttcctagatggtaggtcccagacacttcttaaagaatttaatgcacgttaccctatttatttattttatttttattttttgagacggagttttgttcttgttgcccaggctgagagcaatggcgtgatctcagctcactgcaacctctgcctcccgggttcaaatgactctctgcctcaggctcctgagtacctggaactacagatgtacagcatcacacccggctaattttgtatttttagtagagatggggtttcaccatgttggccaggctggtctcgaacttctgctgggattacaggcatgagccacctcgcccggcctcttttttcaagaaagcagtaagcaggtaaaatatcagctctgccacttagtaccactgagagatataagaatactcttagagcccagtttcttcatctacagcataaggctaatagcttctaatatttagcaagctatgaactttaaatcacatgcctggcagggcgcggtggctcacgcctataatcccagcactttgggggctgagacgggaggatcccttgagcccaggagttcaagatcagcctgggcctcataagagacccccatctctttatttaaaaaataaaataaaactacatgccggccaagagcagtgctcacgcctgtaatcccagcactttgggaggctgaggcaggtggatcacctgaggtcagagtttgaaatcagcctgaccaatatggtgaaaccccgtctctactaaaaatataaaaatagccaggcatggtggcgtgcatctgtaaacccagctgcttggaaggctgaggcaggagatcacttgaacccgggaggcagaggttgcagtgagccattgcactccagcctgggcaacagagcaaaacgccatctcaaaaaaatgaataactaaataaatgaataattaaaaaaaaaacgcatgccttcccctggccaggcactcaagagtgaggaatttcccctcagctttcccatgcttttctttgttgggtgggcttttatggggaaatggatctggggagaaagtaggaggcatttgctttgagaatctgtgttttgtgacctaagaataatccacacagtgctctctggcctgttatgttgctttgtattatatttgtattttatattgtttttatcttgtattgaactaggatagaacctctgacaaacgctagggaatcacagagcgctgggggtttgttaaaaagatgttggggccgggtgcagtggctcgcgcctgtaatcccagcactttgggaggcctaggaggaggatcacttgagtccaagagtttgagaccagcctgggcaacatggagaaactctaaaaaattacaggaattagctggacgttgtagtgtgtgcctgtgttcccagcttcctgggagcagaggcaggaggatcacttgaggccagtagtttgaggctacagtgagctgtgatccacaactgcactccacccggggtgacagagtgaaaccctgtctcaaaaaagaaaaagtatttgatgttgatgttggtaaggaggatcatgaacgtttcatgtgtaatggtgttcctccatattcacctgggggaggtggctctgaagcagcaggcacaaggagaatgggtgcctatgatggcaaagaaaagaggggcaatcccgactcctaagtaacggtcaagacatctagctcagccgggcgcagtggctcatgcctgtaatcccagaactttgggagg

SEQ ID NO: 5053 - DNA, 57536 bp, Homo sapiens
ccagatagacatgcatcagtgtcctcggtgtgcagcacacaggatccagtctgtgttagtgtcagacaccacaggtgaccggtgacattccaatccttgccaactgggcagggctcttttcccaggaggctggcactgcccggggaagaaaaaataaggggttttgaactctgagcctgctcctcacatcctgtccattgaggggtggacgcccaggccctcaaaaatttatacttagtgagacacaaatgcatggttttccttagtgccttcatctattcaatacatatttattcatgtttccagctggaggtggtggctcatgcctataatcccagcactttgagaggccaagcagtcggatcacctgaggtcaggagttcaagaccagcctggccaacatggcaaaacccatctctactaaaaatacaaaaattagctgggcatggtggtgcgagcctgaaatcccagcactcaggaggctgagacaggagaattgcttgaacctaggaggcagaggttgccgtgagcaagattatgccactgtactccagcctgggcgacagtttgagactctgtctcaaaaaaaaaaaggatatttattgcacgggtcagaggtgtcctggtggcacccaagctgaaacctgcaagtaagaaagagtttaccaggagaagagggaggatgagggaacagtgtttccagcagaggaacagcatatatgaaggcccagaggtagaagccttttgaggggcactgaaagtagcctatttggctggatgcaggcaatgagcgtggaagggaactcaagagtcccaggcaccccgcagagaatgtaagggtcacagtcaacaagtattgagccctgctgtgtgtagcagtccaaggaaaacagtccctgcccccaccaaagggagagtggtaagaagctgaaggaaggcagtagaaggtctgtgtgggagtttcagtggagaagaaatcatatgtagttgggaaaaaatcagtaagattcttggaggtggtagcatttgagattgaccttgaacctcaactagaatcttgtcgctggggaggtagggcatggatattccttgcaattcacagcagaacaatgaacatatacgagcatttaccacataccagggcgttagctggctttctccaagcaaccttctgaggtaggactactatcattcgcactttatagagagaaaactgaggcctagaaaggggaggtcacagtccaaggtctgtctagctcaaagacagcataatacctatagtacaatgtgccgtggagaatgtttatgaagccatctcctgggggcaggctcatctccatggctgctcttggcctgtttttcatgcgctgcccatttggaggcatgtgcctgttgagtgtttaagtattgatctcacatggtatgacaggcacaaatatttaaacattcagcagtgaggcctcgttgcccaagattgtcccagcgtgactcggggacagaataacaaaatgaacttaggtcttattatctcctggaggcttattgtggtttctcaagtgattacgcacattaatgcagggactccttttgctatgggggaatttctggcatggaggggggtgtggttaaggtaataacatttcttctgaaaaaaaaaaaatgaaggcctgcttccctacaggggatattttcttaggttgaagggggactttcagtgttactacaattttggaaagcctggaatatgggattctttgttgtcatggagacgagtctgctatgagcagcagatggggtcctggacagagggcctggacaacgggcaggaggcaaagcaggttggtgacaagtctgggggtcctgactcccagattgggtctcttcccagtcgtcacctatagcctaatgagaggctctctggggcggcagaaaaactccctggcaggatcatgagcttacaggcccagagccctggctttggaggagcccaggcctgagctgagatcagtctctgctcctctcctactgtgtgtctctgggccagtggttcgtcctctctacaccttgtttccccatgtgtcaatcattaccatgcagcaagtgctcaaaaatgtagctagtaggatggttttcgtggctttgccagcagatagccaagtaccctcaggcaagtcagtgcctcttctgggcctcagtttacctgcaaaagcattcaactagctaatatctaaggaccatttctgcctaatggcctgtgagtctatgactcaatgaactctcccaactcgagaaagagagaggctatgataatgacattcacaatcgacatttccaccatctattgggtgcctactatgcgcgggaaccctgctgggcaccaggtcctcctcgtctcacacctacagtgcagcctcctgacatcttctcacttctgatcttctcccttttaatccatcctgcatacctggccagtttcagtttcttaaacgctgcctgctcctttgctccagaacactcagtggctccccagtgcccctaaggtcaagacccaactccttaatgtggcaagcgaaccttccatgctcaagcccttcccttgtcatggactctctgacagactgtgttgtctctttgtctagtcctccccattcctcgactcagtaggtgctcaataaatatttgtcgagtgaatgaacacatggataaaatgtttcctaaattaggctactcaaactttagtcctttgcaaagcagccacaagagttttgcaaaatctgcacaccatgtctatttttatttacttaaatattttccttttttagattaaataaagtatctcaaaaggaaactttacatcatgctataactagaaggccaatattacttgccagaataggtctccattaaaataaatacaaggacaaatgagcaaagcattcaattctaactaatactgttgtctaccaaagctggcagcctctcagttaaaatgggattagtcagtgctttgagaggtgttaaagactaaaccagcaccaacctgagacttgcccattgacagaaatcacaggatgtaacaaagggatgaataggggagaactgtttcactccaagttatttcactccatgaaaattatcctacctaccatcagaggttggcagcctacattttggaaaccttgttctcagagcccacagctccagctcaggaggtatgcatatgagttctctgaaagacttcaactaggctttttgaaagagtattggaagccctgcatgcaactacctcgccttcacaatataggtccctatctgaagtctcactgcaccagagacagctctcagagctcgactgtgataagatttgttggaaaccatcttcctggtggaataatgagctctccccatccttgcagagatgcgacatacgctggacagtcatgggtgtagggcaggggcagggaatgccagcgggggcaggaatgtcatggagataattcaagcatcagatggtcagcctatgaaattgacctgatagctgagtttgctttcatatgtaagcaaaacaaatccagagggatgaaaagagagaggaattctttctggtcagcaacgtagaaaaaacagagagacaattgtgaatgaggttacccagaaacacgaaggacaaaagggggatgggaatggctattattattcctttttataatgcttcatattctcaatccaacactggattcatgaagactattttggttttaagcaacataaactgattcaaacttgtgtagcataggaaaaacaatttaatgatataaatagctgacactgccttaggtatggctggatccagggacctgatatacatcaagactcactccactctctgtctctagttctgctctcctctatgttggcttcattttaggtcgggtctgctcaagttctgcaaaatggctgccaacacctctatgcttaggagctttggtggagattgagtttctgtttgacatagttttagcaaaagtcccagacagagttctcattggcccagcatatgtcacatgtccctcattgaggtcagagtgatgtgctctgattatctgtgccctgggtcacatgtctgtctcaggaggagggagccccacccaaccatattgaatatgagtgaaggaggggaagtttcccaatgaaaattgaggttctgtcacccaaagaagttgaaatgaatgtcaggcaagcaaaagtgccttcatttttgctacccttgtatctccactcaaagctatgccccacatctccatccaacagctcctactcatccttcagacctcagttcaaatggcgcttccttgaggaaaccttccaaaccatcccacactagactggaatcccctgctggactagaatcccctgcatgtgtgccctggcagagcttgtcattctgggtttgtgcggttatttgatgaaagcctgtctcccatctggactggcatcaccttgaaagctgtggcctgtcttgtccatcgctctgtccctggagctaggacagtgcctggcacacaggtggaactcgggaaatatttatttgaaataccaacgaagtccacagcacatatgacctggtgatcagtggtgggaggtgaatgggtcaagaaagaaccaagattccctgctcatgagtgagagtgtggggaaacagaagaagtcagggtgacctggtgagcactgccctgggggactcgaggatggatgaaagcagggaggaggccagattagtggggtagaggacctgaggtccatcagcaaaggccatccctggggacaaagagaggagggaagagtaggtctgggctggagagaaggaatcttttctctgagttcctggggaccccaggggaagggcagatgtggccccattcccagaagcctttataaaagagggtggggaggtcagccttggcaaggacaagggaaggagtccctacgtgctggattgggattggctggaaagggacttctctgggagaatccctcaaacctcaagaactgagagaagggtgtctggggctccgccaccatccctgtttcccttttaagtaatctgtttccccatctgtccatccatacacaagccacttgtgtctccatgaccaaccgctggcagtggaagggtgtccttcccacccccatcttacacacactcccagctggtacccagagcctggtcaccccaggccaggcctgtgttccaggtgtaacgggcagcagacgctgccctaggactagagcagggagggggcacgggccaccccaacccacagcgacccacagagggcgaaaagaggacgaccgcagagagaaacggaaggacaggccaacggaagcagtgctgcaaggctggaaggagaaaagccaggaggggagtcttgctgtgaaagacagggagacagagaccaagacggacaggcagacaggctggtgaccaggatgaggccggaaagagccatcaaaggaaggagaaggaaggagagagattggagcggacggcggggcaggcgagggaaggagggggtggggagagggagggaggaagagaggggagaagagggaggaagagaggggagaaggagggagaagagagcgggagaatgcgagaggaaaaagggagaggggaggcgtagaaggggagaggaggtgaagggaaaaggagagagcctgctgcggcgaagctgcaagaggcagctgcggagggagcgcgcggcgggcctgggggagcgctggcgggggcgggcggtgcgggcagggctctccccgagctgggcgggctccgggcgccgcggccctgccctccccctccatccctccggactcgctcccccctcctctcccttccccgctccctccgcccgccctcggaagaccgagacagcggagaggttgcgggtgactgcgctgacccaggagccgaggagtcgggagcgcagcgcagcccgagcccgagcccgagcggccccggtcccgagcgcatcggagcggccgagccgcccggtgcagcgcctgtcccgggcagcgcaccccggccgcaggtaggaaagggcggccggcgtcggggcgcggggcgcagagcctgggaaacggcgcaggaacggccagagccccgagccgctgccgcgagccgggccgggtggggggggacacctcgagattcaagcccccgcgccgcaccttccctgagccacatgaaggagcagggcgccgctcggaccccgacgtgcgcccaggccatccgtcccctgggacactcgggaggaggagggctggaacagaggcgagagttgcatgccccttccctcccgcggtgccccactgccccgcaagttggcactggattctgctggagccgtcgaagctccctattcattccccaggcatggaggggacgcggagtgaatgacaagagcagcgttggggggccgtgcgccactttccaatcctggggtcagctgagccgagttagagctatgcccctcatttgttctctgcgggtacggcggggtcgggtgcgacttgaggatgggacgtctctgggacagcccaagctctcaaaacgttggcttaaaagcacaccggggcttgggctgagtgcaccggagctaagcctagtcaccagagctcgcgccgcgctctcccagccccgactttctccaagagatgtggggtgcggcggtcccttagagggctggaggacggtgcctccttgctgcttcgggaactgcgctcccttcttgcttttggtctctgcgtgtactccccggcgcgacaccgctcaccacggtagcctgggcagtgcccattgggttctgagcacacgtccccacgggtggcacccacagatgtcctttctaggcttggctcggtcttcagacaagaaactcagaccgggcagtcccctattgaggtctgagctaatatcctcccaaaatagacatgaaccacaaggagaattttttaaaagccaatgataacaccacgttctttccggatgtggggctggagcgctcattccctttcccaggagctcagccttatccccatgaagagctgggggggcggggagggcgggaataaaatggctctgagatttgtgacaccccaaaaatcagagacggtatcagactgagtggcattgggggtcacctttgtttttctatgacacacaaggtgggtgtttggcaagagagtagggatgttggggctggatagtgcctagattctgtgtctttgggaactttgggggaagtgtcctcctaaggagccaaaaaggctgctaccccagtcccccaaattccaaaacaaaagaggtcagtgaaagtactcgcattttgcatgttatctctttatctttggagcacattgggaaggactgacccactccagatcagggtctgattggggcaggacagaccctctccaaggcagagaaggggaaaagaacttgcccttagaagtgggagtccctgggggagtgggacagaccttttcccagagcgccctggcaaaatggctgagcctcccttgagcctcagaaataaatcgtcaggcaggcagaaacaaagaaagagctctgtctccagccaagcactggctcagtggccagtccttggaggcaaacagtgagtcccaagcagagagacgcagcccggcctgtctggcagagcatctggaagtggggttcccctaggaacacacaggagagaggcagccactctggaggtaaaatcagggccctctgtcctgatgtgggacactttatttcaggtctggaggcttgatgagaagtgggttccaggaacttagatggggctgggaaggatgtctggagaccaaggagtaggtagcttaggggtaaagatgaggcaaaatcaagtccatcgaagccaaaagatgcacagtggccacgtcctcctgcctgccacggattttacatgcctggtgaccccggagcagcagaggctataaattttttacacgtggcccagcacacagcaggacctcaataaacctcttagaataaagcctgatggatggaaggtgatgctatcactggcatggacctacctgcaatctgtacctgtctcatgagccaggaaggctataaaatgtggccccttagtccatagccgggaatgaacgagcccagatgagggtttgctttgagctggggcattgccatttctggccaggtgaccttgggtacttcttgttcctgttggaaggaaggaatggagtacccaaagcttccaatgtgccagggatattcctacaagaaccgtgtggagcaggcactattctaatccccacttcagaggcgatgaactggatgcagagaggggaagtgacttgtccaaggtcacatagccaggaggaggaagggagggatcttaaccctactgttctaatttccaggccaactctgtcctattgtgggtctctggcctcggtttttccatctgtaaagtgaagtgatggggtggtagttcccgtgggcctgcatgggagcagtggctggtcctctaccttggtggcatatgacatgtggagagcaccatgaataaataaagcaccaatatcaggccacttcttgccatcacacaaagactccattccttgcttggctgtgagctcagcagctgagatagagttccatgctacttggaatttggagatgtttttccaccctcttgcttgtctatgggtctcaggcagagtgttaatgaccgttgattcaccttgccaccacctttagccacctgcatcctgaagtccatctcctttgtccttagaagccatccctgttgcctagcccaaaatgtgcccaccttccccttgactaccacccccgccccgcagcccctctcctcagccacagccccaatgccaaacccagttagagccacttcatccctctctgcccaaatgaaaactaaaatgcaagcgtcagcaggcctgtctatgcctgtgtcggactaccccttcaattcacccgtgcaacgtcgcctgagcttctctgtgcctggagaatgtgggcagggtatagccccgctgaatgacagcaacctcgaattgacttcagttgccaagacattgggcacttcccccacaaggtgaaaagatcatcctgtgtccactgctctgtggcttgcatgcctcgatgctggcttctcagacaggccctgcacgggtggctcttcttgccaacttaccccattctctgaagggcactgggagatggaggggaagaggttggtgcttgaaaaagaaagattgggaggccagatgtgcaccccaaaataggacttcccaggaaatgggtctcaggagcatattaacatccagcatcttcatctactccatgctcacctaagacctctggggtcggggaaggggctatggagtcagtgggaagtgggccagtagcagacaggagagttgcctgcataggcagtaggtgtgaatgcaagctgtgatatttcagcagagacctggaattcagtctaaacagaaaagaaagaaaacactaaatattgttccaatgcaattgtatcaaaaacagtataactgtcagttactgcatgttggcaatatgccagggactgtgctgtgtgctttatatgttgcagttaattttcacaaaaccctgtgagatacgtagcataatgatccctgtcaggggaggaaactgaggaggagaggggctaaagcacttgctgcaggatcactgggctggtaaaagccttaaagcccaaactcagtcacagcatgcttaaatctctgccactgaaaagcccctacactgcttacttggcaatgaccatgagcgccccccgctgcctccaccccagttaaggactgcacagtttacaaagcacttcttcatccattccatctgtggagctttgccacagctcgggaggctgggtggcatgatagcttctgcgtgataactggggaagctgacttgcagagaatgaatttgtgcccaaggtccctcagctgctaggttgcagaactggggttcaaattgagtgtccagcctgttacaacatatttgggacctagattttaaattcatttgcagctagtgcgatgtcatgcactcagccacctttccctaactctcgggtatcccccaattttgtccccacatcttactgctcaggaagctattgagagtgccctgacaaagccatcagctgcatttacgtgatctgacatgacacagaagtggcatccgattctatgcaagctgcctgcagcgaatgtcttctatttttacatttctcacaaattggaaattacaaggaggccaggtcttgcagcggattggctgtggtgctctgaaagcaggggatgtacaactaggtggaacaggccactttagatgccaggggcactgttggctgtgaaaggggccccctggctgctggggctggatgggacctggcacacaggccaggcttggggatgcaggagttagtgactgccttggacggtgaccgcagctctgcccacctgtcagctgcctggtgtctgcaagttctgtgtctcacgccagctctgagataactgagccctggccagagggacattcaaggtcaaagatgccctgaaacatcacagcaggttgctttcatggctgtgtagtttgataaggagattctgtgcagggagagggagcagccacagggaggtgagcaaagacatttggtatcagtgttgcggtttgctgcaactagcgctgatcacgatactcccggtcatcagaaccgcactttatactttgctaaaaatgccttgcagctgctttttcttttgatcatgtatgaagtattccaggggaagaaaatatggtcttgagatcctggagaagaatcctctctccaataaagagtgatttttttaaagctagtttcttataaagcccaaatcagaatgaccttgacccaaatgaggctcctttgcacacatgtcgtacatgcacacgttaacacttatgtagaatttcagttttcaaagtgttttctcagtcaagcttgtgacagccctgggaacttcaagtgaaggtaattttattgttattattggtacattattatccccatccaaaagatgaacctgaggctcagtgagccctgactcctcatctcgtcccctagtttcccagctgatgaaaatcacctttgctaggctgaaatccaagttcaccggtagccccttgagaaggagcccagatgaggccagatctggtaggaggcagagcacagacactcaaagatcgagacttacaagagagcgtgggaaggcacggctgtgaggctggggagaaagggccgtagcatcttgtaaccttacctgagctctggccagagattaacatctccttgttatgcgcagagtttggggtccaaagtgtgatcatttggccggggggtcccagcagtaccaggcctggagggagaggaagggatggttgctctcacacacctatgtgcacacaagaagcttttctcggtgaattgggggagaaatgaacaccagggaccccatgagatttcatagaggatctaaaggtcttggtagccaggaaggttgtggggagtgtttgtatgtgagcctcagtcagacccactggaggagcaggctgtgtgcttctgagccatgcccaggcaagagggcaggatcactcacctctgcctttggactgttgccatgctggagattgtgaaatatcatgagtctaggagcttccctctggggtgcagggggaggcaagagacctgagggtttgacagttcctggctggatggtggggagagaacttgtccagctgggccctgacagtgagttcagagggctgctgggcactggtccctgagccaaggctgatactggatgataggtgctactctctcctctgccagagaggaccctgagcccaagggtggtggagtcacttgccacagggtgcacagacaagtttggtcccaggtcttggtgatgccaacctcatgctgcttctgaaaagcacctgaacaagataactgttggggagccaggggctttttctctgtattcgccatttctggctgtgcatgcaagggctgagaaaaagtgaaagcaatacaaaataaaagtggccaaaagcaaaagtaccagcttcctgggcaccgtctgagctgccagcctgcaatccaggcttcactgccgccgagctgaccaagcccctttccgcccaagtcagatgtttccagagcttaagatccaggaccacctatgattaaaaaaataataataaaaagtaggcctggggagagagaagaagtcatctactgaagagtatttttgaaagatggaatttaaatgcacgcatgtattacatatgcattttagcaggttggttcagcataatgacacagaatgatctgatatgtacatctctcagtctgggctctgcctgtgacctaggcactgagccagtacttcacaagcattgtcccaggatcccaataaggaaactgaggctcagggagctcaagaagttgcccaaggtcataccactgacaagggcagagctgggaatcagatccaaagctgcagggctccgaggcttgggcttgcagactgagaaagaagtgggagagccgccttctgctgggcctcaagcctgtgggggaccgtgggaggttctttcccctcttggctttgcatgctcagttcatacagccaagaggtttggaccatggataggatgatcggctgctccccgcaccaggcgccagttctccaggcaaggggagggagttgcacgccccacttcctcctctcctcctccatttcccccataatagcctccccgagctaatgactgaggaagataagagccctttctccaaatggcagtgaatgccactaatgacgagcagatgcagcactgttaattattccacgggtattaaatgaaaacgccagccctggagagttaaatagcaccactgatctggcaacgtctgtgcttaaaagtgatgccatcaaaccggccggggcagagcagccccctccccaaacttggagctagacaggagtcacaaagtaaggtcccctcattggtcacagacccctcttcagctcagggtccgaagcagctccttggagaatggatcggtggctgctttgggagattttcttaaaggcccctggggggcctagactagtatccttaggggcagatgtggacaaacaattggaccgaataaaactctgagcacctactggtgccaggtcctattttggattgtagaaagaaactggatgctgttcctgccctttgaagtccacttgcattgaaaaccgtagattccttaagagcaggaatgctgtgttgtttggagttctggtcccatagtcaagaacacagagtgggtacctctgtattactttgattatctgctgttccttgaatgagagccagaggccacacagattgtggccagagtgagatcggtgggcaagggactgggccagggtcaggctgtcttcttcaggtacaagcaacatgaccttcctggaagcttagccccaggttctgaaacaagccatgacctggatgaagagccgggttttccactgctgaggcaccacaggcgactcctttgccctctctgagcctcagtttgcacatctgcaaatggggaggataagggccatgatggctgcaggcaaaacaactgtctcctaaccaatcctgccctgaatctggaggatcacagagacctcatgaatgtttgaagagtgacattctggagaaattcagcagagagagagagtgtagtcaccaaaggcagcatctggttcttcctgtgggctcactcaaatctcactccaacccccaattcatctccagcagctcaggtcacttgttccagcttcctggacctggaaagctgtttctcaggtctttgtaggctagagaacatcacaaacccacccatttcagacacacctgtgttatagatgggtaaactgaggcctagagaggaaggtcctaggtcttgcagaggctaggacccagagcttctaacccctaacccagtgctctttccttccaccaagccagcccagctcctccgttaagaaattattaaatagagttggtggaagactctggttgccgtgacaacggagcctgtgtcctcgggagataatggcgttgcacaagcagagcgatgtgtgttgaatgctgattcaggacctgctagagtgagagtgagtacaagagagagtggaggggaccgtgtctagaactcgagcttccccaagaaggaggtgcgggactgtaggggtggggcaaattgccttctctacttccatccttcctacagccttgtcagaatggatacttccctgcacttcgtggaggtgcagagtcaggtgaggagaggtgaagtgactcatccaggtcacacaaccaggaaagagccagagctgggattatacctccaaccaacacggggcctaggctatagggagggcctggaaggaggctcacctgcaggggcaggggatggttgatgagacctctctaaagtcttaagtgcttgtggaggtcctgatggtccaggaatgacaattcagcccaagaggaagagaaaacagaatgtcagcatagctaaaagcatcagctttggagcaaagtcacatctctccctgccacttactaaactgtgtaatcctggatgagtcactttcttctgagcctcagtgtcctcatctgcaaaatggggataatgccggcacctacctcataggttgtggtgagactgcatatcatgaggaagataaagcatcgagccccaatcctggccatactcaatcaccagcagctgttgttatgaaccaaaggggagaggctgggaaaaggatccaccccaaccatgtatcagcttgtaatttgtggtgttggaagagcgaaactggctaacacagacaagcatgatacataacagggctcttcattccaggctagtaaatatcactagaacaaagaacagctccatcaccaaaaatatacataaatattttgcatttgaagagtgtgaatgtttacctcactgcaaatgtactgtccttaaaaacctccatgcacacctcactgagggaatggtgttttctctgtgccagctatctaaatgaccccatgctgcaaacgcttttggaaaataacactctcacccacccacctagtttctcttctagaagcacagctggttcagtgtacttactccctaatcagggattggagaacatggggttaataccctgtgaaaccccaaagtgcatatttgcatgctggcaaagatgcaggctggcagacaaccccattccattttggaagcggaagagggtgctggactcaggcatttggctgtttgaaaagcgctggtaagagctgggatccgatgattgagatgcaagcaaccattttgtttgtttccgcaaacctgtttgagcaaatcccccccagagatagcaacctgtttctgggtcccctgagagagagggtcatttgtttgctgtgtttctggggctggatgccaagctatgaggcaatgagctgacgaccttggatcctgaccccctattctatgcaggcaggagaagggtcagggagactgattcagtgaacaaataaagcggttgacatttaaccaggattttaatgggtgtgccaaattgcaagatacatacacatgccactttgggaatcatgtttaataaacaatttgccctaagaatttgattcaatcagcattcccagtgactcccaccattcctttatattgattgcctataggttaagataacactgggctggcgcagtggctcacgcttgtaatcctagcattttgggaggctgaggcaggcggatctgaggtcaggagatcgagaccatcctggctaacacggtgaaaccccgtctctactaaaatacaaaaaaattagccaggtatggtggcaggcacctgtagtcccagctactcgggaggcgagggaggagaatggcatgaacccgggaggcagagcttgcagtgagctgagattgcgccctgcactccagcctgggcgacagagcaagactccgcctcaacaacaacaacaaaaaaagtaacactggcctgccttccacccaggactttttcccatcactaactaaaaatataaatgaagccctgatcaggtggtttattataatatctgccaggtatcaagcatttactatgtccagatgctgtactaactacatatttccccatttaatcctcatagcagccctagaagtagggttatcacttctgttttagacagagagagtagatgactaacctacagtcacacagcattaaccagagctgaaactcaaaactgggtgtccttgcccctagggaaggacaaattttcttaagtcccacgaacaatgggcatacttatgaagagctgctgcttgggatatcatagagtgtcagaagtttgtttgtcaggagccatgataggggcaggcagaagagggcattgctcattttcatgggacttaaagaaaatttgttcaataaaaatctgatttttagccagacatggtgcacatgcctgtagtcccagctacgtagggggctgaggtgggaggattgcttgagcctgaagacagaggttacaatgagccgagatcatgccactgcactgcagcctaggtgacagagtagaccctgtctcagaaaaaaaaaaagaatctgatgttaccaaatgggtagactgttcttctacataggagtttccactttacaaaaacaaggggctctataccataaaattcctttcccagctaagtgagtgagtcaagaacagatgcactggtgaacgtgagcattcaagtcttttaaaataaaattagcctttatattgtgggaaaatattttagaccctggaatctgacccttattgactctgaaaatacacgcctccctcattcttgcagactattctaaagcagagtctcctgcggttttttaaatccaactgagcttttattaagagaccaataggatttgttgtttccaaatataaaactataacaccaaacatgctttttcaaacttcaccacccccaagagtttacatatcccccaggaaaggggcaatattaaccctcatccatcttccactgcttagagaagagttctactgagtgactaagattgtaccgtgtatacaaggattgcaaattcaggggccttgagggccagacaggtcacagaaatgagtaaagaggtcagcgataggatgacagtaatgtgggacttgtagtaaactagaaaacacatcaccacttcccttctccaaagcatgcaagtcaatttctaaaattcaaatctgataccactcaatcaagcatagctgtgggacccattcgctcaaaaccaccacgttgagatccctggtggttcttattgtgaccttgtgtgatcttgtccagacagtttctctttggggctcagtctgattgtctctagaaggggctgatagagccgcagagctgctgagagagaaatgcagtcccaggtgtggacacttaataaggagccatgggctgtctgcagccactgtcacggatatgccttctgcgaccctaagccagctctctgtttggctgtgctcctgcacgtcacttatttagttcatcgtttagttcagccagcccttgcaggttattttttcttttccccaaatctgaatgcttaaagggcctttatcttaatgcccgtcgagccttccaagcacatcttgaacaggaatgaacagctattttaaccccacgggcttctacaagtgtgttttaaaaggcaaagagcgatgtaaaagaatggcaaaaggtcatcgtgccctcttatttcctggtctaagtcagtcctttctggccggttgagcacagggcttttacagggcgtcccctggaactgaagtcctccagaaagccccacacccctcagaggcaggaggaaaaaggagcctggaacaggtggtgagggtgcagagggtgggcacccggacctgttccacagggctcgccctcgtgcccagcacagggttgggtgctcaagctggcaatgggagacagctccctgagtggaaggttgagactaatgggctggcccccagcaaatacagtcagaaccaacgaaggaagtcagtggaacaggccctgcagcctgggttcaaaaatcccggctcctcagcccttttgaccttggcctccgccaacctcaggcttctcttggctgaaaggtaggctccttcctccctccttgggttcagtgagcgacacagtggagccttgcccagctcacaagcagtgatggcgcatctgttttctcttctgtccttccttccttctgcccttatttttcctctttccctttctgatcccttcctgcgctcctcctttcttcctcctgttttcctcctcatcactctctcctttaccccagcctcctccttgtctgtttctctcctcctctccttccataccctttctctcctttcccctccttcccaccctcctctctctccatccctctccactctttcaaatcacccagggagatgcctctgagttcctgtgtctgatcccagggttcgatgttcctcatctgcagcagacgtctctgcgggcacccaccagccccagcatgcgctccagggccagcccagggttgacatccagggctttccttacaggaagcaatcaagagagtttccagcattaaacactcaggaagcaaggccagtttctgcccgagagcatgcctcactggccccacaagaagaacaggcctaaggctcagtggtgtgctggagcctgctcacagatggcacatacccaatccatgacctcatattagtaccttgcacaggccacagtgggagtgtttacaccacagaaatcgcagatgctgcaaattgagtcttctgttttgtttcctgagagcccattgttaaagcttacagcacaccattgctctgtagacctgccaccttctcccaagcaaacgtttctgtgctgagccttgtaagaacaatgtcctctgccatagagggcagaacccagaagagcgcatgcatactagcactgttcaagctgcctgctgtcggggaagcagagcgggtggaagacctgggcccgttcttgcataggtgacagtgcagctgggaagctaagagagaagaatccgtaattagtccgagagaagccatgttgtatagggcgaccaggccttcctcctcgcccccaccatggtccggttcaggcgctgtcccttatccttgcaccatccctgttacagcaacctccacccatgcccctctcctctcctcctccccacacagctgctgggcggtcttgccaagtcaccatcacacaaatctccccatcttccacggttcaggtggcagccctggtgaccaccccatgcccacatggagagggatagttaagaacatgggctttggaatcaaactgcagtgtctgggagctggaagttgttttactgtctgaacttcgccttcctcatctgtacagtgtgcagtacagaaatcagtaaatatattaagcacttcctcagccttcggtgtgatcatcattcttattacagggaagatgcgccctcttttcctgcatcagagctctttactactactggcggcttcctggcccgttcccctaaatcaccccagattctagcccccaacaagcctcctcactgtctccaaattgttctgtattttggctttgttctatctgcctggaatggaccaggagtggttagggttgagttaaaagcaaggagtccggtcctgctcctctagctgtgattatttgaaaaatatcccacttctgctcccttttccaccaaccgcaatgctacccctcccagttgcctgcctgaaccagaccccggggcagggtgccacctctccttctctgcgtgctgtggaagaacttaccccgggatgtggattgtccatggcccatctcccagctgtcccgagagctcagtggcagcaggatcagactccaacttgcatctttgtccctcagcacccagcatgaggcccggctccccggagtgcacagtcgatgcggatcagattgaaaattgccttgacaaaatgaagttctcagttggcactacagataattaggggccagaacagacgttagtaaaccactgatcgtgtgagcgaacaagcaggactggatcagagtgaagtggagctggaaattggagtctgactgtcctgctgcacacagaagaaagctgaggcacagagaggggaagggactggcataaggtcacacagcagtaagtttagagagagatttcaaacctgtgtctactggacttcagggcgtcaagctaatgcccttcctcctcaggtcagctcctcgcagcagctgcaaggcacgagccatgtctgcattggaggagagctggggtctccaagaggggagtgctgcccctagaggctggctgcctccggggactctgattagagcctgcagccccacagctcagccagaatcccacgtgacctcccgggtctccctggatacctgtaggctttgtccagcgcaaccgtagaagccattttggagcagaactcagaggctctcatgctagcagcctctcttgggtttcttaaaaagaacagcaggcttgtccttgtggaggtttgtcctggagggaggtggctgctggggacgggccatacttgacaccccaaatggagggtttggggggttccacaggtaccccattagagacagcagagtgttaagagtttggacacaggagcccagctgcctgggtcaaggcttggcatccttagctccaactgggagacctttggcacgtcactttaacctctctgtgcctcagtttacccatcaataaatgggggctaaaagcaattgaatagacagaaagcatttagagtggccccggcacattgtaagtgtgtccagctcacttcctccctgtactgagctcttctttttctttcaccccttttaatgaaaagttggggaatttttcttttctgtaggcggctgcagaaggagaaccatcccctggaatctgtttcaccattggatgggtctgtcatattccagtagtcgcaaagttgaattgttctcgcctgggttgtcggggtggggatgccctctggccttcttccacattgtggttcagaggtgtcctagaaaacctgacttctaggctctcagaggctgagagcagaggggaaggctagagcttccatttattcatctgtcctaggacagtgaggctaggcaaactcatctcatgcagtcacatttctctccctctggcatccagcagccatgcttgggcagatcagatcagaggcctgataggtctaatggtttcagggaatttcacacaggccagcgcctgggaggcatttctggacaagcaaatagcaccagactataactcagagggcctgggtcaagtcctgtggaccttgggtaggccatttgacgtctctgggccttagtgccatcatctgcaaaatgggacaatgatcagtttagcgtcaatgtatttagctcttgctgaactgggcacggtgctagaaattcaaatccagtcatcacagagtgggaagtgcttactattgacctcctttattgatgagaaacaaaaacttttttttttttgagacgaagtctcgctctgtcatccaggctggagtgagtggcgcgatctcagctcactgcaagctctgcctcccgggttcatgccattctcctgctcagcctcccgagtggctgggactacagacacccaccaccatgcccagctaatttttcgattttttagtagagacgggttttcaccgtgttagccaggatggtctcgatctcctgaccagtgatccgcccgcctcggcctcccaaagtgctgggattacaggcgtgagccaccgcgccggccaaaacaaaaactttgagaaaataagtagcttacttgaaaatcacagtgggatgtgtgaacagtaggcacgcgataaatactactgacaaagacacctgcttctgcaaattcccctcaggtacgttgaggcagctgaggggtttataccaaggcatgaaactgctttccttcactcttgagtaagagtatgcggctggctgggagttgggagtccataaggttcaggccacttcaggctgtgtgaccttgggccagccaccagtccttgctgggtttttttcttcatctatgaatgccatggtagaccaggtgcaccagtttggcatgcagcaagtctggaccaggaagggaccagctgggtcgtggccctaagcaccactgtgcatggggctgaggtccaagaagggagcctcccatttagaccccaagctgtcccaaccagctcatttctcctgtagcctgcatccaccacaggcctggctggcctctgaggtcttgttaaaatgctgggccttggagaccctcttggcggctccctttccattagagcaccttctccagggagctttccctgacctccaggacgcgcgtggcaagcactgcccacagcaccggctgtcccacacaattccaacctccctctaccttctgtacctgatcatccactattaattggtcttcacatttgtataacatttttcaatacaaagcacttttgcggccattcatctctttgagtggcagcctaagctgctatttattacacttcctgtgtgccaggcccttggctggcctctttccatgcattatcatgcaattctagagcaattctgtgaaatccacatttacagatgagaaaattgggactcaagcaagccagtatgtagccctattacacagagatttgaacgaagtcccatgaaataatctgggtcattctaacaacagcttctgaagctttcctatgtgcctaaatcacgggacctgtttaaaaatcacttctcgttccacaggtcttgagtggggcccaagattctgcatttctgacaggctcccagtgatgctgatgctgtctcttgaagaaccgcactttgagaagcaaggccctgaatcactggcaatttgagaccccaggctggcaaggctgtttccttatctgtcagatgggtgaggtaccctggcttacatagatggaatgactcccggatgatatagtgcctgtgaaatgcctggccacaataggcgctcaataaatgctagctcttctccttcgataggagctggcatgagtctggtacacaacggatgctcaataaagccttgtccaatggattgagcctagcatttttcccaaggcagagaataaactgtattatgtttccccttggaatgaagccaaactcaatattaattctttcttaaaccacagagtttcaaaaagaaataaaggcaaactagagtgattgcagttgaagcgagcctctgtaatttctgtaattacagaacgagagcaaagcaaagcaggcatggcacagtctcatggagggagtggggtggggatagggggaggggaagagcaggccctactccagacccactactccccgtcctcgattccctggcttttcagggctccccactcactcctggcggggccatggcctgggacaatggcagccctgagactccagccctggcctctcggttctgcctaggtccccaccccacgcagccgcctgtccctctgatgcagtgggacagaggggattgtccaaggcggtttccacacacttccctcccccttgcctgccatctggtccagggtgggctgctcacagccaatcatccagcaaggcccatggcccacgggccccacccccagatagatcctgggtgtcggtgacacttcccccaacttctgcccatccagccacccccatgcagccaccatcatctctctggactggcagcctctgatcatgtatccctgcttcccccttgccctatgcagccttttctgggcagccagagggagactcttaaactaaccgtaagtcagactcccaccacttcaacccccacttcctcccatcccacttagaatgaaacctgaatccttctgtgacctctgagacctgtgtgacctggcccctgcccaccacctctgcctgaatccattcctctcacactggactccaaccaccttgggcaccttggtgtctttcaaaagtgccaggtccttcctgcctcagggcctttgcacttgctgctccctctgtttgaaatactgtatcccgagagtcccatttctggctcctaattcagactgaatttttttttttttttttttttttttttgctcaggccaaataaaacaagcccaagggccagttttgacccattttgccacttctatgtagggcttccaaactgtacatgttttctttccctacaaagcatcttgtcattcagaattggcagaggaattctttgtgcttggtttggccccatttttatcaatggctttaacactggtcatagagcatccactgaggaaggatgggatatcctgggaatgttttaccatcttctgcctggagtgtctttcactaactccgtccttcccagaggccccatgagcgagtcatctctggtttacgaatctgatcccattatcagccctgccccatccctgcagctagtccccagttccttagtccggtgtccaagacccttcatatactgaccttcctagcttcacactgtatctttagtacatgtgtttccctccacttggaacgccttttctctctttttaaacctgatgacacctattcaaccttcaaagccttgctcaaaggacgcctcgcctaggatactttctctgctgtattaatgcgtttcttctaggcctcccgtgtcttgttcttacacctcttgcagcattatcacagggtattatgatcagctataggcagaaatatttctccttctaggccatgacttgacaagggcaagggtcttgtcttatgaaattctcacaccctgagtgtccaccccagcccacccacataggaggcctcagtaaggatttacagaaatgaatctttctgctggaacctttagttcactgattcggattctggtgaccagggtgtagttcagaatacaaaatgcttgagagacggctccattgtcgtttcagcacatagcatgtgctcagtaaatacttgcagaatgatgtgttagtgagtgagtacagaggacctgacatgtcatcactggtggtctcacgttaaagtgccctttgaacgtggctttggtggaattaagttaatcgtggtatagtatgcacctgaggaatgtggagccgcatgctgggtctgcagaatgttgtcacctgatgaagaagaactgaagacgctggaagaaggctttggaaaaatgcccagatcatgagaaggtgagaggtgtttttccgcctgctccaccagcaggtaaaggaggctgatcacaggctggcactcagggcgagtggaagaaatgcgtggtcttgccactacagacccgcagagctgtcctccaacatgatccagagagccacaaaacacaggggtgtgtcttgggaaaggaaaagtaacaacttgcaaaaagttggttctgcttcagagaaatgttctagaaagacagccaagttaccctgccgtgaactacacacacctgtgctttctgcatgttatgtttcataggagagggaagtgccgggaattaaattgcggatgcactgttccccaggtgtgtgggtgaggcacgcttcctgggaccactcctttaagcattgggtcccaggcatgttcactactagcaggaggctctttatcaatttcctccgtggaccagatgattgggatttttttttctaccagactttattacagaataactattttgtattaactaagcaaacaaatgtaccgctcccagcttctgactggcccaaggtgctggctagacctctttgctttggtacaaagagagcccaaagccaagagacttggcatttctgtagctggtattccccagggtgactaaaaggatgatttccattggattttttaaaatgctaagacactgaaagacctgaatagtaagcccgtaataaacgttattcggtattattattgtgttgttgtagccttctgggaagttgcgaatgccaaattaagaacaatggacccataccagatggtggcgattgcagtgataacaatggctgagatttcctaagccctaactatatgcaggcatagttgtacatgctttacacacatgatctcatttaatcatcaccataaccctcgaaggagttattattatcttcccattttatagatgagggtcagagaggtgaagtaactcaccagcattagtaggtgttggagggagccgaggtctgtctgactcagcaccagggtggcttgctgctgtgtaagtcaaagagccttctccgttctaaatcctcaaagaagtatgagttaatcaattcatggctttactttgtttatcttcatatgtgccacatcttctaaaaggaaaatccaaatatagtcatgtggctcctcctagggaattataggcatttggctgaatctgaatcatatccccgtattccagaaattggaaatcacatgtatgtcttctttatggtgaggtctcagagcagccaccgtctctgatcgttcagggcttggcatgaggaggtgctcaatatagtatggagaagaactcatggactgaacttcctggtgaaccagagggatggtgcagagatttagattgcaacaggaacccccaagccaatgtaagcaaaacatctatttcatgactatgggatgttttgtaaaatccaagcaccagcctgaagaaagcctggaactgcaaactaggagcttgagacactctatcttttgatgtctagttttctccttcctcagcagaccaaatctcacttgagtacaagatgggcagaggatggctgccccagagtccccaagtcactagcaaaactgccttcttcctgggtcccatgccaaattccagagaaggaatttgattggctagcctgggtaggtggtcagtcctgattcaaggtgattggatcattttgaacaaatatggcagctggagccacaagggtagatcatgggaccgttaagggcatcattgttaccagagttaatggctgagctgctctctcctgcgtatcccaagagtccctggtagaccacagaatcggccgcctcctctatcctgccattctccagaaggggaggcaggcaccctactgagtccagagctctctctacattgccatgcccaggccaggatctagatgggcatccaagaccagcctgtgtgccgtgaggagttcaaagtgagcaggccatccctgagaacgaggagcaggggtgttaggaaagttggattatctgaagatggcctggttctccgtgaactctgggaggagatgatggtgtttggaatggggactgcatgcgaggggctggagggcgagtgcacagcagactgggcccccgccggcaaagctgcggggaggaggccgcgtggggagggccagggccacgccgcaccttgctttgcgcagctcccagctctgagggaatgcagaccgcttcacatgttctggtttgttctgaggttccataagtttattttttgttatattattaatttaaatcagttttgtagagcattatgaaattaaaaaagcacaaagaagaaaacaaaagtcactcaaaaactaagcattgtaacctctttgggtatatccttttttaaaatagatgtggggggtgggggcaaaatgggataattgaaataaactgtctagaaacctgcctttctcaccccaaaacaaggtgctctttctcgtgtcttacgtggtctttttgttacatttccacaagtttggatggaggacagagaaaagtctagcagcccctctgttggtttctcttttcttctgataaaattatggaatgtcttctccacctgccctcatcccacgcccacagctgtcccgagggcagcgggccccactcctgcatgttccagcaccccaagggccagtgccatgctgcatggtctcgctgcggccaccctggctgggacgctctgcgggacacgcgcacagcccagacgccctggcaggcttcctgcacccctgctccctctgtaggagctgcctgcctgccccatcgctgcttcaccatccctcctctcctcccttctctgctttgcaggatctcacccagggtggcagaaggaggccttctggagctgaccccccccgacgaccatcaggtaacgtcaacagccccggtaacaacatccatgagtggagtttctctcttaaccaggttggcgaaaagcactcttgcagcgattacagctgagttttgatgaactctacaagccagaggggattgcccccattttatacatggggaaactaagcacacacacagcagtacttggtagtagtattgagtagtagtactgagcagtagtactcagctggtaaaggcagaccggagatttgaactcaggactagtctcagcccaatttcctccactgtacttaccccacgctgcccctggaaataaaaaggtaagaaggctgcagagtgtcagtagaatacttagggtgattgaaggctgaaagaggtcatctaaaccagtggcccttagctgagggccgggctgggctaccagtataagaatctcctttggcagagcttgttaaaagtatagactcagacttcctgcaacccagtgagagatgtaccagtgtcatcctcattttaaaagataggggacacagaggttgagtgtacttaaggtcacacagctcaaaagtggtaaagtcggggcaggtgcagtggctggctcacgcctgtaatcccagcactttgggaggcggaggcggaggcgggggatcacgaggtcaggagatcgagaccatggtgaaaccccgtctctactaaaaatacaaaaaaaaattagctgggcgtggtggtgggcacctgtagtcccagctactcgggaggctgagcaggagaatggcatgaacccgggaggcagagcttgcagtgagctgagatggcaccactcactccagcctgggcaacagagcaagactccatctcaaaaaaaaaaaaatgtggtaaagggactgtgatcagaggtcgtaactcctaggctctgtcgtcttcacccagacacctccgtgtggggacacctttctccccattcagccacaggtggagcttctttcttgctcaccctgggatggctagtatggccgcagagtgtgacaaggctcccaattgcatccttggaggcaaagtaaagattttatgattaagtacttaacatttcctgttggaagtttggtggcctcagattctcctctgagcaggacatacaacagagggttggacacagatggccagagttgaagctagccaggaaacatcgctgtgtctttggaaacaaaagtcaccttccttcctccaggagcaaggcgggtgagaggaagagggcttatagagagccttttcaagcccctagcttgtttatgggtattttgtttttgtcattttagggtgaggcaactccaaggtcctactctctttctgtgctgttacccaccccgtcctcctagggtgcccttgagccgcaaaactgctgtccacgtggacgggggtgacatcgcacgtccatctgccaggacccctgcgtccaaattccgagacatgggaccaacggcagcaaggtggccgacgggcagatctccaccgaggtcagcgaggcccctgggccaatgacaagcccaaaaccttggtggtcaaggtgcagaagaaggcggcagacctcccgaccgggacacgtggaagggccgcttcgacttcctcatgtcctgtgtgggctatgccacggcctgggcaacgtctggaggttcccctatctctgcgggaaaaatggtgggggtaggtctggcccggggacctcctggctgggtctggaccctgcaaaaaggatcctgcttaggcattttctggggcaactgtaggagaaaagcccccctaaagactccagagggagcaccaggcccatttcttgtttcttgtccctttatcaaaagattcctgaaggacaattgtcctctgttatgataccaagaaattcatctattcacctgcaaaaaatgggatgtatttcacatatggcttccttgggcctgtggttggctgtgggtcctgcttttgaggcaggtataaagaaatactgatggggacccagacccacgacactccctctaccagggcgggtcttgaaagtcttggggcacgagctctgtcttctttacctgcaggagccttcctgatcccctatttcctgacactcactttgcgggggtcccactcttcctgctggagtgctccctgggccagtacacctccatcgggggctaggggtatggaagctggctcctatgttcaagggtaagtctgcagatcagggactgggtggtggtgcccctgcccacacacacctcttgccctctggagagagcgagctgtctcccagaccagggctgacatcacatatccatccaccaggtgcatatctgagcagagtgaggctgttgcaaggggccaggtggcagatgacagtgctggtcagaaactagggaggtggagtggagaggcccaatccagagtcccccgcacatcagcctgctctgtcctgttagcccatcatttcctctgcaagggctgggtgtgactttctttgcctcgtgctcagtgcctgacaggccccaggtagatacatggtgagtcatgctcactgaccgagggcctgggcctcacctcgtcggcaagctgagaccccagccctgcctgccaccagtctgcactgggccccagacatgagtctggccccctggcttgtcagatgtacatgaccttcagcaagtcactgcctctctcttagctcagtgtcctcagtaatgcctgtctccgagatcaataagattgtagaggtcatggaactgccacgacagttcatgttaattccgtattaaatggacgcgtgtctgtgttccgctcccggcgtgggccttgcggctgctgtgctatcattctggctgaacatctactacatcgtcatatctcctgggccatttactacctgtacaactccttcaccacggtgagtggtccctttgacaccccatccagcagaagccacacccagagcccacccttggcccaccacggccaccacttgctgacaaggccattcctccaggagtggggaacttggtttgtcttttgtgggccttggctccccacaacagccatagcctcacaaatttagcatctcctgtgagacaggcactccttcaggctcacatccaatcctcatgacacccctctaaagtgggtattgttagcacattttaatggacacagacagcctgggttcaaatcctgactctactatataccagctgtgcaacttagaaaagagacttaacctctctgagtctcagtgccctcatttataaaatggaaataaaatagaacctgccccagttcctcaaaaaattaaacatagaattaccatatgatccagcaatctgcttctgagtagatacctgaagaattacaagcagctctcaaagagatatttgtacaccctgttcacagcagcactattcacagtaggcaaaaggtggaagcaagccaagcgttcacgataaatgaattggtaagcaaaatgtggtctatacatacaatggaatgtaattcagcctaaaaggaaggaaattctgacgcatgcatcaacatggatggaccttgaggatattatgtcagtgaaataagccggtcacaaaaatacaaatagtgtttgatcttgcttatatgagttcctagagtaatcaaatttatagagacagaaagtagaatgatggttgccaggggttgtgggtgggggatgaggagttgttgtttagtgggtggagttgcagttttgcaaaatgaaaaaagtctggagctggatgctgacaatgttaggcaatacatttctcacaatgtactcccattgttagtgacacatgactgtatttgcagaggtgtggcagggttcagggagctacattatgggttacttaatgcttctaaattgtacaggcaccaatagttaagatggtaaatgttgtgtgtatttatcaaaattaaaaaatgaaagaaaacaaaaagtgaaacccacctcatagggttctttgaggattaaggagcagatatgtgtaaggaacttagaactgcgcctggcagagaacaagcctgtaagtgtttgctggtgtcgttgcagtgagagttagatgggcaaggtctcttgcccaggtcacatggtggggaagtagccccggctgcagcttggaaggctgttctcacagtgaaaggttgaggttcaaatctcagctctggcacttagtagctgtgcattctcaagcaagtcatgtccctctctgatctgtcaaatggggatcataatgctacttgcctcccagagctgctggaaggggaggtgtgaggaggcttggggaccatgagggtgggcagggtgcactgggaccatcatgccagcccctgggagcccagcaggatgcgtcctcatgactgtgtccttgcagacatgccgtggaaacagtgcgacaacccctggaacacagaccgctgcttctccaactacagctggtcaacactaccaacatgaccagcgctgtggtggagttctgggagtgagtatggggcatcaggggatggcagggacggggcatgtcagccagagcccggcaggagacagaggcccccggaggggtaacagaagaggtggataaaggggctacagtcatgtgtcacatcatgacatttggtcatcagtggaccacatatgcaacgatggtcccataagattataataccatattttactttaccttttctacgtctagacatgtctagtaccgaaatgcattgtgttacagttggtacaatattcagtacagtcatgtgctgtacaggtttgtagtctaggagcaataggccaaccgtatggcataggagtgtagcaggctagaccatctaggtttgtgcaagtacacgctagatatgcacacaacaacaaaattgcttaagaacgcatttctcagaacatatccctgttgtaagtgacacatgactatacttgcagagttgtggcagggctaaggcagccacaagggatctgaagaccttttctccccaaaaagagttggaccacagatagagccatgagacacacaactctgacctttgatagcaaaacccagctactcacaaagccaaggtccagcaggaagaatcattccccaacatctctgcctctaatctcctgccagctcctcccaatggtcaaacccagtagaagccagagggcaggggaccagataatgtggccatagtcgtcagcatcctggggccggcacagagtggtcaaggggaagagtggatcagagaggcaaacggaggggaataaccagatagccaattagaatcacctggagaggttgaccacatcctgattcatcctgaaaaccagctgatctacttacgaacctagagtcactcggaataaacatgcacacacactctggccatgtgaaggccgtgctgattgtatcttcaggggagtaccttgtagagatgtgtgtcgggggcactgatgtgacacaatgaggtgctggggcccaaatctctctggcatgaaggaagcatcatgctggacagctcagaaggatccgggagcagtctagaaggtctcagagcaccttggatagctcccaggaggagctgttctcaggcactgtcagaatcagagttgcctgatctcttcaggccaatgtccatggttacactgtttctttacaaataaaaatcaaattctgctctggtggttctgctttctggcatctcccgcatgctgctctcaggcacgttcggacttttcattcaccatttattcagtaaacacttcttgatctcctactatgtgccaactgatgacaggcacgacatgcagacaggcaatggcaccaccaggcggccaatgcggagaggagggaagcccaggagctgggctgcggggacctcagggagtcccctggaccaccccaggtcgggagtggcatcagaagagaaaactgcagggcaggcaggtgctggagagaaacagtgtgaaggctgggaggagatgaggtcaggccaggcaccggcaaacagctgcagtgagtgctgagaggagagagagtgcaagggccttgaaaggctggccagggagtttgggcttcattctgagaacaagcgggtctattcatcgcagtaagcagaggagtgacatgatcagacttgcaatttagaaggctctcggggctggagaggggatagagcaaaactgaaggcagggtcccactaggaggccactgggcatccagatgagcagtagtggtggctgactaaggccctggcaggtcctgttctctttgactcttgaccaaacagcactttctactgattagtataatgggcctcacagtccccagctactcttgaatcacggtgatgacggtgtcagcacagttctagggcggggatatcatctgtgccatgccctgggcacccctgggtcactccggctcccaccagctctgtgtaactttctccccctccactgtttgaccaggcgcaacatgcatcagatgacggacgggctggataagccagtcagatccgctggccactggccatcacgctggccatcgcctggatccttgtgtatttcgtatctggaagggtgttggctggactggaaaggtaagggatatatgtgcacagtggggaaggagggcactggatagaggaacaggtctacaaaggaagctctgcccacaactcccaaggtcccatccaaccttgaattaagcaggtcccttcaacactcggtgtgtccgtttcttttctgtgaaatgggaataataacattaccttaccttctggggcagttgtgaggataaaaggaatagtgcaagtcaagtacgcagcacagtgcgaagctcacagtgagtcccatgggattcactgggcctaacagagtcatctcaaaacagagggcaaatgttgctcctggactgttgaaaaacttttccagagcatctgctctgcaccaaaccttgttctaggtgcagaaactccagaatgacagcttcacatcctgacccttgaggaacaacagagatgaataggttaatggttagttcaggctctgtattaagcagtccatgagttaagatcccaacctcaccatttactagcttgagctcaggcaagtcactttgcctccctggaactcagtttccttctctgtaaaacgggctaataattatacttatctgttggtttattatgataatcagatgagatggtgcttttgtaagcgctcagcacccagcaaggagagttgttattactcttgtttttattctcagcaagtcagagcaaatgccaagctgggatgtctagcccagggacacccgggaggtggaaaactggcttactccaccttttctccctttcaagccctaccccaggagcctgggggcagaagatggagtctctcactggccctgacctgaagggaacccggaggacaagtgtgttgtctcagatctatggcaagtcaagggcagagaagggatttgtactgaataagatgggaggcaggaaggtagaactacccaagaagtgaatgcaaggttctagaagcagtagtagaaatgaaccaagcaaaccttaacaaattccacacttgggcagggcagagctgatgaaaagctaccctagtttctctagtgggaacttctggacccactgggttctcaaatccaaggctggtgtaaaagtatcctgatccattcctaggactagggacgccggaggagggcacaagtatctcccagtctaaattcaggagcagaaaagtatagggcttatgggctttggaagggtttgagtctcagtccctagcttctagctgtgtgcacttgagcaagccatttcatctctctgagcctcagtcccctctctgttcaatggtcacaataacagtaccttacagggttgtcccaaagactgagggagatagtagaatgcttagcatatgccttacacatagtaagcactcaatacatagtatcaattaaatcattttggagtggtaattagagttcgtgctacattaggagactggccacttcttgggacagagagtagggccccctcactgcatatattgaggatgtcaaccaatccatccacaacatttattgaatacctactatgtgcctggcttcatgctgaacacggaaggcacagggaatacgagaccaaggtgacatataataagcctgcggcatgtcctgatgtgactgacctttcgagcagtaggtgtgactgtgcctgattccagacaagagaaagtgaagctaagagaaaatcaacattgaccctaagttacgcagcttgtgggtgacacagatgagtttgaattccctttcctagctccaagtacaatgggttttctcttggattgtggctgccttccttaatcctgcaaatctcggggtcaagtcagggaggtgaagctaagccagtgaactgtccatgctgaccggaaacaggctcacattagactctgagatacaaaggtcatcaaacttgaacattgctcttcatactagtgagcaaagaaatgcaattttagacaatgatcatcagtttggcaaaaaataatgtttaaatgatgatacctagtgctggccttgtgacagaaaggcactctctgtaatgccggtgaagttccatttctcgaaagcaacaaggtaatatggatcaaaagcctgtgatgaattattccttttaattcagtagttccacctctaaaaatttttcccaagagtggtataataatttgtagctgaagatttatatacaggggtgtttaatttggtgttatttagagtcacataaattggaggtaacctgaatgcatagcagtggggaagcttaaaagagaatggtaggacctctgagggactgttttgtgcaattaaaacgtcaaattgttcatgaggcaataaaacaacgttagtgaacaaaatgggaaacaaacctgtatgtactgcgttttttttaactctaaacatttacatggaaaggcaagtacctaatttgaacctcattttgtaagaaaatgtgattgcattgcaaaggagagtttcagaggagcattaaagtaggaacatccctgcatttatgtgttcgcagacaattcttgagtgtctactatatacggtggactgttctagacatggggatgtgaaaacacaagccctgccccccacataacttacattctaggtgctggttaaaggaactttcatttatgtgtgtgtgtgcatatgtaatttaaaagttttcctgtcaccacatgcaatacttgataatttagaagtcaaaaaataggaggggacaggggaagggaaaaaccaaatgtgagcggttggctcagactccaaggaggagcttcagataagtggccaaggagagcaaggatctggaaggcttcctggaggcggaagaactggaatcaagcccagagccacaacagatacggattaggggaaatgggggaggaggaagcaagggtgtacaggaggaggggtcaccagtcacccctttcctcccaggtggtctacttttcagccacatacccctacatcatgctgatcatcctttcttccgtggagtgacgctgcccggggccaaggagggcatcctcttctacatcacaccaacttccgcaagctgtctgactccgaggtgagtgcccctcccagcccggattctgagccccacttagcagctttgagataagcttttgcatctttctgaccctcactgtagaccaggttgttgccagggagagctggtgggcacatggaaaagttcctggatagctgcggctatggtattacttttgacagtctttgataattctgcctataggtgtggctggatgcggcaacccaatcttcttctcatacgggctgggcctggggtccctgatcgctctcgggagctacaactcttccacaacaatgtctacaggtttgagaggacagctgcgggagccccttccttcctggcgagccctttgagtccacatcccacactcatgtgttagggccctctttggccactttgcatctcagcttaacctctccctgagccagtcgtttgtttaactccttctggagacacagacttcctgttgtccccctttcctgaccctgatcttctggctctgccctcctctagcttgctttagggcctgtgcatctgggacctaccgtgtagccccattcccagccccctcctccgggcacccctccataaccacagccagcagctacaccttctgccagctgcaccctcctcacccacccctccctctcttcagggactccatcatcgtctgctgcatcaattcgtgcaccagcagttcgcaggattcgtcatcttctccatcgtgggcttcatggcccatgtcaccaagaggtcattgctgatgtggcggcctcaggtcagtgcaacactgtgtggggccgggctcctggcagggggcactaaccatgctggcctttgccatcatcaccattaccaccaccactgtggctcctggccttgagcactccctatgtgccaggcaatgcactgagcattttacatggactgtaccatgattcttctcaacactttgcaatacacgctattgttagcccatttcatagatgagaaactgagactcacctcctaagggtatggagctagaaagatggcagatctggagttggacccaggtctggctgactcccaagcctgggctcttagtctcttggctatactagcatgtcagcacaatcctggacaatttggggagaagatccactcttgccttgggagtataaactttgtattgggggaaattcacccccgatatttcacgtaggttcttttctattttacctaagttcagctggtctgagaaataaagggaaagagtacaaaagagagaaattttaaagctggattctgggggagacatcacatgatgcccccgaagctgtaaaaccagcaagtttttattcatattttcaaaaggggagggagtgtatgaatagggtgtgggtcacagagatcacatgctcaaaggtaataaaatatcacaaggcaaatggaggcagggcgagatcacaggaccagggcagattaaaattgctaatgaagtttcgggcacacattgtcattgaaaacatcttatcaggagcagggtttgagagcagacaaccggtctgactaaaatttattaggcaggaatttcctcatctaataagcctgggagcgctacgggagaccggggcttatttcatcccttatctacaacttaaaagacagacgtccccaaagcggccatttcagaggcctccccttagggacgcattcttttctcagggaagttccttgctgagaaaaagaattcagcgatatttctcctatttgctttgaaagaagagaaatatggctctgttccacctggcccacaggcagccagacgttaaggtatctcccttgttccctggacatcactgttatcctgttttttttccaaggtgcccagattcatattgtttaaacaatttgtgcagttaatgcaatcatcacaaggtcctgtggcaacatcatcctcagcttacaaagatgatgggattaagatattaaagtaaagacgggcataggaatcacaagagtattgattggggaagtgataagtgtccatgaaatcttcacaatttatgttagagattgcagtaaaggcaggtgtaagaaattataaaagtattaatttggggaactagttcaatgaaatcttcacaatctatgttcttctgccatggcttcagccggtccctctgtttgggtccctgacctcccgcaacactttggctcaattcagacatgttcatcaccatactacaagaccactaaatccatgcttttgtctcagctccaaaaatgttctcgccaagtgggccagcccactctgctcaccacacagtcatcaatgccacagaacccaaggaaaaccccagacacccttcgctgcacagccaggcaagcagccaacaggtggaacccactgtatgcagggcagggcccctgaggctcatggaggccacacggctggtcccttgaagaagtgggctggttccggaaaggagcattctctgctccggttctaatctccccttcaagggcagccaccatctcgttctctgcaattccccaaccattcccccacccccatccggagccagacccagggaggttaaatctctttccttctcattccgagatttcctgatctcttagacacccccaccaactactaaacacaatacatgccaaacaaggctccaaagccttctcctccaccatgctccccatcaagaagggtcccatggtccagtgcccagggtggagacctcagcattgtcctggactcttcctcaccctcatcctgcaaaccagccaataccagcacctgcccctccatcccctacatattctctatctggttgcctctctgcacctgcactatcctcactactggccaagccatgccacccccatcgagatgatggccacagctcctcactggtcctcttgcctctgggcacaattatatggccccacatcccccaccctctttctgcacctggaaaaaggggctgaaaacactcatcaaaaggttactctgaagatgaaatgaaataaggcttagaaaatgggcagtgtgctggaaggctgtaggtgatgagtaccttttatttttcttcttttttgcacttctctgttcaggcccgggctggcgttcctggcatacccagaggcggtgacccagctgcctatctccccacttgggccatcctcttcttctccatgctgttgatgctgggcattgacagccaggtgagggcccccccccgcaccccaggagctctccatccccagactcctcagtccccgagtaaacaggagaggaggcaactcttaggctgccaagaagatgaccaaaaattccaggtccctagaatgtccactgcatgaaatttcaggaaacagctcagccaccttctccattttccagaaggggaactgatgcccagaggggagggactctcctgaggtcacaaagtgagtcacaggcagaatcggctggaccctgggctctcctggctcggtgctgctgggcctcccgtccttccttagaggccaggctttgggtgggttggggctggggctgctgcaggtggctgacctctgttcccaccgaagttctgcactgtggagggcttcatcacagccctggtggatgagtaccccaggctccccgcaaccgcagagagctcttcattgctgctgtctgcatcatctcctacctgatcggtcctctaacatcactcaggtaagctcagtaagcacctggcactcccccagcactgcccaggccatgcccagggcctcctctcccctcctctgttgtatcccacctttcctgccttcattggcatcatctctgtgccaagctctgggcacataacagtgagtcagatggggtccctgcccccagaggctcccaggctggtggagacacaaacattgagctaagacatataggacagagcagagaatgcagcacctaactggactcggagcaccagggactgcttcttggaggaggggagtagaaattgagctttgaaaggcccacagaaggcctggcatggtggctcatgtctataacccagcactttgggaggcagaggccggcggatcacctgaagtcaggagtttgagaccagttggccaatgtggtgaaaacccgtctctacttaaaaaaataaaataaagtaaataaatatacaaaaattagtcaggcattggggcaggtgcctgtaatcccagctacttgggaggctgggtaggagaattgcttgaacccgggaggcagaggttgcagtgagctgagatcgcgccatgcactccagcctgggcaacaagagcgaaaaactctgtctcaaaaaaaaaaaaaaaaaagaagaaagaaagaaagacagaaaaagaaaagaaaggcccacagaaattagccagaaagtcaattggagttgagcctttgaagttgacactgcccaaagctttctttcattcccatttttttttgtattgacatgaatgagaaatgctcacatagctggtgaattgtgcaataaatataacgactctagcaacatgagttcagcactgcgggtctgatttttataatccacaaatcaccccaccccccccccaccagatccaaatgtagttctgctccagagttagtattcattcatccttcattcatagttgtcaaatacctactatgggcctggcatgaccccagaaatttggcattaatgtggcagatactaccatgtctgctgtcttggagcttacattttggtggacaagctgacagacaaattagatgattttggagagtgtcaagtgccctggagaaaagaggacagagcacagagaatggccagtagcacaggaggggcgctccctcagacaaggtagtcaagggggtctctctctccaagaaagcgacagttgagctgagacttaaatgatgagaaagagccaccagagaaagatctggggaaagagagcagagtaggtgcaaaagccctgaggcatttgaggacgagggaagccagagtggtggaggcagagggagtgaggcagtgggtgggagacgaagaccagcccatgcggaccttgcaggccaagacatttgggtgggatgggatgggatgggatggatgggatgggattggatggcatgggattggattagatctctctctgcttatttatgtttatattattgtctcatttaagtcctgaaaggttttaagcaggggagagacctgactgattacactgtaaaaagatggccctggtgaccaactccgctttctgccctccaaccttaccgaaattggcattttcctctaccacctggacatttccttcccaatgcccggactgtcaattccacatcctctcgtggtcacaaagccctcagtgcttcatctaatctaccctgaagcctatcccagccccatcagcctccagagtccatgtggtctgtgaactggatgcagtgggcgcggggacaatgcacctgttctcacctcttttcatcttgcaggggggtatttatgtcttcaactctttgactactactctgccagtggcatgagcctgctgttcctcgtgttctttgaattgtctctatttcctggttttacggtgagtatcagcccctcatcccttattcattcactcttcatccattcattcctttcttgagtcatcattcaacaagtgcaatttgaaccccaggtttctccttacatttatttatttatttattcttcacattacaattcaatgaggttagtccggagtcccccatgtttagaagatataagagcagttaaatgaattcatttaaaataagtgagattttatccagaaaagggaaaccaaaactactttttaaagttttaaagttatatattaacacagtctaggctgtaattaaaagtgtgcactatcttaaaacaaataacaaaagaaaattgattttgtttattttgtggcctaagtttcttgagccaactgcatgatagtaaaaaagacaacatcctttcctgcacctttgattgtcccatcagagcaaatgtttttaaagaagctgatattttgtgtccccctttgcaatatctgccacctcatcctccttgtcattgtccctcttttttgtttgttttatatgtataaatttaagggacatgagtgcaattttgttacctgatatcttgtgtagtggtgaagtctgggcttttagtgtacccatcaccacataatgtacatctttttttatttttatttttatttattttattttattcatttttttgatggagtcttgtctgtcaccaggctggagtgcagcggtgcaaactcagctcactgcaacctctgcctgccggttcaagcaattcccctacctcagcctcccaagtagctgggattacaggcatgtgccacacgcccagctaattttttgtattttagtagaggcagggtttcaccatgttggccaagaggtctcgacctcctgacctcatgatccgcccacctcggcctcccaaagtgctgggattaaggcataagccaccaagcccagcagtacattctacccactaagtaatttctcatcatccccccagctcccattcccccacccttctgagtctccagtgtctattattccacctgtgccagtgtttagctcctacctttaagtgagaacatgcagtatttgacttcctgtttctgagtgttttgcttaagatgatggcctccagttccatccacgttgctgcaataggcatgacttcttctattttatggctgaatagtattccatcgtgtatgtataccatatttcctttatccaccatccacggatggacacttaggttgattccctatctttgctattgtgaataaacacgatgcaaatatctttttgatataataatttcttttcctttggatagatagccagtagtgggttgctggatcaaatggtggttctatttctgattctttgagaaatctctgtactggtttcatagaggttgcactaatttacactcccaataacaccttctctctctaactgttccaacaggtcagatcctcactggtcagtgactctgcttataatttgagcagtgcccgaagccgcttggtgaacttcaagacaccagtttggggtttggggtttttctttttcatgagatttgcattctttgcaattgattgtcaatttctttttctttcattcattcatttatttatttattttttatttatttatttatttttgagacgaagtctcgctcttgttccccaggctggagtacatggcacgatctcggctcactgcaacctccacctcccaggttcaagcagttctcctgcccagcctcccaagtagctgggattacaggcgcccgccaccacacctggctaatgtttatattttagtagagacggagtttcaccgtgttggccaggctggtctcgaactcctgacctcagtgatcctcccacctcggcctcccaaagtgctgggattacaggcatgggccaccgtgtcggcagattgccagtttcttatagcatctgaccatcagggagaaacagcccctgcccaggaagcctttgaaggaatggctgggatagatgtcgagtgggagggacattgagagtggcagggtggaggggatcatcatgtcagtctccttttgttggtagatatcttcacattaaagtgcttgctcacctacacaacccacttgctgtgagaattgggctattgaaaaatacttggtacgaggacccccagagcataacccccatggtacagacaaggaaactgagactcagagaggtaggtgacttgcccatggtcacactgtgagaaagtggtagaaccaggctttgaccctgagcacccacagctcatccatccctcctgctcccaatgtcacaggtgtcaaccgattctatacaatatccaagagatggttggatccaggccctgcatctggtggaaactctgctggtcttcttcacaccaatcattgtggcggtaagaacaaggcctgactagccctgttaggatgagctagaccaagccctggggggactcaggtccagggagaaacttctagaggcagaggcagggggagaggcccccagaaaccctgttccttaataatacttctctctaccatttgttgggctctattctgcaccctgcatggtacaagacacattatatcatcctccacaaacctcagaaggaggcattattgtcccactttaccgctgcaggatctggggctcacctagccagcatcaccagctagtcagcactgggattcgaaccaagcccagtctcttggcacttggagactctcttctcagggtccctcatccccacaagcaggagctgaagcaggggcgggcctgggaggggcacccaaggttcttgaggtgggggcagagccactgcatatgttgtgtccacataaggggccctgccaatggcacattgggagctgatatctcacccttgctctgcttttgaagctgggaacttggaggaaggggttcccttttctaattagtctccctagaggagttgccttttcctctgatcttccctgagagggtgtctttttctattatgcacaaaggcaccttatgtgctagagcggtgctgagtgcaggactcccaagaccttgggcctctgtaagggtcagcctcgggggagggtggagggcagtcagcctgctggcttcagggtggttcatcctgggtgactgactctccccctccctcccctcccctccaccctctccagggcgtgttcattttcagtgctgtgcgatgacgccactcaccatgggaaactatgttttccccaagtggggccagggtgtgggctgctgatggctctgtcttccatggtcctcatccccgggtacatggcctacatgttcctcacttaaagggctccctgaagcaggtaagcccttccccacccttcaaattgccagtgccctctcccactgtgtcaggcacagccccaccccttgtgaagctcacagtctagctggggaaaagacaagtcaatagccaatgacagtagagtattagagacactgagattagggaaagccagggggtgggagcaaacagcctgccttagccctacttgggttaaggaggattaaagaagctcccagaagaggggataacaaaggagaggcctggggataaaccaaacttaaaagtagaacagaaagtatgtttctagaagagggaggggaggagaggttggaaagcatgtgcaaaggtcaggggtataaactgcattgggtcaactgaacggagatcagtgtggctggaaggtaaagggaaaggggtgcgaggaggggacatgacaagagatgaggttgggatgtaagaaggtccaccagatcatgaagggctttgaaaaccaggacaagaactttgaactttatcctggcagcatggggtgtcatgaagggcttggaacagacggagggtgggatcacatttgcccagggctcctctagatctcatttgtagggttgatatagagaaaatgtggtcttacccacaaagaaagcaaagcacaaaagacctgctgcctgcagcaggggcctcaccatcacatagggttctctgccatgcccacactttgttaaattgcactaaattcttgagggaagcaaagaagtgctggagtgccaggcaggtgcctcattgatgaggtgtgtgcaggctgaaaagatgccacggggagagtggagagtcggagtgtgagggctgccccggaaggccctggatgagttgctgtccacttagtgccctgggaaatgcacctgccagacccaggggaagcgctctcaggtctgagatacgggaagcctggctgcaggttatgtgctgccgtggagttactggcccatcttcctccaactcagatgaagaaactggggaaccacaggggttgagtaagcaggttcccagctcaggaagtgtgagcagagctagggcttgcagccctttcttcccaatgcaagtccaaagctttcatttccatgatccactggagagcctcaaacagcagctgggtcttagcgtggcaagaggttagggggtgcccttgcagaaaacagcacagcttgtgcaaaggcccagcggtaggaagggccagacatacctgaggccagggtgtgagctgacggggcaggatggcgaaggcagtagggggtcatccattcagcacacatggacggaaccctgatgatgtgccagacactactgtcagtgcggggacacagccatgaacaagataagcagaaattgcaccctcctggagctcccattcaggagaggaagataagcaactaacaaaataaaagcacgtgaggtggcgaggagcactataggaaaaatcaagtagacagggtgtttagggagtgccggatgaggcctcactgagaaggcgaacatttgagccaagacctggggaagtggaaagcgagctgtcgctatctgagaggaaggtctgccagacagagggcacagcctgtgcaaacgccctggagcggaagcgtgcctgctgttttgcggggcgtcgaggagtcctatgcagatgaggtggatgtgcgaggaagaggggaggcactgaggactgggaggtggcaggggccaggtcgtgtagggccttgaagaactttggcttgcctcttggtgaaatgggagccttcattgggtcctgaagagtacaggggcatgatctggtctggttttcatacaactctcctgctgctgtgttgacgacagaatgaaggggtgagagacagcatgaaagtgggagtggaagctgagggctgattgggagttgttgcaataacccaatgagaggggctgtggcgtggcccatgtggggcagtggcaggggtgcaggaggtggggattggctggagtctgggtgtagtttggaggcagagcagacaggatgcacttgaatagagagaggagagggaagcggccagttcctcaccatcccaggctgggattttccccagagagcctacaccttcctccccggtacccacagcgcatccaagtcatggtccagcccagcgaagacacgttcgcccagagaatggtcctgagcagccccaggcgggcagctccaccagcaaggaggctacatctagggtgggggccactcaccgacccgacactctcaccccccgacctggctgatgcgaccaccacttgatgtctgaggataccttccatctcaacctacctcgagtggcgagccagacaccatcaccacgcagagaggggaggtgggaggacagttagacccctgggtgggcctgccgtgggcaaggatacccggtggcttctggcacctggcgggctggtgacctttttatccaggccccatcagcatcccacgatcggccttggtaaccgccgcggtagatcattttatcccgccagggagtgtgatgcaggaagaccacatgcgctcctggcttttaaacctgttctgactgttctcttactgccgaaacccttgactgttatctcggactttgcaggagttccttccctccgaacgctgctccatgcacaggaaaagggcattttgtacaatggggacttccgggaacgcttgctcttaagtaccagaagccggcggagctctggctttcgtgtttttggtttctccttcccaaggcagctggattgaaaaaacaaaacaaaacaaaaaaacccaggggctcagtcgatattcccagggccgcttctcctgcagtctgtggagcgtccttgtccccgccccggaatgaatgagcattctgcagcccgatgtccctgtcccctcctcgccgggccattcgattggacctggcccagtgcaatctgtccagacaagccctgcttgctggaaaactgccaaagcacaattgatctctttttatcgccattccaggggcctcaggtcctactggggaaactcctataccggagctccagtttctcttaagctgcccaatttcacagagtacaaaatagtgtaggggaaatcaaggtgaaggatctgtccgacagtcaagacggatccacagtaatcttcggtctccttaaactaccaccctcgctgccacccaccccaagctgctgccgcctcacctccttgaaatttctcagcgggagtctcctcactgccactaaaacccacccagcccactaatgaggagctagtgttaatccagagaaccccccgcaatgtgcttccgagattcagactgctcattgggaagtatgatttgttcctttctggaattgggctccgtggtggcggcggcactcaagcaaagacagtttcttgcaagctccagtagctccgcgtgtctcatttgccaggaagtgggttcccacgtagcaaatcgtacattgtgccctgtagctccttagctagttagctcaaagccgtgttttatgactaatccttaataactatggtaaataactgtgactgtggggttttaatctcttgtcattctcatccaaaagtgaccagcataccagttcttgcaataagatataccctcagaatattaagcacattattgtagagaaaaaaaaatatgtgtacacatatgacgcacaacatgcacattcatcctcacatgtggcacgtaaggtctcatttgatattgtgtggaaatctgaagccttttcctgaggtcatctgtaaaatagtctcattgccaaggcatcccagtgccagctggtgaatccatgatcaaaatgcatacgtattgttaaatgataaggtttgaatgacaggaacccatcactgtgtctcatggtcccacttccccatctgtgtgtgaattctttagactaagggcaggaagacttccagctttctctttgttcttcaatgtgaaactgaaccaagtctctctaagacaaatgcagtgtatttaatgtttgtaagcaattctaagtgagtgtttggcaagaaatcccctaactgatttccatccaaacctaccttatagagcacaatataagtgttgtacaattactgtgagaactgtgaatatgtgtaacttttttttagtatttgccggggggaaaaagatattgtattatcatatatgcttttttgcaataaggatttattctagaacaccaagtaaatctatctctatataaaaaatatatgtaatatatacatattcaaatatatacagagcctgttttaaaaaatacagtattatttagtaaaattatctgttctatgaccaaatgtaaaatatttataaatgaagatgcattttaaatgtctataaatggtgtcatactagagcacgggcgttatgtaagtttctaagaatttagaggataaataataaaggttcatgatatacaacatcagaccttcaattctttggggtgggggcacaatatcctctttcatacaacaacaacacatacacacagaactatttttccccagcagacagagattggggctcaaacccaacaaaacggagctggacttccccagagtcttaaagtcatagaaaatgattgtggctgcacgagggaggtgctttcactgtgcatggggtcaactaaataaagatctaaaacccaggagaccaggagcacatttagtgaacaacagcactcgttcattcactcactgattcttcctcaacatttttatctttttaaatcgtatttagaaaaatgcgaattctacagagaagtgtaagaatagttccgtggacacatctgcacttcacccagatttgccagttgttaacactcgccacttttatcttcactaactctctgtcagtcaaggttcagcctggcaagtggagcactggatatgatggaatcagggctttattacaggaacggaccttagaccactgcagggcgttggaaagtaagagtctgcggtttctctacctggtctgctcttccccggctgtcctcacactggttccttcctttcattcaggtctctgctccattgtcacctccttacagaggctttcctgaccaccttggctaaaataacatgctccttcatctctctctgctccctcactctgtttatttttcttattctcagcattcacaagcttactaatttaatctctatctctccccatataaaggaagctctgggggcgggcacagtggctcacgcctgtaatcccaacactttggaggccgaggtgggtagatcacttgaggtcaggagttcgagaccagcctggccaacatgggaaaccccatctctacaaaatatacaaaaattagctgggcgtggtggtgggtgactgtatcccagctactcgggggctgaggtaggagaatcgagtaaacccagaaggtggaggttgcgtgagccgagatcgtgccactgcactccagcctgggcgacagagagagactctgtctcaaaaaataaataaataaaataaaaataaaggaagctctgggaatatggggacttttgctattcactgctctgtcctagatgcccagaacagtgcccgtgcccgacacacagtagaagctaacaaatacatgaatgagtgagtgaaggaaagaatgaatgaatagatggacggacggatgcaggatggatggatgggcaaggaatggcaatggaacagccatcgcaggcactggctttgggtcagacagctctccgtgtgagttccggctctgccgctcactctctcagcaactctgacacgttgcttaaatctctttgtgccccagtttcctcacaaaattgttgttacagtgaatgagttaaaacaaggaaagcacatagcacggtgcctagcccaaactgagcacttaaaaaaatagtggttttattacagcaatggttcctgaaatgttcccttagaagaacctctttaacggggtccatcccccacccagagccccatgttttgaaggattttgtctaccaaactgtccttaataattaagctgtttcccctctttttattaatcagatgtggctgctaattagagccccgattagcatgaggtaaccagggtgacagcactaatctgatatcattccaggcagaacaaagaaatgtagcatttggggtcctcagcttacccagatggtttgtaattatgtgattcctctgggctttataatatggaaaaataaagttctggatgtcccattgacttttccaggaccctcacaggttcaggacctcaggtggggtctatgtctcacaaaatgtttggctgcagctttgtatttctctttctttaaaaccaaaggttgctttgaggagtaaacattttccaggtaggtgaccacgagctttgatccagctaatacatatcatgcaaatggctcccagttttgagctcaggttttgtgcacacctctatttctttctaataaactcccagcagtgaaattgcgagtcaagcggtctgtgcatttttaaggctgttcatgcctcgtgccaaactgtccgcaggaaagtggcgaccatttttattccccccagaagtatatggtagtgacaatctccccacatttttccaaaattagatcttattattttttagaatctttttcaatttcacagatgaagtatcttaatagttgagcttatatttctttgaattttactgatgcaggactttttttcatgcctttctggcctgttgtatttattttgtgaatttatagctcatgagcatcttgctgttcttagagatgggctctcgctctgtcgcccaggccggagtgcagtgatacaatcactactcctacagcctcgaactcctgggctcaagccatcgtcctgtcttggccttcccagtagctggactacaggcatgagacaccacgttcagctaattttttaatttttcttttgtagagacaagtctcgctgtgttaaccaggctggtttcaaactcctggcctcaagcaatcctcctgcctcacctcccaaagtgctgggattataagcatgggcaactgtgtccagccagcatcctgttttgtatttgtcttatttgtttggaagagttatttttaatatattgaggatattaacacatcttatgtatgttgaaaataaatcacaggatgtatatggataggtatatgtgtatgtgatgtacatgtatatgtatatgcgtatgtacatgtgtatgtatatctatatgtatagataatgcatatgcacatgtatgtgtgtagatagatatagatagatgatagatagatgatagaaatctagatagatagatagatagatagatagatagatagatagatagataatctcttctccaaggaagtctttctgttttctagttcctggcttcttacttccaaaccttttacagttgagccaaaggctaggaaaacattttcagccatccccttttccaaccctgtgctagtgtacccctctcttgggtggaaatgtgagagcaattgcatcttccactcagggctgaggattctggcttagtaagtgtcaagtgtttagaacagggcctggtacataggaaactctcatattagccattctgtgactttctgtgaccgcacaatagcaccagctgcttactcttctctctgcctcacaaaccagcccttttatgatcctcgtggaatcttccctggcacacccttcaggccactgagccacggtcagggctgctcagagaaggcaggtgttgaagtagtggcagttcatacaacagtgataatgataacaactattcattcaggccctactaagtttgaggctctgtacaaccaccccacaagatttttctcacttctcccttgggaccaccccatggggtatggctacccttcatgtcagtgctccagccataacactgaagtcccttttccatcttcatttttggcacactggctcccgccgtgcctgcactctgacatccagcacttctgtctgtgtcagatcaagcattatttttataataggaaatacataataaactatatttttaaatacacaaagtatggctaggcacattggcacatgcctgtaatcgcagcactttgggaggccaaagcaggaggttgttaagaccaggagttcaagcaagacccacctaagcaacatagcaaggacccatcgcacagaaaaaatttaaaaagttagccaggcatgatggtacatgcctgtagtactagctttcaggaagctgaggcaggaggatggcttgaacccaggagttcaaggttgcagtgaccttgattgcaccattgcgtgccagcctgggcaacagaaggagaccctatctctaaaaaaaacaaaacaaaacaaaacaaaaaggtatacaaagtcacgtgggcttgtcaatgtggagaagacaatttactgacaaggcatctcattataatgcacataaaattaaggactttgtatatttgcttttggaggaaaatcttctttcaccaaaaaatgctaatgggacatgggtgaggagacaaccatgacagacaactctaataatatcctaacatgagcgaaggagaaatcaagggttcagtgatgtgtttactgatgtttcacctgatactgtcaaagagaatgtcttggtgttttcttgaggttggtgtcagttcaggtccgccaagaagcagatgccaagacaaatgtagcagaaaatggacctgtgggtaaacaccttgaaattttgtattgatgtataataattgcacattttatagggtacatgtgatattctgatacatgcatacaatgtataacgatcaaatcaggcatttaagatgtccatagcctcaaatgtttatcatttctttgtgttgggaacatttcagttttttcttctagctattggggtaaacacccttaaatgacacaggggagaaagggcaggccaggcaggaagacacccagccacattgatggctggacaacaggagaaggaaggagtcagtgtgggaagaaccatagactgcagtgcagcgctgggacagtctcagccagcccgccagaatccccactgcaaaggctgtgctttgaagagttccacattgaagaaatgtccaggcccattaactccactatgcactcagtgctgccagggacagtgtaaacttggctcaacactgtggacatcccaaaggcactgcaactgggggccactagcctactgtactccccacagcagtctccaaattacaggaatgtggaggcaaggaaaagatatccttatttcctgaatgccttcgtgtgcccggcactttctcgtggaatactgtttactcctcaccacaaacctacagaacatgcaggtaattactggcattttgatatggtgtgcatgttcatctcctccaaatctcatgtgaaatgtgatcccaaatgttggaggtgggcctagtgggaggtgtttgggtcatgggggagatgtctcatgaatggcttggtgccctccccatggtaatgagtttgcacaagagctggtgtttaaaagaacctggcatctctctctctccctctctcatatgacacactgactcccctcccttccaccatgagtaaaagcttcctgaggcctcatcagaaaccgagaagatgctggactatgcttcttgtacagcctgcagaactgtgagccaaataaacctcttttctttataattacccagtctcaaatattccttgatagcagcacaaaaaggactaatgcacgtttatagtgaatttcctcaggctcagagagggaaaacaactttctcacaaagccacagagctgaaatcacaggactggaccctgagcccagatccttccactatagcacagtggcctccatggtccaaacatggcacagggtataaggcaaagatctaagaccaggcagagttaaggcaagaggggatcaggaaaagcccatggcatcaatatgaggggcttctgcccctttcctgctggagtttgttacagcccaaaggggttcttcttgcccactgcaagatgaagccagaacattgagaagcagtgttgctgtagagaaagggtttaattatcacaaggtaactaaacaaaaggatggagatgtttttcaaatctgcctccccaagaattcagaagctagggtttttaagtgtacttaaaacagcaggcagagggctgggaaactgaaacaattgattggctggggacaaaatcacggggtctctaaactgtctttgaacagctgagtcagttcctgggaggggatttcaggatctgtggcatctc

SEQ ID NO: 5054 - DNA, 31309 bp, Homo sapiens
  misc_feature 9122, 9123, 9124, 9125, 9126, 9127, 9128, 9129, 9130, 9131,9132, 9133, 9134, 9135, 9136, 9137, 9138, 9139, 9140, 9141: n = A,T,C or G
agaagtaagacagcttgctgaagatttcctgaaagactatattcatataaacattggtgacttgaactgagtgcaaaccacaacattcttcagattgtggatgtgtgtcatgacgtagaaaggatgaaaagtaagttttattaactctgttatatttgcttcctaacaactttgctgaaaattgagggatcattgtttggtgagttgttttaggttatttcagttggtgtgatttctttagttagcctactaatcctgaaaatttcttgaatccttcaaataatggctgtcaccattatagctttcctatagaaggaattcatgtgtcccctggttgacttaaggaccaagggtgaactgctcgataagtggattagcaggcgtttcctctttgacttccagccatgtaaattaacttaatgttttgctgaccataaatgtgtggccctagcaatggtcttttaaaactcagatttttcctttctctctcctattattagacttattcgtctaatggaagagatcatgagtagaaggagaataaaaccattgtttttgtggaaaccaaaagaagatgtgatgagcttaccgaaaaatgaggagagatgggtatgtgtgagctcctccattgaagcagattgattaaaacgcttaggaaagggcaaacttggatcacgagcagtggatttttttcatatctgatagtgatttaactttttcatttctggcgaaattaaagagatctgtgaccaaaagtggtcaagcacggagtctgaggttttcaatgtgagtttaataacacaacttgtcttttaacttaggtggctgccatgggtatccatggtgacaagagtcaacaagagcgtgactgggttctaaatggtaatatttcaaatgaagtatttttcccccttacttaacctagctagaattctgctcagatattgatcatgtatatgccttcctttgtagaattcaaacatggaaaagctcctattctgatgctacagatgtggcctccagagggctaggttagtacaaactcgcattcatggcttggttcccagaagatctccatttaacttttttaaagaaagtttattgctttctttaacctgcatttttctaagttttttttcacataaaggtgctgtctttgtggcaaggcctaggcatgacatcggaggactcgagggggatggaggactagtgatcggctggctgcttccagtcgattaggaggtgaaaaagctgaacgtgtgccagtaatcttcaaaaggcagaacatatcacctctgcccgtaaactgttctctccgagggaaaaaatggaagttatcctcacagttcactgccgtgtatttcttctgtcccatgctttgcatgactgccatggtacagccttgtttcaaactgtcactgtgatctgtgggtctttgagtttcagtgagtttgctgaaatgtcgaagaagtagtccaaacttcaatgttcaatgaaatttttgttcaagtttgaaatggagagagcagctttaaaggtactaagccttttacaaattggtgagtactggcacatgagatctagagcaggagcacttctcacacatagtaagtgggaaaagaaagtgctttgaaagttcctccctcacctaccagtagtcgtcatgtcgagacctgccagagagagacacattctcaagtgaatcctggctcttggaagcgcttgcctagacgagacacagtgcataaaaacaacttttgggggacaggttgttttcttgcagctgcggttgtaaggtcttggcaagacaagcagtgtggccagaatttgaacttctgatgaatgtgtaatgcaaaggaccttgtacatttttttgtttcaaggtcctaaaatgagcacatgaagaggttgctgtgaaactttaagtggccctactgcgcagaagcatcagatgtcacttgatgatctgtaagggaacttgctgatttgggaatgtgcttagggaaacacattccttttgacagggtctgtcactgggtgggtgatgaattatacagatgacatggcttttttttcttttttcaacctcaatggtattcctacaggaaatggataaccattttactgtattttttgcagcccgtaccttcttgggaatacaattgtctaactttttatttttgtctggctgttgtggtgtgcaaaactccgtacattgctattttgccacactgcaacacctacagatgtggaagatgtgaaatttgtcatcaattatgactaccctaactcctcagaggatatattcatcgaattggaagaactgctcgcagtaccaaaacaggcacagcatacacttttttacacctaataacataaagcaagtgagcgaccttatctctgtgcttcgtgaagctaacaagcaattaatcccaagttgcttcagttggtcgaagacagaggttcaggtaaggatgatgataggaaatgttggtagttacgagtcacatcgttgtctacaaatccatttaaatggtttggagggtgagtaaaaccttgaatgtgaaaacttaagctgaaaaattgtaaaaacattcacgcctaccatgaatagatctgtttctttctgtccacaatgatttgtgtcatagacatattgatcaatttgcaattgttttcttgacaggtcgttccaggggtagaggaggcatgaagatgaccgtcgggacagatactctgcgggcaaaaggggtggatttaatacctttagagaagggaaaattatgacagaggttactctagcctgcttaaaagagattttggggcaaaaaccagaatggtgtttacagtgctgcaaattacaccaatgggagctttggaagtaattttgttctgctggtatacagaccagttttaggactggtaatccaacagggacttaccagaatggtatgatagcactcagcaatacggaagtaatgttccaaatatgcacaatggtatgaaccacaggcatatgcatatcctgctactgcagctgcacctatgattggttatccaatgccaacggatattcccaataagactttagaagtatatgtaaatgtctgtttttcataattgctcttatattgtgtgttatctgacaagatagttatttaagaaacatgggaattgcagaaatgatgcagtgcagcagtaattatggtgcactttttcgctatttaagttggatatttctctacttcctgaaacaatttttaggttttttttgtactagaaaatgcaggcagtgttttcacaaagtaaatgtacagtgatttgaaatacaataaatgaaggcaatgcatggccttccaataaaaatatttgaagactgaattaagtggaaattgtactttattttatataatgtcatgtaaactttgcttaagatggtctggttttttttttgtttttgtttggttttttttttccatgaaacaaatgactgttcctttttatttaatttgggaggcagggggaatcagaaggcccttcttataatgagctattcatattgcaggagtcagaatgaattgatacaggtgaatttttagtacaggctaaattgcataaaagctttgtcagcttccagcatcaggggagtcatttaatacctttttccttatttgctagtatggttaaatgagaaaatagtaaaatagatacaaagtctctatatagtgtgagaacgtgggtgactttttcaaagtttataatttaaaaagctccaataactggctttttcaagagacttatactcatgctcttggctatactgtgaattactgaatgttgaacaaacctgtgaaagacatacattagccctttaagatggccaggagctaagctgagtctcctttactgaatttcgttcttagtgcaggttacttgtagattctagtcttcacggctccctggggctcttaactagtcacactgggagtcatgaatgtctttccaataattcgggaattctagagatcctcaaactgtaaggtctattcatactcaacacaaggaaaaaactcattaaaattaatgactaatcaggaggcaacgtaaccaaaagcacagtgaatgaaagtttcatggtaggttcaacatgggtttattgctagaaagatccaggggatagctttaggttaacttcggctcaccaacgtaactttctaatcatttatttcagtaatagctagaagtgggctgaatgttttcccagagtctgatacgtgtttttttttgccagaagagaggtcttcagggacttcatttaaattctgattattaaactgaggctttaattgatgttaatgccttatgtaaatgtaaagttagaatttgctagggctgggatagggagtgatatttctaggacttagaattgaaaactaattcagcctgtagtaacctggatggttttcaatggcatggttagtcaattcatggttttaaacttagaagcagctttcgggggagagggtaggttggagcatttattcatattttactgtttaatgtcttaaccgtgggccttttaatttgtaaacactgaaatgatgttgggctgtggaaaacatttacctatttaccttggaagttttaaaagacagtccacttttagcatgtgtgttgtgtccagcctgtggtcgtcttaactaataaatgtgatttttctcccattctctctttttatttatttgcgtataggccttttacctggtgtgagttcctgaagtggaaaacacctggcagtagtacccagctttgcagttaattactatctagctggccttttttaaacccttgtatacacttgtaaagaagaactatttcctgaacctggtacagcacttactaatgataaaactttactcctgaattacattaactcaattgctaagctgttacccccttaatcaggtagtagtttggtagtctcacagtgaaatgtagattgttcctttttccctaacctctttaaaggttttcgtaactgaggctggtataagaaatcatggactttggaatcaacttcctcagtctgggtataccacttttccactttctgggtaggtcttaaggtctcgactatttaaatagaaactgcaaaatcagaaacctgcaatttaatcatgagtctcttaatataacagtcacaagtctcattgttttgatgaacccatagaaggggcccctggaagaaattcacgtacgtggttttctctgacaccaggagggtttaagacatgtcagggccccttggttatttctagtgcattcccaggtgaggcagatgctgctggctggggactgccctttggaagcactgcaatatttaaagtgaccataccactaccctagtcacgaagcctatcgcccccctcccggaagcttaagcgtcaagacaacggctctggggttaggcctaggccacctggcggcgcatttgcctagttaagaaggcctgggcttacaaatcaccgtaaaggactaaaactgttaaagggaaaccaaatgccaaatttagtccaagtgcttgattgaggtgtatatagaaggtatttggataatactgaagtattttaattttctggactgcaaaacagtggcagaaggaaggactcaagtggctacaccacggttataaataggtgggaataacctttactggtgcttacaggaaagaaaaaagtcaatctgaagggaggggcgcgacgcgaacggcaagctagcagagaccatccgagccggcgtccgccatggtgggcgggggacggctgcggccggaacgcagactgcgcttccggggtggggcctgccgcccgcaagcacgctcacctccgttgcgcctgcgcgtggcctctccggattctgttaacggtagtggtggcttgttgggatccgttgagtgatggagagtgtgctctttaacttcggagagagatgcgctctcgtgtagccgtcagggcctgcataaggtctgcaggtgcctgttgtctgggtttgggggtcgagtagatgcggggcagccgagctgttgacggaaaggagtagccccaaaggagggcatgtgaagtcgcacgcggagctcaggggaacggcgagcacccagaagcccccgggtctggagagggaagcgaggcgctgttaagatctgtcagagaaggcatttcctaagtggaagcaagcagcagcttagccgggattctttctgagtgggtgccaccccggcttcggacccttgggcgtagagttgcggaagaacctgccgcagaatggtggacctcggtggtggtgttcagggagcaggtattcccggtggacgcctccaccacaaaccaggccctttgctacccggggacagtgccttcaggttagtttctgcaaaactctacgcgaaatcttgcaagacaaagagctgagtaaggaacagctagtagcatttttgagaacgtattaaaaacttctgggaaactacgggagaaccttcttcacggtatgcttacgatttcatgcttcaaaacaggtgtcgggtggaaaggcgaggcagtcttgctggatctggggattgcaactggccctgtattcccatgcaaggaagttagttagttctcatctttttaagtagtcggatatattaacagtgctctaccctggagaaaactggtccatggaatcattctgttccttaaacaatctgtccgaaggacctgggaacgctctcaatttcacggggcaactctgaacacagtgctgtcatttagtgcaatgtagtctaagtgcataaggaactacacagcattttgaacttttcttagatttattctaagtaaaaatgttgaaattataattctgaaatatttcatgtatatcataggataaatcaaggccaggcgcagtggctcacgcctgtaatccagcattttgcaaggcagaggcgggtggatcacctgaggtcaggagttcgagactagccggccaacatggtgaaaccccgtctctactaaaaagacaaaaattagccggccgtgacgggagcgcctgtaatcccagctacttgggaggctgaggcaggagaatcgcttgaacccaggggcagaggttgcagtgagccgagatcacgccactgcactccagcttgggtgacaagagcaaactccgtcttaaaaaaaaaaaattcaaatagttgggttagttgttattaggaaccaaatattcattgtaaaagaagagataatatgtaaaagaaggtacgtataaactaatgttaatatggattggtaaattaaatatgaattggtaaattaaaattgaatatgggtctcactcttcacccagactcgagtgcagtggtgtgatcatggctcactgcagcctcgacctcgggctaagtgaacctcccacctcagcctcccaagtagctggactacaggcacatgccaccacaccagctaatttttgtgttttttgtagagatgaggttttgccatgttgtccaggctggtctgaactcctgagcttaagcaatccgcccatcttggccccccaaagtgctgggattacagggtgagccacagtgcccagcctcatgatttttaaaaatatatttcctaactttcttcgttaaagttcctagaagcaatgaccctcagtagcaatgagcacacctagtgcccagatcctgttcctttttttttttttttttgagacagagtctcgctctgccgcccaggctggagtgcatggcacaatctcggctcactgcaagctccatctcccaggttcacgccattctcctgcctagcctcccgagtagctgggactagactacaggcacttgccaccacgcctggctaatttttgtatttttagtagagacggggtttcaccttgttagccaggatggtctctatctcctgacttgtgatccgcccgcctcggcctcccaaagtgctgggattacaggcgtgagccactgccccggcctccagatcttggtttctaagatgaaccagtactgggagaaatggctgattccggtctggggttagggaaagtacaaggtgagtttgaaacactttatggtgctaaaaagcaagaattgcttgaagactaatgggtcatataaaaaggtcacagatgctggcttgaggaggttgtcactggccacatctaggacaaattgaacattaagatacatattaatggtaatggacataacacattgactaaaatctaagagtcaatagtattaatcaaaaacaaataattgacctagaggtcgggggcggggggaagaggtagagaaagcttatgtttttacagaagctatgaataaatgtagaaggaaagatacattagaaaattcaccatttcatgatattgcaaacccgatatcattgattcaagcaacagtcatcaatggattctaaaatactgggtgaaatactgtggggagcaggatattattggggagtggatatttactaccttaaccaagtaatcaaattggtgtcttcagtagtggaataatttgataacatgttcctcatgttatgatgcaataagaacacacatctactatgtagtattttgctaaaaatgattagccgaaattaaatcataaggaacaatcagacaaatcccaaatgtgagacaatctatgactaacctggactcacatcaaagtcagtgtcattaatagcaaaattaagggggaaaggaggcaagggaaatgttctagattaaatggatgaaagaaacctactcagaatgcagtacatgaatcttaactggaaagagaacgtaaaagatatttggggtgaaaattggaacaactaaaatatcaccatatgttagattatttgtggtattatggttaactttttatggtgttataatggtatataggaaatatttttattttagaagatgtatgcggcagtatttgggagtgaacaagaaaaaaatgtggcaaaatgtgataattgatgaatctaggtaaagggtatacaagtgttcattgtatatggatgtttattttttttcaactttcttatagatttgaaaatctttgnnnnnnnnnnnnnnnnnnnngcaatgataccactctcttcttcagataacatgttattctccataagtttcttcctgttgacctttgatgcaaaccaggcttcccatagctgtcttaggcagcaactagttggctgatttaaacttcctgacagttcatgtaaacaacaggtccagttgtctcagacaaattaaccaaatagattcaacagtaatatttttaattaagttatggtgttgaggcaatcagacccttacaattttaaagtgtctttttttgttcaattttaaaactatgaggccgggtgcagtggctcactctgtaatcccagcactttgggaggccgagttgggcggatcacgaggtcaggagatcgcgccaacctggctaacacggtgaaaccccgtctctactaaaaatacagaaaaaattagccggcgtggtggcgggcgcctgtagtcccagctactcgggagggtgaggcaggagaatggcagaacccgggaggcggaggttgcaatgagccgagaccctgccactgcactccagcctggggacagagcgagactccatctcaaaaaaaaaagaaaatcttcaaactaaaaactcagggtaaactacctagaattaagtggtgatctgtctttttttgtttttttttaagacagggtttactctgttgcccaggctggagcacagtggcaccatcccagctcactgcaaccttggcctccagactaaagtgatccacctcccagctttccaagtagctgggactacaaggcacacacaccatgcctggcttatttttgtatatttttagagatggggttttgctgtgttgcccagttggtctcagaactcctgagctcaagcaatctgcccacctcgacctcccaaagtgctgggttataggcgtgagccaccaagcttagccaacatctgtctttatgctgtgttaacgttatactactattaatgtgtctattgacaaaaatgatttgggtttgtggactagatgtatacatgattgatttatcttttgacaggtgccttggaacactatgttaattgcctggatctggtaacaagaggctaccttatggccttgctcagattggagtgtgttttcatcctgtttttgaactaagcagatacgaaatggtgttaaaaggtataaaaagtggcaaataacttggccttgatttaaatagtcaaaaaccagtcatttccacttgggataaattatataattttcagatagctaacttcctgatacgttttatatctaaagtattggtgagaagactgaagcttcgttatatggtttactcctccgagaacttcaaaccagtggcttgatttctggttacgtcatcgatccagtggtggagaaaggtactgcaataattacctttaatttaatagttaatacataaatgtcttaatgtgtcagtggtaattcttctgacatacaagaaattatatttgatgtatgtgctattaatatattatacaaatacaaaaactctttgtaacaattttcattgttctagatacaaagttactttggtaaaaacatttgttgggctcagatgtgtttgttaattagccttttgtgtaaggtaaaattcaaagccctcacctagcattcctggctgatgtagagtttgaccttgaccattgtcacagcttcagcttttgctacctacctccatgaactttccatattagtaaaatggctctgtaattgatgatcaagttttagtactcactgaaaaaaaaagagttgaataagcatttttgtcttgccatgtgttatgttaccatttcccgactcaaacatccccaaaacccatttaaactgtatgaaataatcacgagtcatcaagaacttcgcagaagggtaagatgaggactatgtgatactttcttctttatcccactttagtcatggttaacttcccctctcattggccataaaagtctggataacatcaacagttttttctctgtagttctttcctactaaaaacaatatgttaagcaatatactcagtattttcactttttattttattttatttttttgtctgtttttggttttttttttgttttttttttttcacaagtaccagtcatcttttattggaggttaattcccattaggatatgaaaggattcagcaacaatcgagattgtgttgctatggaggggttgcagccaagaaggttgctgggggagtgcagagcatgtcttcttcagtgtacttgcatagccgctcgtgcttgagctccttgtaggaaaggcagtagatgaagagcagtaccctgccagcaccatggtaaaccccgagatgctccccttcttcacgttgatgtactgttgtagtaccagtagtaacctctttgaaacgctccatcaaggccactagggctgaagtccacatcaagatccagcttggcagctcccctagtttgacctccagaagtttcttgtcctcactggtacaactgactccatcttggtttttttagagacatagtctcactcttttgcccggctggactgccgttgcacaatcacagctcactgcaacttcttttattatttgtagagagaagtcttgctctgttacccaggctggtctcgaagtcctaagctcaagtgatccccctgctcagcctcccaaagagctggcataacaggcgtgagccactgtgcctggccagtattttactttttaaaaattaaatttcagcaacctgtggtcccagctactctgaatcctgaggcagaggattgcttgaggccagcagtaggaggcagcagtgagctatgattgtacctgtgactgccactgcactctaacctgggcaacagaatgagacacatctcaaaaaaaaatgtaaattgaataaactttaaaatttgtattcgggacttgactagtttcgcacatttgctgaataaaagtatcggacaatttaaattcttacagataattatgggagttaaattagtgtttatttaatatgttaagacaaacttaaattttcttttccagtttgccatgagtccatctaacttcacagcagtgactgtcaggatgaagaaggccggaaaggaaacaaactttactacaattttcctggggaaaggagttaatagaaaccctgtggaacctaggagatcacgaacttttacacagtatcctggcaatgtgtctaaattacatgtatgttttacctggagctcctatgtatttttacccagattctctataatcatttccgaaccatttgagaataaggtgcaaacgtggtgtttaacacttcattgtgtatttttcagatgcagagacactcacctacataactacaatccgtcatcaaaatcaggaaattaacagtaatccactattgccacagagccctacaaattgactgattatctcaataatggcatttataggtccaagatcttgtctttcatgtagttgtcaatgcctttacactccttcaaatgaacaattcctcttgtcttgcgtgaccttgacattttgaagagtacagtctagttaatctgtagaatatgccttggctgggatctgtctgctgtttcacgtgatttatgtatttttgtcgggagtactacagaagtggtagtactgagaagctctttctcagtgtgtcatatgaggagtgttactggtgatgttaacttttatcatttagttaaatggtttctactagatttctccagtgtaaagctaataaatagtttgtatttattaattacggccaggcgcagtggctcacgcctgtaatcccagcactttgtgaggccgaagtgggagatcatgaggtcaagagattgagaccatcctggccaatgtggtgaaaccccatctctactaaaatacaaaaattagctggatgtggtggcttgcccttatagtctcagctacttgggagctgaggcaggagaatcgcttgaacccgggaggtggaggttgcgatgagccaagatcgtgcactgcactgcagcctggcgacagaacgagactctgtctcaaaaaaaaaaaacaaaaaattaactagtaattaataagtgttgtgggcagatactttaagatgatgcagacaatttcttgtcaccaaattttgccttactggttgcagcatccattgatgattcttgcccagatcagtactaatgtgaggtttgccaaatggtgatttttttttttctttatttgagacaggatctactctatcactcaggctgaaacacagtggtatggtgatagctcactgcaacctcaaactttgagctcaagcaatcctgcctcagcctcccaagtagctaggactacaagcatgtatcacatgcccgactgatggtttaatatttgtagagacggggtctagctttgttgcccgggctgtctcgaactcctgggatgaaacaatccccctgcctcagcctcccaaaatgcttggatttaagaatgagtcaccatgtttggccatgtcaccaaattttgccttactggttgcagcatccttgatgattcttgctcaaatcagttactacgatgaggtttgccaatggtgtttttttcccttcccttttttttttttttaaaaaaaaacaaattccatcattccttctagatttacggtcagcaatatactgtagagcttttccttctcctccattttttttttaaattggtattcacagattactttctcagggggttacagtgtgttactgtcattatttattttgatggtcaattgtcctagacttggccagtgtccttttgacatatttccatcattgtcttgacgagccttccttaccttttgtagcaatatattgttccaggatcatcagtgagccaagactgtgcgctgcactccagcctgtgcaacaggatgagaccatgtctcaaaaaaaaaaaaaaagaaaagaaaaaatatatagcaaaaacataggagtttatatataatgagtagaaagtagattaattttatttttttattttttgagacagcatctcactctgttgcccaggctggagtgcagttcgcgattcccaggttcaagcagttcttctgcctcagcctcctgagtagctaggactatggtgtgcgccaccacgcccggttaatttttgtatttttagtagagacagggtttcaccaattgaccaggctggaatttttaaatatgaataactaatgaaaaactagaaggcttattactggtgaacattttcctttaactccaccaccatcacacttcattttggggtactcagcttcaaatgaaacttattggttattatcatagttaacgaacagctcaaccttgtgactaggatttaaagatgatttttgtattgtggctattagtgtcttattttgttcttttttttctttgtatgaagaatggggtctcgctatgttgcccagtctggtcttgaattcctgggctcaactgttctcctgcctctgcctttctgagtgctaagattacaggtgtgaactaccatgcccgattattttgttcttttattggtatcattttcactaatgaagagttttcctattgcagaatttttctcttccatgacattgttccttttctgtttccagagttcacaaaattatttatattagttgaacatgttataaaatattaagtagaatttctgtcatttagtatgctttcttaaatgtttctgaggccatttctttctttttttaaaattatttaatagagatggggtctcctgtgttgctcaggctggtcttgaactcctgggctcaagcaatcctcctgccttagcctccaaagtgctgggattataggcgtaaaccactgcacccagcctcttaggccattttgtactgtttttagttgattttatggttaatgtccaaatatattttttagagaacagtgaagcgaccaataaaggctgaagaacagttaggatagaaaagaatttattctggatagtgtgagaatcagatattgttggaagagttgccaccagatatcctgacattgttggatatccaatttcaaaaaattagaaaacaataaacaatcttttttgtttgttttaaatagggatgggatctgccatgttgcccaggctagtctcaaactcctgggctcaagtgatcctcctgccctggctcccaaagtgctaggattacaggagtgagtcactgtgcccagcctaaagcattcttcataagattcagatttagattttgtttgattcaaagcgcaccacagaatctttcagtacttggtttgtctttttttttttttttttttttttgagatggtgtctcactctgtcacccaggcggagtatagtggcacaatgtctgctcactgcagcctccacctcctgggttcaagtgatttcatgcctcagcctgctgagtagctgggattacaagcatgcaccaccatgcccagctaattttgtctttttagtagaggtggggttttaccatgttggccaggctggtctcgaactccgaactcaagtgattcgtccaccatggcctcccgatgtgctgggattacaggcatgagccctgctcccagcccagtttatcttattaactatcagttcgacgataactgtgtgaaatacactggtagaatagagtcccaggtatcagaaagtttactgcctttgagggcaaattcttggaatctttaaagtatcatatgcaattcaaataggtttaaaatgtcagtacatatatgtataatgaagactgtggttgatcatgaataattaacagaagctgaggatttaaatttgtgggttttctctcttttttttttgttctgtgactctagctaaaggtggttatttaagtattttaaaaattacatgaatatccaggtgaacaatgatttacaaaaaaagaaagatgaaagtgaactgtttttatccaaaacttaagaaatttctaggattgaaatttttaagaagtttgaatgattcctcttcagtttagagaagaagtaagtctgtttatcaatacttaattcatatcagtactatgtgtagtttgttttcataattatggctttaatgcaaaaagtaagtttttgaagatttcttttttatgaaaataactttacgtttcagaaaattatactccaaacccctttcctaaagcacaccatttttttccctaaggcctcttttgaataatcagcaaacaatttttattaaaagtgttacctttcgaggtagggcgcagtggctcacgcctgtaatcccagcacttgggaggctgaggtgggctgatcacctgaggtgaggagtttgagaacaacctggccaacaggtgaaaccccgtccctactaaaaatagaaaaaaattagccagacatggtggtgtgtgctgtagtcctagctactcaggagactgaggcaagagaatcacttgaacccgggtggcagagttggcaatgaggtgagatcatgccattgcactccagcctgggtgacagagcgagactcgtctgtattaaaaaaaaaaaaagtgttacctttctgaatactaactctgagctcggaagattaaagaaatagtctgtagggctattgaaaaaattgatgcctaagtccctctccagttagttcgttcagaatctctgggatagagcccaaccaagcaccatagttttaaaattcacattgggcctcgctgatgaaacactgagctcagtgagagcagagaatgcatctttatcgtctcgtgggcccagtgcctaccacaggcctggtacagagtgggtgctttgtaaaatgaaacttacttttgtattctgattgtgtaagtctaaaatatgtactcaggaggctgaggcaggaaatcacttgaacctgggaggcagaggttgcagggagctgagatcatgccactgcactccgcctggccaggtgacagagtgagactccgtctcaaaaacaaacaaacaaaaaaagttcttgaaatgattatttttcttctgtttttctgtgaagggccgagatggacgaaaaaatgtgttccttgtgttctctctgtaaatggggacctagaccgaggcatgctggcctacctctatattctttccagctgacagagaactcctttacaagaaagaaaaatcttcatagaaaggtgtgttgatatttcagagatagacttgggaaactaaaaatatgggtttgtttgttcttaatttagtgtgctcggtttctaacataaactctaaataataaatttagtgcatgtagtctaatatttttcagtttttttagaatctggccacaggaataagaatcaggttctcacagaataaacaaggcatccctaataagtaatcccaaaggcatttctgtttaattgtgaacagacagtatctctatgactcctagcccctgaacctttccactgtgggcttccatttgtatcagaactgaagcattggtacataggaggaagaaagacccggatcagggagacctgtgctattgactctctgccccaggtgtctggcttctggtcttgtgccacatggctggttcctggatcagggagctagatgtgggcctggaaaggctgattttagtgcatgaacatgcacttggagcattttatgggtcaaagaaaatcgagaggagaagttgaagttataggagagaaaagaaatgataatggggcaagatgaaggaaaccggaggggtcaggatgggatcaagagcccaagtagagaatgtatcttgaaaaggagatatttgaaacagcagggaagaagaaaaaggatagtgagtataaaaaggctactgggctttttggtctttgaaggacattttactgatgccctctatttctcagggagttaggaggcactattagtttaaatgtggaagagtgggggtttaaatggccgagtggggaatagtcatataccctttgaacataaaaggaagctgccccaaatcaaaagtttaacaaataatgttgagtgttcagctgggattgggaaccatgagtttgtaggaaaccctcttcttagttaagtgatttattatacagtgttcatttagcctgctataaccatagagagtctgattatagaattattctggggaatggggtttataaatggtttgtagctaacaaaaaaggaatcctttctttttcttacactccacttccaaaccatcagcaaatcctgtttgatctaacttcaaaacgtatcctgagtctgaccacttcctagcctgtctactgctaccacctgctataagccaccgccactcctcctcccctgatagagtggccctgttaaaaggtgcatttgtgttgctcctttgctcagaacactccaggaaagcttctcatctcactcaggaaaaacgaagccctctttttgatctgctgttctccacctcactcagtctgctccagcagcactgccttgctatttctagaacatgctggagatgctgccagctcagagccctgtcatttgtatccccattgcctagagtgctctttcttcatcatccatgtctcgtccccccaccttctttcagtgtttgctcaagtgtcaccatagggagagaaccttttctgaccaccttaaagttgctaaaacctcccccagcctgcctcttgccagcatgttccatcttcttccttttttagcaccaccaccttcacatatattatttacttatttttattgtctgtttctccctgccacgagagcggagatttttacccctagcacctggaactgttcctggtatcagaggcattaaaatgttgttggatggactaatgaatgagaagagaaggctgggctgaatggctcacgcctataatccagcactttgggaagccaaggtgggtggatcattcaggtcaggagttcgagaccagtcttctgggcaacatggcaaaacttcatctctacaaaaaaatactaaaactagctgggcgtgtggcgtgcacctgtagtccctgctacttaggaggctgaagtgggaggatggcttgagccagaggtgggggttgcagtgaggcagtgagtggagcattctagcctgggcaacagagccaaccctttaaaaaaaaaaaaaaagcaaatttcatttaaaaatttttttcattcaaaaaaaatatataaaaagagaagaacagtaggttttgacaagagagagaaagttgaaatggtaagcacgtggcccaggctggtagggtccaaagtgatgctgaaagaagcattttgactgaggggttgtcagaaaatgggagggtctcaagttaatttgtttttttttttttttgagacaggactcactctgtcgcccagactagagtgcagtggcacgatcttggctcactgcagccttgactcccgggtcaagcattcttcccacctcagccgcctgagtagctgggactacaggtatggccatacctagctaatttttttgtatttttttggtagagagaagttttcaccgtgttgccaggctggtctcaaactcctgagctcaaggaatccacctgcctcagcctcccaaagtgcggaattataggcatgtaccaccatgcctggccaaattaatttctttctgccaaacatctagtggagaaatctggggggcagctgaatatgttactacatggtgtttttatgacctcagtaacttctgttttcacacagaaaattataactgttaagaaactgtttgttaatacttgtttatatttaaacttgtgttatatttaaacaaactatgctttttcccctttcctgtcttcccctcccccatttaattgccttaggtacttaaacttcacccttgtttagcccctattaagttgctttggatgtaggaagaggccccacattggaactaagacaggtgagttaaatgagttaaatgtcattttaattacagattgagtattatccaaaaacgctttggaccaggaccatttggatctcggatttttttggtatatttgcatctctaatccaaaaatccaaaatcttaatgttctgatgagcatttcctttgaactcaaggtttcaggttttggagcattttggattcggattttctgattagggatgctcaacctaacccttactctaagtaaacttgatagcttccatttaaaattttattttgattcatttgctttttaaaatgttttaggtcgggcgtggtgctcacgcctgtaatcccagcactttgggaggccaaagcgggtggatcacgaggtcaaggatcgagaccatcctggccaatatggtgaaaccccatctactaaaaatacaaaaattagtgggcgtggtggcacgcacctgtagtcccagatactcaggaggctaaggcaggagaatccttgaacctaggaggcagaggttgcagtgagctgagatagcaccactgcactccagcctggcgacagagactccgtctcaaaaaaaaaaaaaaaagtttttaatttgcctggccaataggcaaaacctggtctctactgaaaatacaaaaattagccgagcataatggtatgtgccttaattccagctattcaggaggctaaggcacaagaatcacttgaacctgggaggtggaggtgcagtgagccgagatcgcagcactgcactccagcctgggtgacagagcaagaccctgctcagaaaaaaaaaaaaaaaaaaaaaaagctttaattaaataatgaactgtgggtaagtatgtgattatatataattttgaagtgtgttaaagaagctgaatacagttcattgggtttgtgttcatgcccattcatagtttcactttttagtgagtagacatagtaattaaaatattttacacatgttagtgaatgtgacttatttctttcccctttgaactttttatttatttattatttattttgagacggagtcttgctctgttacccaggctggagtgcagtggcacgatctggctcactgcaacctctgcctcccaggttcaagcaattctcctgcctcagcctccctagagatgggattacaggtacacaccgccacacctggctaattttttagtatttttagtagaacagggtttcaccatgttggccaggctggtctccaactcctgacctcaagtgatccgccacctcggcctcccaacgtgctgggattacaggcgtgagccaccgtgcgcagcctttccctttgaacttaacacttttggtaactgactatattcagatattctagatctataattttatttgatttttctaatttgttctaatgattaaatactcttaagaaaggccatgggggatgctttcatttcgttccagagactccttcagcagtcgtcatttctgtctgggtgattgagaccagcccagacctgaatgcggacactaaaaagatttaaagactttgagagtcccccagcttctgaccctggcttttgtggagaggtctgggaagatgggagatagtgagctcaaagaagagaagataatggcgtatgtcccacattttctcccagggtatggcagcctccctaataccttataagctaggaagctcctaggatgctgtagctcagtcaccatttagtaatgtctgggagatttgtggttgtcctaagagtgggagggtgctgcaggcctctcctggaggccaggatgctgctaaacaccctgggtcagcagtgcaagggtgaggaaccctgctctggactgttgtgctagactgttaaggggtttttaaattttgctttgttttgcttccctattgcttgtaagaaaacagttaagtttactgtgtcatttattcatcgttacttctgtatttccagtcaagttttgtctccagcattccagtgaaatgggttgatcagtctcttcttgaaacattttccgggtttgcttctggaataccactctcctttttctcatcctttttctttcctggctcttctcctcttcctgacttggtggtataacctagggctcaggtctcacctctcagatgagggcttgagttcatacagccctttggatctcctggtttttttctgacagaatctgttttggtttgtttgtgttttgaatgatactaagggtaataaaaattcttatttgatatacaaatttctagaagattggcatttagtattcagctttgctatgcttaattacttcattttcagaagaatatacgatttataaagtatatgatatggaagttataaacattaacatcacataattaaaaaacatacccattttagagattgaagagggtgatttgtggcttcacaaaaatagaataacactctagctaccattatttctttcatatttgaagtttttctatttctttctaggtttgcaagggctatttaatgagttactagaaaatgggatttctgtgtggcctggttatttggaactatgcagtcctcattggaacaactttattcgaagtaagaattgtattttcattaaaggtgtatttattcaagagtttttgattatgtttatgaattacagaaacaaatctcttctaatttatatataaaatataattttaaattattcctcagtttcccttttacagaactatgtcatttagttaattgcctcagcagggaacagtattcagcaagtatgtttgagcacatgcttatgtagttccaagacttaatgtcatgaagtatgtatacctcagcttatccacttatggtgaaagtatgtatgtagagagcatgtgttgaatcaagactgaaggaatatgagtggaatcctttctttgctggcattgtggtccattctgagactgagtggaagggaattctattctgagggatggtctgttctagtcttctaagggattggcacctctgttcacccaattgctcaaacagagaaactggctatcatccttaactcctccctcttcctcattctctacatccagtcatcatcaaatgctgtcagcttgcttcctaaatgtatctcatccatctctgtcttcgctgcactacccaagttagagtcaccaatatctcttgcctggattattgaaatcatctcctaatgagctctctgtgtctagtctcaccccatgctatttcattaattgttgtttttaaataaccattcttgttattttttttaagctttttgtgttgaatatgtatcttttgggtgaaaagtgtgaaccattgtgttttgatcttcagttctctgaacatttgttaaaatacaccttccagctgggcgcagtggctcacacctgtaatcccagcactttgggaggttgaggcgggcagacacctgaggtcaggagttcaagaccagcctggccaacatagcaaaaccccgtctctactaaaatacaaaaaattacctggccatggtggcttgtgcctgtagtcctagctacttgggagctgaggcaggagaattgcttgaacccaggaggcggaggttgcagtgagctgagatcaaccactgcactccatcctgggtgacagagcgagactccttctcaaaaaaaaaaaaaaaaacacctttcagatgatgtccaaagaaaagtagttttctataattagagcatctaatggtttattatgtgtaaaatgaaggggcagcacttgaactttcttgtcctctcaggttctcaatcttatcctttgagccatgtggacattgtcaagttgcagttgttctttatatggtaaaggtttattgtcccaggatatttttatgaaattattattaaacacgtactatgttttattcatttgctatagtggtgaacaacacagaaaaatgtatcattctttttttttaagacagagttcgcactgtcgcccgggctggtgcaatggcgtgatctcggcttagtgcaacctctgcctccgtgttcaagcgattctcctgcctcagcctcccgagtagctgggattacatgcgcctgcaccacgcccagctaattttttgtagttttggtagagatggggtttcactatgttggccggctggtctcgaactcctgacctcatgatccgcccatctcagcctcccaaagtgctgggttacaggcatgagtcaccacgcccagccatactattcttgttaagcttatattctagtagacaaaatagacaataaataaacagagaaataaaaagtttctgatggagtcctacaaagaaataaacagtaatgagatagtgtgacttggtaagcatacagaaggtcagccgtgcatcatctgtttggttattgctgaactagaagctataagctagctactcaataaaggaaacatattttggtataatttgttataccaaattgcatctttattataatattgtttattgtaaggacttcagtctaaaataattgttcttggattgcatccaagaaccaaaaggctgaggttatatgcggttcttctgtgatatcaccccaaatgatgtgttgaggtaccagtgtttattctagattttattttcttttatgacttttcagctctagcaataagttagaaactgtctgaaatattactttaaatacaattcagaaactttaaaaatgttgggtttttttggtccacccttagccctgagtctgtgactcttgagagtgcatgaacactgaattacagctggcaacgtggggaatttattatttacatttgtgctcatgtgtctgtttaactacttttttcttaggtatatgaaatgagtattctcttcacagttttggttactgaaactactttggagaatggattatacatctgagaagcagagacaccacaatgaaggaaatgatgcatatatccaaattaaaaactttttgattaagtatatatcatcagctaagaatgtatagatttttatatttgtataaaaatattcttctctcctaatttggttgtcttatgttcacttagatttatttctagccccttgcacttataaagtggacatttgtggtgcttgctttcattcagtgtttatattttttagtctttcattgtatcaggaatatgttcagctacaagaaacaaaaatctactatactggataagcaaattggggtttgtttttcttacatacaagaactctagcgggtagactgtccaagctagtattactgtttctatagttagggacccaggcacttcccttctgttctgccatgttagtacgctggtgtttatcattgttgcttcgggatcttaggtggctgctgtatttccagctaattatcattctagttaggagaaaagttaaagagacaagagctagtcagccaacactttcccttttaaattagggaagtaaaaacttttccagacatcccagtcgggagatgtcttacatctctttggtcagaactaaatcacatgataatttctaggcaaatcaccatccaaggaatgaaaatgatctgatttagatcaaacgcaatttatcccttgaggctgcaatagtatctactctctcagaaatgggctttgttaccaggaaggaaaaggtctttatggaatctgccaatctatactgtcagatatcaaaaattaacctaaaactaaacttttaaaacttagagtattacggatttttgaaaagcaactaaaatatatgttagatgtcatatattgtagtttgtttctgtctaatatctatgtttataagaaatcttttaacttttatgtgttgatatgattgtgaaaatatcccattgttaccaacttgacaaaaattccaactgatagtgcctgtaaaatattcaaaagtttgactgacttaattgattttacttggtaggtttttctctttttttttttatttaattttaattttttttgtagagacagggtctcactatgttggctaagctgatctttactccgagcctcaagtagtcctcctgccttgacctcctaaaatgatgggataacaatttgagccactgcacctagccttgttttggttattttatgcttttttttattatggagaatttaaaagcagacatataattgtactaattctatgtagtgatcatctagcaccaacaacaacaacctttggccagtcccacctcatccactaataccacccttccatattatatcagtaattatttatttacatttatttattaatttaagagacagggtctcactatgtggcccaggcggtctcaaactcctaggctcaagtgatcctcctgtctcagcctcccaaaatatggggatacaggcatgaaccacctcacctggcctccttgaatattatttcaaggcagatagcagctccatttaatctggaaatatttaaggatcttttgttaataaccacactattatcacattaaaaaataacactacatgatatcaaggaattatttacaattttgttgggtgtgataatggagtatgtttatatttttctttttaaaaaaatccttgtctgacagatacatacatttatgtaattgagacttgctttataattctcctgtttaaaacaaacttttttaagtggtgggagtgaaataagaatagcactgagttggccagtggctgacgcttgtaatcccaaccctttggaggctgaggcaggtggattacctgcggtcaggagtttgagaccagcctggccaacatgggaaactactaaaaatacaaaaaattagctgggcgtggtggtgggcgcctgtaatcccagtacttgggaggctgaggcaggagaatcgcttgaacccaggaggcagaggttgcagtgagcaagatcgcgccattgtactccagcctgggtgacacagtgagacgctgtctcaaaaaaaaaaaaaaaaaaaaaaggaagtggtagtagtgtctgtttgtttcttttttggggtggccacaaccattgattaatacctcaagtggtgagttcattaaagcttgcaaaatggtgatatttatcttccttctttgttggctagagtactttttttgttgtttttttttttttttgagttgagtttcactcttgttgcccaggctggagtacagtggcgcaaactcagctcactgcaactccgcctccgaggttcaagtgattctcctgcttcagcctttccaagtagctgggattacggcatgcgccaccatgccctgctaattttgtatttttagtagagatggggtttctccatttggtcaggctggtcttgaactcccgacctcaggtgatccgcccgcctcggcctcccaagtgctgggattacaggcatgagccaccgcacccggccgtttgctagagtacttctatgagaaaagcttctcaccgagtatttgcttacctagaggtatgggaaaggtaggataaatgcggattatttaaagtaattattccttttgatgctcaaattgtcccatctttggccaatggaacctcaagttggcctcaagtctttttttttttttttcttgagacagtcttgctctgtccacagtctggagtgcagtggtgcgatcttggcctactgcaacctctgcctcccgggttaagcctccctgcctcagcctcctgagtagctgggattacaggcgcctgctaccacacgtgttaattttttgtatttttagtaaagtttcaccatattggccaggctggtcttgaactccgacctcaggtgatctgcccacctcagcctcccaaagtgttggaattacaagtgtgagccctgtgcctggccagcctcaagtctttttgacacaccttactagtctttgataatttcctctaataactactgtagagattgtatattccaaggagctctggggttttttttattggaaaaagtggacaccatactttggatactaggaatgctcattgatagaaggcagtctttgttctaggcctttccagtattaagagctagcaaatataggagagtgtgtatttcctccctgaaaaaaaattggccagatgtggtggctcatacctgtaatcccaatactttgggaggctgaacaggaggatcacttgagtcctggagttcgagaccagcctaggcaacatagaccacatcctaaaaaaaaaagctttgaaaattagccagtcatagtggctcaggcctatagtcccagcacttgggaagctgatgggtgtggacggcttgagcccggggagtcaaagccgcagggagctggatcacaccactgtactcctgcctgggcaacagagcaagaccctgtctcaaaaaaaaaaaaaataaggccgggcacggtggctcacgcctgtaatcccagcactttgggagactgagtgggtggatcatttgaggtcaagagttcaagatcagcctggccaacacggtgaaacccgtttcttctacaaatacaaaaattaactgggcatggtggcaggcgcctgtaatcccagcacttgggagtttgaagcaggagaattgcttggacctgggaggcagagattgcagtgagcaagatcatgccactgcactccagcctgggcaacagggtgagactccatctccaaaataaaataataataacaaatgaaaaataaattatgagttcacaccaatattttccactcaaatcaggactgcagagggtctggggtttgtatgtctgttttaatcagttttattaagatacatttacatacaataaatttacctcttttaaatgtacaaattgatgagtattgacaaatgttaaccatctccacaaaggcaatgtagaaaattttcatcaccccttaaagtccttttacattttttttgagactgcctcagtagtaaccactgctaaatttatcagagaactgcacaccggattgtattttgacagaacttccttccaacccaattgcttttaataatttttttatgaaaatttttacccaaaatgttatagaatttatttacaaagaaatttcgtaagttgtattttcctactggtgtggtattatgctaaggaaacaggtctggagtcatgaaatccttaggtgctaatttttctaacctgtaagtttctgtgctactgcagatctcagttactgtctctggtgtgggtgtgtgctgcggaagagtcagaggtaaggcactagtccatttccttccaggacattgagaaagaaggaaatgaactccagtcatcacaaatccactgttgatgattcctctggcaggtctcccctttaaatccttagggagaagcaacactgagaaaagataacttcttctttttttttttttttgagacggagccttcctctgtcgcccaggctggagtgcagtggcgcgtctgggctcactgcaagctccgcctcccgggttcacacaattcttctgcctcagcctccgagtagctgggactacaggtgcccgccacctcgcccggccaatgtttttgaattttttatagagacggggtttcatcgtgttagccaggatggtcttgatctcctgaccttgtgatcccccgcctcggcctcccaaagtgctgggattacaggcgtgagccaccacgcccggccaaagacaacttctttagttgtaatcccccatccctgagagtagaagaggcagaaggccaaaagtcgaccacacatgtttgcagctcctcatcccagcaagatttctgtgctgccctggtgtaccctgcagatgccaccttttcccagttttctactggattattggtctttctcttaatgtttgtaaaagctcataatattatgaaacttcatacaatatctgagacctgggctcaaaaacagtcatgcttcacctaacagtggaggtcactgtttgaacagcatagagtgtactcaccaaacctagatggcatagcctgctacacgcctagggtgtgtgggatagtctattcttccagggataaacctgtacagcatgctactgaacactaggcaattgtagcacaatggtaagttttgtgtatctaaatgtgtctaaacatagaaaaggtacagtaaaaacacggtattatagtttttgggaccccattttatatttggtccatgaatgactgaaatgttattatgcaacactcatggtgttttctccctagttattcttttttttttttttttttttttttttttttttgaatggagtcttgctctgtcgcccaggctggaatgcagtggcgcgatcttggctcactgcacctccacctcccaggttcaagcaattctcatgcctcagcctccccagtagcagggactcaggtatgtgccaccacaccaactaatttttgtatttttagtagagacggggtttcacctgttggacaggctggtctcaaactcccaacctcaggtgatccacctgccccatgggattcagacgtgagccactgcgcccggcccctagttattctttggatttagtttatgatttctaatgtaatttttaaatgtttcatctaattaaatgatttatctaattaaatttaacaatctttatgttttctgggttgtgagtcatacctataaaagtcctccccacttcaagattattttaaatcccctgcatattcttctagctcttctgtgactacatctatcagaattaattttttgtaaagaatgaggtaggagtccaacttttttaatgtgattctcaagtttttacaatagttgaataatccatcttttccccattgatttaagatgccatatttatcctatactaagtcctgtacatatttagaactacatctggactttccgttccattgttctacttgttcaatccatacaaatatgtttgtagagacagggtttcgccaagttgcccaggctagtcttgaactctgggctcaagcaatccttctgccttggcctcccagggtattgggattataggcgtgagcaccacacccacccctattgttgccattgttctagttgctgtgatagaggaaatgttggaggtggtgtatctgccacctctgtgtcctgtgtcatatccctgggccttccctctgaccagcagcatctgagggtctactcactttgcactgatagtg

SEQ ID NO: 5055 - DNA, 77564 bp, Homo sapiens
catctcatctacttttccttactccttctatgccagccacacttttcttcctgctcctctctaactcaagaggtcggcaaactttttaagggtcagtcagtatttactttctttcagcttttgggcaatgcagtcttcaatgccgtgactcagctctactgttgtactgcaatgccatcacggacaatacgtacatgaatgagcacggctgtattcctatccaacaagctggggacggattggactgcagcctgctgacccctgatctaactcttcagtcacacatctgcctccatcctctgcacctgctgctcccctgacatacacatggctctctccctcacctcctgcaggcttcattcaaatgtcaccctctcaggaagccctgcccaggccacactagcactgccacctgcttttgctcttaacgctcattttggttattgtctgtcacccccaccccccaccgactgaataagggattttgtctgtttttttcaccagcgaattcccagctgccttgtatatagcgacattcaagaaatattaattaattgaataaatcagtcttgttacgaaatttaggaaaagggagccatttcaaaaacaatatcccaaatgtaccctaacacaggataagggtttgcaaatctagaaagcccaggtcaccagattacatcataattagtgatgtcactgttgggaaaatctcagggtatcctctgatgtaggcctttcaggccttgaatccagtgggattgagaacttctaagagtggtgcggctcttgacaacatgtgggctccaccagcagcaatcatgggggagggcccaccaagaaggtgggcaaccaggcccccctgcagacacaggccctccagactgctctttaagggatggcccggcgaagcgggccgtgtgggtccgccatacgagttcagagcccaagaacctactgaatcaaaggcagccaaggagaggcccaagcaggaggtgaccaaagcgtggtcgtggacctgggcactggctactgtaaatgtggctttgccggcctgccaagaccacccacaagatctcaacaacggtgggcaagccctacatggagaccgccaagactggggaaatcgcaaggagacattcgtggggcaggaactcaacaacacaaacgttcatctcaagctgttaaccctctgcgacatggcatcatcgtggactgggatacagtgcaggatatctgggatatctcttccgacaagagatgaagatcgccccggaggagcatgcggtcttggtttcagaccgccactgagcccacacaccaacagagagaaatatgctgaaatgctgtttgaagccttaacacccctgcaatgcacatcgcctaccagtcgcgcctgtccatgtactcctatggaagacctccggcctggtggtggaggtgggccatggcgtgtcctacgtggtccccatctacgaggttatcctttgcccagcatcaccggaaggctggactacgcgggctctgacctgacagctacctgctgggcctgctgaacagtgcggggaacgaattcacccaggaccagatgggcatgtggaggacatcaagaagaaatgctgctttgtggccctggatcccattgaggagaagaagtccctctcagtgagcatacgatccgctacgtgctgccggatgggaaggagattcagcttgccaggaacggttcctctgctcggagatgttcttcaagccatctctcatcaagtccatcagctgggcctccacacccaaaccgtgtcctgccttaacaagtgtgacatcgccctcaacgggacctcatggggaacatcctgctctgcgggggcagcacgatgctcagtggcttcccaaccgtctgcagaaggagctaagcagcatgtgtcccaatgacaccccgcaggtaaacgtctgcctgaaagagacagtgccgtgtggaccggtggctccatcctggcctcacttcagggttccaaccattgtgggtccaccgctttgagtacgaggaacacgggcctttcttcctctaagaaggtgcttctgaacggcgacgaggatggacactgcactggcagtgcctaccctcgaagggtgagcgcactcctacacacagggggtggagccggcgcttattcctgtagcattaacacccctcatatgcccctccacagtgtgtttctctacttcctgacttcataagaaacaattcacacgtgcagcatctgccttaaaatatacatttcccaaaacaaaagcaggagtaggggaggatgaacaaaaaagggcatgcattgtatgtggattgcttaaacattcacttgttcaaaattatgctgccccttattttgtgcattccccgctttaggaactactttacggttaactctgcttggaagggggagtgcaatgaagattagagggtaaatgctgttggggcatatagcagttccctttccataaatgccaataggaagtatgctgtaacagtgcaaactcccacaagcatcagtgtccatttcatacttcatcaacaaccctgagggactggaaagagctggcaagctgtctgagccctgctttaacaggagtttcttttagttccaacagtcatttatgtctagtaccagttcttactaagccatcacagcgactggctgctgaagcctagcatattacaacaaggcatttgtatgtgccttaaagggcaactcttcagagaacaagtgctatacagattcccattttaaaaactgaagtaagactgatcttgggttatcagcagagaggttagggattaggccacagtcattctctagacacttcaagtagtagctgaccatctcccagcaggctggttctccatcagcctagaacacacacggttggagtctggggtgtgctgaggatagaggctctggttctggggctgatgatatgggtctgtgggaggctgccctatgtgggtcattctaacccactggggagcccaaagatacacagagaccctcagtagccagggaagcccttccaggcccagcgagctctctggtgttcctgcagggggagtttgtaatatgagcactttaaattgagattctttagaacagcctccaatacattctctgtcttgtctttaaagttcaaaatctgacactagttggtgcacaaaacagaggatagaacatgggctctggactctgtggtttgaacgcaattttgctaccacctaactgtgacttgagtttgtttgcttgcctgcaaaactgagataaatgcctacctcacacagctgattaaaaaacagcgaaaaatatctgaataccagtactagactcctgggggtcctcacaatagctagctagtatctttaggtttctacctcttatcagaaggccagaagtctcttactatagtccttagccacacaggtactcaaaggcaggcatctgcatttagaggagagctggcacctccaccatctccagggagaagccctccagagctctcactggttccaggcttgcctcgacagccttgaaagacctaaagtgcctgaccctggaccaggtctggtgactaagagtatctggctggcaccagcagaaagagagccacagaggggatgtgaggttcccatggttcagcacggatgactaagccttatgctggactgtcaaggaacaggagttggggacactgacctgagagagagggacatctttacctcagtttctgcccaaccgctctactgtcaacccatgatcattcactgatgcgcaagttgaagtttggttagttctaacctttggacctctttggcaggggtggtaaacccataaacctcttcttagaataatgtattaaatgcataaaataaaatgtatgattacagagaaaacctatcatacagaagtatgtctatctaccgatcccttaggggtaaataaaccccatgtcaaagatccctaaaaaaggcagggtcttaatgaagaggagggttgggaggtggttctggaggatgggcgtctccaggcctcctaggcctcaatgttcatttttaaatgaaaaatgccaactgaaggctgaacaattgtcagtctttttcaaaccactttatgaattttctcacttgatcctcacaagtatgccccagagaaaaagagaatctcctcataaaaaagtgatagttactaagtatttggaacttatcttgcacagtagttctcaagcagggggcaactttggcctgtaggggacatttaacaatgtctaagatatttgtggttgtcataacaggggtgggagtgtgtactactggcatctaggggttgagatgagggaagtcgttaaacatcttacaatgtgcagggaagcacctcccaacacccaagaaagaatgacatgaaccaaaatgacaacagtgccattgagaaactctgcttagcttgtgggcacacacaagactgaaggaaagcaaggctcagtgagattaagtgactttgtccaaactgctaagatggttggacacatggcccaaagccttgttctttcctttataaccaggagacaactgctgttcctaaatgtcctgggactgtagagccagtaagaatagtggtggagcacccactgcaggcacaggcaagggctcagggagcacagagagcacagaaacacgagaatcaaagcaggccttcagcactgccaaatgttaccaaattagctttgtcttatctccagcctgtgaatatgtacagctacctagctcctaagatgtttatttgcacccagttactaataaaacaacaaacaagaaacaacagccaaagactccccagggcttgtccaggcggtgcttctaagaatatgggagtacaataaccagcacaagaggaagaacaaatctaattttgcttctcaatttgcagtcaccttaagttaccaagcttcatcagttttacttatttttaaaaacaccccttcagctattgctatgacaaatctctcaaatgtgtatgtatatatacatgcatatatattaaatttaatttaaaatatgcagcagggctaagaaattgcaccaagctacatccataaggcatataaaaattgctcctaagttttgttttgttttgttttgtttttttgagacagagcttgttcttgtccaggctgatgtacagtggcacgatcttggctcactgcaacctccacctcccaggttcaagtgattctcctgcctcagcctcccaagtagctgggatcacaggtgccaccaccacaccgcctaattttttttctatttttagtaaaggtgagatttcaccatgttgctaggctggtctcaaacacctcagcctcccaaagtgctgggattacaggtgtgatccacgcacccggcctcagttttttcaaaagcataaatttaaaatgcactttgaccgaagaagaagtcttctgcaagttccttcttgaagtttagagcatctgagcaaagctatctgactcaaggaaccaagaaaagtgaaggttttagcttattgcagcatgaacttgctttgggacaggaccaaatttatgtactcttttctaaaacttgacagactctttcccccaaattaagcattctcactcagaggagtttcctccttttctcatacactcaattttcccccatgaatattcaatcttggctttgcctcaatttggaaggtctcctcctgcctgcttcttctaaaaaggaacaaatccaatcctgctcagatgagagaaacagtaattgatagtaatttgcattcaaacaaatatttcttgctgcttcaatacattatttaaggaaactgaatgtccaggaaaattcacacattatcaataaacacatttacttctatttccagtctatcagcatgggtccctttacagtatccaaagcaagagcactatatttcaatataagttaccatgcttatttacccatgccaagagtgattacaaagtacttgcagcctttcaatattgggcacttaattacagcaaacccagtaagtcaaaaagtagatttctccaaagcaaagtatatcttctttctcttctttttaaaactcctatgagattgtgaaaatgttcaaacatacagaaaagttgaattttacagtgaatctcctagattgattctatagttaacatcttgctatactggcaaaggcttcttaaattacattttggctatatcacttctttgaggatcaaaagcagcatttcctgttagtttatgtacgtgctgtagtttaggcatttgtttccctaaacctcatgttgaaatgtgatcaccagtgtggaagtggggcccaatgggaggtgttttggtcacaggggcagatcctacgtgaatcgctgtgccatcctcgtggtaatgagtgagttttcactctattagttcctttgaaagctggttttgttatagagacacaaatgggctaagatacacagtaagaaaggtctggttctgatattaaaacatggaagaatttttaatcagaatgaagtgggcgttttctagactcaccatgaaataaaatattctcattttgagacagttttttttggtgagggcgtggagaattgaataaaggaagtcagtaaagtaccatgacgaaaaataaatgaagtggcctagacactaacaaaaattctgagttaaagaaacagtatttggagaacagagaataattcacaaccatgcatgccatcaatgcacactgatcactcacaccaactgtgcatgatactgtttagaaattctaatctgtctagctctaacattgctaactctctagcagaaaatacacaggcagtaaaacagtcccttagacattgtaattataggaggctcagcccagttataactgaaagcacatgacctggtagatgttacaaaataatagctgtcagcaaaggagggcttataatttcaaaggatacttttattctgctttagtttaaggtgacaagaagctatttaagtgattacatttgaccaaatgtgcactaatagccattgtaatcttctccgccaacaaaataagacaatttagaaacattgtttacttgtcttcacactttggaggtagaaatcatgaaacattaatctcatgattaccatattatgctctcaaacagcccaagtgaaagaacaatcattctcacaaaatggtgccataaggttaaagcttaatgtcttgctaatgatcaagatgtatacacaacataaaataaatagattgcttgttgtctgctgaagttcttggcaatgctaaggtaagttatcattttactctttcagttctcaatagccagccctcaaagagcaaggggtggtaggacaacaggaatgagtggaatggtcttctctgtcggatccctcctaactgcagtcactcagtctagcaggctcagctccactgggttcttctgttgatctttggtggtataaaaagctcagcatctaaaagcaagaaggaagggaaattgtgacagacatactcttgttggagggcgctgaggcagtaactctaactaaacaaactaggcaggtggagtttgcagcaataagaccatcagagccagagttcatggtctgctacccctgcaacctccaggtcagagcaaacacaacctggaggccctgccctgaaggagggactgcatttcaacctcaggcatgctcacccagtgattcaaagtggaagaatgtctgtatttcaaactggtgggaggggtggtggcagcagtcacatggctgtatacatttataaaactcatcaaattgtacacctgaaatctctgcatttcactatatgtaaagtctagccaatttttaaggaatagcaaaatgtgatagcacatattcagtaagtgaagttaatggacggaactactttatgatgaaacttcgacaaacatgttgatcaataaagatgcccctgcttaaaaaaagtgaatggagagagagggttaggaaaagattctgtcattgtaacctaaaactccaggcactctttcacttagatttgttaagtttcttttctaaccaggaatcatatactgaagcagagataggagaaaatatgtatatataaggattttctttttcagcattatttatgtaaacttccagcagtaaatctgtacatatgagccatgcaggcatgaaaaattacagttgtccttgaatgtagggttatgggtgcggacccccctgcacagtcaaaaatctgcatatacttttttttttctttttttgagacagggtctcattttgttgcccaggttggagtgcagtgcacgatcatgactcactgcagcctcgaccccctgggttcaagcgattctcctgcctcagctcccaagtagctgggactacaagtgtacaccaccatacctggctaatttctgtagagaaaggtttcaccatgctgcccaggctactctcaaaactcctggtctcgttccacccacctagcctcccaaagtgctgggattacaggtgtgagccaccacacctggccccatgtttaactctgaatctccaaaactcaagtaccaatagcttactgttgttcggcagtgtattggcagataaaaagtcagttaacaaatgttttgtatgttatatgtattatatactacattcctacataaagtaagctagagaaaagaaaatattaagaaaatcataaagaaaacaatatttactttcattaaatggaagtggatcatcataaaggtcttcatctttgtcatctccacgttgagaggctgaagtagaggaggaagtggaggggttggtcttgctgtctcaggggtggtagagagaaacaggtaggggaggttaaagaggaggcaagagaggtgggcacactcagtgtcactactttacagaaatacaccataatttctgatgtttttgctttttcatttctctaaggtaccatccttccacagtttcttttagtttcagtgcccataacatagaatcatccatgttgtaaagaagccaaaggcagtcttgaataattggaacctttggaacaaatgtcaatttattttcggcactgcttcttttatgtaatcttcctcattgtctggcgctggtttggaagtactcattccatcaagtcatcttctgttaattcctctggtgtgatgtctatcacctcttgaatttcccaagattcctatcttgaaatccttcatgcaccattttttttttttttttttttttttttgccagatccacaatctttttcatgatttccttgattggctgtcgtaaagcctgtgaagcatgcacatctggacacagttttctctagcaggaatttattgtcctgggcttgatggcttcacagctttttctataacaatgatggcatcattgatggtgtaattctttcagactttctgttctgtcaaggttcttttccatacatttgacaatcctttctatagagtactgtttgtacgagccttaaaggtccttatgacaccctgatctagaggctgaattagagatgtgtgttgggggcaagtagatcacttcaatgtcttcggtgttgaactcatggagtttggggtggcccgggcattctccagtatcaaaagaactttaaaaggcagtccccttactggcaagatactcttaacttcagggacaaatcgacaatggaaccaatccagaaaaagtgttctccttgtccagccttcttgttgtatggtacaaccaaaagcctggcagctggtgttaatcttttcccttcaggctcgggggttagcagctttacagataagggcagtcctgatcataaacctgactgctttgctgctgcctcctggatggcaggagctgcttttcctattatccagacatttacaaaccaaacctctttctaaaattatcaaaccatcctttgctggcattaaattctccagctttatccttcatctttttgctttaagttctcatacaatgactgtgctttttctcaaatcatatagttgtataggtatgcctttctcatagcaatcctgcacccacataaaagctgcatcttaatacaacataaaaaggtattttgcaaaaagtacaaggttttcatgcctgctggcataatgcagtgacagcttcataaatttccttttcttttataatagtccttgcactgggttcattatcttgaagtggtgggcaactacagctgcagacctcaatctatagtacatatcgagcagtcaactttttcttgtaatgttatgacttttctctgcttcctgggagcaacacttgtggacttcctataggtctcatggtgttatttaaggtttacgatattacattaaacgtgataaaaatacacgacaatgcaagagatcacttttcgctgccatatgcaattaatggagactctatgtgctgctcatgtggagatggttagcggcacatggcattttaagcagatattggtaaacttgagctcactcaccacaatagcaacaggaggtagctacaaaattattacagtagtgagtacatactacagttaattttatgcagttatgatttaatactacatctttatgtttgttacatttctctccactaaatggtgccataaagatataagaatatcaatactgaaaaaagctacttaaataaattcactatcaacaaggtatttcataaattccaattaaagttggaatagactttatcttaaaaaaactagttacaggccgggcgcggtggctcacgcttgtaatccagcactttgggaggccgaggcgggtggatcacgaggtcaggagatcgagaccatcctggtaacacggtgaaaccccgtctctactaaaaatacaaaaaaattagccgggcgtgatggcggcgcctgtagtcccagctactcaggagggtgaggcaggagaatggcgtgaacccgggagcggagcttgcagtgagccgagattgcgccactgcactcccgcctgggccacagagcaaactctgtctgaaaaaaaaaaaaaaaaaaaaaaaaaaaaaaaaaaactagttacaaaaatatgtgctctatctcattttttaaaattaggcataactacaactatatttgattctagactaacttgaaataaacacaaagtacagacttttgggcaagaaagtaattattctgacaaatatatgacagcaggacatgacatatttcacatttccatatgtggatttcacagcacacaaaaaggccatttttataaaaataacttgagggcttttcaatttttctaaggacctctctaatcctttgatagtcaaaatcatttgaagcacttattttgtcatcaattgcaacaagtcaacccagctgtgattcaagtacttttccaatatcattttaatctattttatgtaatactaatttttgcaagacttgcaattgatctgcatgatattgtattgcatcaaagcaggaaacatcagaaatgacccatcaagtcattgatttcacttgtggggatgtgccaatatacttaatattgttagctggggaggggcagctgagtaatatttgagtggcactaattttgtgattattcatcagtggcaatttttgaattataggaacttaccttttcctatacatccttgaaacacaagggtaatgataataaacactcagataatgaggggctctcaaatattacagagtgttttaaggctcagctggaaaacaagaaagtgctctttgaagtgggaaagccatctagaatccctggggaatgatgggactgacctaacctgaaggtcagcatcaggccagcaacgaggacacaggaggcagaaatcacaactggattggactacagcacaaaataaacaatgaccaaaggcctcaggtctaatgtaagttcctagcatctgggaaataagtgggctgggcacaggggagacgcctgtaatcccagcactttgggaggccgaggcaggaggatcacttgagaccaggggctgagaccagcctgggcaacatattaagaccccatctgtttttttttctaaatgaaaaacttaagaaaaaaaaaggaataagtggatatgtcgaaactgataccaaaagaaccttgcattctctagacagaagaggagctaggaatacagtagttacagtctggatgtatgagttagctgggatggaaggtagctgttcttcctggtagcaacataagctgttaaagtcaaactaatttgaatccccacaggctacttcaaatgtcatcaaaatgctattacagtgtagcactcggtgaaaaaaaatttcagaaagttgcttgtcacatgctagaaatgcaaataatagcagtaaaactgccaattattttagaaactatcattcacttttcaaagctaagatgcttcattatccaactataagtaagggcaaatactgaaagtcccaagctgactcatcaaatgtttctaccaactttcaaaagaaagcgcttagggtttttaatttttagggatataagtaatctaatgagaatcatctcccctcaacaaataaaacacttcatgcataactaaacaggaaatatgataaaatgctaatattctttggatttgccttcaaattatattgtcaatcctaaacataaaaaaaggtcccactcataagcaaggtttatgaaaatgcccccaagatgcaaagcataacgccaatagccagtaatgatgcttcagaagaatcttttgatgtatatgtaaatgtagacatttagactgaaactggaactgtggtgtgcctttatgaacaagcatatgccacataaatattttaaaaattacacatacaatggtcatgctggattttcctgcaccaggtctcccaccgtagaagcatgaaactgatcatactaaagatgcggtcttagaattgaggaagaattgtagcaattttttgtagtgaaaaattgtatccaatctctccttatactgctgatcttctcaatcttacagaaagatagtccttctgcttagtattgtaatattaaatgagaaaaaatactaacaagaacaggaaccgaagtcttctgttgctgataagatgccatgatactatttgcagtaaattgggacctagaacctgaggagaaaatagactgtatcagcaaagattatctaatactctcaagacttccaataccaaaggccaaatccctaccagcagaaaacagcctgtcatttcactggtatggtgtgaaacacagtaattctctttcccaatgtgattttaatttgccagttctccagctgcaactcagacttctaattctcctttctcccagaacaaggtaaagatgggggtggaggaaaagaaaagaaacgaaactctacagtgatatatcttggccttttctaaatggcaaaccactccctgaggaaagggaaaagagtaaaagaggctacaaatacgtagagtataattatacgcaaagagttatgggaaacaaacatttttaggttgaaataaatacaaacattgcatactatggagcagaatggaaactgtgcacatgtgctccaggtaaaacacaagactcgcaggaatttcaagcctgcagcgagcctctgggcacacccctggttagtgcagaccctggtggcacactctcaagagcaatgccatgagaagtcactcacggtatcctgcacatacccaaccatacttcaccaatcaaaaccacaatcataaaattgatgtcttagaacttaatgtggaggcatggtggcttacacctgtaatctcagcactttgggaggccaaggcaggaggatacttgaggccaggagttcaagaccagcttgggcaacacagcaagactccctctccccattctaggaaaaaattttaaaattagctgggcatggtggtgtgcacctgtggtcccaattatcaggagactgcggtgggaggactgctttagcccaggcattcgaggctgcaccaagccagattgatcatactgtcactgcactctagcctgggtgacagagcaagaaaaaaataaaataaatagaccttaatgtgaatatgtgatcagaagagaagatcactcatgggagtggtatttaaattattatcttcaagccgggcacggtggctgatgcctatagtcccagcactttggaaggtgaggtgggcagaccacttgagcccaggagttgttcaagaccagcggggacaacttgtgacaccctgtctctacagaaaatttgaaaattaaccaggtgttgtggcatgcgcctgagtcccagctactcaagaggctgaggtgggaggatcacctgagcccggggcggtggatgtgcagtgagcggtgatcactgcactccagcctgagcaacagagtgagaccctgtctcaaaaacaaaaacaattatcttcaaaagtactacagttttgaagatgatgatcacatttctttaagaaatacctattataataaattcaagaagttctggggccctgattcctagttgctttatttcaacggtttgtaaagtgcttttacacacaccctcttatttaaccttcaaagcatctattgaagcacacagagaagtcttatgcccatttctaaatgaggaaatcaagacatgaaagcgtatgtgtttctaaacactgagctgatttgtaatctctcagctccaacccaccctctatccactgcttgtggtgctggggctgggcacctgaaagatattcttccttgctgctgcttcccatcatgtcctgcctacagtgaacaccagagggggagtacaaagctggaggatgacaaaagatttctagatttcttccgtgattggctggcttttttttttttttttttaaacgagattcgctcttgctgcccaggttggagtacaatggcacgatcttggctcatcacaactctgtctcccaggttcaagcgattctcttgcctcagcctcctgagtagctgggattacagcatgcgccaccatgcccgggtaattttgtatttttagtagagacggggcttctccatgtggccacattagtcatgaactcctgacttcaggtgatccgcctgccttggcctcccaaatgctgggattacaggcgtgagccaccaccacacctggcccgaccggctggcttttccccagcagcagctgttccttccagtttccatttacttctgtacgcttggaaccagctccctcgaaatgccaggattagctggctggcaccctcctctcagaggttcaagagccagctctacgggccccacttccaggcttctaaattctaataatccccaacaactcctcctgttccctcgctagagggtaaagctgcttcctacagttactatctcaatgtccttcctctgtatttccttttgccttgtttagtcctctaatacttatttaacaaatccatatattaaattctgtgaaaaataatagataggcttttgttttcctttctagatcttgactgatacaccagccttttgaatccaaataaaaactcttaacaatagacttgaagtataagagagtgaacagaggtataataataaacagatgacaatatactagaattctgcgatacaaagctgattcagccttaacacaacccgcaaagtccatcataacaacatagaagtgacaagtcaaatttttcataaaaaaaaggaaaagcaattacctggggtccctttaaagcctgatcccatccctgagttctgaaggaaagtgagaggccgtctctgaccccatcttcccccatctctccccactccaacctcttgaaggccaggagcaatcatgtgactttcccattttctccatgacagctacttcatccgaaaggaaaatgacagtccatttaacctatgccaaggtatactagtcactctacaggcaatatcaaatcttactgacagcttacacataaatctaagataatttaactatggcatctttgttttaagaacaggaaaactttttgacttggagattgtgtgaatacaataacccatgaaatgatgaaaaaaatgcacaccgtctctgagaaaacttaccggggtagctgaattctgcggtaagtaagagtccaaatttctggaagtgacctttccatcaactgcagcgtatcttcaaggccttctgtaattcccttccttgttcatcaaactcaaagagaaagagtacctttaaatatggtatacttcatctagagagaagaaatttgaaagagtggtaagttatattcccagcccattgacagaatcatacatagcttctatccaaagccaaaaatttctatgatcccactgaggtcctttctcccacattatcttttttcttcccaaatgctggaataattaaacacatgactacaaaaagaaaatcaagcacgctggggggcctacgcagaaagcagtgtcccacaatctttatcctggcctaagcatctctcccagttcagttagggggatgccaaatggaggaagcttctcagttaccagctaagaagggctgcttcaggaatgtgtgcagacatgacccttccgctaaaagttctcatctttcctcaaattgggaaaatggtagcttaatcacctactgaacctgcctgtctgtactgcctattcactattgtttgtggtcaggaatcatcatcaggactggaatatacctttcaggttttcagtgttctgcaccacttcactcagtgcctccaggagggcaggtcctccagcggactgccttctttgaggctgtgcttcttccgctccgcttttcggcattcttggatgatctcctgttagaaattacacagatatttttaagcctcctgagtagctggactacaggcatgtgctaccttgcctggctactttcttgcagttgctgatgaccccaccaacttcacagatctccattttaaattcctaaagcaaaattcagtttgaatatataatctgcattgctttacacatcccaagcaagactataaactcttataactcatatctccttatagtttttggtaacatctactgcacctaccatatgagtgctgaataaatatttctgacaattactatatttggtaaaagtgttatgacttattttacatttatggtctcttccaatcctattttgaattgaagaagcttatcttttcattttttcagtgcctataatttagtcacaactttgttcaaaaaataaaatcagatgttaatataaactgagcattcaggggaggaactgctcgtggggaatgggaaaacacacaagccacaaggctgaggaagaaaaccttccaatgccagtttaatgtctcagatatgctgggaaagtgtctgaacaacttccacacagcgctgaagatattctccccactcccactacaccgtcccagtagaaaaccaatctatttgcttccacttccctatatgcccaggatatagtcaatgtgctgaatcaatgtgatacgtacgctgatatctggagttactatgggagtatttgccactcatctcactgccactcacgacactgctagttcagagaagaggtctgactcttgcccgtggggtacctcatcatctagaaaagaagaaccgaagccgatgaaaacactgcctgctaatgtgtgggtttactttcagggcggtaaatgaataactagagtcaactggtgcatatcaaaggatggatgaaaatgattgcaaagttgatctaaaatgaatgagataatattaaatacagtaattactaatgtaaatcagtagtttcctgacttttttctggaaatgaggaaactcattttgttagacacggaagtggtcagctgctctggtgaatgggggtaggtgggaatgtctggcagagctctccccattcatgcttggtcctgccttcaccaacacacaaacacagacacagagggccctgaaggggctccacagaagcctcaacttgcccatggcacagtaatcagattgcaggcggatcaccaagcaatctagacaatgttggcgttacccaaccccactgcccccgcacgtcgatggccttcacgcagatactcacccgacctgcctgctgggcttgctccttgagctctcgaactaccaataaacgtttcttgtgggactgaatgtggctgtctgagagtccagaaatgccatataatttttctgggctggagatcagaatggaaaatagtttgagcatgaggtttaagcaaagagaaaaaactaaaggcgggggcagtgaaggagggttaaaattcagcaaaaagaaagaggttactaggttttccaagcgactctttttccttaataagcattaacaaattagagactgagattccagatcttagagttctcaacattatcccagaatatgcgctaccactgaacttgtaaaatcacctgaacgaagactgatacctaaagcaagggaggattggcaaaacaaacaaacaaacaaaacaaacaaacaaaaaagggggggtaggggaggggagctcagttaacaaaaataagaagaaaattacctaaagtttctggctaaacatccatcaaaatgcccatggatgtggaaaaaatgtatctaataaaattgtccaatggaaaaatacacaagagaaaaataacactagtagaatacattttaaaaagcaaaatactactatccaaggatgcattttattaataggttttgggcctatgtagatgattatcggcatttatctaagaaaggttctcattagtggtgaaaatctaagtaagagctggtagattattatagatgaggaatgatgttttcagtacccagttagaggtacctaaagtgatgacataaaaagtaccccagcaacgttttaattaggatggaggaagggggtgcagacaagtaagaatgtgcatacatgtaaatgtcagaaaggccagacgttacttacagggtagatggcataaaaatgcagaacttaaaatcaaccactccctaaggtttctataagtcaaactgagtccttctccactttgcttttaagaggtcacagtgaccatctgagtattctagaactggaatattcatatgttctctaagaaccacaaacttcatttgaaaaggtaacttttaaaaaaactttgaaacgttgaaacctacataaaagttgtaagagttcaatgaacacacatataccttcactttgatttaccaattactaacattttgacatttttttgcttcctgtttctctgctgcatacacacattcattaatacttttgtggaaccttttaagagtaaggcagagatatgtccttcattcctaaatatttcagcatttatctcttgagaataataggatattatcttattaaccacaacatgattattaaatgccagaaatttatcagtgttatattattatctaataagttcatattcaagtttactatttccaaatacaaagattcttaatcatatttgatcacagtttctaacatttaaatattttgttaccatttaatagttcagcatatttaaaaattctatgagaattaaatattatatccaggtggtaattttgattgagtctacatgacatattattagaaaacacagtaaataggaggagactctctcatctctctctcctcaccttcttccaaagaggaattctatctaaaatggaaccctcaccttctaaaatggaaggctttacgttggttctataatatccagtctgttatatttgtatacctagaaggaaaaacacaataattttaggaggaaaacttctagtcactggagagttaagatacttagaaagacatggattactttcagggtaatcagaatattttcctgaaaaacaggcctcctacaaggcagccaaggaaattcaatcatttcagtaaaagacagtaatatttcaaattattatcaagaatgataaaaatgatttaaaaacaccgcttttccttaagccaggaacctgacctatttctacttatttcatgaacccagaagacaagagattccaactgacctggaatcccttgcttgctctctctgcttagcaccaacatccagaggatttacaagattcttaccagcctcaaagcttcttcccaggcagctcttctaacagcaagagcacagcttcttcataatcctgacaagggaacaggaagaagacaaaagtgaagagagcatgtcagatgtcatcacagccaactacaaaactaaccacagacctgctctatctccctggccaggggagaactcctagttctcaacatcatgcctatcctagagtcatgactccataaatattgatacaaaagacaaggaaggggtgtaaatcctgaaaataatacaaaacacaaggtaagcatcatctctctgcacgcctggacatcaaaaccaccagaaactctgttagacatgcccatctccccagctttactaccaagtttgatttagcaggtttagggggctccagaattgttaacaagaccaccctttgaaaaaatagtagactagaatagcaatttctaaatttttttttgttcttttttttttttttttctcagacagggtctcactctgtccccaggctgggatgcagtggcataatcacagctcacggcagccttgactgcctggccccagtgatcctcctgcctcggtctcccatgtagctgggactacaggaatatgccaccacaccagctaattaaaaaaatgtttttagacagggtctcactatgttgtccaggttggtcttgactcctagcctcaagcaatcctcctgtctcaatctgccaagcagctgggtttacaggcgttgctcatttcaaaattgatttaactggctttctgttgttgagctgcaggagttccttaatattctggatattaaacctttatcagatataggatttgcaaatatcttcttccattcttatgctgtcttttcacattcttgacaatgtccttgatacacaaaagttcttaatttttataaatccaatttatcaatttattgattgtgtttttggtattaattctaaccatccattgcaaatccaaagtcatgaagatttagccctgttttcttctaagagttttatagtttcgtttggttttgagacagggtcttgttctgttgtccaggctgaagtgcagtggcgtgaactcactcactgcagtctcaaacttacaggctcaggaaatcctgccaccttggcctcccaagaattgggactacaggtgcacaccgccatgcctggctaattgtgtttttattttttgtagaacaaggtctttctatgttacccaggctggtctcaaacccctgggctcaagtgattgtccccctcagcttctcaaagtgctggaatcacaggcatgaacctctgtgcccagccttcaagattttacagttttagctcttaaatttttgttgatccactttgagtggccagcagtttttgaaactcggaaaatactgaatcttttggaaaaaaaaaaaaaagaataaacatgaaaggtcttaaaaaatttccttaaacaatcattgatcacttaaagcaaaagcaataacaaagtatttggagtgaatactcttgtaaggtttttacactatatatgaagtagtatacgattatctgagatatggtcagttaatgatatttattataaatcctacagcaaccactaaaatactgaatgaagaagtatagctaataagccaacagtggaggtaaaatggaattatgaaaaatactaatccaaaggaaagcaaaaaaagaaaaaaacaagaaacaaaggatcaatgaaacaaacaaaagcaaacagcaagactgtaggtttaaatctaactatattggtaatcacattcaatgcaatgtctaaaccctccaattaaaagacagagattgtcaaattagatttaaaaaaaaaaaaaaccaataatgctatcaacaaggaacgcactttcaaaataaagactacattcagctagataaaagtaaaaggatagaaaaagatatgcaatgaaaagactaaccaagagaaagctggagaattatattaataacattaaagtcaaattcagaattaggaatagtaacagagaaagaagatatcaaaatgaatacatctataacatactcataaacatgtatgcacctataacagagttcaaaatacattaagcaaacactggtagaatcaaaggagaaatagacaaatactgggaacttcaacactttcccagtcattgatagagcaagtagtgaggaaatcaataaggatataaaagctagaacagcatgatcaacctaatctaactgacatttatagaacactccatccaaaatagtagctttcatattattttcaaatacacacacaacattctgtaaaacagaccatatataaattaaaataaattataaatttaaattaataaaatgtatgttctctaatcacaacaaattaaagtagaaattaataacaaaaagatggctggcaaatctccaatatctgcaagtaaacatacttctaaataagccaaggttcaataaagaaatcacaagggaaattaggaaataaaacaaaacatttcaaaatttgtataacataactaaaacggtgcttgaggaaaattatgcattatatgcttaaactataaagtaaggaatcatctcaaatcaatagctttaagccataccttggtcaggcacagtggcttacacatggaatcccagcactttgggaggcagaggtgagggatcacttgaggccaggagtttcagaccagcgtgggcaactagtaacaccccatcttacaaaaaaaattaaaaattagccaggcatggtggcatgcacctgtaatcccaactacttggaggctgaggggggaggacagcttgaatgtaggagtttgagactgcagtgaaccatgtcgtgccactgcactccagcctgagcaagagtgggaccctgtttctttaaaaaaacaacacaacaaaagaaaaaaataagaaaaaaataaaagtaagccatcaccttaagaaactagaaaataaagagcaaataaaataataaaataataaaaaaagaatgatatagaatacagaaaatcatagagaaaaacaatgaaacagttcattctttaataagatcaataaaattgataaactctggccagaataatcagaaaaaagaagacacatcaatatctagaatgaaagacaggaatcaccatagaccctacggacagtaaaataagagaatactataaacacttcataccaataatctgacaatttagatgaaatgaacaaattacttgaaagacataaactaccaatgctcttccagaagacacagataaacttgaataggttaatgtctactaaagtaactgaactaatgtgaaaaactttcattaaagaaaactcctggccgagatggccttactggtatattctacaaacatttaaagaaaaaaatatctcccaagagctgggagaaagagctgagctgtcaggtttggagtagctgatcaaagcaacaagtcaaaaatgaattaagccttcaggcattgcattgtataagcaagaggctaaaaccagggaaagcaccaactctctctgttccattttttcccaggaacaactcactagtcaagagtcagctggatccacacagacatgagggttggttcacgttgaaggagcttggaaaaaaaggctttagcagtttgatggatcttgggggtatgggtgaaaggaagggggctaagggtggaaaagtactgggtagtgagtcacagtggaaaaaaatgcaaggtttttccactccttcttgcataaacaggccttggcagaggtgcctgaagaagacttggcccatggcctcagatagagagacctaagaatgaaagtgccaggactctcaatgcaatactgttacaagagcatgactaacagggggccctgagtccttgactgcaactccctttgaaactgtaatgcattggcagtacgccaagtctggtgtagggagggcagcttttccccagtggcctcctaggtaaagtctgtaattgtttatggtcaggtctgaaacatcacacatagtttttaaccataagctagactctcataccaattctacatgaaatcctccagaaaacagagtgtaaaggacaccacccctcatttttgtcacccctcaatgacagcagcattatcctgaacccaaaacatggcaaagacacgaaaaaactacaatatccctcatgaacacaaacacaaaatcctcaagaaaattttagtagatctaatctgccacaagagaaaaagggtaataaatcataataccaagtggggttgaacccagagatgcaaggttggtttaacagtagaaaatcaacacctagtcccccatatcactcgtctaaaaacaaaacccttcatagttgaaaatgcattgacaaaatttaacacccattcatgatacaaactctcagaacaaggaacagaagggaattcctcaaaccaagagggcaggaattggcaaatttttcctgtaaaagattagacagtaaattaggccttatgggccaaactatctgtgtcacaactctaactctgctgctgtagtgttaagcagccatacacaagatgtaaactaatgagcatggctatgctccaataaagctttatttcaaaaacaggtggcatgctggatttgtcacaggttgtagtttgccaactctgcaatagaagcattaaaaaaaaaaaaaaaagcaaatatcaggccaggcacggaggctcatgcctgtatcccagcactttgggaggctgagacaggcgaattgcttgaatccaacagttcaagaccacctgggcaacatggcaaaaccccatccctacaaaaaatacaaaaattagccaggcatggggcatgttcctgcagtcccagctactcaggaggctgaggtgggaggatcgcttgagcctggaggtcaaggttgtagtgagctgagatcacaccactgcactccagcctgggtgacagacaagactctgtctcaaaaataaaataatatagaataaaattttaaaaaagcaaacatgaacttaatgctaaaagacaagtgaattttctccaatatcaggaaaaaggcaaggatgttcctcttaacacttctattcaacaccacactggaagccctagaaaatgcaatacagatagaaaaagtattgattgtaagaaagacataaaactatatttatagaaaccatgtttgttgattagaaaatcctagagaatacacccaagagcttctagaactaataaatgagtttagcaagttgcaggatacaaggtcaattatacagcctccctgcaaaacacttcagctatatttctaatactagtaataaaacattagaaaatgaaattaaaaactagtcaagccttgagatgacttagccctggccaataccttaattgcagccttgtaaaggaccctgagccagaggccccagtaagcccagccaagattcttggcccattgaaaaagtgggataatagggtctgttgttttagctgccagcttttaaggtaagttgttacgtagcaatagataatacatctagtgtcacataatacacccagtgttggtgagtataggagtcactgaagcactctcacatatcactgagggaatgcaaaatgatacggccactgcagattagttctgcagcttcctaaaaagttaaactccacttaccacgggatgtggcattcctactcctgtccccataaagacctgcactagaagttcatggctgcgttattcataataaccccaaactgaaaacaatccaaatgtacatcaatggtaaatcaacaaattctgacatatacatataatgggatactattcagcaatacaaagaataaactacaacatggatgcatctccaatgcactatgtgagtgaaaggagccagattaaaagactacataccatatggttctgtttatatgaaattctagataatgtgaaactttacgactgatcagtttgccaaaggctggcagtggagggagaaggctgactgcaaaaggggaatagggaacttttgggggtgttagaaatgttctagatcatgagtgcaatggtggttacacgctacaaacatatgtccaaatgtactgaattcttcatctaaaattggtgaattagctttttatatgtaaattatacaactgtacaacacataattttattgtatgtaaattacacaaataattttatgcattaatcttcctttacaaagaaaaaaagataatgacatcttatccattaattaaccctcgatgtggtatatctttccaacccaacctatctacccttttaggtatgttcattcactggtattttcaattcaatcacccaacaaatattctctccaggatctaattaataaaattttagttatcgtctttcacttactgttattacacaagagacaattaaatattttaaagcacaattaagttacataaatgtgctatcagtaacaactgtaaaaaacactctccatcaaaggtcaaaactctacaaggcaataatccctggtgtcaactgtgcacctgtgtatgttagtctgtggccagtgttactgcagttttattattttcataataaatcctataatataccaaatgctcatatgggtacttatccttataatctgctgtacctccaggtccctgagtaaaagagacatttccaatagggagaatgagagtaaaagccaagagtatgtagccttcatgatcctgttttataatggtcctttctcattgtttctactttggcaaactcaattttaaaagcacagctaccttgagatgtaattaagtactttctaccaaggtcaaaccagtggtatttaaagtagagcaccttcatattctacctcaccaaacttagagatgtactaaatttagattccaagtcaagccagcaagataagacctctggggcaaacactatctctggacttaacattatgcacagttcctttaactttcatgatcactaagatacaattgagaagacctttcttctgactggggggtttagaagggaggaattgagtttacctgggcacactcttccaaaacctggccgcatcaatgtgcttcctctgctcaaccagctttcctgtagagacaataagcagcgttgactacaaagttaaacagatactttagctcaagtgcttctttaatatgtctttatttgtatgaaactatgtactttctgaatttctgtgagggaataggtatatacaccacagagcctatcttaaatggcagctagaatctaaatttagcacaggaattgaaaatcatatacagcaaaattagccttgaaagatgcttccaaagcatgtatatgggaaaatgacctggtatcttcactaaaccacttcgtcccttaacagtaagagaccactatttctttggttgagcactaatggaggtagctgacttatgtttgagtcatgcagtgtctttagatcctagaatcactctagcccaattgagataaaccacaatgagaggcacagagaacccaaggctttcgaaggagcggtagattccggtctctcattgcatgctcactccagtgcatatatcactaaaaaaagtagtaaaatcacctccactatttaaatagttacctttcttttgctctcttgtgtaaactgctacgttaaatgtacacacagagtgactccagtgtgtaacatttctcaaacatctttgacactgccctccccacctacttttgctaaacatctgagaaaaactagaaatactccctcatagacatgggaaatagcaagctaagagctgtaaagaatagaagagatccaagaacagagaagaaggtataaacaaccaatatcataaatttctaaagcagaaaggaacaatggagaccgacgaataactaaaaggcctgaaataaggaattctcgacatttgtaaaaagaggccagcaggaaacggagggatttgggaaaggctaataaccagaaaaagaaaagtgataatcccataactggtataatcccaagaaaaaaagaatactgcaaatgacaaagaaggactggtacataatttaacaaaatttaacaggatagagtttggaatttttttaggactgctttttattttttctttgagatctcaacaatatttacaagttagggaaaaaaatataccagtcattgctttcttcaagcactgctgagatgaccagagcttctgctcatctcttttcataggtgtccttacctttcctccactctggtactagagcccctggtaccagcctcgcctctggttcgggcaaccttgtccctgacgcagctaaactgcctttgctttcagaatgcttcgacatttggcctttattttccccacctcattcctggctattccaacaacctactgtctataacagaatggaccatccaaaaattcatctttaccttcttacagggcacagcccatccagctacatggcgtgccgagatggaatagaaggtgatagtttaacttccatccaggtcatttccaacttaaaggaaatgttttaccatgattctaacttctccccactctccttccttccccacagctgtggaataacccagctacaaccatctgcctaaaaggttgcagagccacacaacggaagggcctaaaatccctatgggagagagaaataaacttctttccatattgggccactgcattctgggatcttgctgtagtagcttatcctttaaagcattctaaattaatttttatcagtgagaacagactgtctcagagtattctgccctaaatttatttgcaaaattaccaaacaaaagaaataattttttaaaacctttgtagatgtaaacatataaatgattgtacttacctgccagagtttgccgaggcccaccagctggtctttggtaaagttaagctgggctgccacacagagggctgcttccagttgccacatgtcagaaaggctgagagagctttctcgtgggcaccgcaacggcaaacatgagccccgctggctcatacatgtgctcctgcatcaggtgctccccataagcatgctgatatcctgtgacaagaggagatttaggactgaggaggaaatatgacaatcattttctaaagctccagtgtagctgccttagttcctatacttggaactcccttgaaagaattactgggaaaatcttacagttgatcagttagtacagtcattttttcattcaaaaccttactaggatgtgccatttattcactcaacaaataattactcttaactacatatgcaccattctggcagtatggatactacagcaaggcaaaaaataaaaccaaacaaatgaaaaaccatatagaaccaccaccaagttgctgctcttatagtaacagaggatggacttagggacaaaatatgtctatagcataatggcaaacgtgagtaaagggacagaggacagtctccttgcagctctagggagtgtgagctctaatggctgtcaggagaataaaccacgtgatgagatagggggcacaggcagagggcacagaaggcaccatggccatgcagcaggaatgtgtatagcaggtctgggagtaacaggacggccagtgtgactagagcagagagagtgtggaagagaacagaaaacagggcaaagaggtagccactggccaaatcctcgattctccaggctggatgttagccagaattcagagaggaatacaacatggagtccctgcccttaaggagcccacagcctggtggagcgacaaaccagctaatcagcagtttgacaaatgcaatcaccaaggcgagggcaggctgcctgggggctcagtgtttggcgcctggtccaggaatggcattcaggagtaacccaagggtctgatggacaaatggggctaaaggaaggctggtgggtagagaaatgacagaggaatcaccgatgtgacatctgtagaactacctacaagtaactgggaatgtggacagtggcagaagcggtgctaaagaagctggcaggggcttgatcaaagaaagatgtgtatattgtctgaggacaactgaaaatggtgatgctggtggcatggtagagtggtggttaatggcatgggcagggtgtcaggcagcctgggctctgtatcccaggtccagcactttgtagctctggatcctcaggaagttgcttcctcatctacaaattgtgtacagcaccctatgaggctgttaagaggatcaataacacatttaacttagaagcaaagtgtgtggtatataaaaaaagctaaagggatgcttttcaagcaaacaaaaatttccctttatgctgaaatatatgggaaagatctgtacttgtaggataatcagacttacagcagtaaggttgggctagaggaggggtgggaaagaagcaggaaccccacgaggaaggtgctgtggtattccagatgaggaatcagagaacaggtcaggacattctcccagataagaagttcaaattgaggctaattagttttaagataaattttgaagcaaggatggtgttatgaacttaggatcctcactcctttcctactaaagcaaaaagcaaaacaggagagcctcattttcacataccacatacctggtactgttgtgagcttggtgaatatacttcagagcttcgttatacaagtttttatcttttatcaagtttaagcattctgggaagactcaggtcctgcaggaaaaagattcacacaaagacaggcttaagacatgggaagcatatggacttcatttataccaatggtcaccaaacaaaataaatgaggaactttttaagacctaataatcagagaatctgaagaatgggatcctggaatttgaatttttaatgagcaccactcagattctgaggcaagagcagcactgattgggatcagcatcctacttaagagtcccagcttccagcccagtgttttctcagcctccttgaaaagacatcacctgggaagcttattagaacatgcacgcctcagtcctatcccagaccacctgaatcagattctccaaggatgccagcgctgaaggcttaacatgcaccccaggtgattcttcctttcccccatcagtcctcagtaagaatcacaactgttccagcatgggaagaacaactggcaccccatcactgtcaattaaaatgcgtcttgcagggcacggggaggtggcctcatcactctctccagacaagcagagtttcctgacatgtctgcaaacagcatgagaaggaagaactgtcaaccaattttgattctgagaactgaagttaacttcacaggtgctcattcttaaccaaaaaaggatctacttgacgttctacctagggagctcctccagttcattaaaagtgattaccttcagcttttcagaacacaggcaaaataacgtgagcatacataattgttagagttttcaggagtgggaagtgaaatcagtactgtctaaactaacagtttaatttataccttgcctagttccaaagaagatctgaagtaagataaacatactaatccccacacttaccacatttgctgaggtggccaatggctttttctatcgtttcaagtatttgtctatagtaaaccgctgataattagtttccattttcttaaggtattaagaaatggaagatattctttgggatcctaaaaaaatgattaatgagaactttatacttgtgatattcatatataggaatagaaactagcatttacatatagcaataaacccaagctacataatttttaaatgtgtattatatattaactgcatattatataatatataaaacaaactacagttgtcccccagtatctatggggaattggttccaggacaccccaaggatacaaaatccaagcataccccagtcctacatttgaccccatggagcctggatacacaaaatttggccctctgtatctgcaagtttcaaatcctgcaaatattgtacttttgatccacactattgtggatgcagaagccgtggacacaaagggccaactgtgtttgagagagatccacattagataaacccacacagttcaaactcgcacagttgaaactcacgttgtgcaagggtcagtgaacatcaaacaagctttggcaaaaatgctttcacatacggatattaataagttacactggaataatagtaacttccttaactaagtctcacagtatcatttatttcataggctaatagggaaataaggtttcagtctagaagatattcaacaaatgcatctaagtttctcctaaagtctaagacattgctcttggtgctgttttcatgacattccatgctctcctgaaatgatccattaaaacaaacataaaattatactgagttggacacaaaactctgagaccctgccaactagtatttattggcactatcatctccagctctatgccatgccctgtaagcaaattgttttcttcctaatggagaggtgtttcctgtttttaatgcaatttccctgggctgacaggataatacatgtaagaacaacataggaagaaaacccaagacaacaaataattaagtgctcattccagcactctgggaggccgaggcagatggattgcttcagctcacaagtttgagaccagctgggcaacatggcgaaaccccgtctcaacaaaaaaaattcaaaacttagccaggcatggggtgcacgcctgtaagctgaggtgagattgcttgagcctaggaggcgtaggttgcagtggccaagatggtgccactgcactccagcccgggtgatagagcccgaccttgtctcaaaaaaaataaataaataccgcactctagataaagacacactgtagtctgcaggggtaggcacttgtgcaacagaagcatataggagggtcacctcacccagtccctggagggaagcatgaatgcttactgggaagaggccaccttggcatcctttaacctagattagtgagaattagccagggaatggtgagggtggaagcagtcaaagcccatggatggcagaagtaatgctgcccaccaggcatgtggtggtgaggggcaagggaagggggacaaaagcattgtctttcctccatggcagaggaaaaaaagacaataccaagaagtgagaatggaaagatacacagaggccaggtcaggaagggtttttaagcagtattatggcttctgaattatatcctcggaacaatgggagccatgaagtattttaagcagagagatgaaggatccgattttcatttttggagaggtcatgggaagagactgaggctgcaaaaaaataaataaaaaatatgcataccagtggtgttcaaatttttgatcatagcaaatgtaccaacataggaaaggaggccatgagccttctgtgctcctgtgcccaccctccactagaaaaaagagccatgtgagaaagaaccggagtggaacatgaccacttgttacatttcctttataagagaagaaattagctcacacatatgcccatcatctaaaaataaccatgtaattttaggccgcacatggtggcccacacctgtaattccagcacttgggagactgaggtaggcggatcacgaggtcaggagatggagaccatcctggctaacacgtgaaaccctgtctctactaaaaatacaaaaaattagccgggcgtggtgatgggcaccttagtcccagctactagagaggctgaggcaggagaatggcgtgaacacgggaggtggaactgcagtaagccgagatcgcaccactgcactccagcctgggcgactgagtgagactccgttcaaaaaaaaagaaacaaaaaaaagccatgcaattttacttcacttcttcaacctcacatcaaaacactttcataagcacaggggcttaggaatgtgggccctagaaactcacagatcgtctccagccctgcactcacagagtgatagcagaaaagctactgcactaccagaagcaggtttcacactatcattatataaacaagaaccaaatggcataaaagtaagaactccacatccttctgtgacttctcagctaccatgaggaccaaatcaaagtcataggtgccaagagaagatcatataattcattaacatctaccagatgcagcaaatatttcaaggcctcttcagcatcacagcatcaggatcagagggagcatttcctaacagtgtttagaaaacaaaacagaaccaatcatttggggaaaaaatccacagacctaacaacataaccaaaaagacaataaattttctcaatagaactggacatcagaagaatatatacttctgatacttttatatatgctttaagggcagcactgaaaaaaactgacaagggtcttaaaatggcaactaaaaagtcacatgtaaatctgtggtgtggcaatgacatggtgattgtcacctgcagaagactagtagcagtcaggccaccttaagcactttctctgtgagcggatctctaccttgaagctcgtgtactttttcagtacaatttccagttctggggttgtcttctttacatgagatgtaagtatggataggcgtatctgaggtaataagtgaagaacaccagaatgagaaaggtaagtaggctggacaaggcaactacacacttcggtttttcaaaggatgccacctggtgacagcatacatacttatgagatttatgctctccatgactgctctcatagcatcgcagacaaggtctattttattcccgcaggatccctggacaggtagacactgctggtaactggtgcagggtacatggtcttcgtgcatcttcttctctaagaacaggtgtgtatggaatggtcatcaacagaacatgtagcccacgatcaaattactaacatacacctggcatgctgatgatgataaataaaaatgacttttgaaaagagttgaattataaaaatattgagaaataaaacatgtccacaaaagacttatacaatgtttgtagatgttttagtcacattagccccaaacagggtagtacaatccacatgtccgcaacaggggaatgaataagcaaatagtggtgtatttacacaacggcatactactgaccataaaaaaagaatgaactagtgatacatataaaaacacagatgaatctcaagacaatatctgaatgaaaacagctttatgcagaagagtaatactgtatgcttccatttaggtgaagtcttgaacaggcaaaactgatttatggtaaaaaattcagaagagtagttgcctggggaatggacagggactgattgaaaggaatctgaagcagctttctgaaaaggagtaaatgccctcaacttgacagaggttcaggttacatgaagtgtacatttgccaaaactcactaagtggcaacttaagatttggacatttcactgtagataaatatgacctgaaaaaacacaacaaaaccacccatacacaaagaatgccctctagttaatgatatacaaggagaagtacaggtggtaggtggactgatgtctacaactcacttagcaatttgtctacaaacaagatgaatgatggatgacagattatagagaatgagaatgtgtatacagaaaaatataaactggcgaatccaggtgggtatatataggttgcttactggacaattctctcaacttttctctattttgaaagtgttcattaaaaagttgaggggaaagatcatcagagagaaagatgccatttgatttcagtctctaggaaaaacaagtagttttatatgtatacctaaaaatcaagtgaaataataattctgatgacatgttttaaggacatagttttaaacaggctgttttaaaaagaacggaaaagagcaaaaaccaactggcatctaagagttatagcaatttttaaaaatgaacagtaaggaattttcttctctagctatttatgcttgatttccttaacaagaagagagaaaactatggaaaagtacacatgaattattcaaaatacttacttcaattctgtaaaaaacaagttaatatgattacagaatctatctgtttaatgaaggtttccacatttccaagaaacacctaccaaaaaaagacaaaacatcttcgttcagatcatattagtttaagtacaaagtaagctagagtaaatgcagcttagaaagttaccttagggttatgatcataaatcagattgagattgattctcagcttctcatgcattcaaatgcctctttaaacataagtctgtgagaagacagagaaagaataaaaagatattcacaaaaactgagctccatgggcccagcatattttcattatgatacaaacagttataatcagattacagccccaatgccaagctgctatcactggatttctactctgaattacagaataaaaaaatcaggtaccacattcatttaccttcttaaaaggtgtaatttatcatcatgactgtctgagaactacatcttcacatacatacaacagaaaatcattacagagcccgggcacggtggttcacacctgtaatcctagcactttgggaggccgaggtgggcagacacttgaggtcaggagtttgagaccagcctggccaacatggtgaaaccctgtctctacgaaaatacaaaaaaaaaaattagccaggcgtggtgcacacctgtaatcctagctatgcggaggctgaagtgggaggattgcttgaacccagaaggcagaggttgcagtaagccgagatgcgccactgtactccagcctgggtgacagagcaagactctgtctcaaaaaaaaaacaaaaaaatcatcatggaattcaggtctactttttaaacaaaacattagtatagatctttccatacaaagtttcctccaaataggttcagaaaatcagtcatttccttcacaagagtagctcggcttttctgggtcataggccccgctgtaaatctattgaaagctgtgggctttctacttaataaatacacaaagacaaggtttggtgtgtacaatctccctgggttcacaggccacctaaacccacatgtgttccctcaggttaagagaagccctcctttatatgatgagtgtcacgttctttctgctaggaatctccactacaaaatactgcattaaagtaaaaaagttaaaaaaaaaaaaagagcctctaagaatctgattgatgatataggtaatgagggcttttcataatttaagttctcgaaattgtaataaaatacttattgtcttcacacataaatcacaagctaacagtcgcaaacagtacaatggcacttacttgtccaaccacttccgaatctgagctaaaacagggctcgatgatgaacaacttctaagtttccccttggcatcttaaataaattaaagcataacatttttaattaagtagaaaacatttaaatagccaggatacaccattttacctaaccttcacagagaattaccacaactctctaaaatcagcacacttttagcagaatcttgttgtctctatatttatcttgactttcaagaaaagtttcgctttgagccttatggtcacagccgtatcaacactcctttgaataaagctaacagaaaactatcaaggaaaggtttacaataacgatacaaagaataagaaagcctaaaatacaacctgcaagaattatgcttggtacttggtgaatgacaatcagactatctatcttgtctgaaaaaccagcttacctgtaatacaagcttgtgtcctggggcacaacagtgacaatccgtgaacccctctccactttccgcagaacttcccatgggacacatgattgctgctcaggccggcctgtaatgctaaacacaccattaactataagccttaattatcacaacaagccactctccattaactgcaattgaaaccgcacacatatgtgaaatagaagagaacaaataacaaccatgtgccttagctctcccactgaacctcagactatcagccctgctgatgaacacgctcatccctggaacttgccctctctcttacaggccctcatgcacattcacatacacagcttctcaaatgatgtggagaaacacagttaagattggggcaacttctctatttcttagcattatcagtgtactataatcatatcaatgaaagaagattccctatttccaagttggaagcaaagaaaataagttggctttttagaataaggacacacacacacatacacgccacacacacatacacgccacacacacatacacgccacacaacatacacgccacacacacatacacgccacacacacatacacgccacacacacatacacccacacacacatacacgccacacacacagagatagatagggcatggaacagaagacaaatgcagccaatatcctacaaaccactagatggagcgcagatgtacagtggagggtgggcaagtgggaaaagactacacagaaggtaaaacattggggatctacatagtaattccaaataaatattagatcagttacataataaaatttcctgaaaagtttttaactttagaatgtgctcttaaggaaggaactcccttccttggatgtctttactaaagtgcagaatgatttaactggatattatgttgagattagggtctaagtaaaataactctaaagattttctccagcctagactccttgataaaaagccaaaataaatgaagaattcaaaaagtcatcaagactccaaaaacattggagaagggaccatttctgttttatacattgaaaacttacttttaaatgaagcaccctcaggcaaaaacactggcaggtatgggaatgggttgtcaacaataaaaactcatcaatactgcaaatgacgtgatatttgacgcaacctgcaagagaaggccagagaggcatggggaaagctagctagattactcggagctaacactgtgaaaaggatccaacaccaaaccaagcttgatacctcaatgtcattgatgaaaaagcgacacctgtcagtcagaccaaggacacatcctgcaaagaaataaaactgaaatcacaagcaattctatctcaaatcagttaaacctacttttctatcacatagttctaccaccctatgatttcacacctaagttcctgtaatcaggctaaagatagatacctaagacgtggctggtccagtgcaaaatggaatgtgaagccatccatccatcagtgagccctgacatctccatctcctacacatatctcaaacccatctccttttcccctcactaactccactcaaccggtgttgatcccatattccagtctcgtcactctccatcaagtctcttctgggcagccagaatcactgtccaaaccatgaagcagaacacattacctgttattaaaaatcacaagaagtttctaatctttgttcaattaaagaacccaaattcctcctatgactgtcactgagctccagccacaatacttccatccagtcccttgaataagatagctcttgctaagctcaaggagtttgttgttccttctgcctggagacagagccttcttttcttcacatctcagcacacacatcactgcctccgagaggccttcctggaccaccagatgaggactcccattctcatagccaccatcctcaaattacccctcaaacatctcagtattcttaccagtatactctgtccatttccatcacactcccaacaaagggaatcattacattgaattaatagatcacaagttccagaagagcaggaattagtcaagcggttttgttttccagccctgcattctaccatccaccacaattataggcattctagtatgtgttgaataaaaatctataaaactattctcaagatcacatttctgtttcccctcctaaataaaattaactttgaatatttgtacaactagggataaaaggttgctaatcacatatattatctcatttagtcttctaaccctgatagacagatactgattttcccattttatagatgaataaggtgtggcttatgaagtgagatcatttcccactattgtctaggcatttagtggagacccaagtccacctccaagcccacgctctttctacttaatgccatcagtccctgggtaactactttaagtaaatttctgctccgtgttcacctacctcttctccaatcatggccaattcggtctgggtgcatggaaaggaaaccgaacaggaaatccaccagagttcttccatggtttaatagccagagaaggtactctgcaagattcacagatctagttcacaaatagctgatgcgctctttgcaaaaaacctcaacatcaacatttgctaaaacacttaacatgcaatttcaatcactttttttctctaagctggcattatttatttatatatatatttttattatactttaagttctagggtacatgtcacaatgtgcaggtttgttacatatgtatacatgtgccatgttggtgtgctgcacccataacttgtcatttacattaggtatatctcctaatgctatccctccaccctcccccacccccgacaggcccaggtgtgtgatgttctccttcctgtgtccaagtgttctcactgttcagtcccacctatgagtgagaacatgcggtgtttggttttttgtccctgcgatagtcatcaatacttttttaagagtacgttagttcattaaaagaggaaacaggagtagaatacacttgccattccactctaaagcttagggttttccagggtagttaaaagacctgacaatcaatattgactgacaagatacaagtacatgttcttaagaactaagcatctatgtaagtcataacatgtttcctaacaccttgatactcaccccaaaggtacttaaatatctggccatcagccagcttaatactactgacttggtcttggaattgcaacatagactgattatgaccccatccaccgtgcagatgaactgacaaaaaaaaggagaagggagtgtaaacagaccatttttctcaaaatagtgacatttcactgattttgaaaatcaacaatttccttttgatgctgcactacctactcaatacaatgtagacaaaatacatatatacacacccaatactatacacacacacacaccacacacacacttatacacttagagacagacggttagatgaatagataaaactactccaaccaaagcccagataaagccacatctgctacatgacaccattttccacaaacccaataagtagttgtttacactgtgaagtcatcattcctcttctggccacaacttactgcaacttatacaaagtattgccttcattagacatggatggtaccaatatcatttctgtctgcttaaatagttaaagcagctggtctgtaggaaaatgagcacactcaatatctctatcactatcattcgattgatggaaaattgtggattttcactaatgagatgaagggaatttgttatcaccatacattttttccctgagtcaatggagcgaagtaaaatttcactattttttttttttttttggacagtgtcttgctctgttgcccaggttgaaatgcagttgacacaatcacagctcacgcaatctcaacctcctaggctcaagtgatcctcccacctcaccttctcaagtagcttggccatagccacggaagcagaatttctcaaaagaggaggaagaggtagtgattaaaaaaagaaaaagagacaaagaagtagtgataaaagcaaatgatgttaatgctaacatttaattcaagtttttaaccaatctacaaaaaaactaaacattataacaatagggaattcctctacaatgcttcaaattttgtgaggataaattatctgtcaagaagagaacaaactctggagctagctcgctgggatttgatcctggctccacctgcatgatctcaggcaagttatctaactgctcatgtcttagttgtctcatctgtaaaatgatggtgcaaatggcatatactttacagaggattatgagaaataagtaagctaaaacagacaaagcatttagaagagtattttttacaaatataagctaaagtaaatgtaaactaaatcgagggactttgtagtcctcaaaagcattaaattttatatgaacaaaacagtctttttgagaaataaaagtcaaagcagtagaaatatacgtaaatgacttctcatttcctttacagcaaatgagatgactgcatcaagcttttgcctcacaagctaatgatgaagaatttcaaatctgaagaagtagaaacttagtaaattgctccgttttcaaaaggtaatctaatggcttactttaagtgctacatatttctagaacatattctcatttagacatgttaacaaaaggctttttcaaaatatcacgaaagactatgagtcaaaggtagcagcaaatgactgcattaaaatgttttatgtctataaatttatgtaatgtatataataaaggaaaggttcctaattttgcaacaacgtttctcagaaatctcaccagtagggcttaattacaaattaatctggggattagtgtcagtggacaaaggtgccaagtattgacactgaaacaaggagttctgggaactggctagaaaatgctatcaactatacaacagggcttacttacacagaagagcattcattaactgaaacctgttacataatgaagatatagtcaggaacaaaacaaaactcaggcccagagaacagtgaaatttcagcaaagaagaatagagacttttaatggtaaatgtagtcaggtacaaaataggatatatagaagaggaggctggaagaagcttttgaagtcaccacatcaaaacaaagcatatatgtgcaattatgcatcatttaacgatgggatacgtctgagaaatgtgttgttaggtgatttcatcattgtgcaaacatcatagagacttacacaaacctaggtggtgtagcctactacacccctagcctatggggtatggcctatgctaccaggctacaaacctggacagcatgttactttacagaatactacaggcaattgtataccatgtcaagtatttgtgtatctaaacatagaaaaggtatgtatacacacacacaccacacacacacacacacatatatgcgcatgactgcatttatacaaaatttcttcccatccattagcccatgagaattagccactctaattatgcttgacagttattaaaatcaattatacatataacaatcacgctggaaaaatgtgggtagatgctaaattaaaatatttaacatactttaaaaagttgcttcatctactaatatttatcctatttttcaccactttttgatatattttggtctgttattttgacatggctcataactagacttaaccttcttgttaagtgtgttaacaagaaagctactgctcctcaaccttgatcaatagaagtcaaaagttgtatgctcaaaaagacaaaaacctaactccatttgcttaacatgtggagtacagggaaaaactgcaatcctgacattgagctgtccatgctcttcatccatctcagaagaagctgcagtcaaatggtaatgacagaccgggggctgaactcactgtggcttacagccaggaagacgtcttcttcaaccaagtgagaaggcctagtttcagcgggtttacatcttgatcttcattattctcaaactgattctattgtaaatattgaagaatatccaagacatgaataaaacttaaaaaccactgaacgttcctggatgaaggaagactgaagcatcttgtatacagtccactcctaattatttgagggacaaaacctgagatactaccaaatactacaaaatctaaaattaatctttgtctggttaagaatacgtttttatattttccctaaatttctcataccctgaaatctttaaatttgagagaacacttgaggaaactgactacacaagaaaattaccagccctagtccctacactatgaaccccagagcttttccactgccatgacttaccagcattcaaaccaggctctggcagtatgtcacttgcagtagaatgggtcctttcctaagcacctcacattaaactgactgactgcttgagagatggtctccatgtctctaatgcattctttggtagcatttatacacctgacagcgcactgttcttgtcacctcacgtaggaaccgacaatggctacttcctgccttttagtcaggtggcaaatccgcagctcccactgaagaagttggtcactagcctgatcttcctcccaaacatctctccccggactcaggctctccattgcattcacatagagtatcccatggagatcagtcccacctctggttttcactgacactttcttccccaccagacccaatgttcccattctttgccaaccccaaacctatcccttccccaagatcacgatgagtactcatgtcttcgtgaaatctcagacgaattggcattatccccatcaattttttttaaatgaaactatatttaaactgcctcatactttctaatttgtcctctatctctactctagtggtttcaagtctagaagtgaaataatgcatgtaaatgctctttaaaaactactaagcattatacaggcagcccaaaatcatacagaggttgaacacttctgctgtatttattaaatatatcacatatatttagaaacattatttattaaattctgctatttgttgtactcagttaattatttctattaattaacaataaatgttccctggaggcagagtagtttagtaatgaagaacatggacttatcaacagaatagaatcaaaccctaaattctctagttaccaggtccatgaccttgggtaagttcctaacctctacactttgtttttttaatctgtaagtactcaataagtggtactttttaaaaagttctctcacagatgtggcattataatttggtttctaggtcattttgcaaatgccttagtgtacctgaggtattcaataacatccaattgtttacaatactgtttcaatggaagatgcattctgatttccatcccaggagcctcaaagcacagcacccagaagttctagattctggatggagcaaagacagaggctgcattaggtcatccatgttaacaacccatacatcccctttatgtaagagaatgcagctccgccttatcattgtcatctccatctttcccacatgattttcctggagaaccaagcgctattgggagtaggtcctaggctggcttacaactcatgcttcctgctacctatcaaattatatggcattcagacaaactacatgactggcttctccaatagatccgaaagtcagggcctgggtgttgtctttatttcttgttccactcagcaacaggctagaactgttatcagatggctgaatttaggactgcatgctggctgattctgttcccagagcccaagataattaagaacctacttgtatctcttttccaaatgaggagttctaaggcaactttaaatccacttccacccacagctcccagtttcactgtagggtcagcacttggacaacacctggaaaacaaaaatgcaaatactatcatcgtaaattataagatttcacctaatacaaggggatggtgtctgcaattaatgagttctagaaggcaaacagcaatctagaaaataacacatctcaacctccttaaaatctctgctttcctcttaagaacacatcagtcataatctccctgacaaaggccacatctcagcaagaccaggtgaaggggctaccctctcagcccagtctgtggacaatttcctccactgtcttcaaccacctctcaatatcctcaaattctccaaatcctaagcacctgcttaaaagacattttctttctattcttcatccagtttattcactgccagcagccaatgcaagcctttaaaaaattcagccagaacactgcactcctctgttctaaccctctggtggctcctatctcactcggagtaaaagccgcaaggccctacaagagcagatcccatcaccactctgaactcacccaccaccttcccctcctttgctctgctgcagccacctggcctcctggctatttcctaaacacaacaggcacttcggtggttgctttttactctgctggaacgctctttcttttttcttctttgccttcaagcatagaatgcttgggacgctcttccccagatgtctgcgtggctcccactgtgattctcaccaggtctctgcttcaatgtcacttcacagagaggcctttgggatcacactaaataggaaagacaccttccccctgtaaaccttatccttaagctctccctaccccttattttgcttaatttttctccacagcacttgccactgatagatcatatttaattgatatcttttgtctacacctagaacaacaagttgtagacaagtacaactagttttctagtacaacaagccaagtactagaaaaaagcctggcatataaaaacaatcaagaagcaatgagggggaaaaaggagtgatactcaggatgcatcaaacacctctttgaaaactttggcaacgaacttgtctccacaccactcaaatgtctaccacttgacccaagttcttaatttcccttccacttgggcacggagccctgacctgttccagtccaagactctttttccagattctcttatatccaaactctccccagtgggttctttaacttctcaggtttttacttcatggatttgttatgatctttctcttctttccatttctatgaacactgcctggctcaagctcttgctagctcctgcctggacacttgacaacagcttctcctaactagatctctgcctccaggtgcccctgacctatggccaaccccacatattgatgccgaacaattttcaaaagtggagctctcaacctgtcctatctcatcacagggagttttctctcaagtaaatgaatgcagggtggtacagggtttcattctgaggagataaaaacgtcctaaaattgacgtggtgatggctgtacaactctgtgaatatacatatatatacatatacatatgtatattattcatacacacacatataaaccattgaattgtacactttaaatagatgaatgatataagctattttttaagtgaatgcagaacaaaacataccatacatcataaagtgacatataactcattagcatcatacagttaagtcccacaaaagcttacatctgattctttttgccttgcaatgaacatatttgcacttttttttaaagctattttgaaaagtttaaggaggactgtacagcattttacacactgaaactataatcagagaaactggtgagacatccagataggatcatgtacacagtgggctgctgacttaacagaaaagctgatatgaaagtaaggacttcccattaaattaattaattttgattattctctcttggcaactatctaggctttttctgagaatcaaaagatatttgaaaacaaggctaacactgccatatgccagcagaatttatgacataacacagaactcacaagtaaaaacaaatttcagattctccagcacatcaggaaagtaatgagaactgacagcaatggggctgtggcaggacaagtggattaggagctagaacacctgtgtgaggtccttgtccattcttgttcaaacaaattacaaaacctctgacactgtgttccctctctacaaaagaggaaaaccccatctctgacacagctcctaggagggatgagatcaactgaaatatgtgtaaaggctatgaaaagagtaaaacatgttaacaatgtataacatactatgtatttccagagtccaatgttattcttaaataactgactcttcaagtcagtaagggaaaagaatggctcgtacaaaccagtataggattaaaaaaaaaaaaaacaaaaacccaagccaataaatatcataatgataatgatatcaactgcagacttaaaaattttgagaaacactagactatggcaacaccaaactataatttgcttttatgtaggagtagaagggacttgattcagacatcttggcaaaagttttataacataccacatttataaacagaaatctggttactggctctagaacagcaaggtcattactcttttgagggtgtgctaagaatgtgacttgattcacgggtgtgggaacagcagttggtaggtgcacatgggaggcggaaccacagtctgccggaaactgtcaccaacaccctgtctgcagtgaaaaagaaagaagaggattagacctagggatatcaatttgtaagataagccatctgaacatcacagtatatctaaacaataatggcaattccaaaaaaataactttcaatgtttttctcaggaacaagtctaaaaacagtgtgggatgggaaatgtcatgggttctgtccataattggctattgtcacctctaggcctaggggagtccactcagtacctggagtttcaggtgccagggactaaggcaaaaaggccaagaggtcagaccctagctttaaacctgggcctgcaaccaagccacactaaaccaagggaattaatactttcaaatccttaaagcactttcctatgtgtggatttggtaataacgcagatctgattaagtttctatatagaatacatgactataaaatcagtattatgtagaatattacacagaatatgattaatataccacctcacattacaatcttagaagccagtgctccctttcatatcagcaataaactattcattaaggtgactcttcagtcttgcccttcccaccccaccccctaaaaaaacttctacctcattataaaatataaacctaatcttcatattaggcaaacgtttatgcatgactgaacatactggagaggtatatatcagcaagcatttgtatcaggaaacaaagcaacaaagtggggtggtataagggtcaattataaatctgtgtcagggcaaacagataaagctaaacacccaatcccacaagactgtactgttgtcatcctctctacctagagtcaaagttttcgtgtcttcaaaggccaggcaagtaaacgtgtgaaggccacagatgcagtataacaggaactggtgggggaggggggacaatggttctcaggagagaacataccccaccttatatcccatcaataaaaaaacaagtaacccaaacagccaaaacaaataaagattccccactgttccatcaaaccaccacatctgcaggccctaggctcaggaccccttgcaggctcatggacacactcccaggagcttacttccatcaatgacagccacattggacaagtcacttgaattatctccacgctccggtcagtcgtccagtgccaatcataggcgaggtaatgccagccctgacagaaacatgcagccggtatggggtcacagggtcccacatcagagacacaatcttgctcttccacaggtgctgaaggataaactttgcttgagataccagtgatagtttccaacagtccagactgaactgcaagggaaaatgaaaagaaggccgttagaggctgggaagcagacttcatccacttgccagaggggttcaagggcaatcttttctttttcaaaggacccttcctgctcagctcgtctctaaaataagaacaataataactgccaaaaaatagctttccatgcagataaaaatcaagaatcaataaggtcagaaatatatgtttattttcttgttttttttctatttttacttttattcatatgtttattttcgttttttttttttttttattgacacagagtctcgcttgccggccaggctggagtgcagtggcgcaatctcggctcactgcaagctccatctcccggttcatgccattctcctgcctcagcctctcgagtagctaggactacaggcgcccaccacacacccggctaattttttttttttgtatttttagtagaaacatggtttcaccgtgttagcaggatggtcttgatctcctgaccttgtgatccgcctgcctcggcctcccaaagtgctggattacaggcctgagccaccgtgcctggcccacatgtttattttcaactttacttccaactttatgatcacaatggaaggctaccaggaaaaagcattcttttagtgggttttctcataagatttaggaagaagataacttggcaattagagtaaaagtattaaaacacttaatccagatctagactagcatcattgtgttgtattgggcttaagatgcttattttctttcaggtgtttgcaagcacttatgttcaaggctatctgggtattaatcctgattcagctgtccaaagagataagcatgaaattatccttccaacatctattaagcaagcaagacttaatcatgccaaaccaacctttactaaacagatgacatataaattaagaccttagttatattaggaattaagttatattaagaaatattatttatattaaggattttctcaatctccttgctcactaatcttaacttagtgatcacagcaaacataacctagtctcaaaccgcattattacaacacttgaagttagaccacatgctgatgttctgtgagcacagatgttgtggctgttcttgtgcaagtgtgtgtgtgtgtatatatatatatacatgtttttgagatggagtctcactctgtcaccatgctggagtgcagtggctcaatctcggctcacggcaacctctgcctcccagttcaaggattcccttgtctcagcctcccgagtagctaggactacaggcgcgcaccaccacgccggctaatttttgcatttttagtagagacagggtttcatcctgtgcaatatttttatgctcacatatcacagtgccatcccttgacacactggttaatcggtggttctcaactgcggctgttaaaatcacttgggggcttttggtttttaattaaatacttacgtataatctccattccacacactgaactgaactcttgagatgaagcctgaatatcattttttttctaaaggtgtggcagggttaagaactgttgtgttgaatgaataatgagtttcttaacattgcagttaaaaggttctactgaggccgggcacggtggctcacgcctgtaatcccagcactttgggaggccggacgggcagatcacgagatggagatcgagaccatcctggctaacgcggtgaaaccctgctctaccaaaaatacaaaaaattagccaggcgtggtggcgggcgcctgtagacccagctatcgggaagctgaggcaggaaaatggagtgaacccgggaggcagagcttgcagtgaccgaatcgggccactgcactccagcctgggggaaagagagagactccgtctccaaaaaaaaaaaaaagggggggggggttctactgattaaagagtttgaaagctacttagaaaataatcaataaaaagatttatgaacaaaaatgtaccatgcattgctgtttacaataatgagaaatgaaaaactgtaaatgtctaacagcatgagatttaatgaacgagaataaacgagtattatacgcaatttaaaatgatgcagatgtatcacacctacacttttttttgttttgttttgagacgtctcactctgtcgccaaggctggagtgcagtggcacgatctccattcactgcaagctcgcctcctccaggttcacaccattctcctgcctcagcctcctgagtagctgggactacagcgcctgccaccacgcccagctaattttttgtatttttagtagagatggggttacaccgtttagccaggacggtctcgatctcctgacctcgtgatccgcccgcctcggcctcccaaaggctgggcccccaaagtgcatgagccaccgcacctggcccatacctactacgcttttaacaaaacaagatgatagctatactgagatatatacatgaaaaacctagaagacaagaaaattgaatagtgattattacgaagtggtagaactatgagatttttttctcatcttattttctacactttcaagtattatttaatacttaaaaccacacacttatacattttaaaagctataaaatattcttacttttacgcttaatctaaatcttctttcacgtccacagaattcctttgttagtgttttttctgtggtaataccatgcactagggaaagcacgtgatgacttacaacattaattttattgtgtcaagttggctaggctatggcacccagctatctgctgaaactccaatgttgctgtgaaggtattctgtagatgtgattaatatttataatcggctgactataagaaagcagattattccccataatgtgggaaggtcccattcattcagctgaagaccttaaagcaaaaactgaggcttcgcagaaaagaagaaattctgccttaaggctgtaacagaaatctccctaagtttccagcctgccctacagatttcatactcaagacagcaacatcaattcttcctgaatttccagcctgccaacctgcccccacaaatttcaaacttgccatcccctacatagctaatcttttaaagtaaatctatccacactctattactctctctccctcccgccccacctattccctctctcaccgtctctctatgtaagtacagctgacccttgaacaacacaggttgaactgcacaggtcgatttatattcgtatttttttcaatgaatacagtcggcccttctattgtggattctatacccgcaaccaaacacacatcaaaaatatggtacttgaggaatgaaaacccaagtatacaaaaggctgacttttcatatctgagtgttctgcagggttgactgaggacttgaccatgtgtggattttggcgtccatgggcaatcctagaactaatcccccgaaatactgagggacgaattatatatatgtattatttgtttctctagagaaccccaaccaaacatgactgaaatccacaatcaatcaaaacctaaccacccccatttccacctacccactcagcatctttgattctactaagggactaagtagaagggatgaaggaaatcccatacctgctactttcaactacgttttatggggcagaaggctggggtactacagctgtcttaccacagttttcggaatggagctttcttctctctgaaggtcttccagccagactgcaagcacagagaatctgcattccagagcaagtcatttacctagaagggaaaaaagatctgtcattggcttcagttatggatttacttccaaatctttataatagctgtatttcctctctcaaatcaaaaatcccactacctgagctcatccctagctgtaaatcactaacctacagaggcattaaacaatctgtaaaatatgtcattattatgtagaggacttaaaaaaaagaaatacattatgctaaagattaaaagagacttaagaaacttaaccaaatacaaggtgacatttttagacaatcgagaaactggaatatggactgggtgttagacaacacagagataagatgtaataatagaatatggttatgtaaagaaaaatgtccttaactgttataaataaatattgaaaatatgattctagaattaaaactccaggaaataaaaatatatgtaagtatatgtatgtataggccaaaagttgcggaccgatgaaaatagttttgcaaaatgttggtatctactgaaagtgagtaatgttacatgggagttcattaaactcgtctctcaacttaggatgtttaaaattttacacaggataccatttgatgtgttctcacttcagcaagaatcttaatggtatacaaaccacttaaatttaaatgttataaatgaaaaacatcttcattactggaaaaattatgcttttgtcaaataaacaataaaaactagcatttttatttcctacttctgttttatctaaggtgggggacaatgctattatttgcaaaatcactggaaaaacaatattttattaaataaaaatcagttctggaagccaccatttttattactatttactctaaagctactatttatatatccatatcaatataaatcccctctataggccaggcgtggtggctcacgcctgtaatcccagcactttggaggcagaggcgggtggatcacctgaggtcaggggtttgagaccagcctgaccaacacgggaaaccccgtctctactaaaaatacaaaattagctggctgtggtggcgcaagcctgtaacccagctactcgggaggctgaggcaggagaatcacttgaacctaggaggcggaggttgcgtgaaccgagattgcactatcgcactccaacctgggcaacaagaatgaaactccatctcaaaaaaaaaaaaaaaaattccctctatagctatggaaagtcctctacattcgagggtgaacaaactcaggcacttaccttaacctcatctttaaggaagggaagtgtaaagtgtccataaggagtccatttttctcaaaaaacacaatatcctgctggttgggtttatcttgtgtagtgcaatcaaactgcctgagggtcttaaagcaaactcagagtgttacaatatcgaaagctacctaactaaagaatagataaaatccagaagagttttttttccagcaaacatgaatgaagaatgaacgaattaatgaatatctttatccaaggaagttttaaatcccatgtgtccctttctctcggcgagcggttcatcccactgtgggactgtacttgcccagaggaaagagtgcctttcctgttttacacagaggctccatttgcccacaaaaccttacatatttacattgcattggatgactttaaaaataataagttatctaaaccattccaggtataatgtcctaaaaataaaatctatttctccttccattatacaacttcagcaaatattctatgctccagtaggtctttttaagacttcaccaaatgttgaaaacatcttaattgcctcatcttattcatatttgctctagggttttaattcaaatacatttctcttctgctctatcatataataccattcagaactggtgggaaacaagaggtctacatacaacagatatcaccgaaacagaggagatacatttctatctaaaatcaggcagccacatatgacaggcaaattgtaacctgcacaagggtacgggccaaggaggagaatggaaggaaagagcagggtctgaatccagcctgcatgctccttgcaagcagatcctctgctgtaggaattttgtgccaaggaaggaggctctttccctaattccacaaaagcaccatttgccccacagagccttgcaaactgggccttcccttctaaacacattttctgctctgtacaatggcttcatatataccctgccttaaaaccacagccttttaaagttaggaatgcaaaatatatgcggccttggaacaatgaaatctgtgaagaagcgtaaatctactattcgagttgaattcagacttcagggaataagaaaaaaaaaaaagaagaaacaagatagatacagccttataaccaaatgaagaaacgtaaaaatccttttgtgttacacaacatctgtatcatctgtatccatgtgtaccaccacctctactctggttccaagaatttcttaaggtttcttctcccactcacttccaagccagggctggtcccagtcctgccacaggctactggttgactgcaaagcaaactctcggttccacactctgaccttccgagcccctgtgcggagtggagtcaaacacacatacacacttaaaacattatgataaaagttgtcaattcagactattcaaacaccttccttacaaataaaaactgccatggttttacatagccaattagataattttgttacaaatttgtgtccaccaggtaggaggatggaccaaatggcctcaaaggctcttctaattcttaactctaacctcatttcacatttaaagcagcacatccttgcctcaatgtataattaataccctactcaaagcaaaagaaagaaaattttccttaattttaataaataaaaattttttattgttgtttaactgcaatatatttccatacctgtttctgggcaaaaacactcacagcaaaaaactgtccatccccccgccaggtaacttgtggtctatggtcatccagggcaaagcagactcatgctaaaaaggggaacaaacaccaatattactgggggacctaagtatcccagaatcaaacaagcctcagaccactagatacagatgttttttaagaggttaagctactttgaaagcctgcctctagaatcagaaaccatccaagggttggttcttagacgcagaaatcatcaaaaagaagaaaaaaatgtaaaacaaacaaaatcctcctttcggcataaaaaaaaaaaaagtggcctctgagaacagcaaaagaggaaaagagctacagatctagtcctgaatataatgagctaaggaacctatcaggtaactacaacaaggaaacaagtgttcatttgtccaacagggtagagttttgtttacatattgtgtaagcttcacaacagggcacaatgagttaagatgtgaacaaggtgaatagggaggagccacagaggtggtaaaggcagcacagacaatgacgaaaacatggaaatgttctcattctgcagcatgacgggaagaaacgtccctccagggccacgtgtatctcaatcctgaagccaactctaccgggtgggagacagatgccacccgggcattcatcatcatattctagtaacagcctaagaattctgctagtactgtatgtagtctgcacagtagggaatacataggtagcctaacaaaatttattctcaatgaaacgtcctagggtatagaaaccaaacctcctttactgaagggttaaggcctgaaataggcatatatgaaatagaactggaaataattaaggacagaaaacgtagatggcaagcagggtattttgagtcatctattctagaagagtagctcatagaaatttctacatataattatgcttcctttgttcaggcccaacccttggtatcctcctcaattcctccctctcacccaattttttttttttttttttgagacggagtcttgctttatggcccaggctggagtgcagtggcacaatttggctcaccgcaacctctgcctcccaggtacaagtgattctactaccttagcttctcagtagctgagattacaggcatctgccaccatgcctggctaatttttgtatttttagtagaataggatttcaccatgttggacatgctggtcttgaactcctgacctcaggtgatctgccaacttggcctcccaaagtgctgggattgcaggcatcagccactgtgcccagctaaatgcacctcttgaatcagtgttactgggcactaggagagcccaggcagggaacaggctgagggtagaataacacaacttaaaaaatcaaagtaaattatgctcacatgagtacttgtatctgctactccatggatttttgttttcttttctgaagggtagctgtgaactttcaaaccaagagaggccctagaaagcctttagaaaaagttcatgaaaaaaagctagagtagtttactggaagtacattagataacaggatgctcggtttttttcccccattacctggatcatcctatacattaataaaccctaattttgttaatactagataagtcttactctagcaggtaccagtagaaagtgtcatcttctccagagtttaacaaagtatggaaaactgccttattttcaaaactccatagattcctttaaagtactattttttaacacctttactgggatataatttacatatattaaggttcacccatttgaagtacacaattcaatgcaccttgggatttttttttggtttttaaactcagtggtaagaatcaatgtttttaaagtatatttacaaagttgaatagccacaccataatctaaattttgagcattttcatcatccccaaaagaaaccccatatccattacagtcaccccttccccaccccaccccacagccctacccaaccactactctactttctgctctgtggatttgccccttctgggcacttcatacaaatgggatcatattatatgtgatctttatgactggcttctttcacttagcataatctttatgaggtttacccatgtcataacattatgagtaaagtgctatttttaaatcgaaaagatatggtcttagaaagctgtaccataattacttgttgcttatagcaagaaagaatattcaaattgcaccaactatttacttggtcagttcctgtttagtcaaggataccttttaagtcctgccaaaaaaaaaaaaaatcacttaaaatcagggggacatgaaaaccacttgtccaaagctgggcagttgtagtggatcacccccaagaagcaaggttgtgtctcagagtacttactccatgtttctgccctctaataatccttactgttctaataagtcaatagctttcagaatgttaaattagacccactatgcatattttctcacaataaagttgttttgaaataaaaactacgctttaaaaagtttcaaaaattattttctactaaaacaaaagcagcaactaccatttgagtgcctacactgtgctgatgctatgaagctgttttatatatgctattacctgcccatctcaacccttgtaaggagacattatgtttccactttacagagaatactgaggctcagaaacattaggaaacttccctgccaaggtctatagcttctaaatgttatgaggataatgtaatctgtacttttctaacagagatctgtaagcccctgggggtacttggtagtgtgccagagggtaaatatggcacatcttcttggggcataattttactcaagggtaatacttttcaattcatagttttaaaaaatattcatattgtaaaattaaaataaaatataagagtttaaatgaatttaatgtgacacggacactacttcccaggtgccccaagagtctgcactcttcttgtgtccacacacctctgccttcaggggccgcccgcctacattagaagattaaaaagtcctgccttgagtcatcaagacatcattatatggcttcagaattttccaatccagaagtaaggaaaacaaagagtttcatccaacagaaaaagaaaatatctaatatacacatatatgggaaaagtatgagaacatgcatgtgaatgaaggaggcagctctctctggagaggaaggggagggacatcgggacgggatacacagggggtttctttgtctgtgatgttttattttttaaactgggtgatgaatattggttataattatttgcactatgaaaataaatcacaaagcaacttggcaataacaaggaaaaaaaggatctttctaagggattcatttcctgaaggttctaggcagttttactaaagcagaagagaactgttcatactggcatctaagtggacaccaaagagttcctggtgggtggcaaacttacatttgttccgtcaaggctttttatccatcaaaccaaacttaccatttgcatctgaaaagctgcttgtcgccttctgatccatggaactgtgtctccttcctaccccatccaacagtgataaacttgctacagaacaattggcaagacaactaataagccacatgaaatgaaacaaaaacagtttcatgctattcttcatgaagttagtcattggcaattactcaggtcctctaacgcctctcaataattgaccagcagtcaatatttgagaaacctatgtttcaggctgggcatggtggctcatcctatagtcccaacactttgggaggctgaggcaggaggatcacttgagtccaggagttcagaccagcctgggcaacatagggagacacccatctctacaaaaagtatacaaaataagcggacatgatggcacacacctgtggtcccagctactcaagagactaaagtaggaggatcattgaacccaggagttcaaggctgcagtgagccctgattgtactactgcactctctagccgggtaacacagcgagacccccatctcaaaacaaacaaacaaaacccatttcatattatagcagcagtgactttgaagaatttgaaatgcccttccttattttggaaagcattttactgcatcttacatattccaagtttctttgatgacacaagtcagcgatctcaccctcaccttaaagtaagaagaatgaaacataaagagtttacaaaatatgtccggaacataaaaccccaaatgagaactgggaataaaattctgattgcaagctctcactggtgatagaggggctgcagtcacaaaacagctcctcacatagacttagagattgagaccctccctaatggtggagccaaagttagaacacaggtcttctgccttccaggctgactggggttctttctagatcgtaaccttctcttatataaactattaggcagagttgctgaaacaacacaacccttctgttcctgaggtaggatccatttgcaagaagcacaataaagatggtcctgaaaacatcacctaatccggacccaatactttcctcctgccattgattctgattctgatgaagcagggctgtttgcattcctataaattatgggtccatatgaccatttcctgtctgctcacatccaagtgctacatacctcaattgctgctgcgtacaaatggtagtgactatcctggtgcaaacccccaggctctatctgcaagtttccacagaaagattaaggaccaaggaatgaagaaagagaacttttcaatggaagacaagaaatgatggggttacagcagggatttgcaaaactacagcctacatcgcttttacaaacaaacgtttactggaacatagatgtgcttatgtatcatgtataactttacacctcaacattagaattgagcagctgcaacacagatcatacagcctgcaaagctgaaatattcatgacctagcccttttcagaacaagtctactgaccccaggatagaggaaaaatttcatcactccatagaatgatttttttttttttgtactgagaaacacatttctgagaccaagatcttaacttggcctacatttcctttgatttactgcattaggatttgtgtgaaaaatcagtgggaaacaccaggcccagagcactttcccatcccaaagtatactgtgtgctgttctctctctctgactgtcctcaaagctggatgccccagagttccaccctggattctagaccttcctgtacagcatctgctccctgagacagtccatctgttcccaaaactgtcagaattcctacatacccactactctcagtccatagctctggcctctcctgagcttcagccttatattgcatactccacatggcaatcacatatggtccttcaacaaatccaaaacagatctcacacccaccccttacagaccagcacttctccatcttccctgttactggcatctttattcccacacctgaggttctggctggagtcctgctcaactttttcttattcaccttacatacgcaagcctatttatttcactttctaaattggtatttctcaaactggcctagggcagaaggggatcatgcacatatattctaaaaaagtttcccagctaattctaaaaaatgtactcccatctcattgtgaatcaagttttttcctgaatgattcctgcttctagccccacacaaaccttcttatctttcatctggattcctgtagcaacctcctacctgatcaccctgcctctcatctctccctctccacacacaaaaacaacaaaaatatgccatcacgagccatctttctattaaaaaatctctttaaacctcttatcatcaaaacttgtaatggctgatcaactataactcaattccatattccctactacaaactcaatcaaatctgttccatttatttcattctacactcaattctgccacttcagcaatgctgaattactcacagttccctgagtaacccacaatgttttatgaaataaccctcccttgaaatggacacttgaaatggacacattcacttgcttggacgttccccacccttatccctcacctacccaataccaattcagctgactactccaaaccctatccctcacctgcccaataccaattcagctgactactccccacccttatccctcacctaccaacaccaattcagctgagactcagctcaagttggcctcctaggggaaataaatcatcctctctagttactcgtttccttcccttatgctaccccagtacctgcacatcatgtcattctgtgctgataccaccaagcccagctaatttttaaattctttgtagatgctgggtctcctacgttgcctaggctagtatcaaactcctgggctcaagcaatcctcctgcctcatcctcaaaagtgctgggattacaggcatgagccactgtgcccagccctccaaaattatttctgacaaatacattatttgtaaataaatgggtagaagttgtctaaatgatttctcagagttgaggagcaagaaggcaggaagttagaccataacagaagttggaacatcttcttccccatcctcttcaatcaggccagctactttgtgacttcaagatggccaaagcttatgcttaataaggtctctcttctcctgcactgcccttcaatacccccacagccttaatgcccagatgacctggctagattttagcaagaaaataatctgattgttcccatggaaatgcagattggatctatcgtagtaacaaaaaccagccttctattccatctttcttcttttcttctccctaaaacttatcccagaaatactaccttgtacagtccctttcactgaaagcccagcctaagactttctagggtttgggtaataactatctaagtgaccttaaaccctcagacctggagaggcatcataggccttttaagatttgggatgggctgaaggaactgggctaatagacatttaatagctggggtttaactttcacagttctttggcctaatgacatggctattagtgcacaaggaaatgtcaaaaatgggaagaaacgtaggtcacaaaatattgcacaaagctatacttactttcacaaaatcatcctgatggatctgctgctccaggattggctcaaaatcttttgtcatcatatcagggtctgttgaccttagagaaacacaaacaaaaatgattttgttttcatgtaacaatttgccattcctaagtacctatggcactgtaagctaaggagctggagttagtctgaacaagcagacagaattcatccaaaatgctttgacttaaaaaaacaacaatgacaaaaaacccaaaaagctttccctagataagtcacctggtgcttatgctcagctattaatgtgtgtacattgaacttaaaagtccacaaagccctcctccactaacttcaacactccttgtccccaagtacctctaaatataaatgtcatcagtggagctggtttactaaactcatctggaatgatggacttaaaggggaaaaacagcaacagaacccaagaagggcttttagaatgtgtccatacgcaactcttagaataagttaaaatacatattgctgacatttttaactctaactggggactagcagcctccccaagttttatgactttgtttcttactcccaaagacttaaaaagttactgaaacaactttttataatgatagactaagaggcaaaacttcagtcaccaaaaaaaaatactctacgttttatatatatatacacacacacatacataattggtattatactggttcaaattggtattatactggttcaaagaaattttttgaaattcaagcagcctaaagctgatgagcctgtaagacatctggaataatgttttaaaaaagccagtgaggcaccagtaacaagctacctgtggcaagaagcaccagctcttggtcaggactccaactcataacagagataccatggctacactcccaacacactccagctgagacagagaaaattgaaaagagagattcaaaactagcatctcagtaaaaactgactgcaacttcaatcaaaacaattaaaaaaacaaaacaaaagacatcagtatatggaagagatatctgcactctcatgtttgttgcagctctgttccaatagctaagatttggaagcaacctaagtgtccatcaatggatgactggataaagaaatgtggtactatacacaatggagtactattcagccataaaaaaagaataagatcctgtcactgcaacaacatagatggaactggagatgattacattaagtgaaataaaccagacacaaaagacaaacatcacatgttctcacttatttgtgcgatctaaaaatcaaaacaattgaaccacggacacagagagtacaaggatggttaccagaggctgggaagggtagtgaggggctggggaagttgggatggttaataggtacaaaaaaaaatagaataaataagacctgctatttatagcacaacaaggtaactacagtcaacagtaattgcacattttaaaataactaaaagatgtaattggattgtttgtaacacaaaggataaacgcttgatgggatggatatcctattcccatgatgtggttattttgcactgcatgcctgtatcagaacatctcatgtagcccataatatatgtacctactatgtactcataaaaattaaaaatttatatttaaaaattaaaacaaaacttactcaacaaacatttcttcagtaatggatatcaagagaatagacctgttattagcacagggattagaaataaatatctttttcttcccagagctgtctcacgagggagataaagaagaccctacagaggataacagcaatgaccaagatctctggaaagcaaaatgcgtctcgcacagggaatgacaagtggcccaaagtccagaaaaagtttttctgacgtgtttcaaaggtggtaataaggacaggaaagagagaccaggaagaaaacacagtgtagaggcacaaagcagaaaaaagagcagttaaaaatcagctgcaactaaaacataaggtttacgtacacacagaacaatggggggatgaggctaaaaaggaatgtggggaacagatagtgaaaggggcttataggcacaatagtgggctctacctttcagacaattgagaagccactaaagggcagaatcacaccattaaatgaagataaatagactggaagagctcagtaaccaggaaacaatgctacaaatgtttggaaagtaaaagcatctatctttcaaatacgaaaaaaaaacaagctgtatatacaagtttgatatttcccaccatgaactgcaagtaaaggtttatgattgtactaaatggatggttaagagcagaggtgccagatttagactgctagggtcaaaccccatttgattacttgtgaccctggtctaattacttaagcactctgtgccttaactgcctcttctgaagaatagaaacaacaacctactgcataaggtcatggtgaagattaaataaatttgcatgaaaagcctttaaaaagtgccaggcacatgatagttaataaatgtaagctgctatcattatcctacattagtaatactctaacttctgtgacataatcaatgttaaggagatcacaactaatgaataatggaagaagatttaaagaatcagccaagtgtaatttgaaacccttgctgttaagaagtgaggatagaaatcagaaactcaactatacactaaagtagagaaagaagcaattgcttaagtctagctctactggcagtcatcacatgtgcaggtaatgacaatgtatttactttaggcctagacttcagggactctaaatttagccaatcaacattcataacagaaaatctaagtagataaacaaagacttcctaaattgagaaacaaaggttgcaactcaagatgagggtctgtaagaggtgatctacaccacataagaatagccagttttaacttttaaaaaaatatattccatttggaacattctgatcactctgattaatagatgcagcagacaaaactcagttttagagaatcttaacatatagataaagccatgttaacaattttttaaataaagaaatatataagcaaaaattaattagcaaaagtgtaactattatggctactgatttgaaaacttccacaatagcaagtaacctatttgaggatgcttgagactcccccctcactggagtcttccacttactgttgtgtgctgagactgcagagtatgacgtctccagaggctgtggccacacacacagctcctgatccagcaagtcctgaacaccaacaatgcggccacttccatcctctgggagaagccttctgccaccaaagaaacttcatttttcacctttcaccaaagtaaacacaagcaaataacccagtctactttcaagaataattgataacatttccagaaatactttttaatgcttttttattacataaaagctttcaaaaatattttttctagatgaaaatccaaactttcattgagaaatatcactactctgtcatctctaacaagaaaaataggtaatgtgacctttttgcaaacaaacacaaaaacaaaaacaataagcctggtctctttaaaattgtccactaaaatagatgctaatagctatgcttttctaagatttctatagtatggggaaaaggcactaaaggagtaactgcctaaaatgtattagtagaagaacataatcaagggaccatatcaaaaccaaccacagaggtttttaaagtacatatagttaggagccaacactaaagattctgatttagttacatgagatgtgggctcaaacttttagaaagctccatgggcaactttcgtgttcattccaattaaaaaccactcttggccgggcgctgaggcaggcggatcacgaggtcaggagatcagaccatcctggctaacacggtgaaaccgcacatctactaaaaatacaaaaaattagccggcgcggtggcgggcgcctgtagtcccagcttctcgggaggctgaggcaggagaatggtggaacccggggaggcggagcttgcagtgagccacgatcacaccactgcactccagcctggtgacagagcgagactccgtctcaaaaaaaaaaaaaaaaaaaccactcttataaacagaattgcatgacaaagagggtaaaaagtacggcacacactcaaaaagtaaggtcagagttctctgacttaggttaaaatagcagcagagttaaagaaggattacgatttaagctatgtctacatggcatatatatgaagcaaaagatgtttatttgggaggatataaattcaataagataaaagaaagaccatgtggggaaagaaatttggaagaagagaaatcaagggtcatacccactgctggcattctacatcagtaacttacttctcttgagacagggtctacttctatcaggcatgttctgaaccaatgagcaccgtcccctgttcagttcggagagagaagcactgaggatccctggaccttgaatatccctgaactccagggtccgaaataatttcagatttcgcatgagaagtgattcccacgagacaagtacaactatcccttgatgaatcattaatctctaagagaaaataaatagcttaatagtgataaatgaccatatttatttaaatgaaatgattcaggggtgaagaagtggtagtcagaatcagaataaccaagaaaagaaaaaacttacctctctgatacacacccatgtatggattatagcagcaacctgacccactctatacagttatggtctaaaattaggaattctgaaacctattttatgttctttttaggagaggcaagattctcaacttagaatgttttcttcaaaaaagatgtaatatcagttattcctttgggaaagttgaaagacaaatgaatggggaaacattttatttttgcatattaggacatctttataaaatcatgagaaaaacaaaagggtatcccactgattagcactatttgaaaatccatttttatatactggagttgaagagaatctgaaatgactttaatattcaccaggtctattcatttataaactggtttatacattcataaaaaaactgaaatcaaagatagaaaagcatttactgttctaaagggaagagaaaatactgggacatgacaacaatttacttcaaaatgatgaccaacatttcaagaccctgatgacctgacataactacttccagtaactttgttcttctggccaggcttttccaggacaatataaaacgtgagaaaagagtgctaaacaagacatctactttggtctggcaaatcaggcttgcttaaatgcataacattacctaagtaggggaaaaaaatgttactgtgcagttatttatattcagatccctttaaggcttatgattgtaagtccctaacttatgttagggtagcaattacaaggaccacaccggtcttattgtcactttaatccaaggagacttctccatcttggcaccccacatatgtatgacatagaaagaataaagatgaatcaatcctaatatacacagaagataatgtcaagtgtcataggaattatataatatataatgtgggataagaaaaggtaagtttatatatgatggaagtgaggaagacaatgattttagtaagttttggtgcaattatattcaagaactgctagaaattacttgaacctctaacatatcatgcaggttttttgttttttgagacggagtttcgctcttattgcccaggctggggtgcaatggcgcgatccggctcaccgcaacatctgcctcccgggttcaagcgattctcctgcctcagcctccggatagctgggattacaggcgcccggcaccatgcccagttaatttttgtatttttagtagagcagggtttcaccatgttggccaggctgttcttgaactcctaacctcaagtgatccaccccctctgcctcccaaagtgctgggattacaggcctgagccaccgtgcctggctgcgttttcatctttaaacatcataaaaacgcctcaaaactagtttctctgaaatttcacacccatcgccttattcccttatcttctcggaggaagacttccctccacttctttccaggctaggaaggaatatcctccatattgccacaggacctaggcctattagtactctttcttggacatctcaacctccaaccttcctgcctccactgattcaaactcttcgcagttcttaaatgtgctaagatccctccacaccaaaggtcaatcgtggattctctcttaatttcctgataactgcttattttcttcccttgctccttcgactatccacctcttggctagacatcacatgcatgattcatataccaggtagatcaccaatacgctgattaggcctaaatgcctagccctgactgaatagcccaaacttaccactaaacccacattttcaacctcctgatagaatcacaagcatgttcacatgcacatcaaatgcgacctggaaagcaaagaacttgctattcttcccccaaatgcagttcccactatttggggacagaccatttctactctatgtccccaagctgaaaaactgctttgctgcctttttgcttactcttcatacggatctattcattgattagttccgtggcttcaatatacagttgaattctttacgatccggtttgtggcctacatccaacaccgactgacacttgctaagtactgggatctgaagattactcagccactgtctccacggagatcatcgtaacgggagagaaagccacgtaaaacaccacgttagatggagaagcacagaggacaccactccacgaaaaagtctcacacgcgagaaaggacccgcaccacagcacccgagcctctataaccgccgccttccatcgtgaattaatactctcgctttcagcgttattatcaaccccctcaagcaatcaagaggctgggttaagtccggctggaggggcagcaggcatccctgggctgcgcgcctcccagcgcccccgatggagcaggtggcaaggctgcaaaaagaatttaaggcttaggaaagaggtggtgcagcccgcactccagtccccggcccgcagcaggcagaggaggcccgggtctccttcacccggacaccgccggcggagaggtccactcccgtgcccctaccctgatggatcgcttacctgaggacccccaaacagaggtgcgtccggcctcgcctccccagcacgcgcagccggctacccagagtcagctcccacagtccgcacccagagtcggctccgaatgcgcacgcgtctctgtccgcggctcccgctctctctccgacggcactaggcctccaagatggaggcgccctccaggggaaaacgctgaagcgctgcaaagaagccagcgactcaatggtgcgtcaactaggcagccgcagcactgggagtgcggcgcgggagtgacgtcaccaggcgagggggcgaggccgggcccgcttctggtcacttacggcggccggccttctttgtaggctggcaccgtagaggtagaggagctacattggccgcgtcccctgtccctctgccctcttgccatctgcccaaacttttgtatttgatctctgttttgatgtcgaaccccaaagcactgtattggggggggcgggggggggggtggaacctgcggacctgagagcagcgcgcgtgcgcagacacgcgctgtgcgccggaagagcacgcccagtccgggctgcgcggaggaagcgctgggtcccggagggcgggggtggcggcgccggaggtcgccatggctaccgagcccgaagccgggagccggtggtgccttcgctcgtggatcgatacttcactcgctggtacaaaccgggtagtgcggagtgatgttgatccctccttggccgcactggcctaatgctgtgtagactatgtgacagatcataagccacgcgcgctctccctggctctccgtccccacgtcagaaggcactgacttctgtgttccgtctagccccagggaatggcatttgcaaagacctggtggcctgaatacttcagggcgcattctggggccggcgattgcagtgcgagctctagggtgttgctcgcgtaagatgagtactctaaacggaggccccaaaggtaggcggagggctaggttgcaacagccttaagtgcctggagggattgaggggctcactctcacagggagtagcgatacataaaatatttaaatgatcagatcgaaactaaggtagaggcagtagggatggcgagaagagggtggttagattagagacatttagaaagaagaagaatctatacatttaccttaagagacgccactgccacttagaagtaggtattctttttgtactgttttgtgtaagcagaaccagtggtggagcatcgttggggactctcctttcttcctttcattcagtgataatggttatactcagttaaaaaatatatattgtagcatattttctgttggccaaacatagggtgaccaacctgtctagttcacccatgactgaggggtttcccagaatgtcggacttgcaccaacatcaggacatcctggaaaccaccaacaaaaaatatatatcataaagaacgggatgctaattgcattttctagcaaaaatactacgtgtactcattttgaagtgagtgtaaagtaagatggagcaagggttaattaccttaatgttgaataaattattctatctgggccagatctctttaaatacttctaggaaacctttaggtatgtctttttgagtaatgaagggatacccgtgatcagcatgcgcatgtatgtgtccagtcttcattatcaactatatgacccaaagaaagtaccacatagtgtagtaaatattgatttcagccaccaacagactcatgtattcttctagatgtcaaaggaaattttgtgaggaccactgtatactacagcactctaaccggtaagcaaattgggaatttaaattatcaaaaatttttttttcctggtattgtagcctggtatggtcttgtggtcttggttgaacaaatgttcactaaacaaacatgcattaattatcttctactgtgttgaaatggtttattataggagtttgtttggcaagaatgagtattccagtgcctggccactctgaacattaaatttgattactcaaacatccaaatggaggaccacatcatcagctgctacttgaagtgccagtctgtgcccaactactgaactgttcagagcccacagaaagggctacggtagagaatgtatggtatctcgtatacacaggcatgccttatttctttgtcttctaccccagtgctcctacctaaagacctctggtactcttccctttcctgggaaagaaattcaatcttgtttttcttttattattgtattctctattctacagttatgccccaatagtagccaaaggaaaaaggggaagatgatagtttgactaaacaaataccagttcatacattcttgttccaataggattatgggaggaaaaattattccaagcaatcacacaggatcaactttttctccttgtagatatgtgtcatcacattggcagaatctcatccagttcttcaaagtggaaaaacaattaaagcatttcctatcagatcagtaccaactgtagcagacttcagaacaaggtctctgggaaattaagcgggtatgttcctgtaattctgtgattatctacttacatcctctatattcatggaatgacagatccaatgaaccttagaatccagtagcatatgcttagcatacttctctagcgtttgaggtgctaattttaggtatactttcacctaaagaaattctcagctcccccaaataggtatctcaggaggtgtagtatctgttatattaggttctgtgctactatccctataatcccaggatggaggagggggaaggcaggcctttgaaaggagaactctaatagcaatataaaagatattttgtcccttctagttgtattaaactagtatgtcgagttctgtaaaatttagtgactaactcttctttaccatatatttccacatgtaaattaaacagaaaaaaaattcccagggagttagaaaaaaaaaaagaaaaacatgggccggtcacaatggctcacgcctataactcagcattttgggagaccaaggtgggtggatcatgaggtcaggagtttgagactagccggccaacggggtgaaaacccatctctataaaaatacaaaaattagccaggcacagtagtggcacctgtaatcccagccactcgggaggctgaggcaggagaatggcttgaacctgggagcggaggttgcagtgagctgagatcgcaccactgcactccagcctgagcggcagagcaaaccaagactccgtctcaaaaaaacaaaaacaaaaacatgaatacgagaaaatatatttgtccttactgtttttccattcctaaagcattgtcaatgtaatactcatgtacccacccccgtacctgcacacaacactcggttatatagaatgctatctctaccctctgtaactctaggaaaatggacagattattaaaagagtatcatgccaaggagaatttagtgacatgttaaaagtcttaacaaacccactggttgggaaagtttctgtggatgatttaagtcgttcatttacgagttcatactaagagtttctgctaattgctctcactattctaggagacccttattcaacccccctttgtaggcctgaagtcccctaataattactgatttattgtgctttacaattatgatttttcctcactcaagaaactagtggacttagaaaagcatgcacctctcttaaacgtagtctacaagttacaataacacttaagacttctgaagtttcaatgataaatctctgtcaaaatagtaacacttaaggcaggtacagttgctcatgcctgtaatcccagcactttgggagccgaggcgggaagatcacttgaggccaggaatttgtgacaaacctaggcaacataacagacctcatttctaccaaaaaaaaaaaatttttttttaattagctgggcatggtggcattgcctatagtcccagttacccaggaggctgaggtaagaggattgcttgagcacaggagtaaggctgcagtgagccatgatggcagcactgcactccagcctggatgacagaacaagacctgtctcaaaaaaaaaaaaaaaaaaaagtaacactcctgttacaagtgaagaacagagaggacctgcatattgaacccactacagtaagttttcactggatctcagaactgccaatcatctcccaaaggaggtgacaaaaaggcatcaaaacatttctgctgttttggcacagacctgctcttttgtgtctgctcttttaacacaagccttccccttccttccaaaagcagaaagtacaatgactctagtattttaaaatgaagaacccacgtgcggaggagtgaagccaatatataatatctgaatgccatctaaaaatgttttgagtggtaaataaaggggtcataaagaatgcatcttaacctgaaatgcctatgtccactacaggaaaaattcatgggagaaaagagggaacacatgaaacatgcctgcactggctctcatgagcctccctgtagatacttgtgagagctccccaggtatatccatctagtggagtacatgaaacaataaccatgccatgacattcaatacatacacatcaaaatgtagtattgactcatgggtcaattatttttattttgctgctaaaacttttgttttccacattttcctcaaagtgcatgtttttgtttttgtttttcttaatagaaaaaatatcccttactaacacactggggaattacaaaggggggggggggaaagaaaatatcccttcttcaaaaagtcttagtgattgaccctggtaaataagttcctttatctataagttctaatattaaaatgaggtagaaatcttaatgaaactaactttatacaatattgtgtcatactgtgtcatgttgaattttatattgtttcttgttgatggattttcccatactttgaaatctttatacctggttatatgtagctttttcatttacagttgataaaatatatttcagtctgtaaattcccatttatcatgtgtcttagcttttttccctagacctaggatggacctggcacacagtaggtacttatattcatataggttctgaaattaatgaatggttttttatactgaagtaactgatttaaaacaccagttccaggaatacatcctgttatacacctagggctacttctcaaaggaaagtggaaatgtccatcaactgattacttcttccgtctcatacacagggggcacagtttctaacagagcttgcacctctctgtaagatttactgctcagaggtgaagaatatactgtgtctaggtgagtaactttttagccaccatttaggagaccaaaggaggtaattttttttcttagaaacaattttttttaactaagtaaacatgctgaaatctaaatttttttaatagttgtgttagaggacgtttgatggaagtgaatgaaaacatcctcctaagccatctattcttcaagaaaaggtaaaagagagagaaaaaatatgatctcatccactaccttttattggtttttttttcatcgtttgacagtactaaatgttctttcctttccagcatctactgaaggctacattgcagttgtgttacccaaatttgaagaaagtaaaagcatacagaagggttactgacacaaaaacaatatgaagaagtcatggtgaaacgcattaatgcccaacagctacgtcatgaggattgacatggaacaaaaagcaaagtgggattcttgttaccggcctaaaccatcagggtactaaaggagaagaaccagtatatgtaaagcatacctaacaccagccatatgcaggggaggcctagtgcttcacttagttttccctctctgtcttcataagagccttggttcccatttgtctacagcctgccagatctggcctgcccatgtactcacacgttctcttgcatctctctaacaactggcatgcaaggcatgtttttctgattaaaaacaacaaagctctttgaagaagatttagaaaatacagaagagttttaagtagccaagtaaaaaaatttacccatcatcccataatccagaagtaaatacatttgacccttgagcaacataggttgaactgcaagggtccacttatgcatggactattttcaactataaacgagtcaaaaattatcattaaccaaacacgaaacccacttatagagcaggttcatatactcaggttccaaaggccaactgcaggacttgagttctcacgtatggatttgggtatatgtggaagttcctggaccaatcccctatgtaaaccaagggataactactacattttaacctacttctgtttgaaatatggtatggttattgcttttgcctcgttttcctaacagtttgaagtttaaaaaaaccaacccacctttcttacccagtcttctataatgtgcctaccaaaaagcctagtcctagccatctgcctcaactcctctcccttttaggttgtagggaa

SEQ ID NO: 5056 - DNA, 18467 bp, Homo sapiens
taaaaatttatatttaaaaattaaaacaagaacttactcaacaaacatttcttcagtaaggatatcaagagaatagacctgttattaggcacagggattagaaataaatatctttttctcccagagctgtctcacgagggagataaaagaagaccctacagaggataacagcaatgacaagatctctggaaagcaaaatgcgtctcagcacagggaatgacaagtggcccaaagtcagaaaaagtttttctgacgtgtttcaaagagtggtaataaggacaggaaagagagaccagaagaaaacacagtgtagaggcacaaagccagaaaaaagagcagttaaaaatcagctgcactaaaacataaggtttacgtacacacaggaacaatggggggatgaggctaaaaaggaagtggggaacagatagtgaaaggggcttataaggcacaatagtgggctctacctttcagaaattgagaagccactaaagggcagaatcagcaccattaaatgaagataaatagactggagagctcagtaaccaggaaacaatgctacaaaatgtttggaaagtaaaagcatctatcttcaaatacgaaaaaaaaacaagctgtatatgacaagtttgatatttcccaccatgaactgaagtaaaggtttatgattgtactaaatggaatggttaagagcagaggtgccagatttagctgctagggtcaaaccccatttgattactgtgtgaccctggtctaattacttaagcacttgtgccttaactgcctcttctgaagaataggaaacaacaacctactgcataaggtcatgtgaagattaaataaatttgcatgaaaagcactttaaaaagtgccaggcacatgatagttataaatgtaagctgctatcattatcctactattagtaatactctaacttctgtgacatatcaatgttaaggagatcacaactaatgaagtaatggaagaagatttaaagaatcagccagtgtaatttgaaacccttgctgttaagaaggtgaggatagaaatcagaaactcaactatcactaaagtagagaaagaagcaattgcttgaagtctagctctactggcagtcatcacattgcaggtaatgacaatgtatttactttagtgcctagacttcagggactctaaatttagcaatcaacattcataacagaaaatctaagtcagataaacaaagacttcctaaattgagaacaaaggttgcaactcaagatgagggtctgataagaggtgatctacaccacataagaataccagttttaacttttaaaaaaatatattctcatttggaacattctgatcactctgattatagatgcagcagacaaaactcagttttagaagaatcttaacatatagataaagccatgtaacaattttttaaataaagaaatatataatgcaaaaattaattagcaaaagtgtaactatatggctactgatttgaaaacttccacaaatagcaagtaacctatttgaggatgcttgaactcccccctcactggagtcttccacttacctgttgtgtgctgagactgcagagtatgagtctccagaggctgtggccacacacacagactcctgatccagcaagtcctgaacaccaaaatgcggccacttccatcctctgggagaaagccttctgccaccaaagaaacttcattttcacctttcaccaaagtaaacacaagcaaattaacccagtctactttcaagaataattgaaacatttccagaaatactttttaatgcttcttttattacataaaagctttcaaaaatatttttctagatgaaaatccaaactttcatttgagaaatatcactactctgtcatctctaaaagaaaaataggtaatgtgacctttttgccaaacaaacacaaaaacaaaaacaataagctggtctctttaaaattgtccactaaaatatgatgctaatagctatgcttttctaagattctatagtatggggaaaaggcactaaaggatgtaactgcctaaaatgtattagtagaagacataatcaagggaccatatcaaaaccaacccacagaggtttttaaagtacatatagttagagccaacactaaagattctgatttagttgacatgagatgtgggctcaaacttttagaagctccatgggcaactttcgtgttcattcccaattaaaaaccactcttggccgggcgctgggcaggcggatcacgaggtcaggagatcaagaccatcctggctaacacggtgaaaccgccatctactaaaaatacaaaaaattagccgggcgcggtggcgggcgcctgtagtcccagctctcgggaggctgaggcaggagaatggtgtgaacccggggaggcggagcttgcagtgagcacgatcacaccactgcactccagcctgggtgacagagcgagactccgtctcaaaaaaaaaaaaaaaaaaccactcttataaacagaatttgcatgacaaagagggtaaaaagtacggacacactcaaaaagtaaggtcagagttctactgacttaggttaaaatagcagcagagttaagaaggattacgatttaagctatgtctaacatggcatatatatgaagcaaaagatgttatttgggaggatataaattcaataagatataaagaaagaccatgtggggaaagaaatttgaagaagagaaatcaagggtcatacccacatgctggcattctacatcagtaacttactttcttgagacagggtctacttctatcaggccatgttctgaaccaatgagcaccgtcccctttcagttcggagagagaagcactgaggattccctggaccttgaatatccctgaactccaggtccgaaataatttcagatttcgcatgatgaagtgattcccacgagacaagtacaacttcccttgatgaatcattaatctctaagagaaaaataaatagcttaatagtgataaatgacatatttatttaaatgaaatgattcagggggtgaagaagtggtagtcagaatcagaataccaagaaaagaaaaaacttacctctctgagtacacacccatgtatggattatagcagcacctgacccactctatacagttatggtctacaaattaggaattctgaaacctattttatgtctttttaggagaggcaagattctcaactttagaatgttttcttcaaaaaagatgtaattcagttattcctttgggaaagttgaaagaacaaatgaatggggaaacattttatttttgatattaggacatctttataaaatcatgaggaaaaacaaaagggtatcccactgattagcctatttgaaaatccatttttatatactggcagttgaagagaatctgaaatgactttaatttcaccaggtctattcatttataaactggttttatacattcataaaaaaactgaaatcaagatagaaaagcatttactgttctaaaggggaagagaaaatactgggacatgacaacaattacttcaaaatgatgaccaacatttcaaggaccctgatgacctgacataactacttccgtaactttgttcttctggccaggcttttcccaggacaatataaaacgtgagaaaagagtctaaacaagacatctactttggtctggcaaaatcaggcttgcttaaatgcataacattactaagtaggggaaaaaaatgttactgtgctagttatttatattcagatccctttaaggctatgattgtaagtccctaacttatgttaggggtagcaattacaaggaccacaccggtctattgtcactttaatccaaggagacttctctcatcttggcaccccacatatgtatgacatgaaagaataaagatgaatcaatcctaatagtacacagaagataatgtcaagtgtcatagaattatataatatataatgtgggataagagaaaggtaagtttatatatgatggaagtgagaagacaatgattttagtaagttttggtgacaattatattcaagaactgctagaaattattgaacctctaacatatcatgcaggtttttttgttttttgagacggagtttcgctcttatgcccaggctggggtgcaatggcgcgatctcggctcaccgcaacatctgcctcccgggtcaagcgattctcctgcctcagcctccggagtagctgggattacaggcgcccggcaccatcccagttaatttttgtatttttagtagagacagggtttcaccatgttggccaggctgttttgaactcctaacctcaagtgatccacccgcctctgcctcccaaagtgctgggattacagcctgagccaccgtgcctggctgcgtttttcatctttaaacatcataaaaacgcctcaaactagtttctctgaaatttcacacccatcagccttattcccttatcttctcggaggaagcttccctccacttctttccaggctaggaaaggaatatcctccatattgccacaggacctggcctattagtactctttcttggacatctgcaacctccaaccttcctgcctccactgatcaaactcttcgcagttcttaaatgtgctaaagatccctccacaccaaaggtcaatcgtgattctctcttaatttcctgataactgcttcattttcttcccttgctccttcgactatcccctcttggctagacatcacatgcatgattacatataccaggtagatcaccaatacgctgttaggcctaaatgcctagccctgactgaattagcccaaacttaccactaaacccacatttcaacctcctgatagaatcacaagcatgtctcacatgcacatcaaatgcgacctggaaacaaagaacttgctattcttcccccaaatgacagttcccactatttggggacagaccattctactctatgtccccaagctgaaaaactgtctttgctgcctttttgcttactcttcataggatctattcattgattagttccgtggctgtcaatatacagttgaattctttacgatccgtttgtggcctacatccaacaccgactgagcacttgctaagtactgggatctgaagattctcagccactgtctccacggagatcatcgttaacgggagagaaagccacgtaaaacacccgttagatggagaagcacagaggacaccacctccacgaaaaagtctcacacgcgagaaagacccgcaccacagcacccgagcctctattaaccgccgccttccatcgtgaattaatacctcgctttcagcgttattatcaaccccctgcaagcaatcaagaggctgggttaagtccgctggaggggcagcaggcatccctgggctgtcgcgcctcccagcgcccccgatggagcagtggcaaggctgcaaaaagaatttaaggctctaggaaagaggtggtgcagcccgcactccgtccccggcccgcagcaggcagaggaggctccgggtctccttcacccggacaccgccggggagaggtccactcccgtgcccctaccctggatggatcgcttacctgaggacccccaaaagaggtgcgtccggcctcgcctccccagccacgcgcagccggctacccagagtcagctccacagtccgcacccagagtcggctccgaattgcgcacgcgtctctgtccgcggctcccgtctctctccgacggcactaggcctccaaggatggaggcgccctccaggggaaaacgctgagcgctgcaaagaagccagcgactcaatgggtgcgtcaactaggcagccgcagcactggagtgcggcgcgggagtgacgtcaccaggcggagggggcgaggccgggcccgcttctggtacttacggcggccggccttctttgtaggcctggcaccgtagaggtagaggagctacattgccgcgtcccctgtccctctgccctcttgcccatctgcccaaacttttgtatttgatcttgttttgatgtcgaaccccaaagcactgtaattggggggggcgggggggggggtggaactgcggacctgagagcagcgcgcgtgcgcacgacacgcgctgtgcgccggaagagcacgccagtccgggctgcgcggaggaagcgctggggtcccggagggcgggggtggcggcgccggggtcgccatggctaccgagcccgaagccgcggagccggtggtgccttcgctcgtggatcatacttcactcgctggtacaaaccgggtaagtgcggagtgatgttgatccctccttggcgcactggcctaatgctgtgtagactatgttgacagatcataagccacgcgcgctctcccggctctccgtccccacgtcagaaggcactggacttctgtgttccgtctagccccagggatggcatttgcaaagacctggtggcctgaaatacttcagggcgcattctggggccggcgatgcagtgcgagctctagggtgttgctcgcagtaagatgagtactctaaacggaggccccaaggtaggcggagggctaggttgcaacagtccttaagtgcctggagggattgaggggctactctcacagggagtagcgatacataaaattatttaaatgatcagatcgaaactaaggtgaggcagtagggatggcgagaagagggtgggttagattagagacatttagaaagaagaaaatctatacatttaccttaagagacgccatctgccacttagaagtaggtattctttttgactgttttgtgtaagcagaaccagtggtgggagcatcgttggggactctcctttcttccttcattcagtgataatggttatactcagtttaaaaaatatatattgtagcatattttctttggccaaacatagggtgaccaacctgtcctagttcacccatgactgaggggtttcccaaatgtcggacttgcaccaacatcaggacagtcctggaaaccaccaacaaaaaatatatacataaagaacgggatgctaattgcattttcctagcaaaaatactacgtgtactcattttaagtgagtgtaaagtaagatggagcaaggagttaattaccttaatgttgaataaattatctatctgggccagatctctttaaatactttctaggaaacctttaggtatgtctttttgataatgaagggatacccgtgatcagcatgcagcatgtatgtgtccagtcttcattatcaatatatgacccaaagaaagtaccacatagtggtagtaaatattgatttcagccaccaacaactcatgtattcttctagatgtcaaaggaaaattttgtgaggaccactgtatactacagactctaaccggtaagcaaattgggaattttaaattatcaaaaatttttttttcctggtatgtagcctggtatggtcttgtggtcttggattgaacaaatgttcactaaacaaacatgcttaattatcttctactgtgttgaaatggtattattataggagtttgtttggcaagaatggtattccagtgcctggccactctgaacatataaatttgattactcaaacatccaaatggggaccacatcatcagctgctacttgaagtggccagtctgtgcccaactactgaactgttagagcccacagaaagggctacggtagagacatgtatggtatctcgtatacacaggcatgcttatttctttgtcttctaccccagtgctacctacctaaagacctctggtactcttcccttcctgggaaagaaattcaatcttgttttctcttttattattgtattctctattctacattatgccccaatagtagccaaaggaaaaagggggaagatgatagtttgactaaacaaatccagttcatacattcttgttccaataggagttatgggaggaaaaattattccaagcaatacacaggatcaactttttctccttgtagaatatgtgtcatcacattggcagaatctcatcagttcttcaaagtggaaaaacaattaaaagcatttcctatcagatcagtaccaactgtgcagacttcagaacaaggtctctgggaaatttaagcgggtatgttcctgtaattctgtgttatctacttacatcctctatattcatggtaatgacagatccaatgaaccttagaatccgtagcatatgcttagcatacttctctagcagtttgaggtgctaattttaggtatactttacctaaagaaattctcagctcccccaaattaggtatctcaggaggtgtagtatctgttaattaggttctgtgctactatccctataatgcccaggatggaggagggggaaggcaggccttgaaaggagaactctaatagcaatataacaagatattttgtcccttctagttgtattaactagtatgtcgagttctgtaaaatttaggtgactaactcttctttaccatatatttcccatgtaaattaaacagaaaaaaaattcccaagggagttagaaaaaaaaaaagaaaaacagggccggtcacaatggctcacgcctataatctcagcattttgggagaccaaggtgggtgatcatgaggtcaggagtttgagactagcctggccaacggggtgaaaacccatctctataaaatacaaaaattagccaggcacagtagtgggcacctgtaatcccagccactcgggaggtgaggcaggagaatggcttgaacctgggaggcggaggttgcagtgagctgagatcgcacactgcactccagcctgagcggcagagcaagaccaagactccgtctcaaaaaaacaaaaaaaaaacatgaatacgagaaaatatatttgctccttactgtttttccattcctaaagcatgtcaatgtaatactcatgtacccaccccctgtacctgcacacaacactcggttatatagatgctatctctaccctctgtaactctaggcaaaatggacagattattaaaagagtatcagccaaggagaatttagtgacatgttaaaatgtcttaacaaacccactggttgggaaagttctgtggatgatttaagtcgttcatttactgagttcatactaagagtttctgctaattgtctcactattctaggagacccttattcaaacccccctttgtaggcctgaagtcccctaaaattactgatttattgtgctttacaattactgatttttcctcactcaagaaactagtggcttagaaaagcatgcacctctcttaaacgatagtctacaagttacaataacacttaagattctgaagtttcaatgataaatctctgtccaaaatagtaacacttaaggcaggtacagtgctcatgcctgtaatcccagcactttgggaagccgaggcgggaagatcacttgaggccagaatttgtgacaaacctaggcaacataacaagacctcatttctaccaaaaaaaaaaaattttttttaattagctgggcatggtggcatgtgcctatagtcccagttacccaggaggctaggtaagaggattgcttgagcacaggagtcaaggctgcagtgagccatgatggcagcacgcactccagcctggatgacagaacaagaccctgtctcaaaaaaaaaaaaaaaaaaaagtacactcctgttacaagtgaagaacagagagggacctgcatattgaacccactacagtaattttcactggatctcagaactgccaatcattctcccaaaggaggtgacaaaaaggcatcaaacatttctgctgttttggcacagacctagctcttttgtgtctgctcttttaacacaaccttccccttccttccaaaagcagaaagtcacaatgactctagtattttaaaatgaagacccacgtgcggaggagtgaagccaatatagtaatatctgaatgccatctaaaaatgtttgagtggtaaataaaggggtcataaagaatagcatcttaacctgaaatgcctatgtccacacaggaaaaattcatgggagaaaagagggcaacacatgaaacatgcctgcactggctctatgagcctccctgtagatacttgtgagagcctccccaggtatatccatctagtggagtaatgaaacaataaccatgccatgacattcaaatacatacacatcaaaatgtagtattgaccatgggtcaattatttttattttgctgcttaaaacttttgttttccacattttcctcaagtgcatgtttttgtttttgtttttcttaactagaaaaaatatcccttactaacacactgggaattacaaaggggggggggggaaagaacaatatcccttcttcaaaaagtcttagtgatgaccctggtaaataagttcctttatctattaagttctaatattaaaatgaggtagaaacttaatgaaactaactttatacaatattgctgtcatactgtgtcatgttgaattttatatgtttcttgttgatggattttcccatacttttgaaatctttatacctggttatatgtagtttttcatttacagttgataaaatatattatcagtctgtaaattcccatttatcatgtgcttagcttttttccctagacctaggatggcacctggcacacagtaggtacttatattcaataggttctgaaattaatgaatggtttttatatactgaagtaactgatttaaaacaccattccaggaatacatcctgttatacacctaagggctacttctcaaaggaaagtggaaatgccatcaactgattacttcttccgtctcattacacagggggcacagtttctaacagagctgcacctctctgtaagatttactgctcagatggtgaagaatatactgtgtctaggtgagtactttttagccaccatttaggagaccaaagggaggtaattttttttcttagaaacaatttttttaactaagtaaacatgctgaaatcttaaatttttttaatagttgtgttagaggactttgatggaagtgaatgaaaacatcctccataagccatctattcttcaagaaaaggtaaagagagagaaaaaatatgatctcatccacataccttttattggtttttttttcatcgttgacagtactaaatgttctttcctttccagccatctactgaaggctacattgcagttgtgtacccaaatttgaagaaagtaaaagcataacagaagggttactgacacaaaaacaatataagaagtcatggtgaaacgcattaatgccacaacagctacgtcatgaggattgacatggacaaaaagcaaagtgggattcttgttacctggcctaaaccatcagggtactaaaggagagaaccagtatatgtaaagcatacctaacagccagccatatgcaggggaggcctagtgctcacttagttttccctctctgtcttcataatgagccttggttcccatttgtctacagcctccagatctggcctgcccatgtactcacactgttctcttgcatctctctaacaactggcagcaaggcatgtttttctgattaaaaacaaacaaagctctttgaagaagatttagaaaatcagaagagttttaagtagccaagtaaaaataatttacccatcatcccataatccagaagaaatacatttgacccttgagcaacataggtttgaactgcaagggtccacttatgcatggctattttcaactataaacgagtcaaaaatatatcattaaccaaacacgaaacccacttaagagcaggttcatatactcaggttccaaagggccaactgcaggacttgagttctcacgttggatttgggtatatgtggaagttcctggaaccaatcccctatgtaaaccaagggataatactacattttaacctacttctgtttgaacatatggtatggttattgcttttgcctcgtttcctaacagtttgaagtttaaaaaaacctaacccacctttcttacccagtcttctatatgtgcctaccaaaaagcctagtcctagcccatctgcctcaactcctctcccttttaggtgtagggaagaggccggagtgtagagtatattatatcttctgtcccccttatgccaacaaatggccttcccctctgaaacaaagtaaaactgcaacactgtgacttcttaaatgagggaatgtgaaaaggctatgaaaaatacaaaggctttcctaggaaatgtgttataatgcagcggaagctaattcttgaaatatgcacattatagttactcagtctcacatactctagttactgcaaagaagttactgagaatatgtcattcaaaggcataggggcctttgaatggaacaaagctttcacatcatttaaagtaaaaaaaaacctccaacaactgtgaatttatagtttaaggtgatttacactgaatttcaaataaaaggactataaaacgtgttatttttctgtaagggtataacatacatgtcaatatcactgtttttaaataaaatatacttttatacagaagaaacattcgatgtattaattccattggttatctatcctcttatgctgttgaagtcataagttccccttcccaacccccacttgctctttctttcactagagaacagtattttttcaggtatcaaaaatattatctaatgaaagtacaagtgggggttggaatttttaagttttaattattacaaaataatacttacttattttgtaaataaaacaacattttggttcataggaaaaactgtaatctgagtgccagcatgactatccccctaaatataccccccagacatgatacatgtgtaagtggataaacacctccatgatggtgctattagctgaaaatataaacaaaccagcaatcctcactttaagtagcacaatgactcttgaaggcgtcataaaactatgacagtaaactagtaaaagaattgtgtataacattttacatgtaacattacctcacatcattctcccatatttctattgtaatttaaaagagtactttggtttcagagaataaaaatcatgcttaatgttttgactgtttaaggaaagattttaaaaaggttattaacagagctgagtgcatcacatttctcccgaaggactacagtgaaaattttcctcaataaaatattgactagctgtggtcattggcattactgtggttcttccggatcttttgtgaatactgattgtggtggctgacccaataaagatcatcagataagcttatattatctactgccatttgataactgacataccctgtagatttcaaaatgaatgtcaaagcattaagatacaaatactacgactgaagtctaacaaaagttggccatactatattataaggagaaaacctataaaccagatccttcaatcatgacccacccacaaaaacaagaaaagctttaaactcctaaattaaaaagactaaagaaagatttttttgttttgttttatagtgaacatttcaaatgtgtgatattcagaatttaaatagatcttggcttccttattctgtctttgtcttccattccatcaatcaatactgagaaagttcaaatatcttttaagtctataagataggcttagaatcccagctaatattcagggcagactgccagctatgctagaactagaaccaaaaacccatctcatactctccaggagttgttccagattctgtggagttccattaccttacttttgggagtaggtgagggacatacacagcacacagacccacccttgctgtacaaaatgcttattagggaacaaacttgctgctggcatggaaatctgggacagggtcatcaaggggatttttgtcacacttggtaaacagagggattgaaagtccacaggtttaaggaaaaccctgcattcacccagactactgtatgtttgctgctgaattagtgatctagatgataaagaaaacagttaaggtaaaatatgccaaagctaagcacaattcaaaatagcttcttgtggattaaattgtccttgagacagttgggatatttggtttgcttttaaagaacattagtgcaatgttctattttaaaaatcacactacaattagaatctacaattaccaagacatttattagttgtcaaaaagctttacaatcagtttcatgatcagaaatagagcaaaatttcaatattgttttctttataaaattgatgaatttctgaaaagataaggatcatttgatttttaaaaatgtcagcttcatcacatgatgttccagagatctgacccaaaagcttctcaagttttactatccatagtgtccttatttgtaactgagacccatccgtattttccatctgaagctggaaagagttaagacaattagtatctggtttcactctgaaaaaaaattacaaaattaagtagtaactattttcttttaaaccattttttaaagtatgagtcaaaatagaaaaactacctcaccttcttcagcagtttataacaaagtgaaagaagttggataagagagccatcatggatcttgtcttcgtaatacacttgtcaacctacaatgacaaaagcatgcaaatgatattctaaaagtagtacttaaaagaccttaccatttatttagttttacatgataaaatttctccatatggaaatctaagggatcttgaaagagatatggatttaggacatgagctgactcaaagccccaggacacaggtgcaggggtagctgcctagatttcatgctatctcatggaaccccagcagaaagagtgggtggaaaattaatcattctactgcaggcgtttaggggcttctcaaaacactccaaatagtggaattaaatcccatcctttgcaattcttgcactctattttgtgggcacaaacccatattctctcagacaaattatgggagaccagctcggaggcacctgtgtcctagttgcagaggtaatgacttcagaattgaagggcagctgtcagtgctatggaattaatgatgtccaaaaaactactttatttggtgaatctgctactcctggggtcagttatgagagtagataataaatgattcttgtagacaaggcatgaaaaaagaaataaattgcccttctgtgggtactaacagtttatttgaagaaaaaggggctttaaccgataaagatagatgtgtgaaagtttttcatatgtctcttttacctttagaaatactttatctgcaaagaagtcttagttactgtctggagctggtggcatagaggaattagcttgttttttccaggagaagcataagcttgtcatcgtctttcagctgaaatgtaatttaacaagtttaacagcccgcaacaaaactccatctttaataccttaaacacatttatacattgatatttacccccaaagtaggttatacataataccaccaccagctccaggtaggtagacatgtgtacctgttttgaaaaagcttgaacactggaagtaagctttaaaccctctgcagcaaaaactggtagaaagagaaaacaccactattttagactgatgtctatggatagttggtaagaaaatacttactaataatttttacgtagaattttaaaaataaagcctagatataaaaagtcttcaggaactcctaaactttttccagtaccaggaatgcacaagggtttaactgttttcagaggagtttccacagaccagatgcagaatccatccctggagaggcttctctacaccagactccaattattctggagggtcacacagacctgtgatattcagccacacaaattatgtctaattacgcaagggacctagagctcatctcaaatatgctcaattataaaaggatgatgaatttcaagcatgaggtcaaaagggttaggaccttcccaattccatctaggcaagacaaaattgtcacccatacatattccataaccagacatttgagagaaccaatccaggtggttggttttgttgccactttttttcagattaattttcactattcaccatgtaccatgaattctatatttaatgagatgaacaggatgatggagaagtagagtgaaaaagaaggttgtacaggtaaacagaagtatttagcatattatgttaaaatggtttgcagactattttagagtgagatgcaggggagtaaagggaggaaggcttagttttaggtggcgtcagtaataatggagagaacaggaaaatctgagagtggtttgtgaatgaaaataataggtcttcataataaattaaagaaactaagaaggaggaggcaataattccagggttaatttttaccctctattcaaaaggcttacaccttgctatcactggataaaatgatctcaaggtcaaatcgtactttgcaaccttcctttaaaagggaaaccagtaagctttacatctagactccaaccaaatgaaatgattcactccccaagtgttccttatcacttcatgttaccactttctattctgcaaattttctctttcttctagcctgcaaaccccttggggacaaaatccatgtctgtctcatacagtatgatggtttaaaactacctgaaagctggtaactcccaggtctctctctccactcctgaactatcctacatcagtcttgtacagtcatccctcagtatccatgggagattggttcccagacctcccaaggataccaaaatctgtagatgcttaagtcccttaaataaaacagtgtagtatttgcaataacctacacacatcatcccataaactttaaatcatctcatctctaaattataatatcaagttaatgtaaatgctaagtaaatcgcagttatactgtattgttttccctcccttggactctaaccttttaaaatgtattttgtttttttttactgttgttatattttattggttttttccttttttttttttttttgagacagggtctcactctgttgtccagagtgaagtgaagggtgtgatcacagctcactacagccttgacctcccaggctcaagcgatcctcctgcctcgctgcctgagtagctaggattacaggtgtgtgccaccatgccccgctagtttttttttttttgttttgtttttttgtagagacaaggtctcactatgttgccccagctggtctcaaaccctggactcaagtgatcctcccagcttggtctcccaaagtgctagggttacaggagtgaccattgtgcccagactgtttttactgttttgaatattttcaatccatagttggttgaattgcagatgcaaaacctgcagatagggagggccaagtgtatatcctatctgacctttgtattaacatgtgcaaaacaaaatgctcgatttccaccctctaaatctagtgttctccctcatgttccctgtctcagaaaatggcactaccactcactctgttggccaagccaaaaaccttcttaaaacataataggatcagctgggcatagtggctcaggcctgtaatcccagcactttggaggctgaggcgggcgaatcacaaggtcaagagatcgagaccatcctggccaacatgggaaaccctgtctctactaaaaatacaaaaattagctgggcgtggtagcgcacacctgtatcccagctactcgggaggctgaggcagaagaatcacttgaacccgggaggcggaggctgagtgagccgagatcgtgccactgcactccagcctgacaacagagcgagactaagtctcaaaaaaaaaaaaaaaaagtccttcccatggcctacagagacatcatattttacccctttcttctggctcacttcactcccatcaataattgcctccttactcttctgatacacccagcctacccctgcacctcggggctttgcacttgttttggctatctaaaatcctctacccacattatccatccaactctcacttcattactgtctctattcaaacactggctccttagagaggcttttctgaccacccctctatcacctctgtattctagtcgtacgtgattttatctccaatacttacatatgtgcactgaatgcttaaattcttattgtctatattctgccattagaactaagctctatgggggcaggagctttgctttgttcacttttctccacagagctctgttctccagatctgacatatagcacaagttcaataaatatttgttgaatgaagtatgcaatttttgttcatcacagtttggagacaattcattgaacattgatttaatgactaagctcacatagaagaaggtaagtagtggatcttttgtagtaaaacacccctacagggcggtatgacagatggacttgggccaaactgaaaaaaaaaataaattcagaatttcaactatcttaagggaa

SEQ ID NO: 5057 - DNA, 84502 bp, Homo sapiens
  misc_feature 4422, 4423, 4424, 4425, 4426, 4427, 4428, 4429, 4430, 4431,4432, 4433, 4434, 4435, 4436, 4437, 4438, 4439, 4440: n = A,T,C or G
gttgttttgagacagagtctcactctgtcacccaggctggagtgcaatagcaggatctcactcactgtaaccttcacctcctgggttcaagcaattctcttgcctcagcctcccaagttctgggactacaggtgtgtgccaccatgcccagctagtttttgtattttcagtagagacaggtttcaccacggtggccaggctggtctcaaactcgtgaccttaagtgatccatcagttcagcctcccaaagtactaggatacagatgtgagccactaagcccagtctttttcttgttgtttttctgagacagggtctcgctctgtcacccaggctgtaaggtagtggcatgatcaagctcaccgcagccttgacctcccggactcaagtgatcctcccacctcagcctccttagagctgggaccacaggtgtgtgccaccacaccaaacaaatttttaaactttttagtagagtggggttttattgcccagggtggttttgaactcctgggctcaagtgatcttcctgttccgtctcactgtctcagcctcccaagctatatatatataatttttttttttttttaaagacgggtctggcactgtcttccagactggagtgcagtggtgcaattacagctcactgaagcctgacctcctgggctccagtgagcctcctgccttagcctcccaagtagctgggaccacagtgtgcacaaccatgcctgactgatttttaaatttttttgtggagatgggggtctcactaattgcacaggctggtctcaaactcctgggcccaaacaatcctcccaccttggcctcccaagtgctgggattacaggcgtgagccaccacactcagtccaagcttacctttttacatgtttctataacatgtaaagggttggaagcactggtttagggaactgtgtcttatggaaatgtatatttttaaacactggactcacaattggctcagtggaacaatgacattatgagaaaccacagaaatgaagacccccccagggaagcatatatttgcttatttctgagtatgcagagtgaattccagtaagtgaatctctaatagaaatagatctctagccagatgtgggttgcatcctgtaatcccagctactctgaaggctgagggaggctgaggcaggaggattgcttgagccaggcattcaagaccagcctaggaaaaacagtgggactctatctcaaaaaaaaaaaaaaaaggaaaccgatctctaggtctaagagttaatgctttgaagttgcttaaagaaaataaaaagcttatcttttgtagacattcagaaagaagggaagtctatcaaacagtcacactctattattgcaagctagttcatttatttgtctgaaatacatttccccacgttgtccaatgatagaaagaccaaagtagaattaaaatcaaccaaaccaaaacgaacaaaaattcctataaattctatcttgctttattagtaaagacttcagtaatagctcttctgcttctttagagtttagtataaaattacagattttttttttaggtgagaaaatttgttattttagccaagccttaaatttgccatcaatttagatgatgtaaaatttgagttgtttcccctattgttaaaataataggctgggtgcagtggctcatgcctgtaatcccaacactttgggaggctgaggctaggggtcgcttgagttcaggagtttgaggccagcctgggcaacacagtgaagccttatatcacaaaatattaaaaattagccaggcttggtggcacatggctgtagtgccagctctctgaaggctgaggcaggaggatcacttgagcccaggagttggaggctgtagtaaactatgatctaccactgcattccagtctgggtgacagagtgagactctgccgctaaaaacattacaaaagtaaacagattattgtctacccctgcttataatatctaagagacaataagctcatattaaagaaatatttgagaagttcttgaatattctatgtcattaaatgctagctttggttctgatgacaatggaaccatcatatcaaatctggggtgcacaccttcgacatttatcttatgagaccattgttatttaggttctattataggcagtgaaacttaaatacactatgggttgcctcgtgaattcttactacccacagatgttacagtcactgtttttacaattgaagaaacaagtttcagggaggcaagtaatcagctttggaaacagcaaggagacactaagacaataggctggaaagagactgaggccaaatcatagcgaatcctcaatgtcctctgaccagtgatggcagcatcagtgttcaagaaaggttttcctcatagttccatgagggataaattgtgatcatttaaagattattgtgttaatctatgcacaagataagagtacgagtagaaatctgcagtaggtaaaagtgaaaagactttgtgatccattgaatgtgatgtgggagccaagataaatctttttggagtactgctcctttatgtggtaaaaaagatatctaataagacttagtgctcattttgtactttgaaaatatatccattacaataaatatattaacattgaacacttgcagattaagtgccatattttttagtgaatttccatagattgtttcctttggtattaaaaatgctgggcatgggccccactttttggccgaaattcctttggaccaactttaaccagttggcctctcttaattattaacacttcctgttgtctctgacttttctgtttcactgtccttgatagatacttatatttccaaatttatcctacttgtataacctagcccatgcttggcaccaagctacacatttagccaggaacacatggggttatctgattagtgcagatggctgcagatacgaattttggccaggtaataataaggaagtatacctaggcccaaggagaacagacctaaagctttccatgggaaaccgataatatcaacagtgggtcctgtgggttgatggttgcaggagcaggagggcaagcacagaagacagcaatcttgagggtttgtgtaagaggatttgtggtggaaaatcagagtttgagtcttgggtccaacaatttatccactatgtgatttatggtaaattatcaatgttctgatttacaaaagggatataatacctccaatgtaaaattgcttataagtaggggctccataaatgtttcttgaatctgaattttcgattctgaccaattgaccacaaattgaaccaaaatggaccacagcaatcataaacataaaaattaggaagaattccaacagctaaaaatttttaaataaatagcttatgttttaagattaaataatgtcaatatgtctttgttatcaaattaatagtatgagggcttgtttagtaaaaatgctgagaatactttttgatttggaaaaatacatacaaagaataggtgggaataaataagattctgaaaaagaagacagggaaccgatgagagaaaaacgtggtgacaaaatgctctaacaaatattaaaacaaaactgtaatagtgaaataggtgaatgggcacagaaaacagtatattctagaagtagaccctctagtaaagaataatgcaagattaaaaaaggacttcccataaatcatattcaacttatagtttgggatttaacaatttggaaaaaaaagcctaagtaatgtctcatctcataccacatcacttataaaaaaaataaaactggaaatagaaacaatggttattattgagactgatgtaattttgaggagacagtagagattacaaacgtggaggcaagtgctgaaagatctgattaagaaaaaagctggccagaaatggtcacgcctatataatcagcactttgggaggctgaggtggaggattgcttgagcccatgaggttgagaccaagcctagacaacacagtgtggaccccatctctacaaaaaaagaattgcaaaagttaggtgggtgcagtagttgtacgcctgtcatctagctacttgggatgctgaggtgggagggtagtttgagcccaggaggttgagaccagctagacaacacagtgtggacccccatctctacaaaaaaagaaatgcaaaagttaggtggggcagtagttgtacgcctgtcatcctagctacttgggatgctgaggtgggagggtagtttagcccaggaggttgaggctgtaatgagctgtctgtcatcaggcttgggcagcaaagcaaactctttaaaaaaacaaaaacaaaacccctgctctaaccaaaataactacagccagaatacaaagtattagcactactctataattcaaggctcatacaaattgggggggttggnnnnnnnnnnnnnnnnnnntagaccctactagtaaagaataatgcaagattaaaaaaggacttccataaatcatattcaacttataagtttgggatttaacaatttggaaaaaaaagcctaataatgtctcatctcataccacatgcacttataaaaaaaataaaactggaaatagaaacatggttattattgagactgatgtaaattttgaggagacagtagagattacaaacgtggagcaagtgctgaaagatctgattaaagaaaaaagctggccagaaatggtcacgcctatatatcagcgagactctaaaacaataggggtgcagtatgtacgccgtatcctactacttgggagctgaggtgggaggatagtttgagcccaggaggttgagaccaagcctagacaacacagttggacccccatctctacaaaaaaagaaatgcaaaagttaggtgggtgcagtagttgtaccctgtcatcctagctacttgggatgctgaggtgggagggtagtttgagcccaggaggttaggctgtaatgagctgtctgtcatcaggcttgggcagcaaagcaagactctttaaaaaacaaaaacaaaacccctgctctaaccaaaataactacagccagaatgacaaagtattagcctactctataattcaaggctcatacaaattgggggggttgggggagggaaccaacaactctaagcaaattccatgagtttattatattggcacattgaggttctatgtaagtaattttgcaagtttgctgtggtagttacaggtttggatttttaggttaatatcttttatctgaagtgaagatatgcatatctgcagtaaaaagaaaccaacagaaactaaggcaaagaccaaacgatcaactttggtcattagatgcttttctataaatatgtatattattcagtaatacaataaaagtaaaaaaattttggctactttaggaggcaacgtatatatgtcttctggcctgtatgtttactgtaagttgatcaaaggtaaattaaaaattcacacttgagtaaaaggtttcagaagtaccaggaaagtgtgcagcttatttttatttattttaaaaaaattatttttattttccaggaggcccattgtcaccagaagtgtatagtttctaacagatttatacattggaagtgattttgctcctaatttcaacatgcctaatgaaataaataatcaaaacagtctaaaatcttcctcctctctgcctcctgcaaaaaggtaagcacctaaagtaggcaagcactgaataatgactctggtcagcactgacaaattaattgcctctaggaggctgaggcaggaggatcattgaggccaggaggctgagaccaacctagggaacatagtgtagaatcctgtctctacaaataaaaaataagtaaaaaataaaaaattagctgggtgcaatgactatgaatgaaagcaaatacagacctttagaaaatatttttattttcttaacacacagaggtaacaatgacatttcccactagacacagtagttcaagacatatcagaaatggatcacaattcacatgttacaaattcatcaatatgaccagtctcatgttttcccaattatctttgaaaacttattaaaatacacagcatactaaactggtaaattcatttatcatgttaaagagtaattttgattttgatagtgaaaaaccaaggcatagtccattgttgaaatacaataccttatccagcatcactcagtatgaagcattctaccgaaacgtttagtcaaatgacacctgttaaaaatctaattctgattttaactaccatagaggaaataatgtttaacatgccttcttaaactttaaaatatacacgcagaatataacaatgttctttcattaatcttcctcattagaaatatgaaccacttattttctagtgcaacacaatatcctaaaaatttaccaacgtgggtatctgccttactagaataaccccaaatggctacattaaaaaaattgtgaacttttaatttttttggtcacatttactgtcagcgattacttcttgctttgattaaatatgctggttttctgttacctttcctactccctgaatatcaaagttagggtacagcaacaaaactacataaacctttgataaactatggttctctcaaggacagtcattccttttacccgcacagtttagagaagggtatatattaacaaggaaggaactgaagaagaaagggagatttggaaaccaatgtccaatgtatttatgatagtggtcagattactgtcacaactgtccttaaatttgtaggatttaatctattttattttggaaaccagaaaactaagctagttaaaactatttctaaagcaaggtcagctttgagaagagcaggcagataatcttaaagtaaattacacgagctttcaagcatgggtatttgaatctgaagcatttatatatttttgctgcccagaagttttagtttgctggttttcttcttaatttcttagtcatagttaaggttttgggtatgtaacctgtaaactaactaaaaaaatgtactttgaaagtagcattattttaaaataccattattttattaggtataaatgagccacgaatattatatagcaatgaaagaattcttgccactactttcttccaactgaatgcataagatttaactgttttcttaagaaaacagtaaaaaacagtaaaaaattctatctaggaaatagttctatgaaaaaatgttaactcatgtaaatgttaaaaacctttttccttttgtgacttaagatttttaaggcatcttaaaataagttatcatgaaaaacttccagtgattttattgatttaagatatctactgaattcatatccatatttttgttaagattcttctcaatgttaacttgtcaatgtaggttttgagttaatagaaaaccagtatctactatgatctagcaatagtttttgaacatgactaaagatagttgagttttagaaaactaatataacattcttttttcttaaagttctagaaatatgaccgacaatttccattttgaaaatgtaagctatcttataaactcaatagaactcaatactaattttacaaaactgtttttaggaaataaatttcctaatctttgcatgtttcctcacataagtaaatcatataaaatatactgttggcattcattacaaaaaattaatatatcagtgaaaaaatgaaagcatagtttgaacatctgtgctccatttagaacatatattgtagatggaaacttctatcattcatcatttattaaatatttattaaatcagtgagcactgtattaagaatactatagtacgtggtgttaatattaatgaaccacagctattcagtatgtattgttactgaagattatatataccacaattaaaagctatcttttcattctttcattattttcatattttattttcatttctgtacaaatagaagatgacatgattttcttttccaaactatggatttctaggcatttgaataattcttactgaactcaaacacattcattggtaatgatatttctttctgattcaaattgaaatctacctctgtacattaaaaaaatcaatgcttttacaatcttacctaattgagcatcaatattataataaatgagattttaaaacaacttgagcctgtgcatataaggcatttacatatgatgaccttgcatcctatatacaagtaattgcatacttaatatctgtaataaactataaatcataaagtgtctcaagatagtagcaattgaccaggcttgtgtttcacagctgaaaggacagtactgggcattctcatggtcagttctggaagtcctttccaaggggatctgaatgaaagaaaagacattttacaagacataatttaattcatattaacaaaataggcaagacctggtgatttttgccttctagttagaaaataatcatatgtagtcatttgctacaaaataaaacaatatcctaaagacatacaatgaatttagactgaaattattctttgacattccatctttggaatttgagacttttaatacaaggaatccctttatgtattaaaaacatagaagaaactaccattacaagctacataaaacatagagataaatactctctcaggcataattttgtttatgagactcaaattgtaatatgcagatgtgttatgtgtgatcttgataaaactgtaaaagtaaaagtaatgaagaaacctaagaactatgattaggcggaaaaatggcattccagaatactttctacttaaagaaaaaatgccaattaatttctctttctactgaataataaacttggtatttattatgcatttatttctaatactgcttttatgtatattatctcatttaatgttcacagtaaccctgtaaggaggtaccataagtattcctatctatagagaggtaagagagatttatagaggttaaataactgttccagccctccttatcagaacacagtgatgttagcacatcaaatttattgttaattcaatgtaatcccttaaaaatgaaaacaaattcaaaaagtacagacatctgtaatgtttctttttaagttgggttgtgggaacatatttgtttcattactatggtttgtatctcagggcatattacatacacgcttcagtgggcatcaaatacttcatagtaaaaatgggaaaaaatatcccattaggtaaaacagggtattttggataataactaatatcagctaggtaccatattaaaaaactgtcatagaaacatggaaaatatagaaaatgtatgtttccaagtattcaagcacatcagagtaaaatgccaaatgactgaagttggatacctgggcatctgtaatgtgttgattacatctccacagaatttgtatgttgaagtcctagccccgagtacctcagaatgtgacctgtttggaaatcgggtcactgcagatgtaattagttaagataatgccacatgaagatggagttttgctgccacaagccacaggattatcagcagctaggagacagggctggaagagcctttccctaatgccttcagagggagcatggctctgcccatgccttgatttttcagattctggcctccagaactgtgagacaatattctgctgtttaacaatttctattatttaagtcctcagtttgtagtgctctgttactgcagctctagcaaactaacagataccaaaattaaaaacaaaatgaggttacaaaaccatgaatatgctgcccataattacacttggacactaggcatggaatgtatccatacaaatataaggaagtcccctttcccttgctttcctgaaaaatcatcctgaagtcattaggtgggacagagcaaggtaggtgaccagaaatggaggggaaaggtaataggtagtatggagcaggatgttagagtccaagaggtatgaagagggagtccaccagggtgagagtggtccagagtgggtagttagaatccaagtggtgccaggagggctccaccatagaggtggcttactgtggggtagcaggcccaagctgggtgagcagactctatgtggggtgatggcccaatgtgggaagtaggttattcattgttggaaaagggaattacaaatatgaaagggagaaaaatagaattaaacactgagaaatagcttggaactggtgtaaactcagttttcaacacacatagacaggatacattgagatgaagataagtgtgtatgtatttactttgtttatgtattattatatattccctagccctatctactgggggtcatagtaataataatacaccatgtgctcagatctggcttctaaataacatttttcactataaagaacaagggaccttagagaattgcccaattccaggctggggtagtgaaagtgaaagatgagtgttgaaaccttgctgggccagaaagcaaggaaggacttccatatgtgacaaacaggaagtagtatgacagaatttccctcctgtctgatacaactgaagaactggacattaagacattagacattggcaacaaatagcgatccttgaaggatgagaaacaaatgaagcaaaccctatgattacctaccttactgccttgagagtttccaggatttggcacagagagggggaacacaggtggagctggcagacttccttgagttgaactgagaatccaggaacactacaaagcagctacaattgcaggatagagtactagagaggaaggagctgtacaaagagagaactctgaagatatgcaagggtcccactcaagtatctgtagtgtaccaaccagcaaattcacaagaggaaactaccaagaacaaggaaagaaccatccaaaaggatgagaagaagcagtatgtggcactcatacacgtcaggaacacttgcttgttcccaccagccagatttgaaaacgtcataattttcgaaaacagggtagggaacacagatgggtcttgattcactaatggagaataattattcctagacaaatgctattctggtcaggtctaacaagcttaaaatcaagaccagaaaggatcaaactgttccaagtaatttcactgcattccaaaacaaagctcaaaaacatttacagaaacaccaaaatctagcacccaacaaggtaaaattcacatctggtatctaataaaaaataaccaggcaatggctgggtgtggtggctcatgcctgtaatctcagcacttcaggaggccgaggttggggactgcttgagcctaggagttcgagaccagcctgggcaagatagcaagacccctgtcgcccaaaaatcaaaaaacaaaaactaccaagcaaagaagcagggtgatatgacccaaaataagagaacaatcacaagcaaaagcaacccagaaatgaattagcagacaaggatattaaaaagtcactgtaatcatattccacatgttcaaaacattaagcagagacatggaagatataaaacagcccagataaaactttgagaaatgaaaactacaacgttgaaatgaaaaacaccagatggatgtgatggtaggttagacataaaaatgatgcagatttcttatcaaaacaatgtaccaccttaaagtatgaaagagaaaaaagcttaactttgaattctatacatagtgaaaattctttaaaataaaggcaaaacacagatgttttacacttataagaattgaaagaattcatatgaggaggcaaacactacaagacatgatggagaaagtccttcgggtagaaggaaaatgtacaagatggagatacagaacatcacaaacatatgaagagcactgaaaatggcaactatagagtaattagactttttaatatattatttaaagatcattaaaacataactgactgcctaacaaatgtagtaaccatgtagtgtggggggtaataacaggtaaaagcaaaatggatgagatgatagcacacaggccgggaggggaaaaataaaactatactattttaaggatctttaaccttacttgaagtggtatatcactggaaggtaaactataaagacatatactataaaccaaagcagccattttaaataaacaagaattacatctaattagccaacaaaggagattaaatgaaataataaatattcaatgcaaaagaagcacaaaaagaggaaaaagctaacaaagaaagacagaataaacagacaacaaacatttaaatttcacaatttcagaccttaagtgtaaaggtctaaatattccaaaagcagaaactgttgtgctacacgagagcaaggcccgattacagctactatgtacaagaaagccactttaaatacaaagacataaatagcttaaaaggatggaaaatctgtaccatggtgacaaccaaacaaaacagaccaggagtggctctattaatatgaacacgcagaagtcccttatgtgcttgtaagaaaggagataaaatttgtgctgtttattattatctgaggaatagaatatagatatacttaggtataatctaaaatttgaggaattaaatacactctgaatttatactcttataaagatacgtaactctgacactgtctatttgctataattaggacaaggaagtgaaaaatgttttttgaactaacaggcaaaagaccagttctgtattttaactataatgaaagcatttctgaaaactatttcttgatatatctttaaatcaataactcaaaaggcccaggctgagtaccttcagtttttatatttatcctgtgctaaccactccaaaaacatcagggaaattttaaaaatcaaagactattccacatgtataaatcgcacatatcaagacctcaacttaaaataaataacaacccaaaataagagaaagtgaaaattattaacagaatttgtcatgttaaagaataaaggcttcacttttcattgggatacctagggctacagaaatcaattctaagaaactgtaatttacctaatagctaataaactgactaaacatagttatggaaattacatgctcctgatgacttacctctcaagatgaacataatgtcgggaagaacatttttaaccaaaactatagtctttgcagtagtctccgggcccatcaatctggaaaatataattttgcacgaagaaaatacccaataggccacagccactcctaaaaaagatatttaaaagacaaaaaaaaccataaatacctaaaaattacttgaaaaataatttaaactaaactcagaagataaatgaaattcttacaggtccttggtgataattgaaacctttagcagattgtagttgtcattgtctaatgcattgtcataaattccacagtaaaccatatcactgaaaatgattgaaatttaagttaaataaaagatgatcagatattatgtaaaaagcattagaaaatttcaataacaaaggtaagagaaataatcaattattttgtcttctacagaataagtcggcattagtacatcatccatctaaccttaaattagtacatactgagttcacaggacttaatcatgtgttaaaaatgattaacaaatactggttaatataaaaaatgtaaaatattcggtatcttgccttaaagaagttagcctggcactaaatatggcttggtttaaagtcaacttttcctaggcctctaatatattgaagcctatctaataattgaaatatatatagaataattgaattaataaaaattaaagacatggttttattaattatagattggaaaggtgatttttagcttctccataaaattattttaaaattaaaattggcctattatcggattacaaatagcactgaatatacatattgctttattgtaatacatggaacttataacacagttatctatacccatttgttacttttctttttttggagagctggtcacaagagtcagctttaattgtgagtttggtgtgtgtgtgcgtgtgtgtgtgtgtgttttaatacagtgtctcattctgtcaagaggctggagtgcagtggtgccatcatagctcactacagccttgatctcctgggctcaaggatactcctgccttagcctcctgagtagctaggactacaggtgtacacaatctctcccactaattttttttttaacttttatttttgtagagatggcatctccttttgttgccctggcaaaaaaaaaaaattatggttgatgtcaatgtatttggattaaatatgataacattcttatacttatattccaacttactctggatctaaagttttcatgccaaggggaccaagcaatttttttctgcaatctccaaagctttccatgctttttctgtagtaaagagctcaggggcctgtgaatgccaaaaacaaatatacaaatttttaagatcacagaagaattagttcctaccccagaaactattcataagcttgaaaaaaattacttaaaataccatgagggtcagaatttggtgtagatgcctaaacagatctaatcctatgaggctgacttagaaggactgtttttggcgtagaagttaggaaagcctttagaggtgattatttctctgtgtcacctcaagaaagttatcagctccaaaaggaagttgccacagctacactgaaggcagaacacacttttattttaaccctttggagacagggtctcactctgtcaccaggctggggtgcagtggcgagatcagagtcagtgcagcctcaatctcctgggctcaagcgatcatcctgccttagcctcttgagcagtgggactacaggtgtgtaccaccacaaatggctaatttttttttaaatttttgtggagagaagtctcactatgttgcccaggctgatcttgaactcctgagctcaaatgatcctccaactcagcctcccaaagtgttggaattacaggtgtgagccactgaacccagacagcacacattaaatttatgtaactcattcttcagcagattcataatagctttctttaagtacatctgtacccattgtttgcttctggggccataaataaacacagaacttttactccaatagcatggtaaatttatcagagatacagagaaagaagagaaaagcattgttgaccaagaatatgcataattttaatggtccacgctgaaccaaagctacctttgtgtacttttacacttttcatttactataatttatagtagtaggtttggtactctttttgacaacgtgaaaacagctagccggcatagaagaacacataccttctctattttacttccttgtagtttatttttagactaagtatagatttaaaacagcagagagtctaaaattctttgccggacaaactgattgcagcatgcaacaatgaaaacagaatgttaactaaagctatccactttagttcactagttcagggtttccaactagtgtgctgaggcactggttatagcacaggtgtgtaggatacagagaccccagctttcagggtagctgggtggggcctggggctaactgaagtagttggatctagcacagcagcctactccatgtaacctattgtgctatacaaatatcattttcttttcttttctttcaaatatggtggtggggcttcattatgatatccaggctggtctcaaactcctgggctgagtgatcctcctgcctcagtccgccaagtgtgtgagccactgcatctggccacaaataactcttctatgtgtgctctgaatgtgaaaaactctaggaagcacttcattagtcatcatctttactttcggcttttggatactgaatgttacaggttaaaagtgatacgcataatacttgttaattaggaaagactatttaaaactagctagtaagcaatatactactttttagcaatgagtgaatttgaaaacaaatgggaataaggaactaagcaaactctagcacatcattttttaaatgtttttacaaacgaatcacctaccacaaccattgctatggtaaaattaggcctgactgatagtcacaccaaggacttgaagctccataactatctttgtatatgccacgtttgtaaccagatttggatgcttttcatttaaatctgaagggtcttcggaaacatgaaatagctttcaaagttgtcttgtatttttctgttccactcatcatatgagacctttatagcctttctgaaaaatgacataagacatggtagttttaatcattcaaaacaattcacacatctagttcagacaaatagtaatatttagtttatttttatctactacaaggcaataaattatccactttggaaaatgtggccagtctgaattgagatgtgttataaatgtaaaatataagctggatatgaagatgtagcaccacccaaaaagaatgtaaaatagctcatgaataattttatattgttacatgttgaaacaatatcttatatacatacactgagttaaataaaatgtcttttttttttttaagacagcgtctggtattgtccacccaagctggagtgcagtagtatgaacttggtcaccgcaacctccgcttcctgggctcaagccatcctcccacctcagcctctcaagtagtgggactacaggctcacataaccacaccctactaatttttgtatttcttgtagacatggttttcatgttgcccaggatggtctcaaactcctgagctcaagcgatctgcctgccttggcccccaaagtgtggagattacaggcatgagccactgcacctggctgatttaataaaatacttgtaatcaatttcacctgcttctttttactttttaaaatgtgggtactataaaatttaaattatgtatgtggttcacattattttggacagcactattctagaaaaagacatgtaagattgcaaaattgctcacagaaatgcaacttgctcagtcacagtgaggaaaaagacatgacaataaaggcaacagctatgctgctttcttatctcagttcaaagttgcgacaaatatgttcaactagaattgttacaattttcacactagtaaattaatgaattttctttcttcttattttaagggttttccgatattagctgatagaatcaaatgatgattacataggttgagaaatacatagtacatttgaaggttctttgtaaataaaataaccagcttaccatgtctttttctgtgacttcatgataagggaaaatattttttttggataattccagcaaccagcgaacacagatttactcaggcccacaatttccacagcagacccatctctaaaattaaaaaacgtattttattctttaagttggcgtcctttaagtactatttaaagggcattcggtaaacaatttaatgaatcatataacatattatgaaaactattaaaaaatccttactctataggaatgttactatatcatgtaaagattttttcctctcacggttttgccattgtctatcatcctcactaattttaaaaaattctatgatgtagaatgggaattgtggaataaaagaagatggcagtggaaaaggtaggagtaaggaatctgaatattgggataaggtactagagaaaagatagcaacatgaaaaatagggctggagaaagtgagggaaggcagacacattaatttgaaagctcattttaagaaaaataaaagggaagtacaaggatctaatgtaccaaatagatttttaaaaactggtaaagcatgtaaagatggcaacttatttattaattattttttgtagagatggggctcactatgttgcccaagctggtttcaaactcctgggttcaagctatcctcccacctcaactcccaacctcccaaagtgttgagattacagacgtcagctaccacacccagtacacaacattttttggacaattcttactgaagataaaatttagaataaaaggccgagtgcagtggccatttctgtaatcccagcactttgggaggctgaggtgggtggatcatttaaggccaaaatttgagatcagcctggccaacatggtgaaacctcgtcttcactaaaaatacaaaaattacctgtctggtagtgtgcgcctgtagtccccaggtacttgggaggctgagacaggagaatgcttgaatctgggagacagaggctgcagtgagccatgattgtgctactgcactacaggcgggcaacagagtgaggctctctctttcaaaaaaaaaaattagaataagaaaataacttccagcttaatacagtatcagaagctattttaatagacattacttaatgggtacaaagtacttatttgggtgatagtaatattaaaagtgattttaatagcttatgatgatgtatttagctttgaaatgataaaaacttcttaaatgacaaacattaggaaaaaagatttaaaaattagaaaaaaggttcagaaagtgaaagaattgcataaaagacagaacaactggttgttttctagtttgcaaaagatgggcataatgaaatgtttacatcaataagcagttcaggttacgaaatgtcttaaccactgggataatgaatcataaatctttcctttgaggtgcttgtagagaataacccacgagcacttacagaaaagaacagatagtgttacttgataacttatatcaacagattgtgtaaatgtataatggggagatgaagggaagaaggcagggaaattttgattgactaatgtaaagagttcatagttaacagaataaaagattccacaagtaagtgctttcttaaaaagggtataattacacagcattataacatttacactaccttggtgtggctgggattccttgtttctagctctgtcactttctcccattttatccatccatgtgccacaattgaaacgattcctccataaacaaatcctgtttcttcatcaactcctgcagttatattaaaacctaaaaacaaaatgtgtataaaataaaattttataagtattatatatagtatatacaaatatttaaaacatttacaaaattttaaatataataaactaggacaaccactctaaagctcagtttgtggtatcttattattttgtatccagaatatacaagcacaaagttggagatgtgtatatctaccacataggaatttcatttctatatatattctagagaaacccttacttatgtgcactggagatgtgtacaaggatattcactgccacattgcttgcattcacaaaaaataactgccaatagaggaatggataaacactgtagtttattcatacaatgggaaaccctctataccattgaaattaatgaactggatttacatgtatcaaaatggagctaaataatgtatgtacatgacatagagtgtggaataatagataccagagactcagaagggtgagatgagagtgacagtgagaaattacttaatgggtacaatgtacattattttgctgatggttacactaaaagccagacttcacccttacccaatatatccatgcaacaaaactgcccttgtaccccttaaattatataaaaaagataaatctccaaaacaaaatgattgaataaaacaagttgcaaaaggactatatagtaagataacttttttgtaaaagtttaatcatagataatactggtatatctaaatctgtgtataatctcaaaacataaattattgattatagtatatattatagtacactgatatatgctatgtaatatatagcataagtaatttacacatactcaaacacacataactacgaaagttcaaaaacttctggtatgaaaaaggggagaagactcatttttccctgatcttctctcttaagtacaatgaaaatccctgagcataatacagtggactatcataagaggactcaaaagtgtaaagaggaaggcagattggctaggaacctcaagacttgaggaatgtcatagggtgagttccctggttttttttttctttttttaaaattctccatatataccagtctggggagatgtaaacttggaaaagcaacctgcaacctccaacaggtaatgacaaagagttccagaaaaaccaattgactctagccaaaggaaaaggaaagagggaccctacccagacagaaattttgtgacaacatccgccctgtgccagtaaacaccatggatgtcctttctccctggaagtcagtggagactgagtggaagcctggactcctatcccctacctgggggtagcagatggttaaggcagtgctccccttcctcagcagcgtggtacctgcgggcaccacgaggggaatcggggagtatgaacttccacacccaacctggcagtagtaggtggccttggggtggcagcagcagctcagggtgtttcccacccctgctgcatgatgttagcacaaactgggtggggagttagacttccacccccagtggaagcaggtcgttagggacagtgctcccctctcctgacagatgctgtcagcagagactgagtggagagtccggatttccatgccctgcccagcagtgatgggtgcccctcacactcccaactagagatttcagggaagatctgaagaggaggaagctgaaaaccacgctttaaagctgtataggaagtcctgggcaggctctgaccaatctacatgtaaacagatgagcattaacacacccaaaggtttgagaagtaaattacacagtgtggaattcactcaggtttcctgagtggcctcctgatagcccatgaatgaagtagaccagaataacctgctaaatattaaattgttactgaaaccacagcccacaagagtaggccagaagctgcatctaaacttaaataacggctacttggtaaaatgaaagatttcataggatccagtgtcctaaacatccaaaggtctaggaaaacacgaaaaactacttgtcaggccaagaaccaggaaaacgcaacctgaatgagaaaaggcaattaacaggtgacaacactgaggtgactcagatgttgaagtatctgacagaaaagcttaagggaggtatcataaaaatgctccaaagagaatgatctttgtagaaatagaaaattccatcttaaaataaatatggaatctccagggaccttgaaagccaaaacaatctagaaaaagaacaaagttagaagactcatgcttcctcatttcaaaattactacaaagctacactaaccaaaacagtgtggttctgtcataaagacagacacagagcctatggaacagagaacccagaaataaaccctgtatatgcagtcaaattttttttgacagggtgccaagaccattcattggggaagggacagtttatattttttttggcaaatggagcgagtaaactggatattcacatgcaaaaaaaaaaaatggacttggacttaatatcatatgaaaaattaactcaatatggatcaaagacctaaacacaagagttaaaactataaaattctagacaaaaatgtatggcaaaagcttcatgacattgaatttgatgaggcttttttgcatagatacaataggcacaggtaacaaaagtagataaattggacttaatcaaaatcagaaactttgtttatcaaaggatacttttaagatagtgaatagacaacccacaatatgggagaaaaatttgcaaaccatatctaataagtgtttcgtatccagaatatacaaagcaccctgcacccaataacaaaagaactcaattcattccctaaattcaaaggatgtgaatagacatttctcaaagaagatatatgtatgcctgcaagcacatgaagagatgctcaacatcactaagaaatattaaggaaatgcaaatcaaaaccattagataccacctcatagccatttaggatggctatagcaaaaaaaacaaaaaacaaaaacaaacgaacaaaaacaaaaaccaaaacaacaaaacaaaatccaaaaaaacaaacacagaaaaaaacaagtattggtgaggatatagatgaatgaagcctgtttactattagtaagagtgtaaaatggcacagccactgtggaagacagtacgtagttactcaaaaaggtcaacaaacaattatcatatgatccagcaagttctcttctaggagatacccaaaagaattgaaagcagggactcaaactgatatttgtacacccatgttcacgcagcattattcccaatagccaaaaggtggaaaaaacccaaatgtccattgacaaatgatggaaacacaaaatgtggtatatacatacaatggaatattattcagccttaaaaagaaagaaattctcatatgtatgataaggggttaatatccagaatatataagaaacttctacaatcaataaccaaaaaatcaaaaaccaattaaaaaatgggcaaagggcttcaatagacaatctccaaagaagacccataattggcaaacaaacatataaaaagatggttaacacttctaacattagggaaatgcaaatcaaaaccagaatgggatatcacctcacacccattaggatggaactatcaaaagaacagaaaataccaggtgttagcaaagttgcagagaaatttgaatagtgtgggaatgtaaatgttgcagccattatggagaatattatagaagtttctcaaaaaatagaaatagaattaacatacaatctagcattccactttgggtatatatacataaaaatgaagcaggatcctgaagagatatttgcatacacatgttaactgcagcattattctcaagagcaagagatggaagcaataaaatgcccactgacaatgaatgaataaagaaaatgtatgcaacaatggaatattatgcagccttgaaaaagaagggaatcctgtcacatgctatgagatgatgaaccttggcattatgctaagtggaaaaaatcagtcacaaaagaacaaatactgcatatttcactcatatgaagtatctaaagtagtcaaaatcacagggacagaaagcagacaggggttactaaggcctgggaagagtggggatagaggaggaagaactagtgtttcacgagtaagagtttgttttgcaaggtaaaaaagttctagagatctgttccacaacaatgttaatatcttaacactactgaactgtacacttgaaaatggctaaggtaaatttaacgttacatgcttttatcacaaaaaagacaaaaaaaggaataaaattatgacatctgctacaacatggctgacttcaaaagaattatgctaagtatgtacaactcttatgtattgataaaaaataattatctaagtgaaataagccaggtacaaaagggcaaagactgtatgattccgcttatatgaggccctaggataattgaatttatagaggcagaaagtaggatagtggttccaggggctggggaggagataatgaggagttcctgcttcaattaggaatgatgacaaagttctggagatggaagtgatgatggttgcacaacaatgtgattgtacttaaagccactgaattgtacacttaaatggctaaaattgtaacttttatggtaaaatggtaaatatacattatgtctattttacccaataaaaaaaaccaatagtaaaaacaaaacaaaacaaaacaaaaaacagcactccaatatacaattataaaacggacaaaagagattgagctcagtggctcatccctgtaatcccagactttaggaagctgaggcaagaggattgcttgaggtcaggaattcaagacaagcctgggaacatagggagactcccacctctacaaaaaaattaaaaaaagaaattagcctggttcagggtgcacacgtgtagtctcagctacttggcagtctgaggcaggaggactgcttaaacccggaattagaagttgagtgagctatgatgcaccactgccatccagtctcagtgacagagtggaccctgtctctaaaaaataataaagaaagagacaatgtgcaaaatacgtgaaccgactttcagcaaagagggaagatggatggccaatgagcacatgaaaagatattccataccatagccattagggaaatgcaaattaaaaccacaatgtccagcctggccaaaacatggcgaacctcatctctactaaaacaacaacaacaacaacaacaacaacaacaacaacaaatacaaaaattagctagttgtggtggcatgcacctgtagtccagctacttgggaggctgaggtacagaatcgtttgaacccaggaggcagagattgcagtgagctgagattgcgccactgcactcagctgggggacagagcaagactccatctcagacccacccccccaccacacacagtttgagtggtctatgaagctatctgaacagcttaaaagaaaggggtaccaccaaatgctggcagatgtagcaaaactggatctctccagtttgctggcgggaatttattaaaatggtaaaacctctggaaaatagtttggcagtttcttctaaaacaaaacatatacttactatatgaaccatcccattcttggacatttatcccagaaaaaatgaaaacttatgtgtcacacaaaaactgtacatgaatgttcacagtagctttactcgtattagccaaaacatgaaaacaacccaaagtccttcaatggatgaatggtttggatgaatggttaaataaatactggtatatgcataaagggaatactactcagcaataaaaaggaataaactattgataaatgcaacaacttggatgatcttaagggcattatgcacagtgaaaaaatcaatctcagaaggttatatagaacatgtttcattcatataacattctcaaaatgacaaaactatagagttgcagaacagattagtactgccagagagaccagggttgggggtggagtggtcaggtgtgaccataaaagggtacacaagatctttatggtgatggaccagttctgtatcttgattatggcagtggctacatgaagtatacatggggtcaaattgcacggatctacacatacacatatacacacaagtgaatgtaaaacttttaaaagttgaaaacatactaatgtcaatctcctgactctgatgctgtactggtgaagagttcatggcatactatgtatcattttttcaacttcttgtgagtctaatctttcaaattacaaagtttaaaaaacccacatgaacataaaacaatgcatgttttacaaaataatatataataaacacattggaatgactaaggggaatggggaataaaatgaaataaattacattagccttgcattggcggcgatgatagtgtgccatgagatgacgaatatggtgaactcagagaagttagaaaagcacatttattttaataccatatacaaataaacctttctacaaaagtattttgtaagtgcctaggctctcaagatagaccatgagtaaagtctacctctaccattagtagctatgtgactctgggcaagctactctgcttcagttatccagaatctacaaagactcaagcaaatttacaagaaaaaaacaaacaaccccatcaaaaagtgggcaaagacattatgcagccaacagacacatgaaaaaatgctcatcatcactggccatcagagaaatgcaatcaaaaccacaatgagataccatctcacaccagttagaatggcaatcattaaaaagtcggaaacaacaggtgctggagaggatgtggagaaataggaacacttttacactgttgggggactgttaactagttcaaccattgtggaagtcagtgtggcgattcctcagggatctagactagaaataccatttgacccagcaatcccattactgggtatatacccaaaggattataatcatgctgctataaagacacatgcacacgtatgttcattgcagcagtattcacaatagcaagacttggaaccaacccaaatgtccatcaatgatagactggattaagaaaatgtgtcaatatacaccatggaatactatgcagccataaaaaaggatgagttcatgtcctttgtaggacatggatgaagctggaaaccatcattctcagcaaactatcgcaaggacaaaaatccagcaccgcatgttctcactcatagatgggaactgaacaatgagaatacttggacacgggaagggaatatcacatactggggcctgttgtggagtggggggatgggggagggatagcattagagatatacctatgtaaatgatgagttaatgggtgcagcacaccaacatggcacatgtaacatatgtaacaaacctgcacgttgtgcacctgtaccctagaatttaaagtataataataaaaaaaatggaaacaatatcactcattctcaatgttttggggagtgttaaatggtaatatataggtaaagtagttaccacaatgcctagcaatagtaagcatgcagttcatggcgatattatagttataaatgaaaccaccaaaattatctttcaaactggctgacaaaagatataaattttatttttctgctagaaactaaaaacttggtgagatcaggaactatgttaatcttttaatcattatatcgtgaggtttggcacacaaatatttactaagtgaacaattgcaaggttaatttcatcaccttgataaatttgtactattttagttaaagttctgtaccttcgtcctcatgtttcgatctatctggggaccagcattcctttctcggaactgtatgccctgcatggtttttgcattgcttcctgtatgacttcaaacaatggctgatcctgtttgagacataatggtgttacctctgttagaaattacatttttcttattttcccccaaatccgacaactgaataatgtgaaaatatatactttcctttgaagtgagaaataggaattggggtgaggccaggaagaagcagctcctatataccaaataatacagacgagcatacaaatatttaacatcagtgttttgactattcatgtctgtgacataaaataatctgctgatacacaaaaacaaatctatgagcttctacagtttctatcagagtgatctcttcagctaataaacgaacctagcttgtatccagcatctgaattttaaattggcattgctatttttactcatctgcatacacaggtatgggggtaaattatgagctaaagggaaactctcaaatttgaggatccataatgactttgaaaataccccagtgaatgtaaagaattcataagtcattttctttacccatataaataataatgtgatactcaggatgacatttgggaaaatatacaattatatttttaaaaataaggtaagaatgttaaatagaagcaaaatgtttagagtccttacatgtttattatgtttcatttaaagactctgaatataaccaaaactctataatataaaaattctactattaattataaaattataatgctgtgaatatttttggataaactgtgagaaaacaaagttatgtgtaaaatattacctgcctgatagcatgaacctatattcattgtaacagaaatgtcagttgataacagggacaaataaaaaaattttggacaaatgttgagtacttcatgatataaataaatatcatagaacacaaatatatgctaaccctggagtagcttacaaagctactatcccctcccagccccccaatcatatataacaaactattaacataaaggcagatcagaagtggcaaaagtatatattattgtccattcttgattagggaaaaaaaaacactcaaaaatgtctatccattcttactgttcataagataatctttaagctccctggattggtagtcaaggctctccataacctgctcaccctttccataatctcttactaccctgcaggtatcctacacaaaaagccaaacctattgactttttcacaaaacgtattttataagagcctaggctcttacaaaaacactattagtactatgtcccctaaactgtgcttcaatccactatgcaaccctattattcctttccttttttttttttttttttttttttaaagagactgagttttgctatgttgcctaggctggatcatactcctggcctcaagtgatccttctgcctcagcctcctgagaagctgagattacagtgtgtgccatacacctggcttcttttcaactctaatgtctcccaacaactttctccattctccgaaagtcctactcaccttttatggctcatttaggtgaaactttagctactttctacgttctccctgagacctacctactggaccttctctctcttttaagagactacacaacattcctctacaatctattgcaatggccatatttatgtacacatcatcatctcttctaccagttgcaaagttcttcaggcaaagaccaatcacttatagtaccagcaggtgccaaatcaaactgacatttgaataattcgtaagatttggattcttaattacccttatttttacattagaactaaaagtcatttttcagaaaaaaaaaaaaaaacaaaaaaacattttaagaaatatcttaccagtgtgccagcaggcaaaggagcagaatcatctgtaggatacattctggaaactggcacttgagaatgtctagaccatttggaaccattttacagtaatcctggatacactgcgccaccaccacacagcatcccgacaattgtatctggcataaattccttcacccagtagataggaatgagaccatgcctcagggtacccgcaaatgctaaaataatattcctaaaacaaagaattaagtggatcagaaatgaaaacaaacacttaaaaattgaagacaaaaaccagtccttttggtgactatattttgaatgcgttttctctcttgccctatttctttatattttcagtagaaagtagtcatagtatgatagagtaagtactgaattaaagtcaggaaccttgatttagactagaattttatgctaacaatctgtgtgactccctctctgatacagttttttcattgagattggactgggtgatttttaaggtccctcatagctccagattctacttttgaagttatggtatttcaaaatcgaagtaactattaaacaagaacttaattattttaaatagcagaaccaagagtaaaacaaacatataggaaaacaaactggctgggcatagtggctcacaccgtaatctcagcattttgggaggccgaggcgggcggaacacctgaggtcaggagtttgagccagcctggtcaacatggtgaaacgctgtctctactaaaaatacaaaaataagccaggatggtggtgcgtgcctgtagtcccagctactcagaaggcttaggcaagagaattgcctgacccaggaggcagaggttgcagtgagctgagattgtgccagtgtactccagtctgggcaaagagcaagactctatcaaaaaaaaaaagaagaaagaaaagaaagaaggccgggcgtggtgctcaggcctgtaatcctagcactttgggaggctgaggcgggtagatcacgaggtcagggatcgagaccatcctgactaacacggtgaaaccccgtctctactaaaaacacaaaaaatagccgggcgtagtggcaggcacctgtaatcccagctactcaggaggctgaggcaggagacggcgtgaaccagggaggcggagcttgcagtgagcggagattgcgccacggcactccagctggatggcagagcgagactcagtctcaaaaaaaagaaagaaaagaaagaaagaaggaagaaagaaaggaaggaaggaaggagagagggagggagggagggagggaaagagagagagaagaaagagagagagaaagagagagagagagagagaaagaaaacaaactggtagaagctgccttgaaaaacataattcaaccagtttaaaaactggttgaagacagttaattttttaaacattattttactattatataccaaatgaaaattttgtttgtaagacagaaaggcactctgaaacagcatgaaattaagaaataagaaggctgaagtctaaatcctagctttgccatcttgtggccttggaaatgttatttaaaatgtctaggtcttactgctttttggctaaaccaccagaaatttttattaattctatgtctaagcttaatgcccatcttttcaacagtaatgcatgggaaactttttatttacaaagtataaaaatattagtatagacagtgacactttcaataagaaaaggtcagaatactagctctctctatatatacatatatatttgtttttttaagaaccctgttgcccaggctggtcttgaacttgtggactcaagcaatctgcccgcctcaggccccaaagtgctgattacagttgtgagccaccatgcctggccatagtgctagcaatcttaccatctggaacaatcttgtacattttaataaaacgacttctgattcatgattacctctaagagggaggaagtagaaccatctgtggtagaggtatatgtccactaaaacgaatttcctcaattcacaaccaatcttacagttggttgtggccagaactgatgcatgttaagtgtatgagaataggtgtgttcccccagctctctttccctctctgcttgcctcctggagaggccccgaagccatggaaactgacagatcctcaagctggaagaaacctgcttccctgaatcagtaatagaaggctgcttactgagcatgcgtctacgactacaagcaagaaataaattttattttgaaaagccattaagattttaagtgtttataatttatggcagctagcactaccctaacaataccctctgggataatatattattctctgggaatcacctctagatcggggtaggcaaacttttctataaagggccatatactaagtattttaggctttgtgggacatatatgaattcgttgcacatgctttcttcttttaaatgaccctttaaaaagaaaaaggtaaaagctattcggtagggcgcagtggctcacgcctgtaatcccagcactttgggaggatgaggcaggcggtcataaggtcaggatatcgagaccatcctggctaacatggtgaaacccggtctctactaaaatacaaaaaattagccgggtgtggtggcgggcgcctgtagtcccagctactcaggagctgaggcagaagaatggcatgaacccgggaggcggagcttgcagtgagcggagattgcgcactgcactccagcctgagtgacagagcaagactccgtctcaaaaaaaaaaaaaaaggtaaagctattctttgctcataggccatacaaaacaggtgataggccacagtttgctaaccataatctagacagttctatgtaaaattaagcagcacaaatttgtgatattgcatagagggataattgggagcctaaacattaataatgataaaaactaacatttatgaactgtttagctgtggcagatattactctaggcatgtggcagatattactctaggcaccttaactgtatggttcatttgatcctcccaagtacccagtaaggtaatttgtcagttggtagtttggaaccggattagaagctggcagtctggtgtaaagccgaagttcttaaccactatactatgctgatgctgatgttccatttccttcttctaaatcagtaattcaggagcatttagggaagaagcaacagcttcctaaatttctatagctccataatggtaatacaaaaaggtcttactatatacggattaacaaaaatgcaattcatttcagatgcccacctaaaaacttcagttttaaaagatcaaaaataaaattttggcatgtaaagatgcaaacttcagttattttcctgatggcataaaacaaggtatcgtataaatgcccttttgctgaaagttttatcttttagagcagtgcttcaaacttcagccttagactgttgataatcatccagagaccttgtgaaaacacagattttgcccaccaaccctactctctctatgtccaggtttggatttgggaggtttggcatagggccaagaatctgcatttctaacaagctctcaggtgagggtgacactactgatgtgtggaagcattttgagtggcactgctgtagtgctttcctttcgacctccaataagttcattcatatattgtgacattaaaaaaaataccattttacggccgggcacggtggctcacgcctgtaacccagcacttcgggaggccgaggcaggcaaatcacaaggtcgggagttcaagaccagccgaccaacacggtgaaaccccgtctctactagaaatacaaaaattagctgggcgtggtgggggcgcctgtaatctcagctactcaggaggctgaggcagcagaatggcttcaacccgggggcggagtcggaggttgcagtgagccgagactgtgccgctgcactccagcccggacgacgtgcgagactctgtctcaaaaacaaaaaacaaaaaacaaaaacaaaaaaaaccattttagtctagaaaacataaaactggaggttacaaggcttgacaacaaatagagggaaacatcagacttctacaagactcagacaaagaactagcaatgccttcactatggaaggcataaaaagttataacatttttagttttgttgaaataaattagctaatgctaaagataacctgactttaatatgaaggactagaacttagtgacttcaaagattttcacccctttgaaattttatgtcctattaagtgaacatacaaaaataaaataaaaactacctaaagaaaatacagctcccaatgttaagaaaagatggacaagaaggaaagtttgaagagcatgtaaaagacattcagaataaactcgcagtacaacactttagaggctctcctacctggcttctacatagcgtccagaatcagcagtatacctctaagtgcaataaaagtatcccttccccagcagcggaaaatacagaagaaaaatgaggtaagcctaacaaaaaaaacacaacaaagtaatatgttaatcatataatacacacaaacctatgaactccattactatagaacagttactctaaacctggggtaaaggcaggcacctgcaaatcctctaaaaccctctaaaattatttgcaaaatgtatgtcttacttatgttaacttctgtcaaatgagattccattatcttgtcagattcctaaaggaactatgacctaaagaagattaagaaccagagctatagagagatacttatctaaattgaggttgaatacacagataaacttttcttctttctgagagagggtctggctctgttgtccaggcggagtgcagtggcacagtcttgcgtcactgtaacctccacctcccaggctcaagccatctcccacctcagcctcccaagtagctgagactacaggtagacaccaccatgcctggctagttttgtattttttgtagagaatgaggttttgccaggttgcctaggctggtcttgaactctgagctcaagtgatctgcccaacttgctttcccaaagtgctaggattacaggcaggagcactgtacctggccaaactttcttttataaattaaatctaaagagtaaaatcagagatcaatatttaacacataaacactaaatattaattatatatttaaaaagactctaccttgaactaaggacaataaataaacctaaacatgaaattattaccttaatgatacctaattaagtaatggagtcaacatttgagcacttgagtcaacattatcaaatttcccactaatttaaaacacttaaaagtgttatattctgtacacaatatgtacaattttacttgtcacttcaagttactggcacattaaatccttcattctaggtaattggaggttttatatacaagataaaatagatgattaatggtgcaatctaaaattttacttaaagattgagtttggtttcttataaaacgtaaggtcaggaattcgagaccatcctggccaacatggtgaaaccccatctccactaaaatacaaaaaattagccaggcgtggtagtgggtgcctgtaatcccagctgcttgggtggcgaggcaggagaattgcttgaacccaggaagcggaggttgcagtgagccgagatcacgctttgtactccagcctgggcaaaaagagcgaaactctgtctcaaaagaaaaaaaattatgcaaagcataaatataacacatattttggttaggggaaactgaggacaaataaaatatacaagcattcacttataactatcttaaaagcacttaacgctatctgaaaattatcttgtttgtatctgttgaatgcatatatcttcccagtaggaaataagacctatgagtagaaacctcactaccttgttcaccaacaagtatgtattcattgaaaattgtaactgtatataatatatactataaatatttgatgactgaaataaaaaacaaatattaaaatgtagatcgaaaagtgaagaatttgactaagataaaagaaagttttggcaattcctgagtgtacttcacaatttaatttctgtttattgggaattagatgttagtttcttccattaagaaagataagaattagactttttcctacctatgttgtctccaaaatgacggtacaaaatttccccaaatacactgtgattatttatttatgattaatatggtttatatatggttgatatatacatgatattaatttgatgatagtgatgacagcagctaacatatatatagcactctgtgccatacacacttcctgtactctgacccatttaattccttgtatgaaacatgaatacaggtagattcaaaggtgatctgaatcggtatatccaaaaatatatgcggtctgtctttgtgaaaaagtcaaaactataaatctctagcactatgtatggaaatgtttgtattaactttttgacctctaagagtacaaactaatagattccatatcttctaagtgatttctaatttgtcaattattagaacaggctcaaatttttttttttttttgagacagggtctcctctgtcacccaggctgcagtgcagtgtgtgatcatagctcactgcagcctcaaactccttggctcaagggatcctcctgccccagctcctgagtagctaggactacaggtacataccaccatgcctggctaatttttaattttttttttggtaaagatggggtcttgctatgttgttcaggctggtcttgaactccctgccccaacgatcctcctgcctcagccttccaaagtgttgggattacaggtatgaaccattgttttaattgctgttgttgcaatactataaccaaaggaagacatccccaatcagtttaaaatgaccccaaaaaacctatctgcaaatctgaatacagtcctattttttacaagtatggaatagcaaaacactcccttgggatgctaggagcaaatatcacacttctatttgtatttgtttacaacttaattttttagtttttatttgttttatatcgtacctgagaagtatgtcagatgtacagtttatatcagtatatcgtttaaagtgtatattttgaagatgtttaacaacagcagacacaatcaaaaaggttgaaattactattttttgtaatgggttctaaaaagtaggctttaaaccaagttatttacatcaatgtttcctttgcccctatggctaaggtcagtttcatgacatctgcatggattcatgagggaacaacgggtaccaggagatcaaacagtcaaatgaaatctaaaaacacaattatagaacttaaacaacgttttatgaatgtttcatgaacatttttatggaaaggtaattttcattttagttgttgggtatcactaagtctttttatctggtctagtagctgcaaatttaagggtaaaagagggaattacacagataatactatttctttcttctgtaacttgatatttttcagtttagtttggaaagttctaaacttcagtcacctcaaatataagtactttctagaaatatgcttgaaatgtattaaaaagaaaacaaaagcctgtccttagcctattttgcttacttgaatttgttacttgattcaggttttaaatctagttggaataaggatatttattcaaatgttgaaagcatttgattccaattagacacatgatgaaaattattaacatctgttttgttttataatttatagggacccttacatgacctcttgataattacagattgggtttattttttaaaattgggggaaaatatagaaaagagaatagtaaaataaattgatttaaaaaaacacagaatgtcaagagttggaaaaaatagaaacatgaagaatcagtagccataaaaaacacacataaatgcctggtgcacagttataattaaacagtaagcatgttattatttttatgagtgaatatctatgaaatgtactaagtggtaaaataaaatcttgatagcattacaagcttttaaaaaataatcattttcctataacttttcttccgcgaatacttcgatttacatattttaaccttgtacataattccttacctgcagctagagaaacacaacttgctccttttcttttgtgatctcatttaacctataaggtacatccattagggcaggtgaagaattggcagggaagggaattttcctactccacacagttgaactgaacccaatgaaagtgtttcacaaaggttgaaccattctgaacaaagctgtaacaaaagtgattgaatttatacttgtagaaatacaatttttagcagttttattttacttggtttctttccttcaaatgattttctatacaaatctataacaatagtaatattacttaacatttttaaaactttggttaatttcaaaactgctttcatttcacccattattttagctggcttacagtccacagatggtgtaaaacaaatggtagaaatgaaagtttgttcttgtgaaattatgtcctaatcaatttgtggctctcacgagtacacttaaatttgtggtttcattttagggaaattcatcattaaagcaaatttcattcatagtaatagtggaattttttctcctaattgatgaaaaattagaaaattgtacatgtagatttcagaaactttatcaattaactcaataagtcagtgaatacatagaacaatataaaacaatattcttatcaatatgttttattagcttttagaacagattttatatattcaagtttgtttttgtatgctacacagactaaaggatgctaataaatttactatcacctacaagccttttcagttctatgacaattctttatggtttggttttttaagaacatgatgaagtgactctgtatatagtttcaacacagatatgcccatttattcaagctttgttgatataccttgacatctgcttccatgctgtatccagaagagtggtatatgcaccaattaaatagcatcaaagtaacatgggataaggtaacgtgggatctgcttcaggtagaagaacatgcctgcaaccatttaccaacctgtaattaaaataaatttgaaagttaatttggtatgtgacagactaggtgtgtttttagaggtaaatctaaatgtgcaactttatctagtaatctataacccgatttccatttattataactgaaagatgatgaaggaaggaggaaaatggttcagttagaaaacaatgtaaatattatatataacatggtaatatttattattatgtccttgatttttgggacgataatatagctctacttacttcagcaatagttcctgatcgtgaaataagcggttactgacatagtcaatcatccaatctccagatctcaaattattacaaaaaggatgcccaagtcattctttggtcttatttctgccaatacagacattaaacctgaaaattcagaacatgtcatgctgtattattggtagcatcaatttgttcctatatcctctagtccctatttgctagtctctattctagtgatttggggtgaatacgtattagaggcacacacaagggctcccagtccacaacactgcttaatacagttggagataagtatgacaatactggcttgagcaagttacaaaggcatactgaaggggactactgtcacaagagatataaagagcttttcagattcataacttctgggactggtcttattcttttggattttaatgttataatattcaaggtaactggcatggcttccctgcccaaaagcatctcaagaaagaaaagtaataagcctgtatttttcatgttgaaaagtagtgggttcatcagtattcaggctagatttaaggaagtcatgaactggtttcagaaagagcaagaacacctatggagataataagaataaagcatgctttgaaggaattgttaaaatttaacaggaggtacttagaactaagtgaagtatcaaaatgagtatatatatatatattttttttttcttaatccttctagtcttcaattagaagcattagatttcccagattttattatttcaatgatgctaccttaaaaattatattggcatcactgactcatttagactaaatttatttatctatttagaattgcatgaattttactaggtatgtagatgttttgagaaactaaaaactatataaatttaagataaagttctttccctcaaggggccacaatcttctctggggaagaaagcttaaaacataaagatgttgggaaacaagactataaataatattctacatatgccctggcattttcatggacagcagataatgctcggtaaatgtggtctcactgttgaataatggaaggacataaggaaaacagtgttttagaaacagatctatgatgaccaacggaatggaatgatttgtagatgaggtaacaagatttggaaaattggtagttggttttgtatataggacttagtcctagaatagagtgaaaactgtggtaataaaaagatatggtgtacccaacagaacatggaaaagaatccacaaatcataatgactgattggaactgaggatgaaaggagcagatccaaaatggattcctggattccaacatgactagatatccgtattataaggagggaaatacattttgtttaagggaaagacaggtcaacaaagtagtaaatctgatttaatctgaggctcttattagcagcctgctggaaatatgtggcctgctgaaatattaaacaatcagagggaaaagggattggtataaagcagcaaaaaataaacaggtaaggcaattctatttagaaaagataagaagaatcatttcattagaaagataaggagaattgcaaagaaccaaacttaactataagaaagacaaaggctagaaaaagagcacacacaagttggtctttgtagtgaactagaagtagtttaacaactcagagtgaaaatgaagtagataatactcaaatctgataacatacatacatcttttaaaaattaattaaataaataaatttattattttttgagacagtctcactctgtcacccaggctggagggcattggcatgatcatagtcactgcagcctcaaacctctcttgggctcaagtgatcctcctgctgtggcctcccaaacatgagattacaggtggaagccaccatgtctggctcacatacacttctttcttactcatgcacaaaacattttgtattaaaaatgagaatattttagaaaaaaagatcataaatccaaaagtctcaaaaaagtttattgagaaccgcttacgtgcttggttttgcagaaagtataaagctaaaagacaagaagcataaaaaagataaaacttaattcttctttctgaaagtgtgcacctacttagtgtggttttaaggctaacaatttccaattacttagtatgaattaggtgtctctaatgagctgttcacatgtattaattcattaatcctaaccataatccctgtggtaggaccattttgcaggggaaaagtaagccatagagcatttacttcaggttataaaactagtcatgtaacccaggaaatctggttttaaagcctgtttcttaatcacaatgataaagattcaaaaaatcattatactaactatcaaaataaggcaatatatttcaagggccaagtaagaggatagaaaataaatgcaatggtgtctggaggacaaagaaattactgtaaaaagcaatagtaaagaaggttttatgaaagatgcaagaattaaattagtccttaaagataggttagatgggaaagaaataaagagttgaacaaaaggcataagtgaaaactatatgaaccaggaatacagtgtgataaagcaaatttcttaaacatctaagtaaatattaccaactagatgaataaaatgataaatacttaattcctttaactcatcttacaactactgtatgttttactgtaagtttctttacaggataaaacaaatatgcaataaaatatatttccaattagatttaaaaaaagtgaatggattatatttacaacctaatcccacttggggcccaaacaagaatattctgtttttatataataaaccaggtcaagaaacattaatcaaggtccaagtatacataaagagctaacagaccttaaggaaagagatagaactagtatttctaggtaaaatttactgggtaattatttgtgttacatcctgttttcagtgttttatgtgaatgatctcattaatcctcacaaaaccttctaaattagataatattattcaaattttatagaagcagaaattggcacacaaagagttatattacttgccaaaggtcaattaatgagcagaagcagagccataattgcaacccagtaggcatactctgagcctatatctatgtctgtaaagaagacaccagatgaccctaaaaaaaaacacaaagctcagctatccttctatttgcttaccttgaagacctgcatatttaaggctgaccagtttggtatgtcatagcaccctccaccatcttccttttcttctgattcacacggtaaaggatctgatttagctcagccaaagttaatctggaggcaagactaagaattggaaataaagataaccatatattgaagtttcgcttgttgtcaatagaaacaaaagaagaaatctgaattacaatcataaaatgtcttagcagtgtatgttttaggaactcagcattcaaaaaacattatactcatacattttaagtaattattaaaggacaaattgtgaaaaaaaattcattagaagcgacattactcccaaaccaagcaaataatcaagtaccaaattgtattgattgaagtatgctgggaaaatattttggcttctatatcctttatcttataaatctgttttttaacctttctagtttggacttagtgttttccttccttccttcatttatttatgtgttctctctgatttctctcctttatattcccctaagtgagacatcaagaactttttatgctagttttgtatactaaaaatacttatcagaggatgactaaaggaataaaaagtcaaagttaattcctaggaaatcacatgctctctgccttcatatttctctccaagtcccttcctttctctttctaaggttgcactgcccctcagcttgtttattcaagaaaccaggatttttctcagattagatgcctcctgataactgtcagagggaagactatcatggccttgatttccctttgtttgttagcagtaagactgtataactgaccacacctgaatacagctgaaactgtattttctttgcttctataatagatgctcaggtaatttcattttacatgactgccattttatgtgaaccatatcctcttgaatgtgtatctttctttcccatttagttctggctcaatttagaaaatattgtcatctgtgctttgttctctccatatcagcctccctccccagagctagtttgtgatcaagcctgagtcaaatcactcagaagtctcagtatcaactccattctaggacaatattttcaatagccagtggactccttgcctaaaaattacctggggatcttataaaactgcaaattcttggccttgctccaaaataatctgagcaggtctgaggaggaacatgcattttacaacagtccatccaaacacaaagctgcttcatcacagattttttggttaagaatgcaactacttattaagaatagtttgaattaggagttaatatccttaacaataaaaagtcttacaaaaaacaaagaaagccgaacacaatagcaaaatggggtaatacataaaacaacacttcaacaataaatacaaatggccaatgaacaaaataatttagcttaatatttaaattacatgagatttatttttaactattttatatttaccagtttgattagtaacagctaacacttatcaatcctatgtgtcaaaaactattgtgttttactcaagtaatctgtaagaaaggtgctataatttgtctattataaattctcaaagatctctttttttttttctagagacagggtcttgctctttgcccaggctggagagcagtggcacaatcatggctcattgcagcctagacctcctgggtcaactgatgctgatgctgttacctcagcttcctgaacagctgtgaccacaggtgcatgcacaacttccagctaatttttttaaaacgttttgtagagatagggtctcactatgttgccaggctggtcttggactcctgggctcaagcaatcctcccaccttggcctaccaaagtgcgagattataggagtgagccactgcactcagccaggtcttacttcttatagctaataagatctgcaatggaattcaaatccagttagtctggttctatactccatgcccttaaacactagttataataatatatactcagtattgctaatgatggaaactcttggatagagctgaaagattaattattataatctttctggagaaaatttggcagtatgtattaacagcctcaaataatggatatagtctaacccaatggtcctttttggcaccagggactggtttcacagaagacttttttcacagactgggggtgaggggcgtggttttgggatgattcaagtgcattacattattgtgtactttatttctactattattacattgtaatatatactgaaataattatacaatcaccataatgtggaatcagtgggacccctaagcttgttttcctgcaactagacagtccatatgggggtgatggcaaacagtggcagatcatcaggcattagattctcataggcagcagcaatctaaatccctcgcagggacagttcacaatagggttcacgtccctatgagaatctatgcagccactgatctgacaggaggcagagttcaggtggtaatgcgagtgatggggtgcgctgtaaatacagataaagctcacctgccactcacctcctgctgtgcggcctggttcctacaggccatggaccagtaccagtctgtggcccagaggttggggacccctcgtctaacccaaacttccatttctgaaaatatttatactagtactaatgatggcaaactatgagcatttctatgtgccaggcattgtattaagtgttttataagtgttatcctatttaattcttacaaattttccagatgggagactgagatgatgaaagttctaaacaatagatccaagatcatacgacagtaatgaagctaaagttaaacctaggtctaaacctcaaaacctatattcttctgtgtatgcagaaacatctagaaagggaataactaaggattcatgtaaagatgaatgtacaagacataaataatagggaacaattagaagcaatctagatgtccaaaaatggaaattgtttaataaattatggtaaagccataaagtagaataatatgttgacatttttaaaaaatgatgggtaaagggtatgaggtatgcaacttagtctcaaatacttcagagaaattgtgtgtgtggtatacagagatgcatgcatgtgttatgtatgcatgtaggcatgtgtgtatctatatcttagagagaatacacatgcaggtacacacacaaattataaaacaatagggtaaaatgttacaacaggtgatgctgacactgctggtccttggaccgtactttgagtagcaaggatatagggacccttaaaactgcttaattcagtctagtggtaacttacttattaaggtggcaaatcctaccaaacaaggcatacttacgaagcaaaaggaatttttaatataggatctgcattgtaacagctaggctgccagatttaaagtgaggactgaattgtgtcagatgatttcgaagaatccaacagcgacttgtgcatgtggatcaagactaactctgaaaatgttaattaaaaagtgttaatttttaggagtaatttattcaaatttaacaggatatgcaaactattttaaatatagtaaagtcaacagtttgagctcaattaacatacctgaatataataacacttcctggagcaagttttcaaattctatttcttgaatatattcattgggcccttttgtggcaactccagttgtttaacaattttactttcattaagcttgaaaaaaagtacattaaaaaaatccattcacaaatagttctaatgttcttaaaatgctaaacacagtagtaagatgagagtcccaaatcctgaatatgttctctaatttctactgtgatatctggtgttccattgattgaattctcaccttcctataaggtttcgtgtttctctcaatagttctagcttcaagaactacttcttcattttgcctaggaatacataaaaacattttaacaaaatttcatatggaatcatccaaaataggaaggctaaagtggtttcaaatcatttaacttaaagttgaaaacaaattatcagttattttttttagaagtctgaaagtagatgattctacccaaggtgtattttcacatttgtaaaaaaattacagcttagttaacaaagctttttttgaagtagaaacgtatcaaaataatagttagctctagggaacaacttcctaattttgagcagagaaaagcaaatcacttgaaaggctacatttttttaaaacttggaatatttcggatacaaaaaaaaattaaaaacccaagttcacttcctcacttaaactttacaaatacaataaagcctctgtgtacccattcttcactttagaggtaacctcaattcagtttggtgctcactacccctggcattttcactacacatgccgtttccttaaacaacatatattattttccctatttccaagttttattaaaatgaattgagttatatatatttgcaacttgctttttagtggtcaacaatgtattttttagattcattccactgctgcatcagctacagcacatttacttcaaatgccaaataatattctactgtatgatataccaaaatatatctgttctattaaggttgtctctaatttttctctattataaatatgttgtaataaatattcttgtgcatatcttcaaatggaaatatatgaaagtttcccagaatatacctagggatagaactgcagggtcaatggattatataaaatttcaaccttactttaataacttaagctttaagtcattaatctggcaacaggtaacagaaccttttgatctagaattctacctctgtaaatatacactaagaaaattgtttaaaagaaaaaacaattatccttctgtatatttaacacttagtaacactactaaacatactatagaatatttaaaagggcatataacagaacgtacgaacatttaacaaaataaaaatcacaattttgcggactgaagtggaatgttttaagaatgatctgtgaccaaaacaaaacctgagataatattgtacacagtgatgttgtcctataaaactgaatacgtatattagcaaagatcagataaggatagtgaatatcatttgtgaacaattaaagaaacttttaggtattcaggttgataatttttaaaaaccggactatgcatattcagcaactagcaaccaatatagaatatgatgatttttataggaatttcatttggtcaatcaatcaacaaactttgccagctgctgcatgaacaggagcatgctatgtgtaatatgccacatataatagtaagtaagacaataaaatacacctatccagaaaaaaacaagtaatattaaggacatatctcagggatgtattttataatttttgactctctatgctgaggaatacatagagactataattgctacatgttcagaagaatcactgaacaaaggagggcaactttagaccttgaaagatccagacaattcgcatagtatttggggagaagtaaaaaatctatttggctgaaatagtggactgacatagggctaggatggtggatgagaatggatttgaaaagccttaaacataaggttatattattttccattttagttcgcatgtttgtatgttgtttgtgcatatatacacacaaagacatttatacacatatatacatatacactaacacaatatacatattgttctgctagaagagaaataaatgttcattttacacaaattaggaaaaaaatataaacaaaaatatttcacaactcaaaaaatgttaacatttgaaagtatttctgctaggttttgttccatgcagtaaaaatataagttgccaaaaatttctttttttttgagaagggtctcactctatcacccagtagagtgcagtggtgggatctggactcagtgtaaccatgcgtgctgggctcaagcgatcctcccacctcagcttcaggagtagccaagactacaggatgtgccaccatgcccatctaattttttgtactttttttttgatagagacagggtgttacataatgctgagactggtcttgaactcctgagctcaagtgatctgcctgcctcagcctctgaggtgttgggattactggtgtgagccatcatacctggccaagttaccaaaaagtttaattctttttctcaagtacgtccacagtagcactgtgttataatatatatgatatatacagatatataaccataacattacagtataatttaatataataatataatacaaatacagtacaatttttagattgcattaccagggatgcacatttgaggcacttccttgctgtaaaatgagtcttgggattcctgaaagcagttctagatacagccacaacagactgatggatgctagtgagtgtcttgttactgccactatgtcttcatcaacttgatccacatacacctgagaagagaaagaacaactagattagctctcaaactggaaagacttactctgaaattgaacctgagaaacaaatttaattatttcttgcctgaataaaacccttggctccaagctcctgatgaatttactgatagcacacctggctgcaataatgccgctttggaaattaacttcacctgtgttgaaggcaatgcttcaggattccacttagtgtaaaaccgttcttcagaaaccactgaaactggacaaaggtaaaatttagcatggatacatcttaattacaatgaattttttttaataaaatgcccaaagttgttggccatgtaggttttaagaaacaacatataaacaaacctgataggcactaattcatcatagcctcttgtacttccactagcacaacatgccatagaaacaatgtagtacttggaagagcatcatacgctgatctatgctagaagacaacaacaacaaagcaaagtttgctttctttcaaatgcaaagtgctattctatagcataatgaagtaaaaggatattacataaataaattcataaggtaaattaatttgcttttaaacaagtaaaacattctgaaactatgtattataaatcagttataaatctaagacactattttgaagtatatgggtatattgtgaccaagtgtcagagagttaaatatcaaagcatttagcaaaataagtacatgaaaagattaggtgcttaccacaataggacactcattatcatgcgtaatatccataaacaggcatgtgcaatagctggcattaaaggcctcaaacagggctgaacaaaggatccaacaggtctcctccatatcggtaaactaatctgccctcttcatgactattatatgcactcattgccctgcagagcattacagaatattttaacaatcttcattatttatgtccaggaagaggttaatttcttctcataaatgattttcaaaataaagaccacatcaatattataaaaaataaaatgctttaaggatttaaacaaatgtctactagtttaagtgacaaaaaagttttccccatacttaactggagaaatggctcatgtaaggaaaagggaacatatgttgtttactgggatgtagctatacaaaattgattataaaacatctaaacattacatcatatctcccagtagaagagaaaaacaggtttgcatattttcaacaacaaaaaatggttttgttagtgagtcttcagtcatcctactggtctttcaatttgaaatgaggtatcttaccccaaagtagaaatttatacgataaaaatagactgagttatattagaatatgtcatacaaagtatttagaagaacattactgtgttaaaaaattattaagcattgcatatgaagctattaaatcctttaatctacttaacaaaagctaaagttttagagggaaatacactccaacaagcctacctcttattaaggaataatgcccagtctagtaacaaagacattgtccagatcttcacttcctgtgaacagttcactactacatataaattgggttgcaaattcctagcagcatccaacatgtactgtaaaaagacagtgacaaatgtaacaaataaatgtaacagaaagagaaaagcaagataggaggaaggaagagacaaaaggaggcatgatttgacatagaaaaatatgcagcaagatatcaaacatacaaaacacatagaaacaagagaatttatcaagagaagaaaacggttaaaaaggaagattgattttgcaaagatattgagacatgagagaggaaaagaagaagaaaaatgttagtttcaattactaaatgtaaatcataacactacaattctgttaggttttctccctgttttttgttgcttatttatttatttatttatttattgagaccaagtttcgctcttgttgcccaggctgagtgcaatgacatgatgtgagctcaccacaacctccgcctcccaggttcaagaaattctcagcctcagcctcccgagtagctgggattacaggcacgcaccaccacacccagctaatttgtatttttagtagagatggggtttctccatgttggtcaggctggttgcaaactcccaactcagctgatctgcctgcctgagcctaaaagtgttgggattacaggcgtgagccaccgtcctgggcctgcttgcttatttttaaaactttaatcagacttaatttccaggtggttgacaaataattattcataaattccctgctggtgaattacttagctgttggaaagattagattgtctgaccagactgaagccagtttctcctacagatgatgataaataactcttaaaaactttacaccttacaatttccacttgtgtgatttacgtttaacactggtgctatctatctagtgtttattataaacactggtttataataaaaaatcagattggttccaaactgttaaacaaacatttgcacaaagattaataaaatacttgaaactctattagctaacaagtagaatccagattttgtaatttaaaattaagtaaattaagtttgaacattcttttctgccatgtaacatcttagaagcatatttctttttgctattgctaaaagcacaataaaataaagccgtcatttttggaactaaacaatgttctaccagcttaactaatattcactaaatccctccaaatcaatcaatttttcatcataggacttgaaatatatattataatactgctttaatattatagaatagacattttttaggtaagcacacatttccaaagaacacctaagtgacactggtcacagtaaggtatcaaaaatcttataagcagtgccactgtagggtttctaaaaataacaaaaaaacttataagcaggatgaaaattatgagtttaattacaaagattgtattagatagaagtaatactataagtattggcattgttcagaagttattgtaaagagctcaaagagaaatagcaatgtttatgtttacacttataatttttataaataataaaaattaaatcgatgaggctgactggcttcaatatgctataatgttaatgtttattttttatttaatttaattaattaattattttttagacagagtctcactctgtcgccaggctggagtgcagtggtgtgatctcgctcactgcaacctccacctcctgggttcaagtgattctcctgcctcagccgcccgagtactgggactataggcacacaccactataatgtgtaataagctattcaccttcacagtcactctaaaatatattgaaagcaacctaaaaataacaaaaattaacattttatgtattcacatagccaatatgattgcactccatattatcagaaacgtgatcaacttccctaaattaaaatttaaaattagctagttaaatattttatagcccagtattccataacaactgcaaaagatgttagaattatgctaattatgcaatagtgataaatactaccaccaaatcaatgcttgtgccaactagcaaaaggaaacatttacctgcatagtttacttaaggaaagctaggaaggaaactgaatttcttttcttaatgtagataaattgtttttctgtacctcagctacgtgaagagtgttgagtggcagttatcaagacgtactccctggaaataagttgcagttatttcagtgattttttcatgtgtgcccagagataaggacagtcctctggtttattcccatagcgtaattaacactgtctccccagcaaataagttctctccttaggtaaacttctgaacctgttcagaaagagattgctttcaatggttcaagaaataaaatgaaaacaattacttcaaggaaacatggtttttaaattgctttgatcatttctgccataaatgatatattggttaaattatatcaaagtggtatgagataatgttttaaaaaattaataattatttatttctcatagctattcgaaaaaactctagcttacagtctcttctaaaaatttgtcctcaatttcaaaaacccaagcgcatcataagggaaaacagaaatgttaatatcataggccttttaaaaccatagttctacaaaaacatttaaaactccatctccaccctcctacttattttcggcaacaggttgtattgatccatggcatacagcagaatggcttgatttcgtttagaatggctagaaaaaagagggagagatacttacacccaaatttatactcttaaaaaaaagcattaagatttctgaataaatttaatgtcactaatatagactcctagtttcgaaatgttaaaaaataaatatatcaatggctcctgcaacattcttcctggtaatgaaatagctatagaaacacaagacactaagagtaggggggacctaaaaccattaggttctggtttaattgccactgaaattcttaatacctcggccaatgagtgaaaatatctcttatgtcaatgtaattgtaatagcagtggtttcaaactgtctgtaaaaatgcaataatattttgtccaaataaaagcttatgtagacccacaatatgaaaacagtacataaaagttattctgtttgagaagataaaaggtaggaaggcaaaggagggacagaagatgaacttctttttttgttggctccatgttttctttctcaaattgtatgttctctggtacctttatggtgaaatatttaaaaaccaatagactaatggggaagaaaatcgtaaagcagattttattttgaccttgccatgaactattctttccccatccacagagaagtaaaaattacatacccggttcagcaaagtttcgaagaggatcatctcccattacccatcattgtgtgccatcagaaaacaagctttatttggcagatgaatcatagattcttccatgggaagtctatctcttcaaatgggaaagtaaaatacctatgaaaatataattaaatattaatccatacaaagaaactccttggagagaatataaatttgcaatattaaaactaaacttctttctaatgaatagaataaaataagtttgatgctatttataggaaaaaaacttcaatatagtcaaaaatcttcattaggctttttgagtaaatctagcaggatgtgagaaatagggagtaacatgacagcatatctggctaacagtttaaacaatttttaaaacttcataaaattatttaaaaaatcattgaggcagctgggcatggtggctcatgcctgtaatcctagaactttcgaggccgaggcagggggattacctgaggtcaggagtttgagaccagcctggccaacatgggaaaccccgtctctactaaaactacaaaaattagctgggcatggtggtgcacctctgtatcctggctacttgggaggctgaggcaggagaatcgcttgaaccctggaggcggaggttgaatgagctgagatcgtgccactgcactccagcctgggtgacagaacaagactccatctcaagaaaaaaaataaatacataattgaggcattgatgttactttgcaaagatatttttaaaaagactctaagtaaagatatgcaaaggcttttactgcactctagttgcccaacctatgtttatgtcacttacaaagtaaggagccagatgcttgcttaatttgattaatattgaattattactaagtatgcagtcctccagaaacattaaataataactatgaattggtttatactatgacagtttctctaacaaaatatttgcctaacaaaattagttaatattaagcctatgtcaaatcaaaacttctatttcaatttaagaaatgtactgaactcacatgttaaagaaaactttaggttaatttcaaaagttaaatacaattttcagttttcaaccatcaataagaaaaaaacaaaaatgcaacacctggtaactaaaggatgctttctagtgacaggtcctagttttgaccatggccagccagtcgttcataaaacacatttcccaaaaggcaattaactgcctgaaaacattaaattgtgttagatcatcaccatcctcaagacaacaaaaaaatagtagtaagagcaaggaaaagcagcagttcaaaaataagtaaaacctgttcctgatgatagttaatgagcgatgcttctctgaatttaattcctccattcttttatgaaaccaattacagcattcttcattgctgctggccccttgctagagcagatggagaaatgcagatataatatttaatggcttacagattctacatttaaaaactttctaacaaaggtcacagaaaccttaaatatattcacgggatttcaattatggctgatgatgttttccaattgtaaaaatgtttatatacacataagaaacatggcccacacacagaaaaagtgggaaaatgtcatgtgctgaaatagtagaatacagtgaattactttatttcattttctattaagcgtttttaataagtagtatgaaaatctactagccataaaggtttgtaagtaatattattatttcacagaaaaaaacacattacatctcatgtggtatgaaagtcgttagtgcaatgttcatatctacagtacagccaaaccgtcgtattcaggatcttgaataatcgtaaggtgttggtttggatcagacttggttactcgccattttctaaaagaaagaaaagacgataccttaaatgcaaatatctacaaagagattatactgtcactattttctaatttttggcctataattttttcactgaaaataaaacaaatattatttcacaggtatcctcctacctcctccccttctcatcctgctgtgtgcacgtgtgtgccgtgcgtgcacgcgcaaacacacacgaggggtgtgggggagaaagaaacagagacaaaataacataaaagaaagacacaaggattcctatcaattcaatctcagcccccacttttctgctacatcagcattcacttattctattctttttttatttttttatatatatattttattaactttaagttctagggtacatgtgcacaacttgcaggtttgttatacatgtatacatgtccttttttttttttaaacactttaaggactttagtggaacccgttttcctccccggtgcaccaaatattctaacctcaggagttctttttcaagattgctttcaaagtttgcttcctgagtcttattaacaacctgactttctttgaattctctaaaagaagcacacaggtttaatatttttttcccttttcatcaaccatattccttagataataacttaaaaattaaaaaggaataaatggtttttggggaaattttcactctttttctggaacttgtttgtaataaaattaaaactggtacaggattgcctccattgaacttgattttatattaactaattaatttgtgtcggcttattctaaagagactttgaaatgacttataaaaacacgaacaaaaaaacaaaatatgggtttcatagtgtagtggttattcacgttagcctcacaaaacagcataaaatacaaacaattcttaaaatccagtttctaaggttcatctggaagagtaaatatatgaaaactgccccgggcatggtggcttgcacctgtaatcccagcattttgggaggctgaggtgggtggatacctgaggtcaagagatcgagaccagcctgaccaacattgagaaactccatctctactaaaatacagaattagctgggtgtggtggcacatgcctgtaatcccagctactcgggaggcgaggcaggagaatcgcttgaacccaggaagcggaggttgtggtgagtggagattacaccctgcactttagcctaggcgacaagagtgaaactctgtctcaaaaaaaaaaaaaaaaaagacactgccaagaaatgtttgaaaaagagaaaaagctatgccatcagtataaactaataactttagtattgatagaataaaagagacggatcagtggaagagcacagataacagatgtaattttgtatattaccatacactatgaagtattatggtggtacttcaaatcagtataaaagatggattttcaactcaatataattttaaaaatacaaatcaagttaaatatcttctttaataatacacaaaaataaatttcaggtatattaaatattcaaatgtaaaaatacaaattaaagaaaagagaatgttgatggaaggtcttttctaagcatgatatgaaattggaagccatagagattgaaaagtttgactacattgaaaaaaaatgtcaccataaacaagagttaaaagtcaagagcatactaggggatatatttgaggcctgtgtaataatcaataatgtcgatataaaaaagagacaactcaatagaaaaatgagaagaaacattaacaggcaattaatggaagaatataaatagctaatcaaggtgtaaaaatatacttcattaataagcaaagaaatgtaactaaaaggctgggcgcggtggctcacgcctgtaatcccagtactttgggaggccgaggcagcagatcacgaggtcaagagatcgagaccatcctggccaacatggtgaaaccccgtctcactaaaaatacaaaaattagctgggtgtggtggtgcatgcatgtagtttcagctacttggaggctgaggcaggagaatcacttgaacctgggaggcagaggttgcagtgagccaagatacaccactgcactctagcctggtgacagagtgagactcagtctcaaaaaaaaaaaagaatgtaaattaaaataaggtatgttttgcctaactgacaaacatgataaaggttaatgatactaatgttagtgataatattaagttggtataacttgctgtgaaaataaatttattatattgaaatctgtataccctttgactcaataattccatgtttaacaatgtatccttcagattactcacataagcaagtaaacataaggtgtacggggatgtattttctgcagtacagcttagagactggaagtttatccagggaaaggactttgttctgtttaccactgaatcctcatgttagcacacagtagtaggtggttcaatgaatatgcattgaatgaatgaatgaaaaatgaaaaactggaaacaacctatcaaaaaggctaaataaattcaagtactttaaaaatagcatatgctatacagaggttaaaagaaataattagctataataaattcatattgtcaactaaaaaacaagttgttgacaatttatgttcttatttgcatgtgtaaaaaataaaaataaatataaatttatgtacttaccatatatagaattatataaaattatatataaaattgaatttttttcacaaagagtcttaagtacaagaaacaatatgtagtagctgagatgtgggttttgggaagaagaggtcatacattctattttcttacacatttaaactattgggctttttctctttaaatgagcacatattatttcatgtaaataatacaggttattgggggaagggaagatagagccctttagtaaaatgaaacagggagaaaagttaatattaaaaattcctgtattaaggtgtacacaattgcaaaagttgatgcatgaagctgactgagtatcctagagctcaagccatatgacgtctacttcaaaggcactatttctgagtcctactctagttctgttttctgcaagaaaaaaaagtattttaagatcttccccaaatcctcactgctaggttgtcctatatgaaatcagatagactcttaataatcctttctaatttgtctcctacaaaccctactttctcatttacctattttttcctaccctattttgttggggggggggcacattaactgcttgattagtttgtccttaatagaagactcacttcgttaccttttgttatctcgtcaatatctggcttcatatcactagtggttaggtggccttaatagtgcgcaaaatcagctgggagcccctctacgcagttaaggttcttactatagacaacaggagactatcacatctctcaatttcaaaactttttcaagcctttctcagctgaaataacctgttcaacctacttcccattcatacatttaaaactatatactgggttccacaatattctgagcattctatggaactaacagtaagatacatacccaggggaaataattgtgttatgtattattatgacgtgccctttagatgtttctgcaactctcagcttacagaatcacagttttataatatcaacaataacacaaatataatacatgacatatttaataatgacgttacccaaaagagagttttccctttataatattacatttttaaaatcgataggaacattctagtatgtatcctttaccttgtgtaagaagtcttctaattgctcaaccgctttgttgacatctacttggaaaaattcccaaagtttaagctttggaaaatatcctcccaaattatttttcggatggactgaaaaatgtcaatagttaaaaaatacaatatacatatacttatttaaaatcagttaagcaaatactgtttatcatattaaaatacagttctaagtaattttcaaccatatatttaatgtgtgctttagaaattttttctgttttatgtgatactcctctgtacatactgacattcatatggtgatcattttcaatcaaagcaggattcccttttctttgtatttcccttctgcaacatcacaggagaaacgccaaagtgctcttctaagacccaggcaggttttaagtgtggagaattcacaagattataggcacattctggtgttcctggatccatttactattagcagctgaaggaaaaaggagacacaaaggagtatccataattaaattgaaactgtatctatgttaagtttagaggtgaaataaaatataaagattaccactcatttttttctatattggacatcaattttacgatgatactgttacaggaaaattttttctttggttatggtatcctatcattcgcttcagcatactttttttttttctaacttaattctgcttagaaaatccgatgaaacaaaaagcaactctctcataggtaacactttgtatggctcatcctaaagtgttaatgaaatacgttgttttgataagttggataaaagcgggttgagaaagtgctaaaataaatacgctcaaggaatacgaatgtagcttatagttcagatcagaatcaggagtttggcacagtattccaaatatttacaacattgaagataatttgtttggccaggcacggtagctcaaccccagcactttgtgggagtggaggtaggatagcctgaggagttcaagaccagcttgggcaacacagtgaaaccttatatctacctatttaaaaacgataatttgttttaatttaaaataaacgaatgaaagttacatggaatttgtttgatcttaaaatggactaataattatccctgaattcatattgaagagcatgagtgattaatgtgtaaaaataaaaagtagtaacaattactgaatatttaccacataccagaaattgttctaagcgttaaatacactaatttattattcctcacttcctaccacacaaattaggacatactgtttgttcccttaacaaaagagaaactgaagcacagagagttaagtaactcagcccaagtcaacagtcaggaattaacttggccaagtccctcttcagaatatgcaatcttaaccacattgtctgctgctgaaatgaattgtttgtgcttcatttactcagctgagcacccttatataatttagaatcattattatttccagtttcagtcatttatttagtaagtcatttatttacttatatttattcatacccataataagcactcagatgaagaaaggctatgtaaggagcaaagagttgtaataaaagttaaattggtaattctcaaaacttgcattaagtagttcctccgagatcatcaacacaatcactgaaattcaaggtatttttcaaaatgacaaaatgtagtaataattatgtccaaataggattttcacgtataaagaataaatattggggctaggtgcagtggccacgcctgtaatctcagcactttgggaggctgaggagggagtatcacctgagtccaggactggagacagcctgggcaacatagtgagacctcatctctacaaaatttttaaaaaattactgagcatggtggcatgtgcctaaagtcccagctactcaggaggctaaggtgggagggcgcttgaccccaataagtggaggttgcaatgaactgagattgtgccactgcactacagccgggtgacagaatgagaccctgtctcaaaaaaaaaaaaaaaaaagagtaaataccaatgcgctctcattcatccatttatttttgagaaaggtctttctccatcacccaggagtgcagggtgcagtggtgcaatcatagctcactgcagccttgaactctagagctgaagtgatcctctgcctcagcctcccaagtagtcaggacgacaagtgtatgccaacacacacagctaatttaatttttccctttttttgagacagagtcttgctttgtcacccaggctggagtacagtggacagtctcggctcactgtaacctccacctcctgggttcaagtgattctcctgcctcagctctggagtagctgggattacaggcgcccaccaccatgcccggctaatttttgtatttttgtagagatggggtttcaccatgatgcccaggctggtctcaaactcctgacctcaggtgaccatccgccacggcctcccaaagtgctgggattacaggtgtgagccactccacccgtcccaatttttaaaatagcaaaatcctaaaactgtttcttttttcaatattttgaaacaaaatcaactgtaaaatgaaagaattctaaacaataggtagtgaaaatatttttttctaattcacatgaaagaagagtcaaactccaaactatgttttaacacacatcaacattaaaaaataatatggacttctggagtgatacagtaagaaactcaacaaacactgtccctagcaaaacatttaactggtgaaaataattttaaaaacaatcatttagtccctggaaattatcctagggattcagcataagaagaaacatttatttaagataagaacagcaagagtcttggcatttgaccaagaccttttccagggcaaatgggttcccagtgttcttggcctgctacttgtgggaaggatgtcagctctgcaagtaggggctgggtggagaaaaggagatttttctccacctgccgcttggaatagaacttctgcaacacggccgggtgcggtggctcacgctttgggaggccaggcagggtggattgagacgaacctggccaatatggcgggactccaactctactaaaaattaaaaattagccaggcatggtggctcatacctgtaattccaactactcgggaggctgagcacaagaatcgcttgaacccgggaggtggaggctgcagtgagccaagactgcgccactgactccagcctgggcgacagaaggagactccgtctcaaaaaaaaaaagagaaaaaaaaataaaaaaaaagaacttctgcaagacagggccggcagggagaattaaaaacactcatagacgtgcctcttagcatgaaactataaccccaggctgggagttgggaggagagaatgtctcctcttggccacacctaccaggagtggagcacctgtgatacagcttccataacagaggcattgtgtaagataatggagcaggtcttggttcaatcaccaaggactcctgttcttactaagtgtagtagatcttcatatgtttctccatatgctaaatatccgtaggacaatttcaagggatttaagtgattgtcttaaaataattttcaccagttagggttgtttcactacgtaaagatgtgtgaagccttcacataaccattctggaggttgaattctgctagataatacttttttaaagaaaactggctgggcacagtggctcacgcctgtaatcccagcactttgggaggccaggtgggcggatcacttgaggtcgggagttcaagaacagcctgaccaacatgaagaaacccatctctactaaaaatacaaaaattagctgggtgtgttggtgcatgcctgtaatcccagtacttgggaggctgaggcgggagaatcacttgaacctggaaggtggaggttgcggtgagcgagatcgcgccattgcactccagcctgggcaacaagagtgaaactccatctcaaaaaaaataaaataaataaaataaataaataaaagaaaacttgtttcacagaaaggatattacgtttgcaacacttttcaagtaaggctgtggcaaggtttacttcttttacattgcacagaactcccaaatgtctcagaaatacagtctgtggtagagactgctgctgtactcagttttatctccctttctttctttagtaataaaattcccaaggttcaactttacacatagctgacaactcaagactacgctgcaggtctcctttaaggtaggtatggcaagagacaaattcctgtgtgcaatatgaacacagtaatatatatcatatcatacccaaaaagacatgcctgccctttctcatttccactggggagaatgtggtagcaggagctggaatagccatatctgactaagatttgaagcaaagtgttggagactgcagagcaacatgagagaaactagttccctatcaccctgaactaccatcctagtccaggaatgcctatctaatcttttgtaagaaataaatacaatttagcctttagtccctatgtttttctgttatagctgcttatgccatatcctaactcatcaatttataactcataaaatgcccttatgtggtttgataaatctgatttcaataatatttagatctcaaagtgattatcaagactgtcaaattttcctttacaatttttttacattatttgtaagagatgggggtctcattatgttgccaaggctggtttcaaactcctggcctcaatcatcctcccacttcagcctctcaagcagctgggattacaggtgcaagccacagcacctgcttaataatgtcaaattttcaaatgaagaatactgagttcttaggtattatgaagtttcaccgtagaactggaggcttggtttctaggtacatgcagaaacaccaaattttagaatgacctatttctttacctaactttgccattatgattagagatttttatttatattgatgaacagatctatgagcttttaaatatcttcatagtttctatggttacttggagaactgtttttgaaacagcagattgtatcttttaaatgtttgtaccaactagaattcttgttctttacaatgcaaatcagtggtttccaaacttttctacattgtagcatacacacaagataacattttaaggtaaactgggttaaacccaaagctgctgatggccacgctttgtcaggctaggccagccaggctcagctcctctgacaggtgaggggagcaaccatttcctcaaggatcactagcggaaaaatctgatctattttaatagaattatataccactaaggaatcttaggaaccaaacagactaaatttaataagctcttttaacatgtagaagacataatttccaaatacaactttgagagtttactaataagtttctctccaaataatagaagtcattcagttttttcatatagctatagtactatagtaccagagctcctgctaatataggatccatgagttacttgggaaggattaatagagtagtcccctcttatccttaggggtaccttccaagacctcaagtggattgtaaaactatagatagtatgaaaccctatatatatatatattttgatattttgtgttttttatctgataactgagcaggctattaagtaactggtggacaggtagtatttacagcatgatgcactggacaaaaggatgagtcacattccaggtgggatagagcaggatggcatgaggtttgtcatgttacttaaaacagcatgaaaattaaaacttatgaattgctgatttctggatattcaatatttttgaaatgtgattgactgcaggtaactgaaacctcagaaagcaaaatgcgaataaggggggactactgtactgtaagttgaaatatgtgatcattatgttccttcatgatcactctcctgtatttataagcaacagatgcaagatacttatatattgacttaatctcaattaagaatgttttctttgaaaggaaaaatattaattttttaaacggaaggacactaatcatcatttgtgtttttaaaatttatgttagcccctttcctttctctttctttcttctttctcttatttgtgtgtatatgtgtgtgtgcataaattctcatcaaaattaatgaagcagtcaatgaagctcataccagtatgattgtagacaacatcagtaatacaaataacattcattccttttttaatttttccactagctgtccaacatcattccaggtatactttctattggtcttgaaaagtcaggatttaattctaactgattggcaagggagtagcatgacctagaagtccaagagtctgcaatggggtaaaatgaatcatgttgtagcctgcaaagcaaataaagaaagaccactgtaaaaacaaacaaacaaaaccagcctaaaatgaagaaaatataaattaaactttcttaagtaattataaatagcaaggcaagcatgctactggaaaagaggtcaaaacttgggttcaaatcctaactgtaccacaagagactttaagcaagtttatttaaatcttcaagatatgtgtcctcatatacaagacagagataatgagataatatttgaaaaaattcaacacactgcctattagaaaatttatatacttaacatgtagtaaatttatcttctacgagatatcaacacgtgtttctactacttttaatgttccatagtacttgtattctgttttagtatgtcagtgaacttctcattcctttcttcatgtattatccaacttaaaagcagaaaattatattgagatcaggtgcagtggtttgcacctgtaatcccagcactttgggaggccaaggaagaggactacttgagcccaggagttcaagaccagcttgggcaacacagtgagactttttctctacaaaaaatagatcaggccactgcactccagtctgggtgacagagacactgtctaaaaaaaaaaaaaaaaaaaaggccaggcgcagtggctcatgcctgtaatcccagcacttgggaggctgaggcaggtggatcatgaggtcaggagatcgagaccatcctaacaccgtgaaccctgtctctactaaaaatacaaaatattagccaggcgtggtggcaggcgcctgcagtccaagctactcgggaggctgaggcagaagaatggtgtgaacccaggaggcggagcttgcgtgagccgagattgcgccaaaatgaaacacaagtttcattttgctcttggtatttatggagcacatgtcttctacacaaaagatggttaaccaatgtttgttgaattaaaatgatacaaatgataatacattttccttcacttttcaatagcttatttctgatttttatatggtaaatcttagaaatgataagtgtttcattatggagttccttcatttcttaagctgaaccacaaatttgccatttttataggttaaaaatggttaagtatcaaaaatgtaatatgggccaagccagcagctcatgcctataatcccagcactttgggaggccaaggtgggcagatcacgaggcagaagtttgagaccagcctggccaacatggtgaaaccccgtctctactaaaaatacaaaattagtgaggcatggtggcaggtgcctataatcccagctactcaggaggctgaggcagaaaatcgtttgaacccgggaggtggaggttgtagtgagctgagatcgcaccattgcagctacgtgacagggtgatactccgtctcaaaaaaaaaaaatttttttttaatatggttctactacttatattactaaataataagaaacaaaattaaacatagaggcaaaaagatatggttggatttgtgtccctgcccaaatctcattcgaattgtaatccccgatgttggaggagggcctggtgagaggtgtttgatcacagaggtggatttcccccttgttctcatgatagtgaggagttttcacaagatctggttgtttaaaagcatgtagcacctcccactttgttctcttctccttctctggccatgtaagacatgcctgcttcccctttgccttctgccatgactgtaatttcttgaggcctccccagccatgcttcctgtatagcctgcggaactgtgagtcaaacccttttctttataaattacccagtctcaggtagttctttactgcaatgagagaatggactatacacaaaacttttgaaatctatatcacagaggataattacatttatttttttaaatagaaaaagaaagcaagctgacattacctgattcttttgcaaccctaagtctgctttcccatcatcaaaaggtcccaaacacttagctaaaaatgtctgaagagtaacacagtccaagggagcacatgattatcagcaccaacacgtaaaatggggtccacaactatgtaacctccacccttttctcatttctaagggaaaaaacaaaacaaaaacttttcagtcagtgatagaaaaaaatcctcatataatatagtctgactctaactaaaaggttaattgtcccaaataaaatgttttatttctaagcacataaaatcattttaaaagttgcaacaaaacttaatggaaaagctcttttaccctttcacaatctacataattacatgtataatacacaaaatatccaagaatgtggtttaatgaaatataagtatactaaaacctatcagtaataacaagggcacgcaaataacagcaacctataatcaggttgcatgaaattactacattttaagatgttacttaaaataatttacttgatactttagctctgcaatggaccataaaattacctcctagaaatcaaagatattctatttgcatctcaaggaagcactataaaaattgcactgccatggttcatacagtacatttacaagttaggtgacttcaaattacagaacaaattaactttttttctcacaaacaaacacctgacttacccttgaaggaaataatactgaaatgaaccagattgttgcagattagtttacagtatttatcagaatcatcttctctttctgttggattttcccaatccagagacggaatttttctctattaaatgtttctccaggaaatgggtaatttgtatacacggtaacgcttttccctgtaaagttgggcctaatcggaactgtagctcataccctaaataaaaagccatgttaataaactcatcgtaggacttaaattaccacattgaaaaacagatgttttattaaagtattaaaaaaccttgatttttcaattatgtttaaaataactccgcaaacctaatgtgttttggcactactttgtattccaatttagctgaatttcacattttagcaagtatagtaacatcatagagctgtctgctctgtaatgtctctttctccttcccctggaaacgcattctattcacatagcaacttgggatgtgcaaattcttatacaaccccatttaccatgatccccatcctcacccctgaattaagtacccaatggcaggcatctgaggagagaccttctctagatttttctaactgcaacagagaaagctagtttctctatggtgtcagaaagtatgtgatatctgtaaaacttgggagctaccatgggactattatctcaccatactgagaaagctagtctcactgacagaagtcaacctctatagaggcagaattcaggattctaacaggagttctgaggcaactgaacccgactgatatctgctcaagtccagtgatgtgctaataaagatttagcactgactagggtggtgggaacctctgacttggagtgtttgctgactttctggtggaaatatcccgacatgggcaatcttaagctaccaacacgacaacattgaacgtggaagtgggaaggatgtgcacaatcagctcttgtgagccagcaaaagcacctccaacacactactgcctaatccctgtgcttcatggtttagttactaaagctgtcttgtaatcctgagagccaatgcattctacttttgcccaagttaggttatttttaaaaaaacataccttagacttgtgcaatggttacaaatattttgccataagcgaaaacaaataagcacattacagttaaaactgtacttgaaagaaacattttggttggtttaaagcagactttaaaccttctttataattattagatacgaaaatactgactatggtcaagtctattagaaatataatacatataaattttaaaccgaatataactttcaattaataatgggcaataataactgatgaggcaggaaagtttagtccactgagtaaaatctttaatatctaaggaatttctttgagaggaaaaaaactaatattacctatttaatatatattatttataatttataatccttgacttattaaacatccaacaagtaataaaagaggatatactaacagggatattttctgtgaacaaaagatttcagtaaaaacactaagagaatgctctatagtgaaactaagaatttcttctctaagcaactaaatgtatttttctataatacaatttggcattaatatattaagaatgtttatattttttgatctagaattttatatagattttttgagaaaagtatcagtgatgtaaacagagattatgtataagatatttatcacagcctcatttattgaaatgaaataaactgacaacaacctaaatatctatgattggcagtgattaaataaattatggtaaatctacaagctggcatattgtaaagccatataaatcatgttatcaaaagacatttggccaggcacagtagctcacgcctgtaatctcacactctgggaggccgaggcgagaggatcacctgaggtcagaagtttgagaccagcctgccaacatggtgaaaccccatctctactaaacgcaaaaatagctgggtgtggtggtgtgccctgtaatcccaactactcaggaggctggggcagaattgcttcaacccaggaggcagagttgcagtgagctaggatcgcaccactgcactccagcatgggtgacagagcaagactccataaaaaaaaatgtaataaccacttttaatttattctattttgttacattgtacacattttgtagagcttttaaaatatcttctggaaaaaagtatggctgaaacatggcagtaggcaggaggtagagtacatacaccataatactactacaaacgggaaaaaggcaggttacaaaatgtttagatagtataatcctaattaaaaaaaaaacacagaaaaaatgctttttatacattgcataattttataattagggaaaacattttaaaattagagctacaattatgaagggataactaagaaataattacagaaagaattaaaacatgaagtaaaatacttagtgactgagaacataaacatttacatctcacaagaatgactaaatttatctttaggagaaatagtgtcatttgaacaagtacaaacagcagagattagctgtctgggtatatgtgtacaacctgtccccgttaagtttatacaaatactgtttttataattacacaagtattcagagaacttgcagagaaaggttaaaactcatctaaaatctccaaaacagtatttggatcagtgctctaccttcagaaaaaaccccaataattcccaagctaagtcatttatttatataatatatatgtatgatttctcatagattatgtaaattataaaatataaaagttaacttaatgggataagatataatgaaataaataatatttaaataatacattttatttattagtgggtagaaaaaaccttttgctctcactaaaaattaatattgataatatctctcagtgaaaatgtaactaaataaattcattattttaaaaagtcttggttttaatattttgtaataaagtgattcaaagatttcaattctacttattttgggtaaaatcatataatgatgaaagaagcatttctaaaaatatatatcaaaatgctttcactatagcaagggttggcaaagtatatccagcctaatccccatttcgtaaatgaagttttactggaacacagccacatccattcatgtatgtttgcctatggctgtttcctgctacaatgggagttgagtcgctccaatagggagtgcattgcctgaaaagctgaaagatttgcgatctgaacttttgcaggaaaatatgtgccaaactctgctccaagcatcatttccttcaaaaaagcacttaactttctcactcatgtttacatcaaagacttaagttttattttttctgaaaatattttctaagtatcatactatctaatgctacttgttatttctgaaaggacgaatctcaaacactttctaactcatcttttaagttcgatcactcctgtgaggaaaagaactattcttggttactctacctctccttacaaagtaatatagagactgttattaagataatataacccgtaaagctacttaacctagcttaagtaaaagtgcaatgcatggcacatactgcaaacaaatgagggtgtgattgtcaaccccttccagacctacaacctctacttttcttctgagtatgccttttttgtttgtaacttatctgacatacaaactgagagcatattcatatattaacgtaattcaatgttgctaacatataacagacttaaaaaactaaaacggtagagagaaaagaaaagagccctctccctcttcccccctccccctccccctccccacgtctccctatcccccctcccacctccccacggtctccctctcccccctccccctccccaggtctccctctgatgccgagccaaggctggactgtactgccgccatctcggctcactgcacctccctgcctgattctcctgcctcagcctgccgagtgcctgcgattgcaggcgcgcgcgccacgcctgactggttttcgtatttttttggtggagacggggtttcgctgtgttggcgggctggtctccagctcctaaccgcgagtgatccaccagcctcggcctcctgaggtgccggattgcagacggagtctcattcactcagtgctcaatgttgcccaggctggagtgcagtgcgtgatctcggctcactacaacctccacctcccagccgcctgccttggcctcccaaaggccgagactgcagcctctgcccggccgccaccccgtctgggaagtgagaagcgtctctgccggccacccttcgtctgggatgtgaggagcccctctgcccggctgcccagtctgggaatgaggagcacctcttcccggccgccatcccatctaggaagtgaggagcgtctctgcccgccgcccatcgtctgagatgtggggagcgcctttgtcccaccgccccgtctgggatgtgagagcgcctctgcccggctgcgaccccgtccgggaggtgaggggcgcctctgcccggccgccctactgggaagtgaagagcccctctgcccggccagccgccccgtccgggagggaggtggggggtcagccccctgtccggccagccgccccatccgggaggtgaggggcacctctgctggccgcccctactgggaagtgaggagcccctctgcctagccaccaccccgtctgggagtgtacccaacagctcattgagaacgggccatgatgacgacggcggttttgtggaatagaaagggggagaggtggggaaaagatagagaaatcagattgttgctgtgtctgtgtagaaaaagtagacatgggagactctattttgttctgtactaagaaaaattctgccttgggatgcgttgatctatgaccttacccccaaccctgtgctctctgaaacatgtgctgtgttcactcgggttaaatggattaagggtggtgcaagatgtgctttgttaaacagatgcttggaggcacatgctccctaagagtcatcaccactccctaatctcaagtacccagggacacaaacacttggaaggccgcagggtcctttgcctaggaaaaccagagacctctgttcacttgtttatcgctgaccttccctccactattgtcttatgaccctgccaaatccccctctgcgagaaacaccaagaatgatcaataaaaataaataaataaataaataaatacaagaaaagaaaagaaaggaagaaggaaggaaagaaggaaggagggagggagggaggaagggaggaaggaagggaggagggagggagggagggagggagggagggaggaaggaaggaagggatgttatattttcttctgtagcccaatagatatatcagcgcataccccaagggatacatagccactctgtagactctaatgcaaatcactgaaactaaaatttttatatacagtaaatgaaacatcagagagctacagtaggtcagattccatgactcagtttgctaaaattagctgaggtcatagcagtaatggtgtggctatcttattcctcatactaatgctaggatacttaacttgcattagccattctctcttgtaggcaactagcataatgagtgattaaactattattgtaaataaatatgtctatcttttcccctccactcaatttatagaaactcagtcttctaatcaaagaacctttagtctaaatattttctttaaaaaatagtaaaaattataaatttcatcaacctacttaaaaatggaagaatttcagatttgggaagtacttattttgttcattattcttttttttttttggaccgagtctcgctctgttgcccaggctggagtacagtggtgtgatcttggctcactgcacctctgcctcctgggttcaagcgattctcctgccttagcctcctgaatagctgggactcaggtgcatgtcaccacatctggctaatttttgtatttttggtagagatggggtttcacatgttggccaggctggtcttgaactcctgatctcaggtcaactacccgcctcggcctccaaagtgccgggattacaggagtaagccaccgtgctcggcctgattttattcattattctccactaaatgagataggaaataagcgaaaaagctatgatttgtctagaaaagatcattattattcttgtacttgttgaactggaagaatctatagaaatatcagtcttaaaaacgaggggaattccttcttgtagaaaagagagaaggaaagaaatatgagggctttgatgaccaataaatatgaaacagccaaaaactgccagagtttttcctcacatttgattggttaccaagtctctgaacttgaaaataactcatactttgtcctctctttttcttttttctttttttttggtcggagtctcgctctgttgcccgggctggagtgcattggcacgatcttggcttactgaacctccgcatcctggattcaagcaattctcctgcctcagcctcccaagtagctgggattcaggcacccgccagcacgcctggctaatttttatatttttaggagagacagggtttcacatgttggccaggcaggtctcaaactcctgaactcaggtgatccgcctgccttggcctccaaagtgccaagattacaggtgtgagccaccgcgcctggccttgtcctctctttttcaaccaggctgttcaatccttttctttaatcagatgtgtttttaaaatagccttctcaatgctcttgtctccaatgtcccttctctaccactcttccactcatctttcacatttcaaattattttttttttttttttgagacggcatcttgctctgtcacccaggctggagtgcagtggcgaatctcagctcactgcaagctccgcctcctgggttcacgcctttctcctgcctcagcctccgagtagctgggactagaggcgcccgccaccaggcccggctaattttttttgtattttagtagagacggggtttcactatgttagccaggatagtctcgatctcctgacctcgtgatcgcccgcctcggcctcccaaagtgctaggattacaggcgtgagccaccgcacccggcttaaattatcttctaaaacaaaatgatcacaccattactgcaaaaaaaggtggcacattctatttataacatttggatacatttaccggttttaaccagagttataaagtcaaccacatcttcttttttcataaatccttcaatttccctcttcaaataggttagcttttacaatttttctagttttaactagagttctagtaatcaatcagcagtacactgcactaagtttgtaaggtgtccctatcctcacagattttattttattttttatttttttttaagatagagttttgccttgttgcccaggctggagtgcaatggtgtgatctcagctcactgcaacctctgcatccaggttcaagcgattctcctgcctcagcctcccaggtagctgggattataggcatgcgccccacgcctggctaatttttgtatttttagtagagaaggggtttcaccatgttgatcaggtggatggtctcaaaatcctgacctggggtgacccacatgcctcggcctcccaaagtgctggattataggtgtgagccactgcgcccggccctttatttttgttttttaaagacagggttcactctgtcacccaggctggagtgcaatggtgggatcatagctcactacagcctttaatcctgggctcaagagatcctccagcctcaacctcctaggtagctggggaccacaggcaacaccatcatgcccagctaattttgtttcttttttgtggagataaagtcttactatgttgccaggctgaccatgaactcctggcctcaagtggtcctccagcctcagcctcccaaagcatgagattacaagtgtgagtcacctgccctcatcaattctcacagattttaaaccctagttgacactgtaagactaacaagcctttagacactgcttcattattcagcacttaatagtttgtgctcattgtgtaattggaaatcaaaggaagcagacagtgaaaaattagggaaagactcacaaaggaggtgatattctagctgaaagttgaaacttaggcaacacatagactgacataaatgagatttaacagatataaaggaatctgatgggagtacgggtataaggacaggcagagaaaacctgctgagaagggaattaacaggaatgacttgggcaactgtaaagatctatacattaatgatggagaatgagatacaatcttggctaaggaaggtgtagtctcattacagatgtcttagaagtcagacagaggtatttaaatttgattttatacataccacttaataacaagggaagagactgcataagattattctggcatctatattcagccatacagaatagacagcaatcagagatatttggaaagaaactgcaagcttaaaaagagactgcaggaaaagagagaaatcatcaaagaatataaggtttctaccctgggaactataaaaatggagatgccacgaataaacagggaagctgagaaataaaggatcgagaatgggcaggggatatttttggacagctagatttaagcatatccaagttgagctatcctaatactattctattgcataatatcagttgaagccaaggtccagggtgggaatacatggagtgattcatatcaatgccttatattatttagggctttatcacaaaaaattcatgtattattaattttgagtctcaaaacctagaaggtagaagaacagaaattaccactttcatctcaccaataaataaattaatgctcagaatggggccatgcccggtggcttatgcttgtaatcccagtactttcagaggccaaagaggggggttgcttgagtccaggagttcaatatcaacctgggcaacatagtgagacccagtttcacaaaaaaaaaaaaaaaaaaaattagcggggcatagtgatgtatgcctgcagtcccagcacttgggaggctgaggcaggagaactgcttgagcccaggaagttgaggcagcactgagcatgatcatgccacaacactcagcttgggcaacagagtaagaccctgtctcagaaaaagaaaaaggaaaaaaaaaaaaaaaaaaaaagaaatgaatgctcagaattaatgtaacttgcccaagtcagcttgttagcagcagagccaggagaattctggctctagatctacccgtcatcaatgctgaaagcttccaagaagaagaaagctcaaggcttttcctccaaaagtagtcattgcacagaggcaacagttgaggccatgagactgtgtaactaattctttgaaggagaacagaaaagaattcctagcagatacccataattaattaaaaagtgaaaggaagagagcctagtagagacaccaagttgacaagaatatgcaacaggggagggggaaaaaaaaatcaaaaccaaaaagtgcagagtcaggaaagccaaaaatggagtaggtactcagtgattttaaatgccaagttggaaaaaggcgcggatttggcatgaagatatcacattgtatgtgtgaaattttttcaaaaatttaattcttaaaacattagcgaaatttaaaaattcctttgaaatgtttatgatagcaacatccatttggtacattaataagggggactggatttttcatatattacacttctcaatgttgaaaaattacaaaggctaagaaaataaaacatctattaactagccttgtagaaagtaatttgatcttttaaatacagatcaactatatatagttcaacataaccagatgattattgcactttttatttgctaagaaaatattttcagcttttacctactccacatttgaaagtttttgatatacataaacaatagtttactatactttttgctgcaatctattttgtcattcaaaggttcaacaaaggaaaagagacagttatacaaaggcaaaactacatgcataccaaagcaaaattacatatgaagtaatttaccaagttttaatagtaaatgttattagaaaaatatgggcaatcttctgatcatatatttaacttcaatcttaagtgggaattagtacgcgagaaaagagaactattttatccttatcctaacacgagggatataaaatatttttaattaaatcaacattaattagtgatatatggagaacacagcaccatctttgcacaaatcaagtttagacccttggaaataatatttatcttaaagctttaaaacatttaacaggactgccaagaattaaaagtttaaaagacgcaaatgagcaaatcaaaacaacttgctactgaccttgtcaagtctgaagagggtcttttccagtttctccatttcgttcagaagtaaaattcgaatcgtttactgtgtcccattttggcttctagaggatttgaaatctttcataagaattaaaagactccacagtcgaatgagttacccctatgaaacaaaaaggagttaaaatatcgaaaatactattgccttaaactctccagagctgacagcggcacttacatgttcgaagtgtgttttagcctagcagagcaatgaaagagaatgaatcttataactattaagattcgagaaggcaaataatagttgtttcctgcctttgagcacaacgaataagaccgaaataaaaatgctgtattcagattcttacaattaaaaaattaaaaacctagaccattctcagagaaaagcaatacactaggaaagcctgaagtcagggggacattcccagccccaagccacagggctctggagactcgaatggcacttctgcttacaagagattagtctgctcaaagataacaggtgggcaatctcccattcccaaattcgggtcgccagccaccaatggggagatgagaacagagggaagcagtgttgcctctggaatagctgccgtagacagaagatgtacagagcgagctatagatagaagaatgcgtttccccgcgaggccagcggcattcctagcacttacgccgagggagttatactgcggcttctggggcactgcaggacccgcgactctggtgctacggtcggggggaggggaggggagaaacagaaggggaagggctggctgcccagcctcgcacagaagccgcagcccaagagggccgggcgccgtgaagggcaaagggaggggcggcgagcgaccggggcagcgccgagcagctgggtgagaagcaggcagagtctcagcgacttcgcctcgcgcgggttcctgggccacccggtacccaacctggccgtgcgcgcactcgccccaggtgggagcggaccgtaccttggcccacttccgggaggctcgacccgcccgccccgaccgctagtctcgcgagagcgtggcaccgcaccgtctcagtcggctccgggccgggggacctggagcctgctgcggctgaggcgggagcggcgctttctccttgccctggggaaggtgcaccggccaaggcgcggccttccttaacagcctgcgagctcacagttgcacattaaaatcccgcggtaccggctgcgagctagttgagctgcacagtaggatcttttgctgggaagggctgaatggtgaggggcaaacgactggcttctggtgtcttttgtgccaccacgtgttttgtttctttgttttgataatttttattggcctaagttctcagagtcctgatttctaagtgtctaaaataaggggcctggctacaccttgacattccagccaacacgtgtccatcacttctagtgctaacagacaggacacatgtcctgaatgcagacccagtaggtaaggtgtggccagtctgcaaaccatcgagagtgcaacaccactgatacttaacggtgtccgggtgtacctcatgtacactagatagacccggagacgtctgagattaagctgcacttatgttaggccagtaactcagaactttttgcagatgctaaggagatttaatgcctgagggtaaaggaaaacccatcttccagggcttttggagggctctaatggttatgagaaaatggacagaagatttggttaactaagacttgtggcgtgtggaaagattcttgcattctttattgtggaatgactgtaggtccaaagaggatataagttaaaaaaaaaaccccatactgaagtatttgtttatttctgtagatttctgagaatggctagttcaaatggtccgtaactgactttgggaacccacagctcattttctggcccctactatttgcaggcacataaggtgctgggaatgcagcaataaaacagtcactgccctcaaggaactccacattttattggtgggagacagataaattaaataaattatacaggatataatatatccttataataagaaggatatgttatatcctatatataataggaagggggaagtgtggaagagaagcagagagaggtttgcatttctaaatataacgttcagtaaagtgatgccaaactgcggaaagaagaagtctaaggtagagggttacatgtagaggtataggaagtacaaaggccataggcaggagcatacttggtgaaccgaagaagatcaccatagctgagtgaagaagagagtgtaagagattaggacagacagatggggcaggagaagggatcaggagcacagacgggtgacagatcttttaaggctttgtaggccattgcaaggacttgggcttttaaactttggaaaaaagccatggagattttgaacagaggagtgacataatctgattgaccttttaaaaggatcctccgcaactttatgggaaatagttgaataaactgtagagtgtagcaaggaaggaagcaggagaccagttagaaagctattttagttattcaagcaagagaaagtgacttgtgtgtgtttctctgtgtcggggggttgggggtgatgggggggaggtggtatagcaggtggtgtagtgctgaattctggactattttgaagatagaacctacaggattggtggagaaaggagtcaagatgactccaaggtttttggcctgaatgagcagaaagcactgtccaatagaaatattaatgccacataggtcatttaaaattttcaagtagccacattaaaaaaacttttttaaatacaaaattagccaggcatggtggcacatgcctgtagtcccaactactgtggaggctgaggcggagaatcgcttcaacctgggaggtggaagttgcagtgaacccagatcatgtcactgcattcagcctgggtgacagagcgagactgtctcaaaaaaaaaaaaaaaaagaaaagaaaagaagttttgaaaaaggtaatattaattttagcaatataatttacttaatatatccaaggctcatttcaacatataaccaatagaaaaagttactttattttattttactttttgagacaggtctcattgtcacccaggctgaagtgcagtggtgcaatcatggctcactgcagcctcacctcctccctcagccttcctcatccattcccagtagctgggactaccaaatgcattacattggtaaaagtattatttcacaaaacttctatttctgttacttatgttttggtgtactggtcatgtattcttactggaaggattatggttaaaaacaagattgaaagtgattgttctaattgcatgctgtgtaaaatgataattcatgattatgaagtggtgcctggtgttgaatccagctctgccactaactagctgtgaagctttgcatggtactcaacctctttgggccttggttttgcaactataaaatggggatgaaagtagtatctattgttaagtaaatgagggcttaaactgtgcctgatagagactaagtactagcgtacatacaaatgttagcagagtgaggcctgaccatgttgtgaaaacagatcacatttatgtttgtcttcaagttctccctttccatgcccctcccactttcagtctctcctatgactatctcattacactgccctcctgttgatcatgttctccagggctccaaaattagcctttcttgctgtccttcctccagtaaaactctcatttaatgcccagtgttgcaattagatataaggagtaaaagatattgatgacatcaattctttagtagtgatttattctcatacaaatgcttgaattttacaagatttgtaaatccaaacatcttaatcttggaaatttcatattttgaatgaaaatgaagactgctaagtaatggaacatgattaatatgatgtgcctctaagattaattttacaagctacatagtgtcctttttaaaaagaaaagtcacattattgtgctatttgtgaagttcttggaatgccaatgagtttgcgtctagggctacagtggtgccatgtgcagccttcattttaatgcacatttgtcatgtgctgtcctgtgcatgacagtgatctatatatacacaataatctcatgctgtagttgtcagggaaggctcaccttggggaacatctgatggataacctcaactatttggcagtgactctaggctttctaaaacattgaagttaatgcatttggggagtgggaggaggactgtagttggaaagactttctccagggttgtgtgtatgtatgtatgctttctgaaaggaaaagagttatttggttattatttataattaggtcctaatcctgtgaccttgtggatctgaaatggatggggtgccttatatttggtttttatattctttggcattttctgtgcactttatttcagagtgcccattattatcatgtcataattttactttgtaaaatttggatttgtgttttcagaatccttctaaattgaacaacttattctgtacttttgaaatatccagatacagccagtgagaagaaaagggaagcagggaaaagaaatagagttgaagttggagaagtggaagacttgaatgtatgatacagaggtatggaaaatcagagagagattttcttaaagtgagatagaaaacagatttagaggcaaacaaaccttggattcgttttaatcactctgaatcacgattgatcaccctaaaatggagagaacaagacctcacttgcaaatttggcatgaagattagaagaaaaaaaaaagcatttgaagcatctattctagcacttagcacatgatagacttttaataatagttttttaaaaaagaaggggtcacatctagttgtccttgctgggttcaagatggtagtcagacaattagatgaagaggaggttcccagtgcatggcagaggccaaagtttccagaaagtttctactttgtgaagaggggatataagagtgaattcagtgagcaaaatcagagcgtaattgttcagcccaaattagaaaacaaaaaaaaggcagaacctaagaatgaaatgaggattagtcgtatacaataaatatttattagaaaatgtattgagatgtacataaatagtggtaaatatgttgtatttctattcaaaacaaaacttgagctcttagagtttgcataggaaaagtccttaaaaattcctaataattgatataataaattagtcaaaaacaatgtatggaatgctttgatgcatgacaggaggacacgcgagaggctttttttggtggtgatctttccttttttcttaagtagatcttttaaaatgttgtttggccccaatttaaaaacgaaatcatttactcttgcaataaatttagctgcttgttgttggaagcaagcctcccaacatctggccataaactggcccaaaactggccataaataaaatctttgcagcaatgtaacatgtccataatggccataagcccaagctggaaggttgcaggtttacgggaatgagggcagggaacacctggcccgcccgggcggaaaaccgcttaagggcattcttaagccataaacaaaagcctgagcgatctgtgcttaagggcgtcttcctgctgcagttaactagcccaacctattcaattaattcggcccacccttcgtttcccttaagggatactttagttaatttaatatctatagaaacaatgctaagactgatttgctgttaataaatatgtgggtaaatctctgttcggggctctcagctcggaggctgtgagacctctgatttcccactccacacgtctatatttctgtgtgtgtgtctttattcctctagtaccgctgggttaagttctctcctaccgaggtggtctcggcagcttgttaaattgtgagctccagagtttccataaatgagcgctttgggttggcagtatagctgaagaaaaggaccaggaaagggggacttcaagctgatttgctgtatttgttagcatcacctcagtgcagatggcaggaacacacacacacacgacaaaagtggcttaaataagagccactctccatattttctctcacataaaagtgtagaggatgctgggcccggtggctcacgcctgtaacccagcactttggaaggcccaggtgggaaaatcactggaggttaggaatttgagaccagctggcccacatggcaaaactttgtctgtactaaaaatgcaaaaattagccgggcctgctgtgtgtacccctgtattctcagctactcgggaggctgaggcaggagaattccttgaaccaggaggcagaggctgcagtgagccgagatcatgctactgcactccagcctgggcgacagcaggagggcgagactccgtctcgaaaaaaaaaaggctagaggtaagctcttcaaagctgtgaggcagctctgtaaagtcatcaggaacccaggctcctttcagcccatagcttcctccttttgtgttgtggatctcatcttcattgtacaataaggctgccagaactccagctgtcaatccaaattcaggcatcaggatggaagaagagaagaagaagggcgaaccttcttcctttaggataattattgaaaatactgtacatttctgcttgtctcatgtttattaaaacttaatccaatgtacatacaaatgtaacctttatgtaggcagcaatgagtctagctaacacccagttttgttgttcaggaaagaaagaataattttggtggacaactagtagtctctgacacagttgcgtggtattttattttaaaatttaattgttgtcaaagtgacacagtttgcagcagggaatggaaggctct

SEQ ID NO: 5058 - DNA, 100000 bp, Homo sapiens
aaatactcagggcagcatatataatttatagatcccagtgcaaaatacaaaagcagggcctttgtttaaaacttcagaatatctagatggcgaaaacagggcattaaactaagtgctggtccttctaagcaggagtcctgcacactgcagaccccagctatgattcattgtaatgagggtgctcagggtattatcgacatacataggagttagccaatccgaagactgctcgtaagtcacttcctggaataaatgaacacggctgattttagagaataaagacaacgaggatattcccctgcatggaccttctcttctctttttcaggtcataggttgttgaagacaatcacttatcagccatctcctgtcaactggcaattcattttgacttaaatgccaatcaccaggagtttctgccactgaacacctcaataatctccctccagagctggaacatacactgtggtggaatggagatgtgccacccatcacccccttcaaggacttgtcccagcttctggaggtgtagtgctgggcaaccttctgctgtcaccccttttggggacagccctcatgcaatgactaatcaggtggagggagaaagccctggccattggcacacaggacgaccctcatggaccattttactccagggttcctggtgggatcagctggtctctctggctagcactccagctcaatttctcatccacccaatcctgcttcttccctcttcattccacaaggattaattccaagggtaacctgtaataaacatccggaacaccaaactccatctcagagtctgcatcccagataatcaactgcagcacagaccaaagaagcttctagggcttggggaggatttttacttgaaaactgtagttatattcgtaagacttatttcttcccaacccccatctagcttctgcagaatcataaacttatttctaaatcctgaaatccgatataaaatagtggaaacaaggactctgtatgtgatgaattaccctctgggttgaaaacttccatttgataaggatcaacatatccattaaaaacatataacatattttgtggaaattaaaccatgagtttattacaatttttgaggaaaacatttgtttttcaatctatatttggggaataatgtagtccataactatactatttatcaatagggtggaagtatttcattgacacacatttactcaattttcaaagaatgaggatttgaaattagaccatttggtgaataagttgggttgagcatagacatggcttttaggatgagcatacttgttgaacattcttagttttctttatttcaggtgatagatttctctctttgctttagtaaaataagtccattagtaatgcatatcacatttgtggaattataaagacattatttgagctgtgatggccagaatgtcatacagtcttctaggtaaaggcagatcttgaaaacgcctaaaacagaattggttgtgggaagtgacttacacattcattcaggtgcaaaatctaactacttcagggcatacattaatcttttgagaacaggatttgaaacaaataccgagatttggaagacaggcttctaaaatctccacagtcaaaccctctgaaagaaaaacacgaattttcttgcagtacataaggacaagttaatcagctgataaattaatattaactcaactcactaattgaacaatactacataataaatctaattcactgactcattgaattgattaaagttgttcttcacaagacatcaaccacttatagtgttattaataaaagcacttagcattatttctttattgatacatagtatatatttttaaaattacatatttatgggatacatgtatttgttaatgcatagaatgtgtaattatcaagccagggcatttgagggtatctatcaccttcagtattatcatttctatgtgctggtaacatttcaagtcctctcttctagttactttgaaatattaatgtattgttgctaactatagtcaccctaggctgctattaaacattagaacttctttttctacttgtgttcatacccattaaccagcctccctctctcacccacccacccttcccacctctggtatctatgattctattctctatttccaagagattaaatgttttagctccaattgagagaatatgtggtatttgtctttttgttcctgccttatttcacttaacagaatgactctagttccatccacattgctgcaaatgacatggttccattcttttttttatggctgaaagtattgcatggtacatatatgtacatcatataaaaaattatttcatccattgatggaccttaggttgatgccatatttttgctattgtgaatagtgctatgataaacgtaagagtgcggtatccctttgatatactgatgaaagaaatatatgtttcttttcctttgggtaaataccagttagtgagattgctggtttgtatggtacatctttttttttttttttaagacagagtttattctgttatccaggctggagtgcagtggcatgacctcggctcactgcagcctctgttctcaggttcaagcaattctcctgcctcagcctgccgagtagctaggattacagattacggcatgtgccacgatgtctggctaatttttatatttttaatagggatggggtttcaccaactggccaggctggtctcggactcctgacctcaggtgatttgtctgcctcagcctcccaagagctcagattacaggcgtgagccaccgcgcccagccgtaaggacttctatttttaggttgtttttttagaaatctctataccaggctggtcatggtggctcacgcctgtaatcccacactttgggaggccaaggcaggtgaatcacctgaggtcaggagtttgagaccagcctggcaacatggtgaaacctcatctctactaaaaatacaaaaattagctgggcatggtggtggtgcctataatcccagctacttgggaggctgaggcaggagaatcgcttgaatccaggaggggaggtcgcagtgggccgagatcatgccactgcactccagcctgggaaacagagtgagatccatctcaaaaaaaaaaaaaaaaaaaaaaaaagaaatctccatactattttccataggttctattaatttacattcccactaacagtatgtaaaagttccctcttttctgcattttcctaggatccgttatttattctcattttaataatagccattctaaccaggggaaggtgattctcattgtggtgatatctcactgtggttttgatttgagtttcctggatggttagtgatttgagcatttctcatatatttgttggacatttgtatgtcctcttttaagaaatgcctgtcatgtcatttccccactttttaatggaattatgtgggtcttttactattcagttgttgcgttcctcgtatattctaggtattagtcccttgttggatgaatactttgagaatattttccccattcaacaggttgtctcttcactctgttgactgcttcctttgctgtgcagaagcttttagtttaatatagtcccatttgtctatttaaattgcctgtccttgaagtcttagccatcatctttgccgagaccaagtccctgaaattattttatttatgtacctcatctcctctaaggagattaaaaaatagaaaatgagcaggtggaaactttgaggtgatggacatgtttatgcatagaatgtggtgatggtttcataggtgatatttgtctccaaacacaaagcatacacataaatatgtataactttctatatgccagtcatacctcagtagagtggttaaacaaatagatccagaaaaaccttagagttccttatttttgtacttatcctaaaattgaagaggaagtagatttattttatttattggttagagaaaatatagaccttggcttctcaggtaccaaaacatcagacgcatcagctgtgatggaccacaaaagacaaccgtcaaagagcttcttatttaagaactcagcagaagtaatttcctacgtgtaaattattccctttttgaagactgaagcctgaatctgagattctaaaggaaaaacaagaccaactttttaaaaagttaactcagtgtaagtatgacacataaaagtgttcaattaataacgatctaatcaccacccagccaaacaaaattttttttttttttttttgagatggagtctcgctgtgtcgcccaggttggagtgtagggctcgatctcggctcactgcaagctccgcctcccaggttcacgccattctcctgcctcggctcccgagtagctgggactacaggcgcccgccaccatgcccggctaatattttgtattttagtagagacggggtttcgccgtgttagccaggatggtctcgatctcctgacctcatatctgcccgcctcggcctcccaaagtgctgggattacaggcatgagccaccatgcccagcacaaaaagtattttaagtatcgtagaagattcatgtgtatttcccctaattaccaacacttccatctccccaaagttatgaactgttctggtgttgcactcctttgttcagctgtaaatttttgaattttatataaatgggatcataaataatcttttgggccaggtttctttggataaatatcatgtctgtgaaactcatgagttcttcatgtagtcaattgctttcattgctgagaagtattttaatacctcataatttgttttccttctgctgctgatgagtatttggatttctcgtttgggctgttaggaattatgtttctaggaacatccttgacaacatctcttggtcacatgtgtacacatttggagtgctacagacagatcgcagagtgtgcagtttgagtcaagctgtcaaattgttttccgaagatggtttttcaatgtacttacatggcagtacctgagattcctgttgcttcattggcactgggttggtattctcagtctgttacattttacacattcagtggtgtctagtggtatctcatggtgcttttaatttgcatttccctggtaactaataagagtgagcacttttccagttattggccatttggatattctcttttgtgaaatacccattaaatctcttgtccatttctctaattgggctttctgtgtttttcttaatgagttttaagattctttaagtttatggtactggttctcagactttagcctgcatcagaatcacacttaggcgctcgcttcagtagcacatatactaaaattgtaatgatacagagattagcatggcccctaaaaaaagtcaccctatggcttgttaaaacacacattcctggcccccaccaccagagttctgattcagtagatctgcggtgaggcacaaaaaggtgcatttctaacgagttcccagggatgcggtatgctgctggtccagggaccacactttgagaatcattatttaatagtgattcagcgtaacagcggtagatgtttcttgttagttttggacaaagtcaccttaaaaaccaaaccaaaagcaaaaacctcaaccatttaatactgctcaagcctgaggcataagctaatacctttcttcctagaatggtgcaaatggacttgcttaaatagcaactgcttcaaactgtctaaacccactgaaatctacccgttagaatacttggtacacctaatttgccaagagaaccgttgatgatagaaggtatcctttgatactgtatttttcgatctcaggaaaactcactggcttcatcagcaagaacatgagtcaggaatcccttgaagcacagaaatacagatctctgaaggagatgaaaactatcatttatttcaattgaatttagtttcattaaaaaattctatgatacattaaaacagaaacaggacgtttatatgactgtctttaacctcaaaagtccaaataacatatagacattttgaatatagctatcgttttaacaaacctcattatgatcactgttgcatttcagtcacctaaaatacgaaccatgactattaataaacatttactgtgtgtggtttttggactgaacattaaccatacgtgtatttctaagtactaggagttgaacagctactacgtcaatgtattttggcagttagctgtgtgtggtgtgtgctttttaaggcttcactcaataaacatcggttgctctctgctgatgagcaaaaaacttgctatacgaaggacaaatatattatacaaacaaatgcacacgtgtgcatgtctatatacatatatgcaatttcagggaggtacaccttattctgagaggtcatgagactccacttcaaaccataatagtaaaacctttagaaactgaactcaacatattacagccaccatcatcaggaaaaattaaagactcatagttcaataaagtacaaaaggtcccaggaagtattgtggtttgttgattcattcaacagaaagccaaatgacaatgctattagtggtcaggagtaaactaacctggacaggctcatgaaaatgacccctggatgcatcctgagaacgtactgcataattatagtcaatgcttgcaataatttcagtttgtctcatcacgttagcagagcctattcatgcaatttagaaaggatttcaatacgcccaaaccaaaaggcttacagtcaacagagggttagccttccataaatgagaaatccaaaaagaataatgccacgtatttcaggaatgtcggttagaggtttggccttcttgggaaggtcacaatgctgagtctaaaactgcaacagttaccgtgtccaagtcatgcaactctaaagaggatggacggtcacatttgtgtccttcagtatcaaagcacctttaagggcttccatttgagaaagtagtattttctcttccttctcttttagaacatatgataaaatattgccctttatcctttaaccatgtatccatttttttttttgatggggagtaaggggtacacactcccactacaatgtcacaaactttttctttttgttgttcctattggttgtaactgtactatttctaacaagaagccttcaggggaaataatggatcctagttatgtcaaagaaaacaatgagcaaaatggcaacttcacagtcttcaagtaaatagaatccctgatataaatggaaattaaatgtaattttgggggcaataaaaacaacaacaaaaacctgtgacaactttgtcctactctttaaaaatgagctttgactctgtagtctcttaaggcacaaaacctgatagacggcattaactggtggcctgcacctctgatttggattttaaaaaacaactattgacatttaaataaaataaaccattttgttagagctggagatccttggataagttgggagaaatattcaaatgactagcatcttgtatgtataaatatttgttgccaaagtaaaaaaaagtacaatgtggttacatagtccaaaaactagtggaaaatgccttcggaacggacttgacattttggttggatcacagtgctgtctcgaaaatagttaaggtcgagggctgtccattggaagtgtttgtaacatgtggtcagtgtgaccaatatgtggataatttcttttgaagtatacctagaaaaaaaaaggtaagcataaaaagaatgtttcaaaattttaaagtctcctccctgaaacaatgcactctgtgtctacttcttcatgtgaagcaaatcatatccctcactgaggcacaatttaagaaagggatgaatctactgtacagagaaattagccccactaaaaccctcagcagggctgggcgaatgccaaacaacctgtagatccattttagttccgatcactctgattcatagatatgtttatctctgtattaaattgataagcggaatcattttactgactcaaaacctggagataattaaaaacagggtgacaaagaggctgggaaatctagcgtctgcatgagggtttctcatttcacacgtaaaatgagcacaatagatttggatgttaatatcaagttgtaatccctatatttataaactctgattgacaagcattgaaatgctggcatatacgtatgaaacatcccggctttaatttgtgcggcaaagcagttatagggcctatagaaatgtggtctgtggatagtggccacaataatgaaaagagaagcaaaagctttaacaatgactcaaccaagcaacttctctaaatgtaagatgataccaaataataggacagttctttgccaagcctttgagttcctgaatctaccaatttctagctgaactagaagagatacaggttttctgataaacgtataatcagacataaaggaaatgaaatgctgtcaagtttctctgttccacaatcatcagtttttagtactgtatcgtatcttggttccttgacagatgcgcataacaaaatgaaataatgtcaagactgtgagctcttatctcaaaacgtgtttgggtgaaaaaggacttcaaatgtaatttttttccccaaagaagaatgtgaaaagttttgtttgaatctttaaaacagaaaatgtagcaacttctgaggctgacacgtgtcacctgggtctcttagtcatacgattctggatctattttataaaccttgctctgaatatattggtgggtgctgtcaacaaagttatcactggagataatggattcacgtacaaaaaagaaagtgctgagacacctgcctacatattaagtgtactttcttttctctcacttcttgcacacttgttactccagaaatatcattacatataacacacaattactaaaatgtcacttaaggagaaaataaattgtccaataatgctggaatgccaccagagaaatctgaggctatttccattataatgcaagtgttcaaaagtaagacttttcaggggaaatttcatatcatctccctctcccacttttttaagctagccatattttgtgtggttataatttatgtactccaaaaaggctattctgtagtgaaactaaaaacagccaaaagaacaaaagacattcacatcactttctactgcttgatagccttccccaaataggctgcttccttcttgtaaccctcttgatgtatttttttaaatatatataaagaaagtgttgttattagcaacttaaacccaaatggtcttagcttcatggtctgaaatacttagtcaaaaacaaacttccttgtatatattctttgatttgacctttctttttctcttctgctaccaggttttataacacctatgggtaacagcacaggtgagatgaaacatcttttttacagtgcaggtgatgaaggggttgagattactgaactacttttagcaaagccctcatgttgtaagctatgtctgggataacaggtccagtctcagctctctcctggattcactgctgattctggaaaaattacctaacactctctctaccagctgcctcatctgtaacatgagataacaatagcttacgtcacaggactgattaatggctacaaactacaggttgaaaacctgctgcattagtgttgggtgtcatgtgaatgctgctcagagaagtggcccctaagcacacagaacgtggaggtatcgcccagctgaaggatgaagacaaagcatttaggaatccctctggtgcatcttttatctttacagaatccaaagctgtggctgagacaatttcaactgaatgaatatggtaacctgggaggcagaaagtagaactgaaagatcatagaagatggagtatgaacacttttgaactggtggctttgaaacttactcaggctgggcgtggtggctcacacctgtaatctcagcagtttgggaggccaagcaggtggatcacttgaggtcaggagtttgagaccagcctggccaacatggtgaaacccatctctacgaaaaatacaaaaattagccaggcatggtggtgcacgcttgtagtcccagcactcgggaggctgaggcaggagaatcacttgaacccaggaggcagagattgcagtgagcgagactgcaacactacactccagcctgggtgacagagtgagagactgtctcaaaacaaaaaaaaaaaaaaaaaaagttactcagattcttgtactttagcattttcatgtgtcaaaagggataataacagcaggtcagaaggactgtgaagcttaagggagacaatgccataagcgtcacgtttgcggcaagaagagtatcaggtcagtgagtatgggaaaccttgtccctcttttcttcttctcttgagtttgctccattatagttcctctaatgtaggatgaaactaagttcaatttaaactctaactcatcagtaaagccaccgtaacagagctagattttactaaaatcacagagcaatacaagctcccgcacgtggacaaaggagagcaactgggctttgattgacatgcattcctaagataccatctgatgtgttgaattcaggctcaagaccctgtcagttcattttactgatgtgtatggccctaattcaatcacagtaactctcaaggcctcaagttcatcattttaaagccagtctaattttggtgtacataattggcatgcatattgtcaaagagtaatgagacttagaaaggacttctgcttttaatataatggagtaatgaatttcctctccttttctttcagaaaccactctgaacatcaaagatattcattaataaaaaataagctaaatcttgtgaaatcaggagagcctgaatggtaaaatatcatgaagggctgccatatgcaactggaccaatggggctgtggcaaggctgagaagatgtctatgaagagcaagcctcaacaatcatggaattctccagttaattggaggagcgctaaggtatgtcaataaagaatcaattagaaaatctttgactgacctatgtacattggtgaggtcctgacagaagacagattgcaattgccaattctgtaagctaaggaggaagaaaggcaaaacatgcactctcaatttcacatacacaacacacccacacacacccacaccacacacccccacaccccccacacacccccacacacaccatacacacacacccacacacacacacacccccacacccccacacacacccccacacaacccacatacgcccaccccccacacacacccacacccacacacccatacacacacccaccccccacacacacccacaccccacacacaccctcccacccccacacacatacccccacccacacccatacacacccacatcccctgacacccacacacacacccacacacccacacaccatacacatacacactcacatccctccctgcatcccccccaccacacacgcagcctctcgggtcataaagtacttctacattaagcacagaaaattccctttagccagaaacaaggcctagccacaactatcctgtaactatctggtctaggaagagttcgttttagtcataggtgagagtaggaataataaaaattattattataattttaagagtagtacagggcctggagatttacaaataagaaatgaagtaagataaacacatgacaaatgttgagcacatagagtttataatataattcattcaaagaaaatgcagcagaatgatcaggctgtgcataacagagatacaaaatacaggaaaacatggcagagcaacagaagatgctgaaacatgagttgacagtggtaaaagtgaagtggaaaagaaaagtgaaaatatcaaagaaatgggctaggtgcaatggctacacctgtaatcccagcactttgggaggctgaggtgggaggatcacttgagggccaggattcgaggccagcctggccaacataatgaaaacttgtatcatataatgaacataatgaaacttgtaaaactacaagaattagccaattgtgatggcgcacacctgtaatcccagctactgggaggctgaagcatgagaattgcttgaaccgggagttggagggtgcagtgagccaagacacgccactgcactccagtttgtggaatagacggagactctgtctcaaaaaagggaaaaaaaaaataaaaaaataagtggcatttctactgaaggcagcacaaagattagccaatgctaaaaaacagtgtgagacacaggataggattgagcaaacaaacaaaataactaaaagttataaagaactaaaaaggattaaggagaaaatagctttacaaaatagacaaaggacataaacatatacatgatagatatttgtaaagaagagaatataatcaaataaaaaaattcaaggaataattcaagtaaacttccagaaaaaaaagaaaacttgaatcaaagtctgaaagactgccaataatgtcctaggaaaactaatgaccctttcagcatacaagaaaaaagatctggctggcatagtggcacacatctgtaatcccagcactttgggaggccaaggtgggatgatggttaagcccaggagttcaagaccagcatggaaaacacagtgagaccttgtctctatggggggaaaaaaattagccaggtatggtggcatgtgcctctagttccagctttaagggaggctgaaagggagcattgcttgagcctgggaggttaaggctccagtgagctatgattgtgccactcactccagcctggacaacagagcaagaccctgtctcaaaaaaaaaaaagaaaaagaaagaagaaagaaaaaaggctgagttgtgtcaaacatggtcatagatgtctccatatgaacagcaacacgagaagaccttagagcaaaggctgcaacatactaagtgaaagaaggtgtgaccaataattttatatccacaactttttaaaatttttatttttatgttaaattccaggataaatgtgcagaacgtgcaggtttgtcacataggtaaatgtgtgccatggtacagccaccactttaaatcagaggggtaacaaagatttcagacatgcaataagtcagggattctaaattcaaggaacctttccctttgagatggtatagagcattgttttgcaactttttttttttaaatgccacccacaataatgggtggcacatttcactgtacacagggacttggtacgcatccatacctatatctgtatctatactgaaaagcatttcaaaaaatattaccattactatgaaaatacatgttatttttcttctattccattgtattctattttacatcttaaaacacactagcatgatggaccaaattgattccacagcaccactagtgggttgtagcctgaggtttaaaagcactgaaggataaactttagctaactaaaagatggagaaagtatcatttaaagaaaagcaaataacagaggcttaagtatatttggggtttgaaggcaaatagaagaaaaactaagcaaaatttggtggtaggatggagacagaagtgtatttatattgttattgtttataatgggagtcaagaaacagcatttagaggaaacaaaaggaacacatgcaaaacaatattcaaagaacaaaaattatctactacaaattaaaaggtaaaaaggaatactaaaaactgaaagcatacatgacagaactaagacaaaacatacttataatctcaataaatgtaaatgtactaaaatatctattaaaaacaaaggctaagattaaacctcagagtaaaacctaaccacgccatataaggagacacacctttggatattcaaagacaatcccatatatagcagacaaagaaagcaagtaaaagcacgcgacccagtctagttttgaaccagtgtggatttaggaccaaaaccattcatgaatcaaagaaaggtgtgttaaaatggcaggaaatataattcatagtggaaacccagttatgaacatctgtggactgaaaaccatagcatcaaagttaccaaaacaaaaatgacagtactacaaagagaaatatgtacagtgtgaaactaattcacctctagatccaagtcacaaaaatagaccaatataaataaggattaataagaatgtaattaacaaagtagaactaattaaccttattaaactctataccttaaacagataacaccatcttttcaatgcccaaagaactctagaaaaactaggacacaaagaaaattccaaatggatagaaaggatatggatgacatcaatgaaaatgaaactgatgcgtaaaacagaaaagaaatgaacagaaaaaacaaaccgcaccaccaaaaagttttaaaaacttccctcttcaataatttctgggccagagaaaattaaatccaaaattgcagaatgtataaataaaaaataaactatgagtgaaagcactacatatcaaaccaacagaatacgaaaattcacagcgctaaaatactaaggaagaaagaatggacacaatgcattcaagaagaagcaacgagaaaaaccaaaaaacaaaggtaataaagataaaagagaaactgatcaactgggaaacagaatataaactagtaaataaatctgataagtcattcccaggaaaaaaacaaaaatagctaacttaattggaagttaattgggaaaagtgaaaagtcagagtggaaaagtataaatactaggtagccattaaaaaatgaggtaactggccggtcaggtggctcacgcctgtaatcccagcactttgggaggccaaggtgggtgggttacctgagtcagaagttcaagaccagcctggccaacatggtaaaaacccatctctactaaaaatacaaaaaattagccaggcatggtggtgggcgcctgtaatcccagctactcaggaggctgaggaggagaatcacttgatggagactgcagtgagctgagattgcaccatagaggtccagcctggcaacaggagtgaaactgctttaaaaaaaatacatatatatatatatatatatatataatatatatatatatatatatagagagagagagagagagagagagagagagagagagagaaaagagagagagagagagagagagaacgctaataaaaaatacacatataaaataaaatgggtaactatatgtattgatataatatggaatataatattaagtgaaaaaccgtaaagaaagctattatttgtgctcaaaaaccagaaaagctatatatgcacagatgcttgtttatgccagaatacatcaacaaagtggagaagaaggtgccagggctgaaacctggcagaggaactcgtgatgaagggcaggtgtggcagagtgacttactttttacttattaaagttttttgcaaactatcaatgctttgaattttgtaacatgagcatatatcatttggtaagctgattcttaaaataatttgtaattatttagtctataaagctacaaaactttggatacttcttttgctttattgggagctaagagttcagtctacagtcttaaaaaagtactgagcttttataaccatagctagaattcgcttatatttgtaaaacaccttatattctttgactcacttaaacataactatctcatttaatacatgttaacagtgaagaaaccggagcagtactgcaatcctggctgacaggtgaggcctctgaggctcacaggccttgggtgacttctgtaaggccattggctctaagtgtctcctccacctattcaaacaggccccaggctcctaggatccaggatgtcagacttcttgtctatctatccatccatccatccatccatccatccatccatccatccatattttttgagacggagtcttgctctgccgcccaggctagagtgcagtcgtgtgacgtaggccactgcaacctccatctcctgggttcaagtgattctccagcctcagcctcccgagtagcgagattacaagcatgcgccaccatgcctggctaatttttttatttttagtagagacaggtttcaccatgttggccaggctggtctcgaactcctgacttcaagtgatatacccgcctcacttcctaaagtgctgggattacaggtgtgaaccaccacacctggccaggatttcataattttgagttgtatctggcaatttcatgagtgcataaaatggcacctctgttactcactggaacctcaaattaggtcggcttcatcagggaagacaatgattgaatttaccctgtgttagggctgatttgcatccccctaaattcctatgttgaagtcctaacccccaagtacatcagatgtgactgtatttggagaaagtctttaaaggtgtaattaagttaaaatgaggcctttaggtgggccctgatccaatatgactggtgtccttagagaaagaggtgatcaggacacagaatacacagagaaaagaccccgtgaacagaccccgtgaacatatagccatctgcaagccaggagagaggcctcagaggaaagcagctctgctgacaccctgatctcagactccagcacgaagtgtgagaacataatctgctgtgggttaagccagctagtctgtgctactttgctatgcagcctgagcaaaccagtgcacccttcagctttatgtacctgaaatgtaattatgtaattaaatttactttaaaatattaaaatactgagtcatctgcaaaggtcagtcaaaagagagctcagctttgcctgcaccagcattttcaggaaagcaactccgtggtcaagaatacgtgattggaagtaccttttcccagatgttgagttttccttccaacaaatgaattctaatctgtagagcgaaaagcttgttgatttagactaatcctcatggtgttacagttgtgaatgatgcttgatatttgatgcttgcacatttaaaaggttgacaatctgacagcttgttctcctaagggaccaagtgtatgcagaaatgtcaagaaaatattcaacttggatgagaatcaagctgttatttccttatgtctttctgtagaggaggtgacctgagccagtggttaggcaggactaaatccaggaaggaaattctgccactgtgtgaatttgggcgactagctgcatcttggatacaaatgagacaaggagcagcgttttcaggcttgacacagaacgctacttaggggaagacacggcctcccccagcaatctaccttctgttctccacggaccagctctgtgtccacatgaaacacatgacccaacatcctcatcaatacagtaagacttacagactgctgtgaggattaatagaatcatacatgtaagaactatgtaaacaatgtaaaataaattataaagaactatacaacgtaagttacgattaatattgttgaattagatggaagattactggaccagtaattgaatttcaattctatgaccaatgtccctttctatatgtatgttatacttgcattaaacattatttaaaaaaagattcctaattctgtctctgctataaattagtcagggcccacttacttttggggccttagtttcctcatctgtaaaacaaaggtgaactatattatcttatgttagtggaacatgctaaaattctatgacctatttcttattactccatgccttgataatatataaatattttttaaataggtattttgatatatagatagggacacatctctttgatgtgaaatcctgaggtaccaaagaacaaaaagggtttttgaggttcctggctcttttgtgactagatatacagggaatcccaaatgattgatcgggttttatgagggaagctttggctgggagacagctagaagataaaagtattctgtaaatttcaagtataaaagaaatacagtgcttcaagtcagcttccctctttattcatacacaatgtgattcttatgaaaattcagaacacagattttgtcgatcctaaagccaggcttgaatccggactctgcctataattctgctagctatgagtcatgggcaatttccttccctctctatgcctcagcctcttaaacaggcataatgagaaggcacagtgcacatctgacacatatcatcatcatcatcattgccatcagggctcaccacacaatcaaatctctgctctgctctattctttggcttatattgtcaatgactaggggcatgttaatgtatttgctagtgcccagcgtaatactgtgcacacaaaggcatttatagaatcgtttgaggataaatgcaggattcaaagaaatatcctacagacagtggcaaggatagttcccacttctgtggagaatgagatgaaataggagctgaaggcaacctaggttttatttggataatctttaatacagaaataccattagatatgggaacatattttctttttcttttttcttttgagacgcagtttcgctctgttgccaggctggagtgcagtggcgccatctcagctcacgcaacctccgcctcccaggttcaagctattctcctgcctcagtctccctgagtagctggactacagatgtgtgccaccacgcccagctaatttttgtatttttagtagagatggatttaccatgttggccaggatggtctttatctcttgaccttgtgatccacccgcctcggcctccaaacaaagtgctggggttacaggtgtgagccatcacgcctggtctttttttttttttttttttttgagatggtgtctcgctctgtcgcccaggctggagtgcagtgtcatgatcttgctcactgcaacctccacctcccaggttcaagtgattttcctgcctcagtctcccgagtactgggattacaggcaatcgccactacacccagctgatttttatatttttagtagaaatgggtttcaccatgttggcccctattttcttattctgttgtctgtaatagatatttaaaatttacacacaaacaagcaattttattctacctacagtgatgaaaacctgaaaaatacagaaacaatgaaggaaaattatacccatattatactgcctatggatgaacagttttgatggggcctcaccatgtactgctagaagtctccttccaccctaagccaagaacattggatgttcttccctccctccatcaatacaactctcacctcacagaattttaaggaagaattacaggtaccatgtgacatctggctaagtcccttaaatcaaactgcagttatcacatctgtagaatagatacttccacatcaccattgttggaaagagatcacgtagcctgcgtgtctttaatgcttataaacatacttcaaggattattcaggctatagctataacatattataaattcttgattgtcctgatggcaattacatctttttttttttttttttgagacggagtttcgctcttatgcccaggctggagtgcagtggcgtgatcttggcccaccgcaacctccgcctcctcggtcaagtgattcttctgcctagcctcctgagtagctggggttacaggcatgtgctaccactccagctaatttttgtatttttagtagagacggggtttctccgtgttggtcaggctggtccagactcccaacctcaggtgatctgcctgcttggcctcccaaagtgctgggattacaggatgaaccaccactcccagcctgacaactgcctcttatagaaggtggaggaagcatatggctatatgggcctaattctaaacaacaaagaatgaggggaaaacccaggtcaacagtgaggtattatgtaacagttttctttacaaataataaaacagaaaccaaaagcaatctaggtaatctaggtagaacattttctaggtagatcattctagaacaataaacaatatcccacacttttgcccaaactcttaaatctcctgtatgtacctcaacagcatttgcctatcaataagatgaaatgcaatgggtttgcagaatatgagtactatgtgctctatgcctttttctatgagatctgaacccacagagtctaaatgtgtaaaaagtctggtctaacacctctccgcttcttggcacacggcatgcacacatgtgtgcacacactcgaccccccaacccctacccgcttctccaactctttgcagaccttacttcaacccgggacgtgccgttaagacccactcatgaagtttgtctctgcaggcttataattgaaaagggtacacagtgcttgttaccatacccatgggccaaattgtgcggagggagccgctgagacaaactttaattacaactccttggagcacgtcacctgttttgctgtttcagtgagggcagcggcttctgccttgcccagttgttgcacctcttgtaaaataggctctctttattttgcagcaaaacatacggctcatcatattctttcgtcttcctgaatctaaaacctgttaatcagcagaaagaaacccattgaaacacaatgtttgcagtaacatattataacagagacaatatttcggaaaggggcaggagagggagagaattgtttgggtggtaggcctggatagtatttaaatggtttgattaccctgttttacgaagcaacaaaggcctaacctgaccttttattactataatgttataggaaaggaagaaaatgaagttctagactattattctgggcactcagcagtcctgtggcattttatattctgccaaagcattttgggttcttatcattacttagtgcttttaactctcagactctcagccttgagggtatttatacatatgatcagagttgggaaacttcttgatttaagaaagtcaaattaaattatctaaaaggtagggtaatgtcataaaaatcagatgggagagacctgacagtaaattaatgccgagccagtttcatagactctaagcaatggaaaagaagtaaatgcttctggaattttttaaggttctagaacatgtcagctgccaagaggggctaaactctggatggtgaggttaggtgcattctgaaatcggctctgggtgtactttattattccgagagagaaaggctagccaaaaagctgttacctaagcagctttagcataattgctctctgcacagaagaaatctctaaaatccaattttctctttggataagactaaagaaccaattaagaaattgagctccaaatcctgtgatcacagcccacatggcacacggggcagcccagtctgcattgctgagggctgatatctgttttcccaatcacctttctttgcttctttctctttcttgagctgcttgcctttagctgctttattgctcattaatatgtccactggaaattgaaagagggaggaaggggctctaactctgcatttctacttattagtggctttggttaatggtttcagagggaagaaagagctgaacaattggcccaaatgacgtacctaggaaaacagttctgaggttaagtggcacttgttcttcagttaggccatatttagagtaaatttatcttaagagaatatgctgaacctccagcaggacacaggttgtttttctacatgtagacattgcagttaattccgtcccatggtattaatcggacacatttattaagcctcataaagggcattttcctgttaatcttttgtttatactgtgaatcactgctaagggcagctttctcaaaagagttcaagaataattgaatctgcacatccacataacaattaaaatgtcctataatttggcatgccaatttagataccccaatgtgtaattttacttaagcatagcattacagaacataaccactcctcctgacgaggaagaaaaaatctgcaatttaaaaatacaggtctctctaatgctaaagactaagtaaataagtaaccaaattacttgctaaaatgatgaagttttagtctgcaaaagcaacaagtaaactttaaaaattattcccacagagttgagagtgagtgagttctctgtaaagactttacataatgttaatggaaaggaagtcctactactatttggtccttgtccaaattcctactaaatttatcacatttgagtgactagtaaatctttccagattccctctcattgtctgaaaacacatgatgccactgagaccaggagttctcaaaattgaccagaatctaaaaaggcagagccagaaaaaaaaaataatgttctcaaaaagcattattattattagattaataataaaaatgacagaagatcatttggtcaaaatactttaagccttataaatatcaacaacttagcaactgcatttatttgttaggagagtttttgagtttaggggtgatagaaccatgaccttaataatttacagaacttaaaattttaacttctataaggtttcacacttaaaaaatataaaataaaaccgcctctttaatatttttttgatatgcattaaaacaaaatataggccaggttcagtggctccgcctataatcctagcactttgggaggccaaggcaggtggatcacttgaggccaggagttgaaaccagcctggccaacatgacaaaaccccacctttactaaaaatacaaaaattagcgggcatggtggtgtgcaactgtagtcccagctacccaggaggctaaggcacgagaatcattgaacccaggaggtggaggatgcagtgagccaagatcatgccactgcactccagcctggcaacagagtgagactctgtgtccaaaaaaaaaaaaaaaaaaaccccaaaatcccaaataccccccaaatatagtatcttataatgaactggattattatagctgcagatgaatctgcagatttgagacaaggcatccttggcatataaatatgacctaacaaagagtatggctacctaaaaatcaatgaaagcaccccataactaaaatatcagtttgtgaacttgaaaaggaaataaaatgggttgaacatgctctgcttttacagtcatcccagaaaactcccaaaatagaaggataaggtaatttccttccttccatccattcatccaatattgagtgaatgtctatttcaaagtatcattttaggaatgggagattcaaagatgagcaagaaacagtctatcaagatgtgacagccagagataaagatggaagtgcaaataagttaaacaacttagcctaggctgcaaaatcggaagatggcagagctgggatttgaacccgggtgtaaacctgtcttctttcctctcatgtgagttcccagaggtacattattatttactttcagtttctttgttttcagaagtaaatatgggcaatgagaactgtaaacagttaattttctaagacaccttttcatttggatataactgcatattttaagaaaaatatgcctgtaagcataaaaaagttcacctattcacttccactacaatttgagtcctattacacccaggactcaaaattatttactgtgtgcctggatatactcacagaaaaagaagacaaattttttgttgttgttgttgaaatagagtctcacctgttacccagactggagtgcagtggtgtggtctcggttcactgcaacctccacctcctgactcaagcctcagcctcccaagtagctgggactacaggtgcacgccgccaaagcctggtaatttttgtttctttgtagagatggggtttcgctatgttgcccatgctggttttaaaccctgagctcaaagcgatcctcccaccttggcttcccaaagtgctgggattacaggcatggcccccacatatggcccaagaaaacaaacttcattaaagtttcaggattaataatgagcagtgacactctgccaaaacacattggaggaaaatggaagtgaaccttcatgaattcctgatttattcagcacacatttattgcacacttactgcattcatgtcattatgctagatgcttggaagaggcaaagatgggtaagtcccagcccctgcttttaggaagcccatactcaaaaaaaaaaaaaaaaaaaagacagaagaaaacactcaagtgactagaatgccagaaaaaaggaaaacaagcgggagtttagcagcagcagaagtcacctctggccaaaatttctgaggagggcttcagggaggagaaaatagcaaactgggccttgaggaatggacagacttagacacgtgaaatggtggtggaggtgaggggtgggaggaccgtggtcattccagatgccgagaggtcgacagctcacctatcacttcctcaagggcagggttatgtgcttgctcttgttcactgttcatctccatggcctggcattgcacataacgtgtgagcaggcaccccatgcacactgcctaaagttaaatacaaaggaagggaaattcagggcacaattgggtgactgaccagtggtgcgtctggtaagaccacagagtgagatccagcagagaaagagtctagctggccctggaaaaagatatggaaggaggtatagggatgctaggattcaggctatagccttggaggaccacatcctcaagttgatggctatagacaagagagagaaaaagcaaaaaggagacacagcaggaagagggcagaggcttgactcacaaattaaatattggaaaagagaaaataaggaacaatctatgctacaagggccaagttaggatgcacatgaaaaaatgctaagaatagaactttaccccttagcctttatgcatgttgagtatacttaggaaatgcctgggaccagaagtgtttcagtttcagatacttttgaattttgcaatgtttgcattatacatacttacagattcagcatattaatccgaaaatccaaaatctgaaatgccccaatgagcgtctcctacaagcttcacatagagctcaaaaagtttcagatttaggagcatttcagatttcagattaggggactcaatcgtatttactgatttgaccaaagattctagatcttttacaacaaaataaagtgactctgattttctttttgtacagaaaaaagggcataatcttgaatttgtatcttcatatcttctgtgctacatgaaaacagtcctgaaatctcctgcttggtcctcacctttcctctacccaagtaaactgtaaactaagccatgcattgatgttggtcccgtggccccaggatctctccagcatgcaaacctcaaatcacttgctgctctctagaaggtcaaggaaaaacacattatactggatgcattagtcagttactcagttacataagctcaatgaagatgtgtttatcaggcctaatatctgcagatattccaggtagctgtcctagatataaaaattaagtgaacaaactgcaaacaatttaatccatttaattggcaggatgccatcgctgatagtggggtgatctcaggaaaggggaagggcagggcagggtgaaggataaagcctgaccataggaaaagaaaagctcggacagctttcactatggcagcaagcaatacagagaaaccccacttagcaacaggcagagtagggtgggagggtttccatttcagaagtcgtttctgggccaccatgatgaaaggggtgtcggagagtcatctgacgttggagattggttccctcactggtaaaatgggtgcctgtgaccttctctgggacaagatactatggcatgtggcaaagattacttaaaatcctgcctcaggcttgaaacagtaaatgattcttctcacctggggaagatgaagggtaggtcccagtgaccactcagccacttccccaaagctctgcaattgtgtgtatttattctcccagtgtgttcatttttattttttgagatggatctcactctgtcgcccaggctggagtgcagtggcgcgatccggctcactgcaacctccgcctcccgggttcaaaagcgtctcctgcctcagcctcccgatagctgggattacaggcacacggcaccacgcccagctaatttttctgtatttttagtaggacagggtttcaccatgttggccaggctggtctcaaacttctgacctctcaggtgatctcccttctcggcctcccaaagtgctgggattacaggcatgagccaccgcgcccagccccatttgtgctttctaccttcacattagttctttgtccccctgaacactttaattaaatgtccagcatatttttcaagaagtaatttttcctcttctgaaatgttctaattgtggccgttgcggtttcttaaagagaagttccatgaagatgaaacatagaatttaaataaaactcaggtagctttgagttgtgtttctccagctggttctgctagaacgatttctagtttgttttctcgaggaaacgctactaaaaagagatttgggtttagaaagaaagatatacattatacaccctaagattgcctacaaagaaaagagctacaatctgaatttctcaggcctggttttgcttcctgtaattcactcccgaagaattctctaactgcagattcgcttattcctcgttcactcaactaccagggagaatccagagcgttgtaaggacgggtgtgcagggactggaggaaaaggtgtgctattggctgaaaggaaaacaggtcacaagtaaccagctaatcctaaaaactacaggaggaagctgtctttaatgtggagatagtggtgcgtattagaaaaaagaggatttctatttgtctgtcttgctctactgttttgtggcaactgagcaaatgaagattaaattagctgcattaagactacaccatgtttaataaagttaaaactgggagaacatcttcataaaataaattctaagcttaacacattgatggcgcttaatgaaccaaaactgggtaaatccctttgggagtcaacacataaacaaagctattaattaggtcgcagttgtttcccaacaagcttttttttgatttacttacagtaaacaaaactatatctatccgtctttgtggagaagtattcacaatgcaacaaaacgtaattattacaccttaagcacttgcaattacaggactgcatgatgcaatagtgttggttatgtccttcattaacatctgtcacttccccagccactccctgagctgccttttggagtgctgagctttgcagctgattcacttgtctctatgttttcacagcttcagaataacagaacagaacatgtgttttctggaacggtatctctaaagcaaacaaggggaaaaacaaacaaacaaaaaaaacaaaacacctccaaaatcaaagatctgaggaagaatgtatttatggtgttcccccgaattgaaagctggctgatgatcagaagctctagaatacagagatgctttcagctaggggttgagggaacatagaggccagttcccaatctcaagctacaaatgcatgtctcctgggttccctgaggctgaatcctgccactgcctgttaagaaaaattgaaaatagttctcacaaagaattcagagcttgtaataagactccttacttaaatttatactcctggtaggacctcctgtgatgccactgatgacctcgtggccagggagccctaaatgaagctctcccaatatcattggagagatcgccatagatggagacactaatggagttgggatgagaaggaaagctccatgttgaaatgcaaggtcatctcaacagttacatcctccaaggaatgcttgcctttccctcctccaagtttacttcttccgggtcttcctcattcatccagaagtcaggtcccaaacagagaaaccaggactgactacccctgtcttccctcaaatctcacttcaatccatcacagtccagttgctttactttgctatttactccaaatctatccattgcccatcttcactgctcacaccatagtctaagccgccattgtgcatggtgtagagagggcagaccgcaacagtgaatgctgcgtttgatgaactgaaggacaataactaaaggactgtggttttactgcaaaggaaagagagagaacagagggaggaaaggctagaaaggtagggagggccaactgtaaattgctttgtagaaccatgttcagagtttagataaagacattactcaaggagaaaaaaattaaggttctcaaaatctacctagagggactggtatataaagcaataaataatgggcacacttcaataatggtaacagcgctgatggatcaagaagatgcttgtgaacagacatttatgtggtcagaagctgattgatcagatttaggagtgaccaactgacttgtcgccaagttctgtccttgcttgctgtctctctaactaatcagaccttctaagttgacagccttccaagcattagataataaaaggagtagctatcaccaatgcggtaacagcaaatcccacaagaagtctatatgatacatttagactacaggcgcctgccaccacatccaggtaatcttgtattattagtagagacagggtttccccacgttggccaggctggtctcgaactcctgcctcaagtaatctgcctgcctcggcctcctaaagtgctgagattacaggcatgagccacgtgcctggccttgcttcctaaaattatcactgtttcccttcattttctaagccctccaatcttatgtaacaaatttcctatgttaaatcctttctgttggaatcatttgtttttctggtaggccctctctgaaaataatttgtgatggatcttctcatctcttcccctgtgacacgttcttgtgaacgtcccaacagcatagaagttctgcaaccttacccaacaagccccttgcatatataaaaacctaaatctttcattaaggggatcaagcatgctgaaacaactgtgacaggacaatgactgtgatcttctattggatactactccgtagtatgacagttagcatcacaactgaatcttagatttggaatattttcatggtaaacttttaacatatgatttttgcatatattatatgcaaagagatacattggatatattgttagtagcactgagggtgtagttaagctatgaattactgctgggaagagagccaaaattaacagaaaattaacttactaggggttttatcaagttttacaaggaaggaataaactgaaaaagtgaacataattgggagcaacaggattccgcaggtgaaggactcaccattatcttgtcgctgtcaataatggtgttcaatctggtgcaatggttagcacggtgcagtgggcaaatttctcccggatttttttttgtattaaccatcagttctgcaatcaaagaagttaagtttaatttcgtaaagatgcaaaaagtagactaagacttaaaaagctctacttcacaatagagatttaaaaaaaaaagatcatatctatttatgttttaaaaatcatgttaaaatgttttaggacaatcttattctttaaaaacaagtataaaatctatgtagtaatttactaattttcataaaacaacgaaaaatgtcttccctccaattgcttaaagctgattattgggagtggattttaggaatctagctctcctgggatactgataatatctctgacactggaaaacacgtttgggtttcttctttttttttcagaatgaattatccatgttaaaatgttatgtctggggcaaacagagcacttagaaatatttctcagaatattccatgtttcccatttacacacttaaaatgtggactcaaggttacatggacctcagcttataccttggatccacatttgccgtcgcttcatcaataatcaatatctgatttttcctagaattgccctggcaaggcacaccagttgtctttgtccaacactaaaattggatcctgatctgctaattcagtatccattttaccaggaagatcttcaatggtttctttaagttgtactgtagatgtacaaagaagaatgactgctatcattcaagccgctatggaagtagtcaagctcatagacattagaaccttcaagtcccttctctcgagagatataacttaagtggacacaacatgaggctgaattacctctagttaatgttcaatgagaaagatggtagagtcaacacaaacggaaatattctgacttaagagaacaaacaatggaacccaagatgctcctttatcacatcagcaaacacagtctgttcatgcagggtcacgtgttaatactgcctgggccaatttcttaagaaaaacacagtatgatcaataaaagtattctgtaggtaaaatacagaaagataaaaaaattcccttctttttagttaaaagattacagaaatttagagagacaataagagtgaggttgccaaggggctggaggattaactgtaaatggacacaaggaaatttcttggggtaaagagatgttttaaaactggattcctgcaatgactgcacaactctataaatttaccaaaacactgaatcacttctaaggggagcattttctgctatgcaaattagacctcaatagagttttggaaaaaaatcatatcagtgtcccccagcacctgaactcccttaccaataaccaacagacagccaacaagaacccctcttccaggtagggaaggaagtttctcaaaaaatgaagctatgctcccaatatagagtctgaagaaaaggtgaaaggatctttctggttgagtcaagttcccaaagcacattttggagacgagtgagtataactcaagggaaaatttaaaaagaaaatactgcaggaagtatggtcctccaaagatatcatcttataggcactttaccattttggaagttttttaatcaactggaaaagttaaaaaaatacaaatgcaaacaatgggaaactgtgctcatttgttaggaaatcaggagcttattcttgggctggtcctttcccaagtttaagccctatggctataaagtaggtcagtacattttctacagtctaataaatgttttgcagtgaataaaactcacaaaaaaacaggacacaatataacatcttgccccagacgacggggatagatatgttgatattaatgtatctttataaaattgtagctataagatgatttgatactacattggtggtggttcagttcactgatgtttgttttggagaaattttatagaacaagagccaaatcaggtgacatttgagagctatagaggaaccaagagtcaatacatctccaattaagagacagcaagcagatagatgagtgatggccaataagcaggtgtacagaactacaatgcccaaaacaaaaagccaagagtaaacgggtaacattgtcatgtaccttaaacacggaagcacactctatgaatgtgatcttgagttgtactcatgatggaagtccaactccaagaaacaggaatttgagttaagattaaatatggtattgatatttggcattagcatgcaaggtaggaaattaaatccgaagtgtaagatttggctcgtggtgcaaaatgttaccctgaaaattataggatgaatatgtcagcttagtcaaaccctctccattacaaagaagaggacttgctgagtaatcttttatgaaacatactcacagacctataccccatgtgatggaactgatcaaaagtagatttagcaaagtttttattagcttttccttctgagttgattttgataatactggtaagtgcaaaaggtcttttctaagaccggcagccagatttgaagaaataatctcacacttgcccttattaaggggccaacccatcattcttctgggttttgaccctccttgaggttatccacattacttgatgaagaatagggttgtgaggtgaagaataatgaacacatttcccagataacaggtcttctgagactctgtcatcatgattgaatcggggatggttatgagaatgatatgaattatggccaagtacagtggctcatgcctgtaatcccagcactttgggaggctggggcaggagatcatctgaggtcaggagttcgagaccagcctggccaacatggtgaaatcccatctcactaataatacaaaaaaaattagctgggcatggtggcgggcacttgtaatcccattaggggctgaggcaggagaattgcttgaaccagggaggcggaggttgcaataagccaagatcggccactgcactctagcctgagtgacagagtaagactctgtctcaattaaaaaaaaaagaatgaatgtgaaggccctctgtagtgttatcatacattcaagttatggttaagtattagcctgagaaaaagacaatggaggcagtggaacacagtgactaagagtgacaactggggaaatgaaaatatattaaacaatggtattacattactcttcaatttcttcagtgaggtaaatactgtattatgtcatgtagttgaatgttcttgttcttaggaggtacacatacatatttaagatgaactgcaacttcatggaaatgtctgcaacttactttcaagggctataagagaggagcaaatgtagcaaaataccgtattaacaaatggtgaatcttggagaagggtatgtgtatttcataatactattcatttgactgttctgtgatttggacattttaaaataaaaaaatgggccttgaagacacacagcatgggtatgagtcctgcctggctctgccaactgggcaagttctgaactttctctatcttagcttcctaattaacttgtaaataagaccatactaagattatttgaagatgtttatctcctaaaattgttggagtataaaatcagtcagtatgtgtagcattacaatagtgcttggtaccaagtaagagatcaatagataatatctattctttttgtttttttgctccttcctggacaatgaaatactgcctattcttttttttttttttttttttttgaggtggattcttgctctgtcacccaggttggagtgcagtggtgcgatctcagctcactcaatctctgcctcccaggttcaagcgattctcctgcctcagcctcccgagtagctgggatacaggtgcataccaccacacctggctaattttgtttttgtatttttagtatagatgggtttcaccatattggccaggatggtctcgatctcctgacctcgtgatccacccgcctcggctcccaaagtgctgggattacaggcgtgagccactacgcccagccgcctatttttaatatgcagtcagctagttcttttcatgcactgctgtagttttcttcactgcatttaccagtactaatattatattacatatgcattttcttattttctatcttccatacaagaatttgtgcctaagagggtagggattttatctctcttgatgactgctatagctccagagtctacaatgctatgtaaaaacctccccacacataatctgttgaatgtatgaagtcacaaggatacctcttttgtgacatgtctattcttataaattacaaagtaaatccacaaagaaatagaatttaatacaattttcttactaaatgtcattgtaaaagaaacagtccttataaaattaattggcccaagatatcataacattatactttaaaatatagaaaacttaatgttttctacatttaaaaaggttgtaatttcaggaaaacaaaatcaaatcatactatttgaaactatacatttcaacacaatgtatcaggttattttgaagcttagaaaaaataggaaactacaggaaaagtgaaataatgaactgaactttctaagacagcccatttctatcatcataaatgttttcaaagctcaaagagactcatgtggatgtcagattctgtttccatgtttctttgaactttctgactttcataaaggaagtctctgatgccagagactgaaatgtgataaacagcaactcaacagagggaacaacctttaacaagaacacagctaagtgtgaacgaagcgagcggaagcccattcgggcaatacaggcctgggaaaaatggaggtgcaaggtgtggggaatagaaggcccagagatgtggacactgctgatgtgcagatttctgtcttatggtgtcctgaatacaagacatcctgtattctaacagcaattctatcaatgttgaacatgattagataatttctccactattcaacatgatataacctagtcttaattgtagatcccagtattaaagtcgttttttaattaaagaaataacgtgctgctgattcattttcttagttgtacctactgtgtgatcttttgactttttctcataaacgacttccatctttaatcattacttacgttatatttacagagttgctttatttaggggcccgaagtggcactaattctagtaaactttcttccatttacagctgacatttttcagtatttacgataactttcagcattagaaaagaaaccccaaaaaacgagcaggtgtggtggctcacgcctgtaatcccagcactctgggaggccgagacaggcagatcactgaggtcaggagtttgagaccagtgtggccaacatggcaaaaccctgtctctactaaaaaacaaaaattagccaggcatggtggggcttgcctttaatcctagctacctgggaggctgagcaggagaatcacttgaacccaggaggtagagtttgcagtgagctgagattgcaccactcactccagcctgggcgacagagcaagactctgtctaaaaaaataaataaataaataaaataggccaggcgcggtggctcacgcctgtaatcccagcactttgggaggctgaagcaggtgatcacgaggtcaggagtttgagaccagcctggccaacatggtgaaaccccgtctctacaaaaatacaaaaagagtagccggcatggtggcaggcacctgtaatcacagctactcgggggctgaggcaggagaatcgcttggacccgggaggcggaggttgcagtgagccgagactggccaccgcattccaacctggatgacagagtgagactctgtctcaaataaataaataaataataaaaataaataaataaaaaaataaccaagatgacacaaccacatccataggactgttccctccagatgcccgaacttcttttgcatgtcaggtattaccctttccaagggatcatggtaagaagaaataaaaaaaacttccaagaaataaaaggcatctttcctttttatgtggtaaaccaccttttaagtggttaaagaggaaaaaactgacagtgctgtcctaatctcaagcaaccctctgagtttgggttcccatttccagtttggcctcatttataaaccaagtgacttgttttttgtctgctttaaagggggtttccaaatgacaccaggtttcctactaaagagcagatgagttatccagttctgaactggatatcaatgaaagatgaaaaccatggagacagcgagagacagaatgtgacagagaagtccagagaaacttgaatggcaccagagtcgtggtgtgaatcccttgtgtggtatctctcaagataaacacacacacataacttcacgtttacaacaccaggaagtaagatttggaattctctacgagaagaccctcagactccacggaccccagggaagaattcctgacctatcagaatgcccccagcctccatcaacttgtagtcatgaaattgttgtgaaaaactcacaatgcttcatttgttaggagtgctcagcctttcccctgacctctagaaggtaaaaagaatacaagcacccagaaggaaatttggaaaatccaggaaaacttagagaaaagaaaacactctcctccagtctttgtctcattacccccaaacgagcaatgtaatgctctggtgtctttcttaggtcaggtgtcagaatataagaatgattaaaaacagctgaatcacactggaaatacaatgttgtaccctaatttttagtaactcttccaaatcattccagaaaaacctacaatgccataaagaagtagttcccagagaaagacaatgatgggataattttcacttctgagggggacctaccacgtcttccacctcatcatttctagaattcttgaaggctactaaattttattttaattttggctataacaaatgaaataagtatgagttacagcaagttccatgatggtttttgataggatcatctcccaattaacatttcttcactgttcaagagaaatgtgtttctaaaaagtacttttgctctctgagaatctgtgacaaggaatctcagctctgaaacaaatagaaaaacactttatgagtaattcttgttcttttagggtgtgtccaatttcactattaaacctgtcctgagagtttaggggcacaggattgccttatctttcttacatttgacagttaactgtacccacctcttctctcctagaatttcactgtacagagatcacaaatttaaatgaaatcagaggtcaattgcttatcaagtatcaggaggtgaagtaatgacctaatttagaaaaagaaaatccccacagttgctggaaagcagggtgggtgtgtaagactcggcaatgacatgccttcagaaacaagaattactggcaggaaactgtcaggcctccagtctacttgctcacagtcaaaacccatctataaattaaagatttcagagctatccctgaagggcaacaatgacaaatgcaccaattcaaaacaacaacaataacaatggagggaaataatctctgtcactcaggctggagtgcagtggtgcaatcatggctcactgcagcctcgactccagggctcacaagatcctcccacctcaactccctgagtagctgggactacaggtgcagccaccacatctggctaattctttttttttttttatttttagtagagacaaagtccacctgttgtccaggctccacacttctttgaaatgaagagatcaaacatattaatacatacttttaaatgcttacttttttttaacttttaatatttattatttattttgggatggagtttcctcttgttgcctaggctggagtgccagtggcacaatgttggctcaccacaacctccgcccccaggttcaagcaattctcctgcctcagcctcctgagtagctggggctacagatgcgcccaccacgtctggctaattttggtatttttagtagacacagggtttcaccaagttggccggctggtctggaactcctgacctcgtgatccatccgcctcagcctcccaaagtgctgggttacaggcatgagccaccgggcctggccaatttttatttttatttatttatttatttatttgagacggagtcttgctctgtcgcctagatgggagtgcagtggcacgatctcggctcatgcaaccttggcctcccaggttcaagcaattctcttgtctcagcctcctgagtagctggactacaggcgcacaccaccatacccagctaatctctgtatttttagtagaaatggggttcaccatgttggtcaggctggtctcaaacttctgacctccagtgattcacccacctcagattccaaagtgctgggattacaggcatcaaccgctgcacccagccttaaatgcttacttttaaaagcaaaagactaaactaggtcctgtgagggattaccagttttatgatatggtttcgccatcaagtagactggcacaaatttgcagaactagactgaacacagaaaatcagtgttaaatacacaaaccaacagcaccttaatagtcaaagtccttttttcatgcaagggtgagaaatttcaagaagtggcccaacaggaaccacataaataatagaaaaatcctctagaaatcacatattagtataaaaccttagcagaggctgcagggttctgttatctgcattaaaattaacgtttgccaataaataattattatcccattccaactgtataatttacctttataaacatttcttataaaacttaaagcatttcataaatatgatctatcttttagttaatgaaaaacactatggtcttcccttactagaaattccctaagaacagagcagtaaaataaatggtgcaagtaacttagtcactaataggatctcaactcataaatacaacttctagtttaacgcattctaaagacaaataaaacaacaccaaactgttttggacaacaggaagaaaattaaaatgaaaccagggaaattttatttttggttttcatcatcatcagtatacacattatagcatatcacatcctcaatgatctcctgggtggtgaacaaagttagttaaaccgctaagctcctcttatttcctgcaatgctgtaaaggtacatatacacatactgaggctaacagactaaagatattacattttatcaattacctcttgtaaggcattccacagttcctcatccgtgtgctcataaagggatccaggtttttcctcattgttccagtgaacaaaacaggttcctaagtgcccaaatagtcacggtcattaccacagactcttttttcattttattccaatgctaacatcaacatagaattaagataccaaaaaataaaattcatgataataattatagcgttacaaatgccgtttacaaaacaacatatctattaatgttccactgtacaaagcgtgctccaaaatacctccagaccactgaacactaacaaaactgttgcaatgtgctatcttaagaagaaaatgaaaacacaggcctgatgtttaaaactgttttcctcatattattagcttaacatgaaatataagatataattattcgagggtctacatgaatagagctatagaaattaactatcaatcatgtatactggaaaataccgacagcatgattaaagtttgtgcttcaaagccaaattattaagcttttccaatttgcactaaagaataaattaggattattttctccgttggcaaaacagtttccaagattaagaatctctcaccgggcgcagtggctcacgcatgtaatcttagtattttggaggtcgaggcgggtggatcacctgaggtcaggagttctagaccagcccgaccaacatatgaaaccctgtctctactaaaaatacaaaaattagctgggcatggtggcacatgcctgtatcccagctacttaggaggctgaggcaagagaatcgcttgaatccaggaggtggaggttcagtgagccgagatcgtgccattgcactccagcctgggcaacaagagcaaaactccatccaaaaaaaaaaaaaaaaaatctctccaatgtcagaatgggacatccttttttttttttttttttttggccaaaggagatctaaacaactggggccagaggcacctctacttatgaaagattgcctctgattttgcatcagtgaatccccacattatctcatctgtgcatcaaggttactgggtcacagaacctcattattaactaagaaagcagggttacctgaaaaccactgtgaggaggtcataataaaattacatcaatttaaatagctgttcctattcatctgcttcaggagatcccacaattaaatcactcttggaatatcagcctcttcctggatttcaagagagactttgaacataagcttaggtaggctgtgtgaaagttttcttctggtagctgggtgcggtgggggcacctgtagtcccagctacttgggaggctgaggcaggagaatcacttggacctgggggcagaggttgcagtgagccaagattccgtcactgcactccagcctgggccacagagcagtctccatcttaaaaaaaaaacaacaaaaaaacaaaaacacaaacttttcttctggaagctctaataagccaggccataaggatataggagccccatcaactgctttcaaggatagggcagaacaaggggatgcacagatgtgggaacaagagaaggtgagactcttccacaggtacggagaaatgctcaagggaaccactggcctcaaatctcacctggctttggggcaggactgtcctcctcacttcccaaaagcctgagaagagagataaaggtggtagacttcttttttctcagccataaagaaaaatgatacccagggaggctctcatccctttccctatcgtctccgtttaaggctggtgaggaagaaatggatgtagaaggcagacagggtgccaccaaaaacatagtcctcagcaaaatgcaaaaatggaaacgacggtaaaatgggcactttgtgtgtataaactgataaagtggccaatatccttccaaaagcactgaaaagtcactggtcacatgatgttctgaattaccaaatggaactgaaaaattccaagagtcacaggtaaggtctgtcttaaaatacccaactgaagaccaaaacctgaacaaccatctaaacaatggtgggaatttcttgtgggggaataaccatcattctggttatttcagattaaaagataaaaacttgacttactcttgtaattatcaactctaaaattccaacctctgcaggcagaacatttcagagtagagattttggtaaacatacaatcttcatgtaaaatgtaaaagatttagtagcctaagtacatatttttgatggtatatattttaaaatgtcatttagtacgagttttaacctccattgttagcaaaccaatgttctgttcaacgtattattttaaatgaagcaccagatcaaacctgtttttcatagggtttaaaggtcatactttttaaaaatctttgcgccatactgagtagtaattttgtctcattactcacataagacaagctgatattaaacatgtgaccaggctgggtgtggtggccatgcctgtaatcccagcactttgggaggccgaggcaggtggttcactggtggtcagaattcaagaccagcctggccaacatggtgaaatcccatctctactaaaaatacaaaaagtaccaggcagggtggggtgcgcctgtaattccagctactcgggaggctgagacaggagaatacttgaacccaggaggtggaggttgaagtgagccaagatagcaccactgcactgcagccgggagacagagcaagactgtctcaaaacaacagcaacaacagcaaaaaaaaaacccacccgtgacctaaaaatggccgctctgaatcaaagcatttagtgcagtaaattgataatccccagcaggactgcaagactgaaaattacagtcttcctagagctttcatataaacttctggagacaagcctctcattatctcaagaagaaactctatccaccaaccttcagacacttaaacgacctgggaccaagacaaaaatcgcatggggagttacaaaccagcaggacaaagcacatactttaccctaatcttgtcccaaaccaggaaacttcgctctcttaaaatatacactgccagtagctagccacaactgctgctgcctgatgtcctcagagctatgtgtgcatttcaaacctgaagaccttgattcagggcagctcatctccctgtgtcaagaatcagggaatcacctaagtcactttaaatcttggtttcccttcttttttaaaaaaaccctgtagcctctgaatgactgatcatcatccattttcagaagaaaagaacattgttcaccaacaaaggaaaaagaattaagtcgtgtaaagtcttctttagatacaaaaaggtcaccagctccagggagcagttcatggccttaatgaagacttcagtgtgcagaaacaaaggactgactgcattaggccagaaccaattgtatttctttactagtaactgcatacctacctcttttccctttgaattttgtttcaaaaagaagaaaaaaaaaaaaaaaggaaagaaaatcaggtaataaaaaaagaagtctaaagagacacactctggttaaccttttcaacttactgaagaaaattcagggagtagaaaaccaagatagcagaagtctgagcagtgggctgcttaaaaactacttagcttttgctttgtagaaaaacaaaaaagtccatcaaatatgaaaaatgaatctgtttaatcctaacaaagatatagctgttgatgtatgccaaccgttagggtgctatcataaatgttgaatttgcatgagttactctttagttgaaaacatttatttgtgccagtaggattggaggagtaaataatcctcctaaaaaaagttttgaaatccatttttccagatccttcagttaagcaaactcttgtcgagttatagtatcaccttggtgttctccttgggaagtgcacttaactaccctgtgtcataacacaaaggaagcatacatttcggctaactattctgtttagggaaattatttaggaagactttcactgttcgcttcttcctgaaattttgaatacaaattgaggggtactttcttaaaattcagtattttttttttttgagacagagtctccctctgtcgccaggctggagtgcagggcacaatctcagctcatggcaacctctgcctctggggttcaagcgattctcctgcttcgcctcccgagcagctgggactacagatgcgcaccaccacgtccggctaatttttgtattttagtagagacggggttttaccatgttggccataatggtcttgatctcttgacctcgtgtccaccctccttggcctcccaaagtgctgggattacaggcgtgagccaccgtgcccggccagtatttgtttcttaaagtgactccaggactggcccctgactatgtatgtcatcattttgtgccccagttctttcccaggtccttgctgcttaatcctaaccacgaatttgagttgcaatggtgtggtcaagagtgacagaggaccctgaaccataaatgaaagggataagccaggagagagagaacacagaaactcgtgctccacacaaccccaggaagccatgcaggctagactgcccaaacatggccattcgaagaaacagcgcttggttctgcttttgctgtgtttgctccaaacttcctagattccctacatcagtgtgtggtgacacaagccatttggctttccactacttctgaggaagaggggtgtatgctttctgcactgcagaccagtaaccttcatgcaactcaagtctccagccttctccaccctctgcagccagcgaggcctcggaagaaaaagggcttgagctcccacaaggtaaggcttggaggatcttctgacgctcactagcccacgacacatagtgaatacactctgtttccaaaatgattttcttttagtgcttagtgtcacttaaggtttggaaaaaataaaaataaaaataaaaataaatcacaaatgattcagtctttcaaaatgactaactgtccaaatgacagataaagttcaaagaaaagataccttttgactttgctgtattttgctctctttggttatggcttctgggaaccttttgtaagttgggtagacagaaaaacaacagtactttgggaggctgaggcaggcggatcacaaggtcaggagatcgagaccatccggccaacatggtgaaactctgtctctactaaaaatacaaagattagctgggtgtggtggacgcacctgtaatcccagctactcgggaggcagaggcaggagaatcgcttgaacccaggggcagatattgcagtgagctgagatggcgtcactgcagtccagcctggcaacagagcaaactccgtctcaaaaaaaaaaaaaaaaaaaaaaaaagaaaagaaaaagaaaaagaaaagaaaacaatgagtaaaatgtctgatgagatatcatgctgtccaacaaatacttactgaaaaaaattgagttggatagttctgagttctgattctactacttattagctgttcatctccagtaagttattaatctccctgagccttagtttccttcctggagaatggggctaacttgacaaccctgcagggctgcagtgacaatcactgtgtcatgaggctccttgcacggtgctgccagcagcaggagcccggccaagcagggcagcacagtgaggcacgctgttcttcaaatggcagtgcaaccaatggatcatgaaatcacttttgtgactcatgaccatccttatgtcttttaatgaaccagaatagaatggatataatagaaaatatcagggcgcagaagcatggagtaattcgtgttgtgagacttttgtttctgtgcgtgtgtgtgcacctgcacgagcccacactaatcatgttgcaaagcagagttctgatcggggactgcgccagccaacatgggtttaaagtcctaggagagggttcaggaactcaggatctggcattgagattcgccgtaaattccatttgatcctgactctgctgtttacttgttaagtgggttaagctctctgtgcctcagtttgaaatgtgtcaaatgaggatgacacagaattgctgtgaggacgaagtgggagatggcaaggaagaagataaccatgttaaggattctgcaaatgttaggaattctcactacttgtgtaactttctgggacgcaacaatcactaaagcactggatctaagagggacaagcccctgttctcaccagggctgagaaccagtgtcggctgcctgctcgcgaaatgcaaagcattagaggggtacgagagtggtgaggaatgccgctaagaccggggtgggggaaagccagaaaacaaagtgatgcctcaccttttgttccttgtgagaaaaacattagatttctctcttaggcttttattgtcacatttttttttgtttgttgctgcttcactatttaaatttacataaacaatttggttaaggaattcaccaaggatcacaaaaatagaaacagaagttaatgagccaagtccttctagatagcgagtagcaataatgccctaaaggcctgcaccccaatccttaattagaaatagttctattgagcattcctcagaacccagagtagggccacaaacatgttctcatctagtaaaacttcacaacaaatctgtaagttagtaattactaggtttggtttaaggatgaggaaactgagcttggaggctaagtgacttcattgaggtcacacttctatcaggcagtgctggaataaaatgtgggtcgtgttgacgcttagaagatgctctgaaagattctatcccaggcagtctgtgaatgatttcctgggtcgcattaagtattgcacagtccctctagactatgtttcttttttcaaccaacattgagccttggagacaaagccatacaaagttaaaaaggaaagtctctcgtttacaatgcttggagatcaggatctacatggatacaaagcttagcagtgttttgtaacatgctccctggactacatacatagagcatttgctcaaaagtagggtggaaacttatggactgaaccaaaacctggtgatgtcaaggtatatttagtctttgctcagatgtgcttccaaacattactggcagagccaagaatcatctaatgttacttctttatttagagttcttttagtacacaagcacacaactatttcttattaagaattcattcaaagtaatgcagggcacgtcctagaacctttcatccaaggatataaaagcactttacagacatgcccattatctctgcaagtaaacctcatttggcccatttttgagatgggcataaccaaaatataaaacttgagatttatactctcattttctactgtaagcactaagtcatgcttctaatagccagagggaattaacgtgctaaacatttcttcccattttatcctgaaagggatacttttttttctttaaataaaaataaaaattgtggtacaatacacatagcataaaatttactgcttttgccatttcaagtcaacatttcagtggtcttaaggacattcacattgttttgcagccatcaccaccatcattcacaagacgcttttcatctgacaaaactgaagtcctatgtgaaataatgtaactccaaccccccaccttccctcagcccctggtgacgacgcttctcctttgtgtctctgtgaattgactagtctaggtatctcatattaggggaaccatctagtgtctgtccttttgtgactgcttatttcacttagcataatgtctttagggtatatctgcattatagactgtcaggattccttccattttaaagctgaataatttcccattgtatggatagaccacgttttattcatcgctcatctggcgatggacacgagctatttccaccttttgggtactgtgatgatcatggagtacaaaactctgagatcccgcttttaattctttctggaagtggaactgctggatcacgtagctctcattttttgaggaatctctacagtgttttccaaagtggctgcaccattttacttcccaccaacagtgcacagggttccaatttcttcacatcctccaaattacttaagcgtattccaattgttttagaggtcagtgctaggatagccataactgtacttggtctaagataaaatcacattctccttcccttccggtggcacgttctctatgcttcctactaaacaggcatgaagagttgtttatatccacatgcccagaaagctcattactgcctgggttttgctctttctcctctctgtgtttctcttctccagaatatgtgtttgtgtgtgtgtgtgtgtgtgtggtgtgtgtgtgtgtgtgtgttcctcagctcccctcaatgactatagagtgttaaaaaaaaaaaaacccacattaaaagaaaacaaacaaaaaacccagccatgtctggagttgaatattggaggtgttaaagtgaaggacaggatggaactgtgaggtccgatggaagccatgaggcccacagctgcagaccccatgccggtggggacaaggtctatgttgctcatgactatacactggagaatagtaattactcaatgaatactttctgaatttatgttaaatatgaaccaaagaatgacaggagctcttattgtacaaataatccaatctctagaacactccttgagagtcattctgcaaaggagaagaaaagaaaatagaatcagagtccgggaaaggatggccaatttaccctccaccatcagagcaaacactcactgggtctgtgtgaaatacaccacacactctcaaatggtgatcgtaaggaagatgaagcagaagtgcagagagatggaattccgtctctcatttcttccttgctattctttaacaacctcctggttaaaatcattcaccaagagctagatttaaaagtcaccacaaagccaactataagttttttaactctcacagcccacagtttcacaaaagcccttcatggaggtaatcacctttgagaaggtagctttagttcctacagcaaaatccaacattaagacacttaaaatccacatctccccatagaaacctccccagtgctaaacaacaatgcatcattttgttctttatggttatcagtggataaaactgtggcatcttagtacgaaatctatctgcgtaagttattaaatatcacacacacacacacacacacacacacagaagagagaaatgaacaaagctggatatctgatgaaaatacctgttgaaaatatctgctcaaaaaacatgctctattgggtgaaaaaaaaaacaatcctttcatccaattaaaaaaagcataagagtaaaagcaattaaacatagtagctcttataaaaggggcaggtaaggacgctatacttgcatacctgaggtatgattgacatcttcttccttaaatcgtgaagtccaatttcattgtcaagatcttatcaatccaaattttaccttcgggttctgacaatctaaaaagggctagatgagggaactttttccagctccggttcttcccacaatgccaacctacagagagatcaggcggcaggattaaaaaaaaaaaaaaatcacaggatgcagcaaaactaggagaaaacttcggtttttgaagaagaattaaggacattctatattgagtgtagtctaagagtttcccacctcagcactgatgaccttctgagctggatacttcttcattttggaagctgccccaggcttgtgggaggttcgctagcatccctggaccctactgcatagataccaggagcacactccaaaatgataccaccaaaaatgtcactgacaaacgtcctctggggcaaaactgcccctggtgagatccactgttctaaaaaagagttgaaaataacagaatctgtttactggcattgaaagtcaacagtctcctaagtggcccatgaaaaggcaacttttaaattagctttgcttgcagatctgagtaatctgaatttctgagataatttcacagggatattaattcaagacagagggtcagaagtgacataaacgagtattcatttttctagagttctattatttaagataacatttctttggtagagaaacttccaaatattaaatatctgcctatattttgtctcaaaatgttcaaaattctgaagtgaagattgcaatgtcttaaaagacagtagtaaccagtagccaaaaacacataatgagatcaacaacaacgcaagtaacatttgctatttacgtaaggcctttctctgcacagttcaaaaggcatgctgcaaactaattaatacttacaattgccccttgagaacatttgtgtcaagtatcactcctctattaaagccaagacagagagaaatgaagtgcacgccaatacgatcaaagaatcaataaaatgctggtaaaaaggtgggggcaatacgtctatttgtaaaaactggctttcacatgtgtgcatataaatctgtatgcagaaactggcctctgaccaatgaccttgcacaactgcaaatttcctggtgggaacttcccaagaaatgacatccccttatttagaaatctggagtcaacgaaggacataaaacatgccttcaatcatttgtccttatttaataaattttaaaactcactgcaaaactttactgggcactgggtatgtgttggaatgtgacatattacctcatttgaacacctccatatctgtaaagtcaataatggcatttcacaaggaattttatctttaaagagatacatgtacaaaatataaaaatgtaaatgtttaaaagtggctttagctaattttattaactttggagtcatattctaccttatggtaaatccagtttatactttataggtgggccattttctgcacataggtacatccgggtgtgtgtgtggtgtatatatatatatatatatatatatatatatatatatacacacacacacaccaattaatttctgagataatttcacagggatattaattcaagacagaggtgtcacaagtgacataacaggtattcatttttccagacttctatcatttaagatgacacattctttggtagagaacttccaaatattaaatacctgactatattttgtctctctcacacacatacacacacaccacgtgtatgtgtgtatgtgtgtgtgtgtgtgtgtggggcttatgtgtgtttctcagtaatcagcacgtatctagacatagacaaatgctgtgtttttgagaatgtgtggacactcatttatcagctctatgggaaactgatccatctgtgcaaacctggacatttgtaggccattatagtagatggccaggatggaccccctcaaaggtagggaacactgagggctgcctacaacataagactaggcactccaaactcaggtgaggatataatcagcaaaaggcaaccaaagaaacctggctctggttagttctcttcaaagtcatcaaaattacagtctccaagtctttcatagtcaccaatgggtttcaccaaatcctctggagaatatcactaatatcagtaagtttacttcataacacgaaagagacacttagttttattttaattgctttacaattgacccttttttttccccaactgggccaagagtggtctctttggccaaacattagacatttgtacttggactctcttcatatatgaaactcaacatgattaatacccaacagcccccctccaaacagctctgcttctaactcctccattttaatctaataaattcttccccaagttcacaggctcaaacacccatctcccaggttttctcaactccaagcactaaaaatattacttgttctgtttctgactcaataccctcactttaatttctgcagccattacctcagtgcaaggctgcattaactttgaaaaacaaaaactcttttgctagttataatcagtgcaagtgaattcgaaaaataataaatgctggccacaaccccagcaatctgacagaatccttgtcacatgttaatacctttctttctgaacttgagtgtgagttatctgtgttcctaaagatataatctcatatatttagcaaaatgagaatatgcacagaatattataatctattatttaataaaagtatttacttcatagctacataatattacagtatatatgattatttattcaacaaatcccctatttgtggagtttaggctccaatattttgctattgtaaataataccatgttaaatatccttgaagctaatctttgcaagcaaccttaattggtttcttaaaataaattcttagatgtggaattgctgggaacaggtatgaacattttcaaaggaggctgttaagtgatgccaaactaccctccagaatatgataccaatttctactcccacctgtatccctgcaaattcactaaccagggtattaaactttgttttaatcaacattagtttgattctacaaagtggaatcacttgccccatcactcttgccagcagtacataaaatcaattggcttcaggccttcagcgtcttccccgtgcaccatttctcagattaaacttccgaagtacagctctctgcctggcactccacactgggaaactcctctacaaaacagtcccaactaacctttccatccttagctccatgagcaggattgatttgcggggtggctgtgaggactaagtgtgcacatgtgtgttattcacctggtagttcagcccttgtatgctcagagatgcctaattcttcatatcaaatcacggcatcgagccttggatatgccatcgtgcctttcacatgcatttcgacctgctgaaatcctaaccaccttccaagtctgtttcaaatgtgtaattgccttaaaatcctccacttgtcccctcgtgtggatttccccacacttaatggctgtcgtaacatcttttctaaacagccataaaatctgcgaattcctctatcttacggagcaggcatttatatactactttgtttcttctactaggcgataggtgtgtgggcagggcctatattggaattagctttgtattatttgtatcacctgtggtgtcctcaaaaaaaaccagaaatcccccagagagttaagcatttaactcaggcttgaaacatttagggaaatctattgccatattgttcaggtatacaataagctaggtgttttacacctcttacttgtttaagttataaaactctaatggctaggccctatcacttgcattttgcaaaagagaaaatcgaggcttagtaagattgattaaactgttgaaatgactgagcccctaagtgatgaatgggactgaaacccaagtctgcctgcctcttgcccattctgccgatggcctcccaatacttggatagcctggctctgtattcccttggtgtagctagaagggagacagcggggagagtgtggttgtctttaaaggcactggcctgccatactggtcctattgtcatacatttaatcatgctgtggacatgcgtgagtataagaaggtggctaggacaagaagctgactactgtggccaagacagtacctgtattagggtggattacagctgttgacaggaagaactggcaccccagaagaggctgggagagaagcctgcagctacgttggacatggggcaactgggaaacagccagacagacctagtgtactgtggggcagtgagacccattttgatcccatcagtagtgacggaactcaaatacatcgctgtgctgagctggtatgaggacagagactgctattcatggaggctgtatggtgggatgaaaactgtgatagaagacagagatgaccggaaaggtgcaaagaatgcataaatggggaatcacacagaattaaattgtaatgtaaattcataatttgcagatataaaagtaaaaaaacaaaaaacctgtagggtggcacttggcccaggactatccagatctcatgtttagtcacaagaggggctggggcaatccacgagctccacttcaagttgtcaaggaagtttcttggaaatcacagattattagtcatccaaaattgcttaccggagagcaaggctttaatgcaggggcaggagtgggggtggttcttgtcccagtgcaattttaatcaaagggtggggtgggcctgacagtctgcatttctaacatgtttccaagcagaggcaggtgatctgatcccagcccctgagatgagcaagcaggcagggcaagtgggacaatctggctgtgaaggaggggtttctcagcaaacattaatgtaaaaaaggagagaatataagaaactaatattttgcacactatagcaaggtctagtacacatctgtaaaaaggtattatccaagtaatagtttgagcaaggaaaaaaaaataacaaaccaaaatcaatctacctctagagctgaaaaatctttaaaatggcccagtactctctaaaatgattaaatcaaccacaaaaccatctaaatgaaaatgcagccagtgtttggaatctaaccaggaaggctagggtggtatatacctcatttggttcattcttttttacttgctatttcttctgtgaattagaaacctacttagcgcctatactttttcctatttgttataatgtccaggaaatctgagcagatgaagcaattgaaagagatgaagccctgtttctgctgtgtggacacattcctacatctccactggaaacaatgccctctccatcagctccaacagcaaagggactgcctgagatcctggggctgcaggcaggtgtgaggagacgaaccctgaatatacacacaaaaagtggaaccaactcaccacgatgttgccgaatacacaaatgaagctaaaggtgacactgtgagtgaaccaggacacaaatcaaaagcaagtggggctcagcgcagtggctcatgcctgtaatcccagcactttgggaggtcgaggcggtggattgcttgaggtcggggttcaagaccagcctgaccaacatggtgaaaccccggaccactaaaaatacaaaaattagccaggcatggcagcgggtgcctgtaatcgcagctactgggaggctgaggcaggagaatcgcttgaacctgggaggcagaatgagccaagattgcgcactgcactccagcctagatgacacagcgagactctgtctcaaaagccaagtggttgtagtataattcagtcttcaaattcaatttaccctcccacatttcagatctcaggtaatcctagatttgggggggttttaagatggaacgatatcaatgtggggatataggttgttttctaagtgtacaacagaggtttgtagataattcatattttatggctacaagagaaatttacaactggccaaactaacagaatgatgttgatcaggtaggacctaataacacattgtctgagagaagcaaacatccccctggccccatcaggaacagaatctgagaaaccttgctttcagcaaagctacagctgatgctgcctgcagagtggtctccaccttcttcacactcacaaggatgcgggtagataatgaggaatcagcttttgctggttccctgggtatcttctgggcatgaagcgtatatttatttttcatggcacaagggtatcattcattcaattgtgactatagcccattaatgggtctgtggtgggaagagctgaaaagagcagttccgaaagtatctaacactgacaccagagaacgggctgttgcgggagctgtcgtgtgtgttttgttaccgatttctttgtattgcatatccctcactctcacaggcacccaccatgtgccctgcagcatgccattttctggggtacagagacgaatataaaatgctccctgactttaagaggctcagggtactgtgagatctgacccagaattataaatcatgccatcgtgctatcttctttaaaaaaaaattgtggtaaatacacaaaaggtactttatgtacttttcaaattgtggtaaagtaacataaaattgatattgtaatcacttgaaaatgttcagttcaattatattaaatacattcatgttgttgggcaccgtcaccatcatccatctctaaaactccatttatcttgtaaaactgaaactctgtaccattaaacactaatgcccattcccctacccctgccgcccaccatcctactttctgtctcatgactaactactccaggtacccacatgtaagtggaaccttatagcaccgtccttaggttctggcctaattcactcagcataatgtcctcagggctcatccatgtcagaatcacacattcagcatgtgtcagaatcaccttctttttaagtctggataatattccattatgcgtgcgatcacattttgtttttccattcctcagtcaatggacacttgggctgcttccacctactgtcactgcaaataatgctgttatgaacacgggtgggccacagatgttacattaaagaatcggccaggcatggtggctcatgcctgtaatcccaggcatgatttgggaggttaaggtgggggatcactttagctcaggagttcgagaccagccatggccaacatggcaaaacctggtcttactaaaaattcaaaaatgagttgggtatggtggtgcacacctataatcccagctacggggaggttgaagcaggaaaatcgcttgaacctgggaggtggaggttgcagtgtgccgggatgtgacattgcactccagcctgggcgacagagcaagactctgtctcgaaaaaagaatcttaagatgatgtggagaatatagtttcaaagaggcagagatgcttgaactgactgaaaaggtgcacactaagagcaaggcagacaggtgcttggggagaaggagggcaccctgagtgcagggatgtgtgtccatattgggagttgtgaggagaggggtgggaaggggaagagattctatgtcttgtttgttctggtttagttccttcaagaggctgtcctagtcctagccaagggcccaggacacatgtgaaagggacattgctggcagacttagatacctgcaaaaccagctcacaaactccacacagcctcccaagtccctccttgttttcctttcactgactttgagtgagttctggtgcctttactgcctccagcttgggggtctgatttctgagcactgatggggtcatggatctgggtcttcccttgggggctgagagccagacaggtcctgtcagggtgggcctgggctcattaaggttgcagcagctgctcacccaggcaaggagctggccacgtaaggatcagtctgtgatcaaactgtttcagaaagaaagagtttgcagtgaaagggatggggagggaaacaaagcacaggttaaaggaaggcaagaaagactaaggaaagggcctgataatgtttggcgtgtccccacccaaatctcatcttaaattcccacatgttgtgggagggacccggtgggagtaattgaatcatgggggcaggtctttcctgtggtgttctcatgatagtgaataagtatatgagatctgatggttttataaggggaagtttccctgcacaaactctctctttgcctgcgccatccatataagatgtgacttgctcctccttgcctgccatcatgagtctgaggcctcccatccatgtggaactttaagtccattaaacctctctttcttctgtaaattgcctagtctgggtatacctttatcagcagtgtgaaaacagactaatacaggaccaaaggatggaggagagaaaggctggaacagaagctgcagcaatggaggggaagagaaggacttgagaaatgcacaaagtaaaaatcgacagaattagacataggagtgttggtgacacaaagccagagttgcttcctggaaaaatccatgagtaattaggtatcaaacagagtatcctgggtcacgttaactccagccctgaggcccggggcccaccaaccacagtaaagcagttcacagcaggaagaagttggtatccacattccacggttagtttccaagacaggttaacctacgtatcactgatcccttcacacatccacaaggaagacaacaagcagacatagcactaaatcttctgaaattggaagaggcaagatgctttaaacaaaccttttcttgtgatttaatgagtgctgtcagatgttcagtaccagaggcccacctggactgtacatgaagttcacattgtcaaagattatcacccttcatggggccaggctggtggtgggcgtttctgatattcccaaggtgcttctttttcaggtctgtgtattcaatgaccctttctactgagatcatctgaaagaaatatgacatcccaggggttaggaatggagggtgtcatttatggatgttaagagactgtcaatgaaatgttctctttcatacatagttggttaaggagagaagcaggagacagacgaggatgttgatgactacaaatttggttcatcattgtgtaacaccttcacttacaaccacttccttcaacattagttaaaagaatgagagaaatgaatgcttagattttatttatccacttctcacatctgtataaaggcaagaaaattttgtaaaggaaaggaatacttagagccaccaatcaagaatctttgctggctgggcgcggtggctcatgcctataatcccagcactttgggaggccggggcaggggatcacctaaggtcaggtgtttgacaccagcctggtcaacatggtgaaaccccatttcactaaaaatacaaaaattagccgggcgtggtgctgcatgcctgtaatcccagctactcagaggctgaggcaggaaaatcgcttgaacccgggaggtggaggttgcagtgagccaagatgcactattgcactccagcctggggtacaagagcaaaactctgtcccctcacccctacccccaaaaaagaatcttttgctatagaaggatcacctgatataggtcagttaaactggatgtcgtgaaacctcactgtaataattactcaacttttgctctatgagaagaatgaaaagattttatgtttattgcttttctctctttaggggaaggtgcaaatatttaaaacattgattaagcctcctataccaccataaactaataccctttgactagcacattccaagaggaggcttctgtaccaagaaggcacaccagcaaagttaaggccttcctcccttctgttcttcacatagagagtaaacgctagaactgggagaggaggagacctattaattaaatgtaaacaacctcaaatactgaagtcttcttttaacaggaatgaggaattacccgttaagaaacaaaattaacaggcttctaagaaattagcttatatcctctctagaatttcagaacctccctcctacaggacatttattacatctgaaaaagcttgtgatgaatataaaacctgctgacagagcaacctaagactcagaaaaagatgtatatattttattttacattaactttaaacagatggaggaggatcttaaaaaaaatctgttaccaaagatgtaaaaataacagttttaatatttcacatagaatggcttttataccatttaatggcaaggagattgaaaaggcaaagaacgtgaaggtaatattaccatattctcaacttcagcactttgtcgaacacaccactgaaacatccccatagcgtgagggcataggacagtgccaaaccaacctgcccggcatccagagctacgtaaggggaagaagggaataaagtcagtctcacttcaaacctaagcctggctccttctgccacttccaagaggaacccttcataatgttgaaacaattcacatttaatgacattaatagctatattttaccatttgttgcttgagatcaagatacaatggggaaaacaacactgtatatttagaaaatttttagatgattttatgaattccaacaggatcgacatagatttaattaacagtatacaaacgcaagaaataatgtcattattcagacattcattattatggtttcaaagcccatacattattccactttctacgtgcaatgcaaccacagctggaaaccactaaaaacaaagaataggttgtaagtgccaatgcttttgagactaaaatactactctccttgttccattataagtattgtaatgcactgttgttactggggtggtgaactcatgccctgcttgtctggtaccatgtggcattgaagataatactctcctgctgagaatttttctcaacctcatgcaccagcaactacaaacaatagattcaagtagttggaaggctaacaccctaagttggacaaaatcttcagaataaattggttttctcttcacaactaccagacactaacaggaatgttcagaactcaactgcgcatatctcaacccattcaaagaaagataaacccatcaagacccaaatgatccttaaatgagtcacactgctgaatcctacccaacctgacacatcgtaaatgatttaaacacttcattaggaccaaacagtatgtagtagtagacaaggtggcaagagtttaataaagtaaacacagctataaattgtaatcataccatacatagttattcacatctgtacttacttttgccagaatcagggacccaaaggcaacgatgatgacaaacatggcacagatggcatcagacggacggcgaaccagcgggacgttgtcaaaaacaagaaccaagcctctgaatttgaaacggtaataagcatgatgaataagtagatgaatgtgcgagtgtgttttgctcagttgactacagaagatttttacgtggagtagggcaccaaagttgcacacccaaggaacctttagttccagaaagctaagtgatacaggcaatatacgatacacatacacaatggtaccgtggcttctgtgaggatgcatgcgaatatgaaacccagaaatatgatcctaataaagaactgagaaagtagtctcataaggacatctcgtacagtgctgagaaatacttatgtgaagtgcatccatgtgaagtccacccacacacatggttgactggtccagttctccaacagcagagtgcactcccaatttacttctcccaccttccatacttaccagaaggcccacacacactgactatgcttaggggctatataaaaatgacctcactaacaggatttgcatgtggttttttgtttgttgtttgctacttcttttttccttttagcatgtggtttttaaagtgccatttaatcagcagataaaataaagattggaatgacggatctgaattttgtagatttggtggaaattctgaatttccatattgaaaaaatcttcactgatgcaaggggtcagcaaactacagcacgtgagcagcacctatttttgtaaataaagttttattgaaacatagtcacagccatttgccaatgattgacatctgcttttgtgctacaatggcaaaggtgattcatcacaacagagacaataaggcacacaatgcctaaaacacttactaggtggccttttgcagaaaacgtttgctgacaggccacaggccatgcatggtgagagaaagaccccacaagccagtcagggggcacaaagaggaacgtgcagcagcgattccgagaggagtccaagcccagaagaaggggatggggaaggaacgaagatgcgcaaaaaaagcaggatgtggggctgggccctgaggtgcctgccaacaagtcatctgaccagggaggttaagccagaaaaagcagcagatcctgtcctttgaaaccattccagaaatagacagacctgaatgtaaatcctggtgtgcatcaaacagttcctgacaccttcttctgctttgtatgcccggatggtccagagcccctggagagaagatgacaagtgggaaacactggactccgagctggggaaacagacagagaaaacagctcagtgaggctgggtgcgaaaaacctgcggcctcccaagctccatggtcacgtatccaccaaacagcacacgcaggctcctaggaggcttcatgtttcaaggaaaaataaatgttcccaatagcctgaggggacctgccactggaatctcaagctcctgctcaaaccacacctcacataaggggcctggaaataacgtcctatttttgaccacattcaaatctagttataattctttccttcctaactcagcctccaggtcttcctcctctccatattcttccctgacatctctttgggcagaaatgatattttctgatttttgagccagtaggattttaaaaaacaattctctgttaagagtactcaccaactgaattacaattagccatctatgtgtctgtccccaccttaaattgctaatttctcaaggtcagctatagccattgcaccctggtaactggatggtacctggcacaggacaggtactagtaagtgagctgaacagacagactgtcacttccctgcatcctggggaatcttctgtgccactcatgctggaagaatcctttgtgatctccatggacctgggtgctgcaatgcccttggccgtgcccaaggaacctgcccagccaagatgtctctgaatggtcttaacattggctccggaaccggacggatgtttttatgactgccccactgcaaacttgtcctgatctctggaggctctatggcatgtgccattgcttttttcagaatctgactgtggtctcagtgggttcttctctctacagaattttaagaagtgaattcttttttgtgtgacttcttttttctttgggagtgtatatcccatgaggttccctgaccagctgctcctccttgagccattgtgtttttgttgtgtggtgtaggtttttttttttttttttaagagggagttgccgccctgccccgacctgccccgttcaagcgattctcctgcctcagccccctaagtagctgggattacagatgtccacaccacggccggctaatttttgaatttttagtagagacatggttttgccatcttggccagctggtcttgaactcctgacttcaggtgatctgcccacctcggcctcccaaagtgctggattacaagtgtgagccaccgcacctggcctgttgggttttttagaaacaggatttcacttgtcaccgaggctgggtgcagtggtgtgatcatagctcactgccaccttgaattccaagctcaagggatcctcccacctcaggctcccaagtagctgggactagacatgcacaccacctgcctggataatttttgagtttttcatagagatgagggtcctcctcctgccttggcctccaaagtgctgggattacaggcaggtgtgagccaccatttccagcaggccactgtgtttcagcacaccatttgatgactaccaggacatacctccctcctgcatagcagcggacatgaggctagctacttttgggcagggaggaattcctgagagtttcaattgtctaccatgaatgagccatactggggcaggtgcatattggggacacgtgacctagcacaatgtctttagcattttttctgggataaatgatttgtgctttgcaattagcaaacactgactttgctacctgtgagctccagagaagaccctgttagtaaaacatggggtgtccgggagaagttaagataacttttatttatttatttttttctgagacagggtctcactctgtcacccaggcttgagtgcatggcatgatcttggctcactgcagcctcaacctcccaggctcaagtgatcctcccacctagcctcctgagtagctggaactacaggtgtgccaccacactcagctaatttttatatattttgtagacactgggtttcgtcacattgctcaggctggtctcgaactcctgggctccagaatcaggctgcctcagccacccaaagtgctaggattacaggtgtgagccaccgtgcgtgccaatctatcttacaggcgatggctacatatgttttataaaatgatgagggggtagggtggggtaaggggcggagggagtggaaaatttaagagaaaaattctaactcattttctgggcggactcttagtacagcatccccatgccgatctgtgctacagctgactcaatactggtggcccactgtacacacagacactacacatttgggggtgctggggtaccagtgtgccaagaatggaggttccacatatatcagagtccagagtccacagttccgtaagtgaaggaggaggcgccaggtatgagacactggggttctgagaaagtgggaagccctgggttggggaaaggcgatggagctgcaggttactgactgtccacccatccttggggctctttcctgactgatactctgactgggggcactaacttttaggggccctctcctgtgatagtgctttaagaaaccaaccttccctgagcatagattctccaccagaatgtgatctggcacttcccttatgtctaatcaggcagagagcctcccacgagtccacagggttctctctattctctatctctggcatcacaatgtctctactaaaaatacaaaaattagccaggtgtggtggcgggcgcctgtagtccaactactcaggaagctgagacgggagaattgcttgaactcgggaggtggaagttgcggaagccaagattacggccactgcactccagcctgggtgacagagcgagactatgtctcaaaaaacaaaaacaagaaaacaaaaagagtactcttcaacacacagagtaaccttttactcttatttgtgtcagctctctataacctgtaactttgcactgggaaggtggcaggtgacataccgcaagaggactgagctggtgcttctgtgagaaaggctggatgttctgcacaggtctttctgcacgcctcagatgttctagcctgcaccctggaacttggtcaatctggaaacaggtgatattgggaataacacaagagaattccaggccccattaccctacaaagagtttggctccagtagttcagagaaatcactagaaccatgctcttacctccagagcaagggagtgttggactgaacgcgtccatcatataaagaatgccactgagaaggaaggagatgtggcagtcaggggacagagtcctggaatgaaattcttcaacatagctattgtcatttgctttcctcataggagatccaagtcgccactgttttatctccaactgggtttcagggcagggtcaacttggaaattaggtaccatcccagttttggaacacccgggaatatcatgaagatcaagctacaactttaattcacaccaaattaccaaggtatagcaggaatttgtaacctttgaaaagatatcctttctctttcacaccccacttagggctgagagggctgccagtgagggtgagctgggggtctgcaaagacaactaactagtaccgagggagagcgtatgtcaagcctcagctctaagtactagtcagcagtttccagctgacacaacctgccgtttcacaagatcaatagctgtgtttccacaacacagagaactctttaggatacactctacagagattttctgtcttctctgaaagaacatgaaaaggaactgcatgcaaagatctggtctaccagtcttgctgcggggtatgacgctgtgtaggacctctcagggttattacggttttaattctcaaggctatagcgccctggtagttcccgtatgttcaaggtttccaagcagtctcaggcaaccctcataagtatttatccttgacagagggaaaaacagacttgaggcattaagaacactgcccaaagctgggtcgatggctcacgcctgtaatcccagcactttgggaggctgaggcgggtggatcatctgagtcaggagttcgagaccagcctgatcaatatggtgaatccctgtctctactaaaaatacaaaattagccaggtgtggtggcgggtgcctgcagtcctagctattcaggaagctgagacggagaatttcttgaactcgggaggtggaagttgcagtgacccaagatcacggccactgcctctagcctgggcaacagagtgagactatgtctcaaaaaaacaaaaacaagaaaacaaaaaaacactgcccaaggttaagtaaagtaagccacgcaagtggtagacttgggcatggaccatatctgttttatttccaaggctgtgcttttaatctgagccacagtatcagagagagaaataatcagagttaaaggttctcatgcatcctgagggcatttttctccagactttgtagccacgctttaaaaatcccctaatcttacttagctaatatccaacagccttccctattccgtgccggttattaaccaccttgcattgaacaaagtccctgggaatctaggatgaacgaaatgggacacatgggttcacactcatggcagacattgctagtggatcacaatatctttacaacagaaattggatacggcttcacatttcaggcattgccaaatgagtggaggtggctaggaaatgcagccaaatgccattccggtttttatgtacttctctatgactgactgttgataggtgactcttgcaaacataaaatgatcaactgcagattagtttttgttttttgttttgtttgttttgctttttcagtttcactcttgttgcccaggctggagtgcaatggtgcaatctggctcacctcaacctctgcctcctgggttcaagtgattctcctgcctcagcctgccaaggcaatggcacaatctcagctcactgcaacctccacctcctgggttcaagcgattctcattctcagcctcccaagtagctgggattacaggcatgcaccatcacgcccagctaattttgatttttagcagagatggggtttctccatgttggtcaggctggtctcgaactcttgacctaagtgatccacccacctcggcctcccaaagtgccaggattacaggtgtgagccaatgcgccggcccagatttgttattaagattcattaaatgccggctatgactccaggggcagtgagcagtccaacagaggctttggaaatccttgagggcacaaggatgaagctggattatgccccctgccacggcagtcaggcatcctgctttcagctggtgactccagcagtggtctcaaaaccacgatccactgctgctgagaagaaacagtggaattgtgacttatggcagagacccacaccctggacgaataacagtaaatagttccaaccaaccagcccccgtggttggtgatctagcgcatggagaaagaatcctgcatatttaactcattgttacagccaatcagggtacggaacacccaaatatgcctcaggggccatgataaggttgtcagaatctccacatgaaaatgtttcaagctttaaggtacatgctgaaattcaagagagaaaatcctacactgcttcccaaaagccttcctaagtcccccttttctccacatccacatggatcggatgtggctgttgacaagacagtctacgtcaagatgttccttctggaacggctgcttccttcaacataccacagatcccttaaaacaagactctcgaataacttcatttcatgagcgggcccaaaccataaaatcctgcacagccttgctgtccacacacaacactggctagggccagtcatctgcacaaggaggtctcccagcaattatactctaccttccctagcaagtcctattggccaagtgttactccatgtggactccactgctcggcctgcccactgaaaaccttacaagactagacctcatggagcttagctggttttcttgatgactgaaaagtttttctacaacttttatggactgtcacccttctacttcatgcagacacttaggataaatgcctcttagagttcactgttggccagggcagcagtacacacctgtagttccagcactttgggaggctgaggcaggtggatcacttgggtcaggagttcaagaccagcctggccaacatggtgaaaccccatctctactaataatagaaaatagtgaggtgtggtggtgcacacttgtaatcccagctacttgggaggctgaggctgagaatcacttgaacccaggaggtggaggctgcagtaagctgagattgcgccactgcatccagcctgggtgacagcaagactccatctcaaaataaataaataaataaataaatgttattgttaaaagagaaacatatatatgtcacaaccaaaaactgctttgtcctaataaactctatttaccactcagtagaagatactgaaaatgatgggactcaatgcttctcttctagggtggcttccagagagctgagttggcattcagcttttctgatacaaatatcttccttcttattttttggctattatccttataccttttattaaaaagtaaagcaattctactctcctttgagtttgtgtttaacaatgatgaaatatgttaatttgtgcatgcataatgagatgaacctggattatttcatctctgcgattacatgtggaatagagtgattaatcataaaatgtctcctcatgattccaaaactaggaaattgaagagagcaacagactatatgttttctaaactatatatctccttgtgatctaaggggattattttcagtgtccatatatatataaacagccgagggggaaaaacctcaaactgtgacattagaacaagcaccgctggtaacaaatggaaactgaaaataacaatgcttatcttttcaaaacgtttaaaactgcaacttcctagccatttgtgagtttgcaaaagtcataaatttaccaaatacattgcttctgacacctcttttccttctccatccttctcatttccttgtcacttttagtatcttcggggaaagatgctaaaatacctaattattttccttctatattagtttcaccatgatcaaatattttatttctaagaaaatgtttaattaagtgccggctttgtgtaagaaagtatgtcataaacaagacacggagagtcctgtcttcacagtgctgacattcctgtagaatattactccccatatggccttcactcctccttattccaaatgcaaagttgcacgttgcaggctatcaattccacatgctctaagggcacaatgattcataatggccaatacgttcaattacctaatgttagagaaattctggaagcagagtctgccgaatttcagggggtctctgtaatttatggcataaatggaaactagctacatgtctataccaacccgagtttccatactcacttgtagattccaggcgcttcacatctttgacgtttccaaaaaatatcgccgaagaaaaatgaaaatgattccaaggggaaccaaggtattgcgatccaaggaatcacggccacagccacagagaccacaccaaccacttgtagcatgtctgaaatagcagaagtagatgcaggttttccttatcaagtattcttttcaaaaatctttcatgagttgttgttaggattacactcctttctctgaaagacttattgtagtaccaggactgcttttccatacaaaggaataacaaaagtataggtggtcctgatgatatctattcatgcctgccatgtgccaaacactatgatataaacttatccattaggtttttttttccttttcttttttttttttttgagatggagtcttgctctgtcacccaggctggagtgaagtgtgccatctcctctcactgcagcctcccactcccgtgttcaagtgattctcctgcctcagttcctgagtagctgggactacaggtgcatgtcaccatgcctaatttttgtatttttagtgagatggtgtttcaccatattggccaggctggtctcgaactcccgatctcaagtgatctcccacctctgcctcccaaagtgctggaattatgagcgtgagccaccacaccaggcccccttagttcttttgaaacactcaccagcctcatgagtcaggcattattactttccctatttatggatgagaaaactgagatttagagtaggacttgaatcccaaactatcatgagtcagtgatgttatgcgggaaatgagcaagcaggcatcatagacaaggaacccagaagcctcagcatgcacgggataaggaagtgactaattgcaaattcagtgctcagaaaaaaaggaaataattaaatcttcacctttggaagtggggagtcatctctcttggtatctatcctttgctaactttactgaatgctgattgtgtatctggctgtatattaaatacacatgtatcaactcactaaatctcacaatatccctatgaagtagtattactacaccattttacagatggagacactaggcacagggagaaaaaagtaacttgatcaagaacacacagcaccagtcacagagctgagagcatgcattgtcagccactacattttagcttgtccccagcatacggctagctttttatggtcaggataaaatccctgaatttttctttaatttttcccctaaacacacttacataaaaattagagttcattaacatgcccaataaagaatagataagagaaatgtaattaaatttacatgttttaaaagacctgagacttttttctttttattacaatatattgaattttatatgtcagaaatttttgtcttctatttctcttacatttagtagcactgaggaagaggtttgaaacaagaaaacaagtcaaaatgtctaacagggttttttttttagctttaacacttggattgcattaaattttccacgattaggagagtatttcaaacgtctatttcagaggcacatgaaacaatagcaaatgacatgtatgagcacgtgcaaggcactgtgctaacgggtctgtgaagttcacttacccatcacctcacccagcaaggtgacattatctttggaaattaccttggttaaaaggtgaaatataaaaacaaaagcaagaagcataaaaacccaagacactggatgatctcatttcagtattcatctttattaggaaacgtgtgatatcacggtctatggcttcgggaatatgagtgcaactcaagttagtccctacctactctgaaaccacaacgcttgcttcttagaaggatagaacagtgggggacgtgcagattcacgttatacatgctctgaggcctccaagttcactgtcttacataaaagtacatgacttcagcagaaagtacagagtgctatagaatataaggagaggccagttgtggtggctcacacctgtaatcccagcactttgggaggcagggcgggtggatcacctgaggtcaggagttggagaccagcctggccaacatggtgaaacctatctctactgagaaaaaaaaaaatagccgggtgtggtgccgcatatttgtaaccccagtactcgagaggctgagggaggacaactgcctgaacctgggagctggaggttgcagtgatcgagatggtgccactgcactccagcctggacgagaaagtgagactacatctcaaaaaacaaacaaacaaacaaacaaaaagaaatataaggaggaatacatgcacactttgtagaggttctaaggaagacttacaactgattttcacaggcaggtttaacagacaaccagaaagtacgcataaataatcacttgcgggtcgcaatcacagtttgcttgctgcgggaacacaggcagtctgtgtgtgtcttctcagcaccaccacctgcatcttgacccaccagcccagcatctggctactaggccacccacaattttctgtacctagctgacagccaaagaaaggtacaattgcctgccctcccaaaaaccaagaagaggcaacatgtcataagccttgcttatatccaaacctagtacatatgtatttcgcatccattatctaacttcactctcatatctaaataggagggttatcatctccatttacacaggaggaaactgagtctcagagaggttcagtaacttcctcaagacagaaaattcagtcatactgaccttacacctgttctcttaatcactgcaagatacatatcctacacacgattcatattttttaaagcatttaataccgaaatatatctgtatttttatatttttgttttctgaattttctagtttttaaggttattgtgtgtgtgtgtgtgtggtgtgtgtgtgtgtgtgtggttatatctggtctctcagtgaggtgaccaatcccagctccagctaattaggaaataacagacttctcagctcaaaaagaagagctgatctttaaaaagcttaaaatatttgctaatagaacatggcaacacatattgatttaagaattattgtttactctaaaagtcttacaaaaagatgagttctagacccagaaaacaaaatgacttaagaaaaaagaagaaccacattttaataaatatataaaacctcaggacacaaaatgaaggttgaatcatttcatattcaatatctatatttgaatggtagtgaaaaatataaaatttcccccggcgactcttctagaattaattttgtatccgaacattacagaatggaacatattcttttaacagcataattttaactacaatgcctgtttggcatttaaccaccaaactgctttgagtcctgagaaatttttaggtatctatccactatttactttaaacttcattttgtgggattctgtcctgctagtctttgtgaagcttgtgccaacgaacatgttttctataaacagcagtaaaatgtattcctattttctgcaaataaaaatgccatccatccttctggctcattctattcctatttgaactctccctctctctgtcaaccttctattaggtacaagatgaaatatgtatttatcatgaggtcacttaatcagtagatggtattttcatgatttgtttatggtattaaaactaaaatcaggatcattaaggttgctaacacctcacagaaagtggaaagcttttaattctctgtaagccactgaagaattgtgttctaagctgtgataagtacaaatcatccagattgcttaaacgattactgacttcgcagaagacaaatcttaggtgtaataaacaaagcagggttacttcttggtgagagactatggcaagattttcttctgatttagagagaaaaaaattgccactagtttttgatcagtaaggtgtttactgatagggtggcagaagaaattcttctactttttattttgggaacacatgagactaaaacaaaaaacaaacaaacaacaaacaaacaaaaactggcagggtgcggtggctcacgcctataatcctaacactttgggaggtcaaggcaggagattgcctgagctcaacaccagcctgggcaacatggcgaaaccccgtctctactaaaacacaaaaacttagctgggcgtggtggtgcatgcctgcaatcccagctacttgggaggctaggcttgcagtgagccgagatcatgccactgcactccagactgggtgacagagcaagacctgtctcaaaaaaaaataaaacctacttctcaatgaaatgactaacataacaggttgtgtcctggctaatacaggatttcttctggagccactaaaattatgaacagggtatacaaacgacaggaatattaagaaataaaaatgtaattctgtcaaatcattatcattaccttcaatacaggatgaatagaagcaaaagggacaatatggaagacacttaaatgtaagctcctaagccaaatactgacagcatcagcactaagtcagcagatgtaaattatgtgctactgtagcactcacctgcctcagggagttcagaggtcaactctggttcccaggtcccacctggggagactctactttacatctgttttttttgttacctcatccaacccagtgaatgcctttaaatcgaactttatggagtgttggtatgtcttctgtgtatgacaagatctaaacaaacattctcaagcttttctaaacttgtccttcccttgggatacattaatcactcctttcatccctcattgctaatctgatcttttgacatccagcgctggtacctgtgttggacttcggttagtgctaatcctgagtcccagctaactccaatgaagagtgaatggtgtaaggcattagagcaatgggtgcacctctcccttcctttgtggtcagcatatctcactgacagatggtttcctttgtcattttttccatgttaatgtttattatgaaattcaaggctgaagtccgtctatatgctacttaaaaatacacatcttagaaaaggcatataaaagtggaaataaaagataagttttaaccacttatcttaataactgatataacaagcacataaaaatcgacagagaaaatttgaaacatgattaataaacttgacttaatgatgacctaaaggctacaatactatagccaataacgcataaacacacttttcaagtgcatctttattatgccataaagcaagtatcatcaaactcaagagacagatattatacagaatatattctgacataagtggatttaacatgaaatcaagtaattagaaatgtaactagaaatgttaggaattcagcaatatatttctatataacaccgtttcaaataaattacaataaaattagaaacttttcaaataaaagaaaatgaaaacctataatattaaaatttcaggactgcaactaatgctgtttacaagtaaaattattccttcaacttttttttaaagacaggttaaaagtaaaggatctaaaaatataccttacaaagatagaaaatgagtagcatattaaattaaaatctgagaaaaatggaaattagaaaaaaggagaaatgattaaatagaaaactaatttgaaggagaaaaatcaacaaacccaaagcctcattataaaaaaaactgatgaaatcaataaacttcaaaaagactaatcaagaaaaaaagagaggaaattatcattatcatgaattaacagggaataacagaagagatactacaggcattaaaaagatatataataaacaccgttccaataaattaaaaattttgatgcaaaaggcaaatttctgaaaaatgatgggcaaagactgacataataaaaaacctaaatctgaataattctattattaatttaagaatatgaattcatgacacaaaaatttcccatagaaaaaacaaagatgggtccaagatgattttgcagaagttttatcaaattcttctagagaattggaatccagcattatctgatataaaaaccaaagaaaggaaaattataaaccaaactgtgttaagaacactaagtcgggcccggtgactcacacctgtaatcccagcactttgggaggccaaggagggcggatccaaggtcaggagtttgagaccagcctggccaacatggtgaaaccccgtctctactaaaatacaaaatttagctaggcgtggtcgcgggcacctgtaatcccagctacttgggaggctgggcaggagaaacacttgcaaccggaagctgagatcacgccactgcactccagcttgggtaaaaagcaaacaacaacaaaaaagaacactaaataacatactaaatacactgaatctaaaacataaaaaataattatactttataaactgtttacaccagtaatacaagcctgatttagatctgacaattaatcaatcaatgctatttatcaggttaacgaaacaggaagaaccacagatcatataaatagtggcaagaaaacaccagggcttgaacccaggagatgaaagttgcatgagccgaaatcatgccactgcactccagcctaggtgacagtgagactctgtcaaaaaagaaaaaaaaaaagaagccaatcccaagaggtgggatcatggcagacgagaggcaggactgattgcagctctgactcggactaacagagcagtgtgcagaggcttgcatgtgaactttactctggatcgacttcaagaacaaaccagcaatcccaagaggagccacagaccctttgaagaagtggactgctactgcaggacctaggagacaccccaaatactctgcagcaagacccaccaaggagagtctgagctcagacatgcctagccctgcccccacctgatggtccttccctcgcaccgtggtagtggaagacaaagggcatataatccagggagtcctagggtcctgtgcctgctagttcctcttcatgctaccacagctaatgctctctgcaaagtgccaccttccaaaggaggccaaccagtacaaaaatagagcattaaaccaaagctaagaaccgtcacagggtcattgcaccccccgaccacctccaccggaacaggtgctggtatccatggctgagagaccaaagagatctctgtgaggttcacatcacaggactctctgcagacaaccgccagtgccaacgggaaccaggcagactcactgggtggctagacccagaagagagacaataatcaccgcgttcggctcacaggaagccgtatccacaccaaaagggagagagtactatatcaagggaacccctgtgggacaaaagaatctgaacaacagccttcagctcaagaccttccctctgacaggcctacccaaatgagaaaaggaactagaaaacccactctgataatgtgacaaaataaggtctttaccagcctcacaaaatcacactagttcaccagcaatggatccaaactgagaagaatccctgatttacctgaaaaagaatttaggaggttagttattaagctaatcaggggggcccagagaaaggcaaagcacaatgcaaggaaatccaacaaataatacaagacataaaggggaaatagtcaaagaaacagatagcttaaaaaaaatcaaaaattcgagagacattggacaacttacagaaatgcaaaatgctctggaaagtctcagcaatagaactgaataagtagaagaagaagaagaaacaagtagtagaagaaagaactcaaagacaaggtcttctaattaacccatccaacaaatacaaatggaaaaagaataagaaaatatgaacaaaacctccaagaagtcgggattatgttaaacgaccaagcctaagaataatcagtgttcctgaggaagaagagaatctaaaagcttggaaaacatatttgggcaaataatcgaggaaaacttcttcagccttgctgagacctagacatccaaatacaagaagcacaaagaacacctgggaaattcattgaaaaaatcatcacctaggtgcactgtcatcaggttacccaaaggtaagaccaaagaaagaatctaagagctgtgagacagaagcaccaggtaacctataaaggaaaacctatcagattaacagagatttctcagcagaaaccctataagctagaagggattggggccctatcttcagcctcccaaacaaaacaatgatcagccaagaattttgcatccagtgaaactaagctccacatatgaagaaagatacagtttttttcaaacaaacaaatgctaagagaattcactactaccaaacaccactgtaagaaactgctaaaaggagctctaaatcttgaaacaaatcctggaaacgcacaaaacagaaactctttaaagcataaatcatacaggacctataaaacaaaaatacaagtaaaaagcaaaaacaaacaaaaaaaacacaaagtacacagacaacaaacagcgcgatgaaacaacagtacctcacatctcaacactaatattgaatgtaaattgcctaaatgctccactaaaagatacagaagtgcagaatggataaaaactcaccaaccaatctgctgccttctggaactcacctaacacataagcactcacagaaacttaaaggggtggaaaaaggatttcatgcaatcgacatgaaacacagcaggggcagctattcttatatcagacaaaacaaactttaaacaacagcagttaaaagagacaaagagggacattatctaacagtaaaaggccttgtccaaaggaaaatatcacagtcctaaacatatatgcacccaacactacagctctcaaatttataaacaattactaatagaattaagaaataagagagacagcaacacaataacagtgggggactcaatacttcactgacagcactagacagatcattaagacaaaaagtcaacaaagaaacatggatttaaactataccttggaacaaatggacttaacatacataaatagaacatttcatcaacaactgcagaatacacattctattcgacagtgcatggaactttttccaagatagacatatgattcaactccaaaaggaatcttcaaaaccatgcaaatacatggaaattaaataactgctcctgaatgagcattgggtcaaaaatgaaatcaagatggaaattaaaaaatatttaaactgaatgacaataatgacacaacctatcaaaacctctgggatacagcaaaggcagtctaagaggaaagttcatagccttaaacacctgcattgaaaaagctgaaagagcacaaacgacattccaaggtcacacctcaaggaactagagaaacaagaacaaaccaaacccaaaccagcagaagaaaggaaataactaagatcagagcagaactaaatgaaatgaaacaacaacacaaaacacaaaagataaataaaacaaaaagctggttttttgaaaaggtaaataaaattgtaggccattagcaagattaaccaagaaaagaagagagaaaaattaactgacaccactgaatacaaaagatcattcaaggctactatgaacatctttacacacataaactagaaaacctgaagagatggataaattcctggaaaaatacaaccctcctagcttaaatcaggaagaattgataccctgaacagaccaataacaagcagcaagactgaaatggtaatttaaaaattaccacaaaaaaaagtccaagaccagacagattcacagcagaattttaccagacattcaaagagaattggtaccaatcctttggacactattccataagacagagaaagaaggaaccctcccaattcattctataaagccagcatcaccataataccaaaacgaggaaaggacataaccaaaagaacactgcaaaccgatatccttgatgaacatagatgctaaaatccttaacaaaatattgttaactgaatccaacaacatatcaaaaagataagccaccatgatcaagtgggtttctaccagggatgtagagatggtttaacatatgcaagtcaataaatgtgatacaccacataacaaaattaaaaccaaaaaatcacataatcatctcaatagatgcagaaaaagcattcgaaaaatccagcatccctttaagattaaaactctcagcaaaatcggcatacaagagacatactcaatgtaataaaagccatctatgacaaacccacagccaacataatactgaatggggaaagttgaaagcatttcctcggagaactggaacaagacaaggatgcccactcttaccactctcttcaacatagtactggaagtcctggccagatcaatcagacaaaagaaagaaataaaggcatccaaattggtaaagaggaagtcaaactgtcgtttaccttggaaagcctaaagaccctccagaaagctcctagaactgataaaataattgagcaaagtttccagatataagattatgtacacaaatcagtagctcttctatacgccaacaggaaccaagtagagaatcaaatcagaactaaaccccttttacaatagctgcaaaaattaaaataaaataaaatacttaggaaatacctaaccaaggaatcaaaagacctctacaaggaaaactacaaaacactgctggaagaatcatagacaacacaaataaatggaaatacatctcatgctcatggatggatagaatcatattgtgaaaatgaccatactgccaaaagcaatctacaaattcaatgcaattcccatcaaataccaccatcattctgcacagaattaaaaaaaaaaattctaaaattcacatggaaccaaaaagagcccgcagagccaaagcaagactaatcaaacagaacaaatctggaggcatcaactacttgatttcaaactgtactataaggccatagtcaccaaaacagcatggtactggttaaaaataggcacacagaccaatggaacagaatagagaacccaaatacttaaccgccaatgatatttgacaaagcaaacaaaatcataaagtggggaaaggacacccttttcaacaaaggtgctgggataactggctagccacatgtaggagaatgaaactggatccttatctctgacttatacaaaaatcaactcaagatggatcagagacttaaatctaagacctggaaactataaaattctagaagataacattggaaaaacccttctagacattggtttaggcaaggatttatgactaagaacccaaaagcaaatgcaataaaaacaaagataaatagtagggacttaataaactaaggagcttttgcaccgcaaaaggcacattcagcagagtgaagagacaacacacgagtgggagtaaatcttcacaatctatacacatttgacaaaggagtaatatccagagtcacaatgaattagaacaaatcagtaagaaaaaaacaatctcatcagaaagtggacttaggcatgaagagaaaattctggaaagaagatatacaatgctcactatcactaatgactagggaatgcaaatcaaaaacacaatgtgataccaccttactcctgcaagaatggccataataaaaaatcagaaaacagtagatgttggcatggatgcagtgatcagggaactcttctacactctggtgggaatgtaaactagtacagtcgctatggaaaatagtgtggaaattccttaaagactaaaagtagatctaccatttgatccagcaatcccactactggctatctacccagaggaaataaatcattatttggaaaagatacttgcacacacatgtttatagcagcacgattcaaattgcaaaatcatggaaccaacccaaatgcccatcaatcaatgagtggataaagaaacgtgagattatctatctatctatctatctatctatctatctatctatctatctatctatcgatggaatactcctcaaccatagaaaggaatgaactgacagcatttgcagtgacctggagagactggagactattattctgagtgaagtaactcaggaatggaaaaccaaacattgtagttctcactgatacatgggagctaagctatgaggatgcaaaggcataagaatgatacaaggactttgggggtttagggggaagagtgggaggagggcgagggataaaacactacaaattggtgcagtgtacactgcttgggtgatgggtgcaccaaaatctctcaaatcaccactaagagcttagtcatgtaaccaaataccacctgtacctcagtaacttatggaaaactaacaataaataaataagacactgaaatagatacagatttttttaaacagaacacaaaaatcaataccataaaggaaaagattgataagtatgtttatgaaaacacaatattacagggctaaaagataagcattagtacagaaggaaggtatctgcaattcagaatacataaagaattctacaatcagtaagaaaaacaaaacaaaaacccagagtactcaatagaaaaattgttaagacactaaataggtgcttacccaaatgatattcaattggtcaataaacataaaaagatgaaaagataagagcaaaacaaatgaaaattctataaacaaaaattgaatatcaaaaaaacaacattagccaggtacagtggctcatgcctataatcccagcactgaggtttgcttgaggagggagaggattgcttgagcctaggagtttgagaccagccaggacaacacagcgagatcccatcctatgaaagaaaaaaaaaaacatattcaatgggctggcagcagattgggataagagaaaaatcaatgaccctaaagacagagcaatacaaattatccaaatgaaagacaaaaataaaaagactgaaagactggaatgcaacaccctagatcttggagctacaccaaacagtctaacaactatcattttcagtcccagaagttaaggagttaaaagagaaagaaaagaaaagtgtataaaacataaagtactcataattttccaaaattaaataaaaataccaacccatatattgagctcattaatcccaagaaggatactaaacacatatagtcaaacagcaaaaactcaaagagaaattgttttaaaaagcagccatgaagagtcataatgtatagtgcaacaagcataatatgatggtttctcatcagaaacaatgaagggagaagacaatgatgtgatatatgtacagtccaaaaaaaggaaaaaaaaagaaaactgtcaacctagaatcttctatctgttgaaaagacattaaaaacaaagttgaaataaagacatgctcagatgggcaaaagctaggagaaggtcctagcagaccagcctgaaaggaagttcttcaggcttaaggaaaatgataccagatggaactcagacttcagaaagaaataaagagcactggaaaggacaaatatgtgaataaatataaacacaattttctataatatgtatgcacatacatgcatacatatgtataaatttctttaaagaccattggttatttaaagcaaaatggacccaatatatcatgaagtttatagcatatgagaagtaaacaatatgacaacataagcccaaagaatagcagaaataaattatataatagaagattattctattgtttgcaaatttggtaggaaattatttgaaaatagattgcaataacttaaatggatatgtaaactctagagcaaccactaaaaacaataacataaagagtagagtaaaaatgtgatagaaaaaataaaataagaacatatattctattcactgcaaagaaggaaagaacatatgagactaacagaagacaaataccaagatggtagacttaaaaccaaccgttctataattacattaaatgtacatggatgaaactccacataaaatgacagagaatttcactgagcatttaaaaagccagacctaattagatgctgcttacaacaaagactgtaaatacgagagagagagagataccaagcaaaaacaccccactcttagtaaatgacagaacagtggcaaaaattcagtaaagatactgaagatccagatattataagccaacttgacctgtcattttagaactctatactccacagctacagaatatacattctttttttttttttttttttttttcaaatgcacaggggaccgttaccaaagtaaagtaaatactgggccattaaagaagtccaatacatttcaaaggttagaaatattacagaatatgttatcgaattacaacaaggctattagaaatcagtagcagtaaggttttttaaaaaaaaaaaatccctaaatctttagaaataagttatatactccataataactcactactaaaatattacttcagaaagtcaactcatggccaggtacagtggctcacgcctataatcccagcacttttagaggctgaggtgggaggccacttgaggccaggagtttcagaccaacctgggcaacatggtgaaactccatctctactaaaatacaaaaattagctgggtgtggtgatgtgcgcctgtaatcccagctattcaacagctgaggcacaagaatcgcttgaacctgggaggtggaggttgcagtgagccgagattgcacactgcactccagcctgggcgacagagtgagatactgtctaaaaaaaaaaaaaaaaaagcaactcataaatattctgaactgtagataatgaaaacacaacatatcaaaatcattggagcagctaagcaatacttagaggaagtataactttaaatgcatatattatgaaacaaatgaaaccaacagattaatgttcaatcttaaaaagctaaagaaaaagataaattaaatcaattaacttaaaaaatataagaaattaatgaaatagaaaatctaccaactacagagaaaattcaaaatcaaacatgaattcactggaaaaaaaatcaaaattgataaactccaagctaaacgattgacagaaacaaattatcagtgtcaggaataaaagaagaaatttcactatagattaaaagacattaaatggacaaatgtgagattatgaacagtttcatgcaaaaagttctccaggaagacgaaataagcaaatgtattaaaaaccacaatttgcaaaacaggaaatattcacaatgcctaatattaaacatatacaaatacacttatgtatattaaaaactaaaaaatcaacagatttttaaaaacacgttttaaaaagctggcaggagatctgaaccagtatttcagaaataagacacttgaatggccaattagcctgtatggaaaaagctcaatattaatcatcaaggaatgcaaatggatcatctatactctactaaaaagaataaaaacaaaaagattgatcatataaatgttggcgaggatgtggagcaactagaatgctcatatattgccactgggtgtgtaaatagtacaaccattataaaaatccttgtcatagtttgatttttggtttttaaagtgaatttacgaacccagcaattccactcctatgcattttatctgagatgaatgaaaacatatgagtgtacccataaacacttctataagaacattcattgctaaaaactggcaacaattcaatacccatcaatcagagagtagacaaataaatgttgatgtcatcatacaatgaaatatcatcagaaaaagaaaacaaagaaatgaaccactgaaacatacacagaactcaaaaacatgggaacaaaagaatccagccacagaaaaattattggttccatttatacgtagttcaagaacggaaaactaattgatgttgacagaaatctggaagaggtgtagaggtgtgaaaattgactcagaggagcaaaggagacttcctgaggagatggaaatgctctacatcttgttttagaggtggatattggaatgtacacaattagtaaaattcaacctaaaaaaaactgtcgattttatgtatataaactatacctcaataaaaatagatagggtaaaaaaaatatgacactagaattcattcccatccctttggccatgttcaggcagaggttgggcagtgtatcaatacacaacctaacgctaagagatgatctcctcaggtgcattgagggtgggaaagggcaaatgtgagaataatggtaaccagcccatgtgccctagaacaaaaatggctcctgatccatgtttgatactgtcccataggtggctggccctttgctgcgatgcacaagcggcactatcggcttcatgatcaacgcaaatgagagagaacactaagtcaatgaacccagggaaagggctgaaagaaaaaagtgagtcacaaaactcacaagtagaacagattacacttacccatgccccacatcagaggaagtgatacatccatatagaaaatagtgactgcaagattttaataaaactcaggcaattctccagtccaaacctttttttgttcatcttatcaagaaaactcagtaggtatacagaaaaaatgaatgtaatcaatcaagaatagcatagagagaatttaaaggtcctcaattaagaaacatttggccattttcctctcctgggtaatagctgtccattttatcattactaaggagcaaaatgacaagaagagaaagcaccacgaatggccactattgttttgcaatggacatctccaatatgccagaatggaaagttctatggtctgctgaataccaccagacttgataaaatgagactcttaatttttttctttaggtcttaattagcttcttgttaaactacaaacatttcattggaacacacatgctgggaaaaattggaacactggttgccagcctgggaagcctggagggtccccagtgattaactgtcaccacactaatggtgacagtactgctttctacatggctatcacactggaaaaaacccaaccattgcatctttcattaaaaaagaaaaggtaaagaattgttagagtgggcctgtgtgaatcctatcatcctgatctcagaaatccaggggtcagagttggcaaatatttccagtaactcatgtcatcaactgccctgtctattaacaaggaatccactttaatgtggcagttggcatgaatcattatctctagggctggcattttcacagatagtccatccttgtaaatgcagtgactaaaactcttttgttgactttgaaagcatgagacgccgtgattcagttaaaatggatgagtttacttttgaaagactcagtaaaacagagattttcaaatgacggcaaggcgacctaactaacgatctcttttgtccaatggggatttgaggtaggagttgggggaaggggtgaacaaacctcagaaatctcaaaatgacaaagtcattgtcagtgtgctttctacacactttccctgacatctctacacaatgaaatgtaagggtcagggtactgagacaagtcaaggcagttccactcttttgcttctataaaagcgagtgacccacctattatactcaagtcttaggatggctttgttctccacatccagatgcagcagcttttctcctgcccctcatcctgccctcccacccccctagggaagaaatgactgaggacacctcttcacattttctttttcttgggcatttcacttcataaagctgcagtcaatgtgttttgttgtgggaggagggactggcacattcagtggtggtctccactgctgcctgcattggtggccaagtagcctcaggactagtcctttgtgttccatgaaaggatatgaaaagtcagttattaagctcagtcaagctgctgatttttttttttttttagatgaggggtgtgtagggaagaaggttttgcaattccgtgtgcctcaatatattacagtattttgctgagtgcagctgtgtgaagttagcacactcggagcactcccaaatttaaacagaaaaaattaaaatgcctaaatcaacctctgcatcttatcttcatttttcatttgtttttttctagtaggaagacttcttagggcaaagattttagctagcagaagtctagataactcagactctacactcaatgttatcagggccaaggaagtttcagcaatattatgaaaattacgttattatgagatatttagtgctactggtttattctgaaaacaactgattttgatactgtggttccagaagagaaaatagccttaaagccttcagggataataaacctaatatctggaatacaaactcatgtcctaatactatgggtctggtaactgtctgacaattaccttaatgcagcataatgtcattgtcaggctattctcccacttaaaaatatacgtagtatttaaaaagtaccttttatttagtgagcttagtgttatgctaagaatgttattgaaatgacttcattttatcctcacaataaccctcatggataggtagaattttctccattttacagagacgtagcatgtggctttgtgaggaaagagaggtaagcggtagagctaggagtcaaacttaagaaggatgattccaagcctctcccattcatcctacactacacttgaaattttttattattattttttggttcttttgagtctgggtcggctctgttgctcaggctggagtgcagtagcacaactgtggttcactgcaacctcgaactctgggctcaagtgatcttccggactcagcctccagagtagctgggactacaggcacgcccactacacctagctaattgttttatttttttgtagagacagggtctcaccataatgctaggctggtctcaaactcctgggttcaagagttctttccaggtcggcctcccaaattgctggactacaaccataagacaccatctctggcaaagtcttttattatttttatagagaaggggtctcactatgtcgcccaggctggttttgaactcctgaccttgagcaatcctctcactcggcctcccaaagttctgggattacaggcatggaccaccacacctggcccctacattatctttgaagttatttacttacaagtgatatctagtcacaccttttttttttttagatcgatctcgccctgtctggagtgcaatggcacaatcttggttcactgcaaccactgtctcctgattcaagcaattctccctgcctcagccccccaagtagctggtattacaagggcccgccacacgcccagctaatttttgtatttttagtagagatggggtttcaccatgttggccaggcggtctcaaactcctgacctcaagtgatccacccaccttggcctcccaaagtgctgggatacaggtgtgaactaccacactggcccagtcacatctaatcttattcacagtagcacactaacactcacacctttaaaacctgaagctgggccgggcgcagtggctcacgcctgtaatccagcactttgggaggctgaggtgggtggatcacgaggtcaggagttcgagaccagccggccaatacggtgaaaccctgtctctactaaaaatacaaaaattagcctggcgtggtagcagcacctgtagtcccagctacttgggaggctgaggcaggagaatggcatgaacctgggagcagtgcttgcagtgagctgagatcacgccactgcactccagcctgggcgacagagcgagctccgtctcaaaaacaaaaaaacagaaaacaaaaacaaaacctgaagcttttcctagagaccaagagcacttgcaaagggaattttcatggctctgatatcctgaggtagaatcacccaaacagaccacataaatgatgctggcttccttttaattttggaattgagaacagctccattttgcaagcaactataatttgacaggattggcaagatatctgacagctttaacagttgtctagtaaagcattcacggaggtgtgcaaacctaactggccttctactgggacacagcctgtgaatgacacatgcctgaggggatcgactatcctgcagtgtgggccccctattcagagcaagggctttcattagccacacaaggcattctgacctggatgtcctaaagagaaactttccaaaccagtatcctttcttgttttcctgatgctggtacaaccccatctttctgacagctcccattcctctccatatccttccacccaaatgtctaaactctacattcctgtgcttagaaacaagccttcttgtgatctggcccctctgcatctctccatctgatctcctctaatgcttgtctcaaacctcctgatgcagctattccacactgcagtgtccctgtagatatcctaactcctgcacttcctgccatatgtgcctccttctcccctacatggctcaggaataaccagaagccttaccagcttccccaagcagggcaacagacaaagccctttgctgctgtgatgtaacttgtatttggccagcatggaaataagggatacacaatacaaaatccttaaagttggtttgaggtttttttggtttgggtttttttgttgttgttgttgagatggagtctctctctctgcccaggctggagtgcagtggtatgatcttgactcactgcaacctccacctcccatgtcaagcaattctttcagcctcccaagtagctgggattacaggtgtgcaccaccactcccgctaatttttgggtttttagtaaagatggggcttcgccacattggtcaggctagtctggactcttgacctcaagtgatctgccctcctcagcctcccaaagtgctgagattacaggcagaaaaaacatgtccgggtctgatgttggagattttcatggtctttcttatgtatatatccacacataatacatcatctatgaattttaagacacatgtgaagctattagcacacaatctattttcctccaattctcatctccaccccatttattctcatccacacataatttgttaaaattttttaaagtgaagatttctttcccaaggcttcgacttgtcaaacaaatctttctttggcattcctgtttcatcagtttatatgataagtattgccatcacaaaattacagtaacaggataagtagcatgaatacgttgaggaagaatcacaactgactctgaggaagcataataggccaaggattggggcagagaatggggtccgccagaggcagcccagtggcaggcatgtctacaggtggagtggagggtgctgtgaatccagaaggtggtgaaaacaaacaagtggatagaacacagtcctcaacctttttggcaccagggactggtttcgcggaggacaatttttcatggatggcgatggaggtagtttcaggatgattcaagcccattacatttattgtgtacttatttctattattatgtggtaatatataatgaaataattatacaactcaccataatgtaaatcagtgggatccctgagcttgttttcctgcaactagatggtcccatctgggggtgatggagacaatgacagatgatcaggcattagattctcataaggtagatgcaagctagatcctagcatgcacatttcacaatgttcacagggttcgtgctcctatgagaatctaatgccgcgacgatctgacaggaggcagaggtcaggcggtaacgtgagtgatggggagcaagctttgtttcttgtccaccgctcacctcctgctgtgtggccaggttcctaacaggccacacagacagtactggtctgtggcccaggggttggggaccactggattagtcaacaagagtagttgtcacttcttcatcctccctagagcactaattagcaagaaaattaaagaataaatttaacattacccctggaggttcaaggacaagttagaagttaataccttaactttcagtttcactcaatgtgcataaagctccattagtgctgctattggtttcactaactccatccacaattctccgaaaacagaaaacctcatacaacaaagccaaacctgaaacacaatcaggtttccaccggcagaagtatggtgactaagcctagtggcctcagcactgctggacactgaattgcaatgggtaagtgaagagttccaaagccaagggaagcctcccaacagcatagcttggaatggatgatctgctgtccaaccccaagatgctgatgcagatgatgatgataacagcaagatagagagacatccactgccacaaagacctttttcaggtgaccgcaaagagcagggagaactctaaaacgacccttttcaggaagcaaccaggcacaactcagaggacaaccaccacgtgtgccagggtaagccggttaccggcctcgctgattttcagtaaagcccatcaactgggaataagtctctaaaggagagagatgcatgtgcacacatcacacatccttgtttaaccttacaatacaagatgagctgccacttagctgctcaaagaccttagaggggttcagctctctataggtcaactatgaattccatacacaagtttacaaggctggctaaaatgtagactccgactgcctagagccctacataaatcatctattacagccacaaatgttattttcctcaatttacagttaagatgggcatcaagctactttaattggaagattacatatcaacggtttaattgcttttgaggggtatgtgcgtgtgtgtgcgtatatatgtgcgcgtatatatatatacatatatcgcacacacacgtatattttaaccaaaaagtaactaaggcaggtctcaatcgattagagtttatttagccacagatgagaatgtggcaggggcatctgtgatgcttttttctagaggggttttgtaaacttcagtatttaaagaagagcaagcagaagggaaaaaaaaataaaaaaagaaaaagggagggagggtagacagtgagatggtcaccttcttgtgagaccctgattagcccagtatatctacattttacatgtgaaaagagggagtagaagaaaatgtggattgtgcatgtctcacactcagtcgatctgtattttatattaagataaaggagggagtacaggaaataggcagtgacacaggatagtagggttgtgaaatcatggctatctgtttgggaacaaaagaagatggtactggtgactctgttcccaagcttaactttccctttggcatagggagtctggacctgagattctatttctctttcacacatgaaataaggcacccagactttgttgtctaaatcaaatacatggggctgtgggggagttcagatcctttacagacagtttttaagagtatcaggctgggcgtggtggctcatgcctgtaatcccagcacattgggaggctgatatgggggaccacctgaggtcaggagttcaagaccagcctggccaacatggtgaaaccccatctcactaaaaataaaaaaattagccaggcatagtggcagtcacctgtaatcccagctacccggaggctgaggcaggacaatcacttggaacagggaggcagaagctacagtgagccgagatgcaccattgcactccagcttcggtgacaagagtgaaactcctctcaaaaaaacaaaacaaacaaaactagagtattcaaagtataaattgtgacagaaacattccatttaattaaacctgaggtgtttttatttcacaaaaatatttatgctgtgtactgtatatgtttatagtattaaatttaactctttagtatacttatgtaactttctataaagaatgcacttccagtgaatatattagtacaatgtacaatcaccagttgttacaaagttttaatgtaaagttattttttacagtaactatagaaatgtgcctttgcttttgccacagttaattgtttttccttgtttaacagtattaccacagagctatatatatcacaacctgaacaaaggtgcatcagaatactgagataaagatataggctgggcatggtggctcactcctgtaatcccagcactttgggaggtgaggtgagtggatcacctgaggtcaggagttcgagaccagcctggccaacatggtgaaccctgtatctaccaaatatctaccaaaaaataaaattagccaggcgtggtagtacacactgttgtcccagccactgtggaggagtctgagatgggagaattgcttgaagctgggaggcaagtttgcagcgagcagagatcacaccactgcactccagcctgggcgacagagcgagacccatctcaaaaaaaagaaagaaagaaaagaaaatctagtgtcctctctctcctgagcttcagatgctcatatctaaaaaacagtcacagtttctctggtacctgggtttgagaccaggttatcataaaaccaggaataaagttatttaaatgagtagtctccacagctgggaatcttctgaccactcaaaatgtctaaaagaattttggggaaaggaaactaagtttgtctaccttaattctaaagacacagggggtaagaaaaaaaggctagtaccacaatttctgaaaggttttatctaaaatatcataggctcatattaaatgagcattatatgactttctatagggagatggtgggcaccagatgacaaataatctattattagagacttagtgatagatatggtttggtgtgtccccacccaaatctcatcttgaactgtatgtagctcccataatccctacatgtttgggagggacccagggggaggtaactgaatcatggggttgggtttttcccgtggtattccgtgatagtgaataagtcacatgagatctgatgattttataaacagcagttcccttgaaatgttctcttgcctgccgccatgtaagacatgcctttgctcctccttcaccttccaccagtgaggcctccccagccacatggaactgtgagtccgttaaatctattttctttttttttttttattttattttgagacagagtgtgtcgtccaggctggagtgcagtggtgcaattttgctcactacaacccaagttcaagtgattctcctgcctcagcctcccaggtagctgggacacaggtaccctgctcatgcttggcatctctctgcctgaggaaatgccactttgttccctctggagacctggcacctgttcctcctccatacaatgtgcccctccctcaacctgccccctatcttctttgcacggctgtttccttatttttcaaactcaacgtcacctcctccttgacatgctggtccagtcattagcaaacactttcctttgctgaacacactagacctatactaattagattatttatgtttattggtctgtttattgtcgacctcctgcactagaatgccaatcctagaagctgatacccagttaactgctccatgctctagatcctggaaaagtacttggctacaggaggtgtccaagaaatactgattgactcaacgactatgagtgaagtttaaatgaatggggcaagtgaaatatgctcagagcagtgctcagcctggtgttatatgatcccttcttttacaggacctagagattgttttattacagaatggagtggtaaagaaaagcatcactatgcgaaagagagactttcgctggtccttaaaggatgaagaattagaagggtacatttgaggtgagccacaggtgtgcaaacacacacacacacacacacacacacacacaggtgccaaagtctggcatgcacatagtttctttccaaaagttaaagagagattagatttaaggaccaaaaatttgaattttgctctttgtatgtcctttgtagccacaaatcaaaggcaagcaaagaaaacaaatctatttagatatttattctaacatatggctgcactgtgagaagagggtttagtcctcactccagcattaggtgttgcatggccagtcttggaggaagccataattgaactaaagtgaaagagctaggattggaaatttgtctcgtgctgagaccttaaccattctctctacagtatcccttctattgtaagtcttatcacacagcatggtaactgctttctatctgtcctcccaatagagtaaactcatagaagaagggaattcaatttcacttagccccatatctcaagcccaacatggggcctagtacacccaagatactcaataaatgcttctcaggtggataagataaagcctctatcttttccacctctgcatactcagcatatagtaggagctcaataaaagctggtgggaaaaaaaaataaaaaggaagacatgtaataagaatgacacgtattggcaggcgtgatggcgcacgcctgtaatcccagcacttttggaggccgagacgggcagatccttgaggtcaggagttccagaccagtctggccaacatcgtgaaaccccatctctactaaaatacaaaaattagacaggcgtggtggtgggtgcctgtaatctcagctactcgggaggcgaggcaggagaattgcttgaacccaggaggcggaggttgcagtgagccaagatcgccccctgcactccagcctgggtgatagagcaagactctgtctcaaaaaaaaaaaaaaaaaatggatatattgaaaagaattacaaattattttcacaagtcacatatttgtaatagaaatgtttccttttgggagaaactttgagatattcccagatacatccagttgtaaatatagtcacaaacaccatatctccccatcaaatactacaaataaatttgcactattaaaattgttgaaactactgattccaaatcattaatattaaatttctaattaaaatgctaataagatattataatacaaatattacaggtagggtacctattaatccaattattgttttaagaaaatggaaaagagattcatgatgctggcattggtgctgatattaggaagtaatcaagcacttctggccagcgcagtgcctcatgtctgtaatcccagcactttgggaggctgaggcagcaggatcattggggtcagaaattagagaccagcctgggcaaaatggtgaaaccccatctctactaaaatacaaaacttagctggccatggtggtgcacacttgtagtcccagctactcgggaggctaggtatgagaattgcttgagcccgggaggtggaggctgcagtgagctgagactgcgccatgcactccagcctgggcttcagagcaagaccctgtttcagaaaaaaaaaaagaaagaaaaaaaaaaaaaaccacagaaaaaaaggaagtaatcaagcactttaaaatgtgaatgttgatatcatctctatgtttttgtttgttgatttacgcaaacatactatgttttgaatgccaattcctattcaaagaacataagttccagatgaagatctttatgctatttgtatttcaatttttatgaaaacaagatattcacttttaacctgtgaagagccattctatgttcataaatgcttggctttagaaatattgtagatgttcaaagctgttacaagttttgaaaaagcagacagaaaaacatgtttgaacaactctttataagccagatgtgcactgccagccttggctaaatatctgattagcccatggcaaccttgaggtaacttgcagactgttcatttgtattctatagttatttatttccagtgatatatttatatcttatgatatattcaaaaacttcccttaatctggctttccttccaaaaggcctaatcaaaaacctcacctttctttattcactactgtgcacacctgagccaatctgagttccaaagtgacacattaccctcgctgcccctctgggttcttcccttaatacaggacagcaaatgacacccacttttaagttaccagtgtcactgttccatctgcaatgagtgccaacatctaactatataaaaacaaatgaaaactcacaaatacaatattttattgaagtccaaaaatcaaagttaggttaattgcctctatctggccagcaatctggtcacatgtaaaccagaatttccttatctcagcgatttcatcgggagagtaataaatctgtgcatggtttcagacttgcttctacagagcctacattctagacaccaagccacagcagagggttctcctctcagatctacccctccagtctttggcaaactcaattggaaacattcagttctgacccaatggtccacagttccagactcctacttacaaaaccaataaaacgtcaccatcatacagaaaacgtaatcaaacatgaatgctctggattaaaaaggtcacatgggccaggtgcagtggctcatgcctgtaatcccaccactttgggaggccgaggtgggtggtcacctgaggttaggagttcgagaccagcctgagcaacatggcaaaaccctgtctctacaaaaatacaaaaattagcttagagtggtggtggtcatctgtaatcacagctactcaggagctgaggcatgaaaatcgtttgaacctggggggcaaaggttgcagtgagctgagatcgcccattgcactccagcctgggtaacagagtgagaccatctcaaaaaaaaaaaaagaaagtacatggataaatgcaactacattatttatttctatagctatttgattttaaatctcagcttagtaagaataacaactcgacagtcttagtctgaatgttctggtaagtgtagaatttcactccctttttatgaagatacctaacttttctgtggattttaatcttcattctatttgtactatacatcctgccaaagttctttctggctcaagaataccatccgtagttggttctgagatacgtagttcccctgtcgatcagtcagctagataacaccaagggtaacatcttgacaagaaatttccagtttttttaaactcaattgtttcagtcaatctcagctgctgggttgagaggcctcactttctgtgagtttctctgggcttaggaggaactgctagtcactgtgattatacctattgaacctaacgagagccatcaaaacccagggcccgtgatgtcagcagcatgttattacccatagaacctgatgacagccacaaaacccagggccccagtgtccgaagcatgtttgctaaggatgttaaacacaaagtcatccaggaaatttcctactatctgaattttgaaggggctaaataaaccctgtagaagaattgatgcggtagacgaggcctaaaattcaactcatttcagatgcccatgcaatggagaaggctactatccacacagataacatcaggcttctgtatggctcaccccactggctctagaaataaattttaaaaatgtatcacagaactgagcaaagtagacaaaatttcctttgcaaaacaaaacacctccctccttcccccctaaaagacaacgactttaagcaaagccatgaggtgaacaaagctaactgtcattttgaccttgcttgctttaattcaggagactacttagaaatgtaccgagcaacccccttcattcggctcagcagcagagctaataggcttctaattaatttccagaagattgctgttataactaacaggtttaaacatttggttgattggggaaaatgaattgaatataatgtatttgatttggaaaattgttttcattctatgtgcttaccataatagtgtttattttaagtttacatgattccattagagtcccagaacagcactgggctgttttcatccttacagagaggcctaggcaacttaaaaaaaaaaaaaaatttacatttagatttttgttggcctttatttgagggcaggttaaatgatttttttgggtgggtggctttaataaaaattttcacttcctaatatagcaacaggcccaatacttcaaaatgatcctggcgatacctcagtcaaaagcccactcatcgaatgcaaatcccgggagaaaggctcggcacacaaagtaagatgaaccagttactgcattgtttaccactttcacttgattcttcctgacaaccatttaaacaatgaatgttgggaaatgtccctcaagaatcaacaacaatggcagggaccagagcttttatatttagctaatactatttttaaaagagaaaatatttcttcctgaagggattatgggaagccttattaaagacacctgcaaacaaacaagtgacaatagatctttatcataattgataactaagttatcctttagataaaactctttcttggagacaataacattaggatttaaccttcgctgtagattcaagaaatcagctattggggccagtaggattccacaacattaagtttaccaagattatgtgagtggataatacaaacgcccttgtctctctggttaaatagaagtacaacgagactagaattttccctcctatgcttctaagaaatgttttatattgacatcaagtagcatccatccctctccctccatagtgagacaaagcacataagggatactaattacgaccgctcactctgctaagcacatagtggccagccagcttcggaaactcaacctttgcctagcttcctgttgcaaagaaacagaaatttcacaaaatcttcttgaagtaattaacaatccctgtcaaaacgtgtacagacaataactgcattctatgtaaacggggcaactgttttagtgatggcttctgagggataaataataagctaaacccaggagggcacattttaaaaatgtttgcaaaagaaaaaaaaaaatcagagtccttgtttgcagtaaaaataatccacctgtgagtctcagcttacttcacctccataaaagtggatgccttcgcccatgggctatactgtttgcagtcacatgctcatttgctgccttctgtgtgacaaacaggaattcctataagcatttcaagcctatgactgatttttcttacaagctaattttccaaattaagtaattttgcttcctttataactgtggctccagaggagattaaagcatctgagcattgagaaaaaagcaggggtagggggatcacaggatcaagccaaattgcagaccccaactgtagtatttctatttaatggctttaaattcagctaatgattacactattctaagttggcacttagaaaaagtcacagaggttcaaatttcataaagtgttagcacagcagctgagattttggaatatgtatagcttttaatagatgcatttccaaaataaaccttgggaaaaaaaaagtgccccagcttgaaccactgacaagtagacaaaattaaacaatggaaaaaataaaataaaaccaaaccacatgagcaacagtactgaataaggagatgagagtgacccaatattattttttagagcctcaagttcacaaacaaaagaaaagttttacagaagtatttctgtaggattgttggtttttttttttttaaagacagcttaagacttagagcaacaacgtgtgaaaacaaaaaagacattttctgagttgactttgatcctgtactcaaattgcttagatatccttgcctttaaaggctttgtatccgcaataactgctctctattgtccttttaataaagtattattttcaccttattattactaatcttttctttgtaagtaaccacactggttctatccaaaaaaaaaaaaaaagtgcctaagtatttgccctttgtggtaa

SEQ ID NO: 5059 - DNA, 52705 bp, Homo sapiens
tttggattcctggcacgaaattgcctggcttccttgagtttgacttggatccctgtgtttcccagctcttcagtgtccatccagcagaaactaacagggcgcctgctgtacccaggcatctgctggggctggggacgcatagagaggacagggtccctccttcacagctcataggctttcaggggcaattccagcacatagtggcggtgttctgaaggaggaggctctgggagcttatgagccccacaatcttcctttgaatgtgagggaaggcttcctggaggaggtggcatctagctgaaatgagtgggactttgccaggtgtgtggggaaggtggtccaagaaaggggaacgcatgttcaaaggcccagaggcaggaggcagtaaagggccctttccatcctggcagctgcagccttaccccactggaccctttcagggttcttcatgagactgggttttttttagagaagggtctcactctgtcagccaggctggagtgcagtggtgtgatcacagttcattgcagctcaatttcctgagctcaagcgatcctcccacctcagcctctcaagtagctgggaccacagtatgcaccaccacactaggcttttttttttttttttttttttcttgagacggagtctcctctgtcacccaggctggagtgcagtgacgcaatctcgactcactgcaagctccgcctccaggttcacgccattctcctgcctcagcctcccgagtagctgggactacaggcgcccgcaccatgcccagctaattttttgtatttttagtagagacggggtttcaccgtgttagccagatgatcttgatcgcctgacctcgtgatccacctgcctcagcctcccaaagtgctgggatacaggtatgagccacggcacccggcctttgttttttctttcctttttttttttttttaatttttagtagagacaaggtctcaccatgtcacccaggctgatcgcaaactcctgggctaagcaattctcccaccttggcttcccaaagtatcaggattataggtgtgagccaccacaccagctgacattgggcatttatggtacaaaacctccctcaggtacaacggctccaaaaggccagtttccagcattgaattcatcgtggacttacccatgtgtggttctggcaccctgccggggctggaggcctgttcttggccttggtcctttagaataggagtaaatttggcaacaaggaggacacccaggatacattgttaagttaaaaaaaaagagattctaaaatagaatgttgtatggttctatttttgttaaaagttatgttctctaagtctttttaaaaagtttgaacgtcacagccaagaagggtctaaagagacatgacagctcagtggtgtgtgagtcctggatggatcctggaacagaaaatggatatcaggggaaaaactgaggaaatctggctcatatttgttgtgtgtagataccagcattatccaggttttaaaaaggagaaaatcctggccgggtgggtggctcacgccagtaatcccaacactttgagaggccaaggtgggaggatggcttgagccagtagtttgagaccagcctgggcaacatagcgagaccccttctctacaaaaaaaaatacaaaaataggctagacatggtgttgcccacctgtagtcccagctacttgagaggctgagtgggaggatcacttgagcctgggaggttgaggctgcagtgagccgtgattgtgccactcacttcagcctgggcaacacagtgagacctcatctctaaaagaagaagaaaaaaaaaggaatcctgcaatgtgtgacaacatgaataaactctgaggaaataatgctaagtgaagtaaccagggacaggacaaataccgcatgattccacctatagaaggaatctgaaatagtcaaatcagcagaagcagagaggagaagggtggttgtcaggggctggggaataggggaaacggcttgctgatcgttgctgtgtaaagtttgagtcctgccagccgaatacatcctagagatggctgtacagcagagcgccgtcagtgttggacacttacaatctgttaaaagggtaggaccctattaagtgttctcgccatataataaaaagtgtaaacactaaggaaatcaatggacttttagttaataatatctcagtctggttcgttaattgtaataaatgtaccatgctaacataaatattaataatggaggaaacccggtgggtgtgaggtatatgggagttttctggactcttgcagtttttcagcaatctaaaactgttccaaaataaagtttagacagacaacaccatgtttctttagagagtgggattacatgtgagtcttccccctttggcttatctgtgttttctagttttctacagtaaacatgtattatttgtataatatattaacgacagaacagaacattactagaccatgctgactgcaccagccctggtggcagagagttccaagcatggcagccgcctcactgtgaatgccgtaaggccccaggtgctgtccagggcactggcctgggaaggggctccttcttttgatatgcagaggccccaagtcagtccagaggagacaagaatccattcaccgcccttggctatgatgatgttttcagcattgcacttaaaaaaaaatcttccactttatttattttaattttttgagatggagtcttgctctgttgcccaggctggagtgtggtggtgtatctcggctcagtgcaacctctgcttcccaggttcaagcgattctcttgcctcagcctccgagtagctggaattgcaggcgcctgtcagcatgcccgggtaatttttttgtatttttatagagacggggtttcaccatgttggccaggctggtcttgagctcctgaccttaggtgatcacccgcctcagccttccaaagtgctgggattacaggcgtgagccaccacaccaggcccaaaatcctccactttaaagaaaatatcatttggtaatcagaaaaaggtgacattttgtcatgtgtatgaaaaaaattatgcatttaatacctgttcattgtagaaaaattggaaagtaataaaactcaaagagaaattaaaagcactggaatctactgctcaggagaactgctttttcattcttggagtttatcctcccagacttttaaaattcaccaatacatggtataagtacatataagcatagatgactttttataaaaactgggtcacacaatggatatgacttgatcattgcttttacctcccagcaatatcttctgatcagttttctatgttaaataaatatacatcaccttgtcagtttagatgactgtactggactccagtatactgtcaaactatacttgattatcctgtattgctggatacgtggggctttctccctaccctccagattttaaattattgacaagtatttatggaggcctgctgtgagccaggagctgtcctgagccctggaaacccagcgtggctgtacagacctggcccagctgtcagggggcacctctaaggaaaccgggaggcaaaatcgtagctcccttgcagggaggttgtgaaggctgagtgaggacatctgtgcacctgggcacagtgtgagtgtgaaaccagtgtcagcccttattactgtcaataccatgaaggggggcgggggcactaagggtggcaggactcaatatctaggctctggggggtgccagagcctgccgtgcagggtcttctctctccctccaccctgactgtgctctgtccccccagggctggaatccacttcatccacgtgaagcccccccagctgcccgcaggccataccccgaagcccttctgatggtgcacggctggcccggctctttctacgagttttataagatcatcccactcctactgaccccaagaaccatggcctgagcgatgagcacgtttttgaagtcatctgcccttcatccctggctatggcttctcagaggcatcctccaagaagggtacggggctgctagaggtccataactgccccgtcctcgccaagggtgggcccggtgttcccaccaggctctccttccgcggggtgagcagggagttggcccgaggaagctgggaaaggaggggcctgagaggccggcccagacacaccgccctccggggctggagatgccacccctatatttgggctccaggattcttcttgcctctgtgagcttttctgacctccacctgggggtaggcgggcctgagaaattcatagaacaccagagggcccaaggagcaatctgcctgtgactccgtgactccatgccttccccatcactgccagggttcaactcggtggccaccgccaggatcttttacaagctgatgtgcggctgggcttccaggaattctacattcaaggaggggactgggggtccctgatctgcctaatatggcccagctggtgcccaggtgaggtcactgttggggtggtgtgtgtgtgtgttgtgtgtgtgtgtgtgtgtgtcctctaagaagtggacctgtgtgcagggtgggccaaggccccccaggggagaggagggagtgtgacctgtcactcagcagtgcctgaggcacgttgattggatcctcctgtctgtaacccagggttgcggctctgggtcaggttcccaggcagagaggcctgtgataggaggggaaggtcaggcattagacctctctgctggaccaagctctgggcagccctgagcagaactccccagaaactgtatttttcccccaacctcccttctccaactccatggcctccccagtggggccagtgctgaaagaggctggctctgtgctcgctcctcagcctgaggcctgttcctccgccatctctcctctctccctgtccttgacaccagcccagcccaccccggcccctctctctgccttcagccacgtgaaaggcctgcacttgaacatggcttggttttaagcaacttctctaccctgaccctcctcctgggacagcgtttcgggaggtttctggcctcactgagagggatgtggagctgctgtaccccgtcaaggagaaggtattctacacctgatgagggagagcggctacatgcacatccagtgcaccaagcctgacaccgtaggtggtgtgctcaggggtcctcgcccactgccggctccactggggcagggagacacccgcgggtaacctcaccaccccaccccaatgctgcccacagaaggaagcctcttgtaaggacctccagctctttagatctttaaactgcattttcccatagaatcaagaggatggaccctcagcaattcccaggccaatttagcaactctgtttagccgactcagtattcatagtggctttcaccctgatctcccacccctgagtctatatcctacactgagaagcagagggatggagggggtaggtaggaggaatcctgggagtgggcagctctggggctgcaggggagaggggagagggtccctggggccttggggaagaggttcccaggcagtgagggagggcccagcaaccatgtctccaccagggtcctgttaaaggacaatactttttcaaaaaggtaaatttataaaggaaccgtaaaattttaaaaagaaacaattcaaagacaaataagaacactgaaattaatttgctacagacacaaaacttgtcaacatccacagagtaatatcaattaaatctccatgggacaaattcatttgcctctatgaacaagagtcattcgcattaccctcagttctttacaattcacaaactgtaaaatagctcaatgacaaggaaagatgggacccctgtagcatcacgtcagtccgaaggtctgctaggtaactccctagatcttgtccagaagacacccaggaattgtcttgccatctcaaagttcttcatagttttcatggcaaacccatgcccacacacacgaggcagctataatcataataatggcactttataaaagtcagcatttttctctgattataaaatacatttgtcaaaaagcttaaaaatgcaaaaagtacaaaacattaaagacaatctcatataacccttctccctccccacatcccctctccttcaaaagaacttgtgaacattttggtgagaatttcacaagtgaagtacgtccatatcaccaacatggccccaacactccagatgcccctcgggttctctcccaggtaccacgctctgacttctgactgagatggttttgattgtgcctgttaagtcctatgaatagaatcacagagtatatacccttgagtctggcttcttttgctcaaattatgtttgtgagattcatttatgccattgtcccagctttatttatttattttttctcagacccagtctggctctgttgcccagggtagagtgcagtggtgtgatctcagctcactgaacctccgcctcccaggttcaagcaattctcctgcctcagcctcccaagtagctgggatacaggcacctgccaccatgcctggctaatgttttgtatttttagtagagacggggttttccatgttggccaggctggtctcgaactcctgacctcaggtgatccacccgcctcggcctccaaagtgctgggattacaggtgtgagccaccgcacccagcctgtcccactgtcccagcttttttttttttttttttgagacagagtcttgctctgttgcccaggctagagtgcagtgtacgatctcggctcactgcaacctccacctcccgggttcaagcaatttgcctgcctcagctcccaagtagctgggattacaggcatgcaccaccatgccctgctaatttttttgtattttaatagagatggggtttcaccatgtcagccaggatagtctcgaactccttaccgcagggatccacctttctcaccctcccaaagtgctgggattacaggcatgagccaatgcccccacctgttccagccatttttaatgactgtacagtattttggcttatgagtatatcaatattgtaactgatcccctattttagacttttttaggtggcttctcatttttcatgaatcagagacatagactgaaaaaccccgcctttttaaaaacagcacttctcattgggaccccaccaatgcagaggcgtaggcccttcagtttgaaggaagctgagcaggcagtgtgccaggccctggagacagtgggaaggtatcgtccctgtttatcagatgaggatgccgaggcagagttaagaagcgaggcatgtgagcacccaggagttaaggcaggcctgtgctcgaacgtggcttcctcacacagccccgccctctgcggccagtgccacacatcacacctgaagctccagctctctgtccccaggcctgagtctctcccttgctccccgctccccgccaggctctgctctgaatgctctcctgtgggtctggctgcctatattctagagaagttttccacctggaccaatacggattccgatacctggaggatggaggcctggaaaggtgaggccctggtttgcccctgcagtatgaccctggtcccagcagccaacctcctcaccctcttcatccccttgtctggttgctcgcatggggcactcagcaaattctattgttggctttcttacaaatcctcaccctgtgaccacgtagctgcattttttgggtgaggtggcctggtgggttgttcccagcctcacagtgcaggtcaagactaggatgcaggctcacctgcttgtgctccttttgctgaacaggcccctctgggattagggagcccacagggcagcaggcaccacattattgtcaagagcacctgggctttcctcctgattccctggagagcctggcatcagggtcacgtgactgcgtgttccaggaggtggtcgcagaaagacaggaggctgttaatctctcagagccttagaggctgtatcctctaatgcctgactcccagctctgtggcctgactcaggcttcaccaaggtcagctctgacccacctttccagggcccatccctttattccttcagtgacacacaggaccagacagtgctgggatgggaaagacagtaaaatgagactgaatcctgccttgggggtagggactctgtcttggcatgctgtagccccatcacctagaacaatgccgggtgaacagtgggagagcccagtacaagatgttgaatgaatgcgcaaaggactgtgagagtccagtggaaggaggattctttgtcaagcggcagagaggggaaatgaccaggagaatgtatctgatttgggccttggaggataataggagtttgctggatggaggagagaaacttaggcaaagagaaaagcaataaaaatgcaggaaagggtgcttggaaagggtggcttgtccagaggctgaagcaggtacactggggccaatcaaaagcaaactcattcctgcaggcaggtcctcacctcctccaagagcctcagcaggccttcgtctgggatctgtttcccctgccctacattcagcaggacacaggggttgatggacttctgcaagaccaccttggcagggggtctggcctgctccttgcacacggatacctggacaagatgtgaggccccaccagactatcccactaggccactcctgcagctctggccccggttacagggagcaccaaatccctgagcaggaggtagacaggatcagatctgtgttctagaagaacaggaatacactagggtggaaatggtggtcgtggtcgttttcaagctgcgggcaggccgaaagggagatggaagcacttggccaacttgcagaaatccagttcacagaggtgattgtatactggaactagttttcattgaccagttttcattttgccaccaaaatcacattgaaaggctgttccctttatctctgtccctgctccctgctgctgttgctagagattcagggttgagtgaggaaggtagggttgggagggcgtgctctggggaaagtggaaggtggggtggggctgtggagtatgcatcctggacccaagctggctaggtttggattctccacttaataagaaaatggagataatagtacctatgtcccataggctgttgagaggaaaacatgaattaaagaaggtaaggagcttagaacatgctgcctggtatgtggtcaccacagtagctggtgcccgagcagtttcacggtgcaggggttgaggggagggaggagaggtcagtggcaggagagagggacaggtgtgtagaggcaaggtgggtggggggaggaccttggggtgataagagacactcaactaaatccatgcgctccagtctagtgccctgggcgcagcctgcctgtgacacgaggtaccacacacgttgcatgaggtctgaggagggaagccgcatgggcagggcctggcattttaggactttctggctgccctttgtcacacaactgcatgtggcactgagagtggggcttttgttctgcgttcccaggaagttctccctggacgacctgctgaccaacgtcatgctctacggacaacaggcaccatcatctcctcccagcgcttctacaaggagaacctgggacagggcggatgacccagaagcatgagcggtgagcctggctgagccgagaacaggggcctctgaggtggaggcagggggacggccagtcttgggctccacgaagggcacttggtggtgggataagatagccttgcctgcaggtgccccaggggcccttggatgggaacactaaaggtcgaggtgttggagaaagccctcatggagggaccaggtgcctggctcccgggcggccctcagtaccgtccccagtctaggatgctggtctggagtggcactgatggttctgggatttccaagtctccatggaaaccctcaaaggtggggatttagaggctgtcccatgcccctgcctgggtggcctcccagaaaagagaaggccctcagtgaggggagagcggttgagaccctggatttgtcctttctttatggctccttgtgggtgggccagctgatctcacccccaggcgctttaacccccgctgtgcaggacggaggggcgcagggccacagcctcacccctccgtcggctctttcactccaggatgaaggtctatgtgcccactggcttctctgccttcccttttgagctattgcaccgcctgaaaagtgggtgaggttcaagtacccaaagctcatctcctattcctacatggttgtgggggccactttgcggcctttgaggagccggagctgctcgcccaggacatccgcaagtcctgtcggtgctggagcggcaatgacccacccctctccccccgcctgccacctcccccacaagtgccctccaggcttttcttggggaagataccccttttctgaggaatgagtttgctccgtcccctgcccatgctgggagcccacgctcaccccctcacccctccaagctcactcccaacccccaactccgtgtggtaagcaacatggctttgatgataaacgactttactctaaagcggctggaactcagtgacatgagcgtgcgctgaccccacatggggccccctgtgcagcagagctggccggcccctccttgctggcagaggcacgggaggcctgctggggatgaggcactggccagggctatgctgcaccagaccaatggcaccgcccccacccctcccagcgcagggcagcttggagcagaggcagcactggccaccactgcgggggcaagtcagcgtcaagaagtccctgagtgagaaggcccagataagcccaggccccccaggccagcggacaggcacagcagggcctacagaggtgccaaggccccaggccagttgtgctaggagcctggacctgctttccacacccccatcccgcccctactgcacaggcttgtgccttggtgccccctggaggcgcagggaggaggcttctcaggcagaagtcttaagttgcatcccattccccagaatccccggagggagaagagggatgggctgcccctccttcctgccagagccacagctcaagggcaggggatggccctgcacccagcccaggtaccccttcctctgtgccgaccatgctgtcctttgctccgaggaggccctgagcactgcccacccccacaccttggagggagcagacggaggggtgagtactgcacagagcctgcctggaggtgcagactcatgcactcagccctgaagagggagagaggctggatcttaactgtggtccaatgggcatattatgagtggtccttgtccctcctgctatggggtaaccctgacccagctagcgtccctgacaacatgatacaaaaacacaaactctagcgggatacagagatgtgtgcacagctggcaggagcactggccacctcccaactgttccccatagcttactcctggatgtagcctggagggactgctgggctggggagggatggccatggagcagggagctggatgccagcgggacctcagacctggactgcagcatctcttggttatcggttgtgtgtgtgctcagaagggaggaggccttccccttgttacatctcttctccatatattctcccggactcatcagtttggggggcgaaaagtccaccacatggtctggcgacaaaccactggggatgtcaccccagctgcagagctggaagcttgtgccggagggaaactgggtgagcaagggaggggcgaggcctgcctgtgctctcctcaccactgctgggacagaaaagatgggcacctgatagctcagctgggcagtcccaacgcattcccactcagccagggcctgagccccaggccattctggttgtgtcttttcagagcagtgagacctaaaacaatgggaagaagtcatgaacttgggagtcaggccgcttcacctgtcttctcaccccacagctcccctgagcctggcccagccagcagctcacccagcctcaggcctcctggggggcagcgccacactgcccgtggcgctctgcgccaagcactgtccagggatagtcccgctgatgtttggatggcaccataggtctgctgctgctgctgctgcggagacagtgctgtcctctccgagccaagccgttcagaatccgaggcacgtagggctgtcagcaaatggatttgtgcttggctggacaggcatgagcttccacactgcatccctcccctcctgcccttctcccaacaggaccagacagtggccataaaggacatatgaagaaacaccgacatccatttaggacattaagacgaaaatatgacacctgcagaatttcctagcagccagggcaaaagagaaagcacagttaacagttctcatgatcacagaaggaagcacaagagagcagttctcagaggaaactaaactcctagccctggatcctaggaggatttctcactttgtagaagaaacaagtctacctatatggggggcttagaacgctgccctgggacccctgggatgctcaacatatctgtgtgagtctattttgagtctcatttcctcccaatcccaggctccagccactgaccccaggcacagagcctgccatactcctcctgagaccctggctgtgagggcttgacatcatccacctgtcctgctgttccctgcttggccagcatagccacaggtgtgtcgctgggtaatgagtccttctgagccctcccttgtttggaacttgtccaaggacagacaccgataagagagcctgacacctggaggcagccaccagaaagaaccctgcagatgaggtcggctctgtcctggccacggctgtcggaaggctggtgactacagctctggaaccctggggctctgctttcccttcccagccccacctaggagcaggaccctggaggctgtgtgcagagagaactaggaaggcaaggagccctggtctctctaccatggggtcttcctctgaagcaggtgcaatgttcatttcttgaattcaagggaagtctgcctgacaccctcttggagcctagtggaggacctcgcacaggcaggtgcacgctgatgacaaacctttgtcaaaccctagcgccttaccatgtgccttcactaaagcccaaactcaccaggcattaaatatgcagagaaggaaagagagcagggaactgaaaccaaggggatggccatgaatcgagacaagactctatctcctcaacagtttcaaatatgcaggttaaatacccagggggaccaggattccttctctgccattaattcacaaacttgcctgccatggatcttagcaagagatgatcaaagatttgccggggcccatctggttgggactgttacaacaaagcaaaaaaaagggcgacaagctcagaggctgaggggcacagcttactgtgaacgggggggcatgtgggcctctgcctcacttcctttgtcacttgcaggctcttctgtctgcagtaacagcaaaaacttgcgatgataaacaaaactgatctctgtgaacgaacaccctccaacacacagactattaacacccggaataatagtaccagctggcaccaagctccccagcagccgagagaggatggggtgggggagtgcagggatgaggggaggaagggaagctacacatggacccaaccacccacgcctttcccatggagaagcagaatctggagaaggctgctgctgtgtgatacagacaagggtgggcggggttgacagcgagcccgtcccaccatctgttcctcccgggcttgaccgggcagtggggtcgggggcctttactttgtagttcagagggctgaggtgttgaagcatccaaagcaggtgtgagccaggcagaccaggatggtgagcagcagcaccagaaggtgaacagagtggcgggggccttcatacctggtgatagagggtggctagccttgggtgggcagggaggggccaccacctaccctcaccctgctgaggaaggggccgcacctggtgggaaactgcccgtgacttctccctcaggcagaaaataaaggcaaggcctaaccccccaccccacccctcaactccagcagcaaggatggtgtcttcacagccaggaacacacagagggcccactgaatgactggcatcatccctggtcagatttcaggcactggggtgccaagtcaaggcaattcttcagcctccttgctggtccgttccctccagtctccagtgccctgggctaggaggatggaccctcccacacccccagtctgaccggggcagacgtgtctttcccccaggatgtcagttttctctcctccacgtccccacctcttccatgccaggaggtacaaggagctggcccaaccaccagcctcaaagggcaaatctggatcagcttccccatttcctctggttcatccctgcacagctgataaaggcactatcttctctccagggatgtatgggacaattgaccggccttcacaagggttacacctgcactcgggctagcttaggagccaggctgtcaacacccacccaaccagcccctcaccctgggtatcatgttttgattggacacctaaccagtcctcctctgggcaccacattctgactagacatgtaaccaaccctcattctgggtaccacgttcgatgggacacctaaccagccctcactctgggcaccacattctgactggatgccatgctgtgctgtgaaagcaatgagggatctgactggctggtggggatgcagggctgggaggccaaggctggccccaggtcagaagggctgctcacccaggcgcaggaaggaaaagaagtagagcagaagaggcacaggatgggggctgccaaggcctggttcacagcggcaaagtggatcccctctccagcttggctgggaggtagacgaagtagaggttgtgccggtccaccatgtgcttggcaggatgtagatgaggcctgcaggggatggggctgtgagctggagacctcgcagggcccacagacacctctgtcctcttcctctccggggcggctattttggcaaggagccagggctgggctgctgctctactgcctgaacacaaaatgaggcatcctgcacctctggctactagtttttttcactttctctctcctacccacttcctcacttatctgtgaccccaaggtgtagggatcggtcagggtggtgggagaaaatttaagataaagttataggaaatagacacaaacctcttggaaagccgagaggtttgcatagcttcagtaaagggtttggctgaaggcagctgattctcttaaaagcttagggtgcagatacataggaatgtgggggagtttacctaaatagctgtttactcatgtggtcctaagaccaacctttgatcatccactggtgcatgattgctcgtattcagggggtcggcaatgttaattaccctctagtggtgtttactcgagacctttgtctttagtctgtactaaataaatgcgaacttcgcctggcattgaggactacactgcagactaggctgcagagccccttagccgcactgacaggcaaaatatctgtcagtgtatgtctgtcgtctgtttttttgagacagagtctctgttgcccaggctggagtgcagtggtgcgatctcgctcactgcaagctccgcctcctgggttcatgccattcttctgcctcagcctctcaagtgctgggactacgggcgcctgacaccatgcccggctaattttttatatttttagtagagaagggtttcaccatgttaaccaggatggtctcgatctcctgacctcgtgatccgcccaccttgcctcccaaagtgctgggattacaggcgagagccaccgcacccggcagtgtatgtcttcatccgtcgctgggtcagggtctgtgggacagaccctgcaccaagggagtcacagtgttgtgatcctgtccccacagaacactaacattccagaatcatcttggaaagaggctgtttacagttggatgcctggcctcaattcctccccagcccttcccatgctgagcccctgtatgcagtgctcccacacccctggccttctcccacccggctgatccctgccctcatcacagtcacagagaatgaggcccaagggtcttaccccaggggtggcacaggagcacacaggggaccacagaaagtgggtgctgccttttctattatgccaggttcttttgtttttttattttttatttttttgagatggagtctcgctcattggtcaggctggagtgcactggtgcaatcttggtcactgcaacctctgcctcctgagttcaagtgattctcctacctcagcctcccgagtagtgggattacaggcgcctgccaccatgcccagttaatttttgtatttttagtagggacaggtttcatcatattggccaggttgttcttgaacttttgacctcaggtgatgcactgcctagcctcccaaagtgctgggattacaggcataagccatcgtgcccagccccaggttctttttaaaaaataaattttgttttgaaagtgtaaatactgtagatttttaaaactacacaagaagtatacagggaaaactaaaacaacttttccccctaaaactcagctatcactgccagcatctcttgggttttttgtttccttctagagcctttcattaatctgccagttgcagatgtttatttcagtggccaggaccttggtctttaaacagtcctgagttcaaaggctggttctccgcttactaacaacatacgaagttattttgtgtgaagggggaatagaaacaggaactgcctgtaggatgaggtgagaaatgtggtaatccacgtggaggcaggcatctgccagagtgaagcagcacgagagctttgattgtgactctggcactgtcttacttgctgctaaagaaatcaccatgaacgacatagtcagtgggcagagaacctcagaccagaaatactaagagaggtccagctgagggccagtgggaggaattcatttaaaaatgaatgaggccgggtgctgtggctctgcctataatcccagcactttgggaggctgaggcgggtggatcacctgaggtcaggagtcaagaccaggctggccaacatggtgaaaccccatctctactaaaaatacaaaaagttagcaggcatggtggcgggcacctgtaatcccagctactcaggaggctgagatgggaggatgcttgagcccaggaggtgggggttgcagtaagccaagatcatgccactccagcctgggcacagcatgagaccctgtctcaaaacaaaaaaagaaagaaatgagtgaaatctggtgtcactgagtctttagcagcttgtggctcttgtggctgtggttttgggaactccattgtgccctgtgatagctgtccccgagaggtttggtgcaatcagccgtccatgtacccatgtaccctggacaggctccagggccactcaccaaatggcgcgatgatgggacaagtgatgctgtaggcacgatgacagtgaagacacacagcatccatgcatacatggctccaaactcgtactggaagcctggttctgggaggaggaggtggtgaggagctcatggacttgttccacctcaaacaccttttgtgctctctaagtggtgatgggagagcagggtggaggaggactttggaaatagggatgcgtggctccccgcctcccaaggtccttcccatccctcccagcctgccctgcttcatcagtgcacccagccctcccgaggcatggtgatgcgtgtttgctcgtgctcccttcgttcacccaacaggcatgtgagcccctggagggaagaggtggtcagggaagaggtgtagagtactccagcccttctagcaggggatcctgggccagcttagttcatgcctctgtgaaatcggatactagcagtgcccagctcataagggggctgagaatgaaatgaaggaatgcagcactctcccactttcctcgcacagtgcccaccatggcagaggagaataaaagagaaagccacacctccagttcagggaatcctggaataaatgccacaagccgaaaatgcctttgacatctgggtttggctaagaatttatgcaaatgggtgcctacagaaaaagagtctgttggtttgagtgtatgtatgtatgtgtgcgatcaaaccgtttcaaatgccaaagtcccaagctctctccccagcctgtgagctagagaggaggctggaggaggccacgcctgcctggacccgggtttggaagcacttagcccagtgcctgcactagtgggtagtcaggtaaatgctacccactagtggggtagtgggggtgagaggccctcgggtcagtgaagggggacatgggagggagtcagagcacagccctgggcccaggggatggcacctgcttgacattcctgcggtcagcagccgtctggccatgatcatgcggaaggtatagaggatgagacctggcagccgcagcagctccatgcattgccgatgaaggccgaggcgatgacatagttcacaaagaaggcaccctggtcaggcagaagacgcacctggggaaaccagggcccaggtctgtgagctgagagccgctcttggaggagaggaggggcccctaggctgggcaggagcagaaagcccctgggagggctgtatactctccgttcattcagcacatatttgggaaacacatctgtgtgccaagcacctttctaggcacgagaatagaacaaagcccctgcgccactctcttgaagttcacattctagctgggggcacaacaagcagacaaacaaatattccatctgctggggacggtgagcactagaggaaaacaagcagggagggttcctatgtcatacaggggttggaggagcctttctaacgaggtgatattgtgaagaggtgaaggagcaagtcatccccaaacctgggaagacaggattccagggaaaggaacaacatacaagacacctgaggatgtcctcgtctgctgcacatccaggggctggacacagtgggcgaggggaggcagaagacaaggctgaaaggggctgggggccagcccaggacagggatctgttccaatggggtcagggagactacacagatggccactgtgtcatccccatggggatgagggcggttgtgatggaggtggtgagatatgaagggattctggatctactttaagagagttgtcaggattttctggtaggctgggtatggcatgggagggatagaaaggaaaaaggtgaactttgaggttttttgccaaaacaagtagaaaaacaatatggaatggggaaattgtagagtagcagatttgagggtaaaagtcgagagtttggttttgggcaggtaacatcgtggtacccagtaaaactccagctagagtttgaggtgggcagttgggttaccagcctggggtgcaggctagaggcataaatgtggatgttgtccgcataagttaattcaggagcagtacatggcatggaagccgtgggttcagctgaagtcacctagagaggcagtgtggacccagactgggggctgagccttcaggcagccaaaatctagagttggggagatgggagagaacccacaaggagggtgacaagaggatgctgcgagatgagagacccaaggccgagcttcgaggagaaggctcggataaatgtgtcagatgtcgctgatagatcataagatgaggattgagctggcactggacttgtcaatctgaaagtcactgtcaacctagactattgctggctgtatgtattgtgtctgtcacagtcatcagctcccaactcatcagcttactcagcaagaactcatttaaataactcgccccatccttacaggtaagcacattcttttaggaaagtcaatgccaagccctggacctatattaagacctaatgtatagtctgtaggggctggggttgaatcccagctcgttccttaaccagctggataaacttgggcaagttattcaacgtctccaaacctcagtctctcatctgtaaaatggagagaataatagtatcttcctcatagctcattgtaaagatacatgagaaaaagatgcataaagcatttagcatagtgccttcttaaacaatagctattactataagtggcatggtataagtttaaaatactaacaaggatacatcagtaataaatttaatttattctggcaaaaataatccccagagcccagaggcatcctggctgccatctttaattatattctcctttccccactccctggcaccactgagacccagcaattccttctccccatgtgctctgtgctcagtaagtttcaatgaatgagacagctgctaattgagttctggcctaaaaattaaccacatttctgcaagcatagcacaaagtgggtcagctcccacagtgtctaccagaacctggcagggtggaggtgaggccccaagccctgctgtctggggaggaagatgcctgtcagaagcataggctacgaccgcccccacccatcccactgcagccccagcccctgtgggatttcacccagggccatggctccagaactcaacttggcaatactcactccaacctgatggggcctccgaggaagttttgtcaaagagccaccggaagaaaaaatctagactgaaaaacaaggaaccccctaagagtttatttccagcattccatattgtcactacacatgctttcatttcttttgctctaaaaacaggccaaagctcgagattgacttttgttctcaacgatgccactactacggcatgacctgtcacagtctgctttaacagaaacttccttccttgagataaataagccatgatgaggccttccctaagtggaaggtccttgataagtttcattttcttttctttttgtagagatggggtttcgccagactgcccaggctggaactcctgggctcaagcaattgcccacctcggcctcccaaaatgctaggattacaggcgtgagccactgtgcctggccaaaaattttcaagctggttttttttttttttttttttgagacagagtctcacgcctgtaacccagcactttgggaggccgaggcgggtggatcacctgaggtcaggagctcaagaacagctgaccaatatggtgtttttttcttttttaaagaagaacaatcaatcatattgccagaaaatcaatgacccagccctactgcacgccgagtggttgcgacaggcttagatattgttagggtttgcttctgctgccaaaccgtttgcattctcctggggacagtgctctcctgatgtgctcttattctgaatttagagcagaaggtggtggcatatacctggtgagacccagggaggcaggatcagcaccatgaagatcaagaatatgtagactttggtcatcatgatctggttttccccgacctgcaggaagtcaaaggtgagcactcgcagtcccccaaatgctctatgtgccccagtgaggcccctgccatgtgcccactgcctgagcagctggggggttagggtgtggacagggagcggtcagagatatccttcttaggggcagggcctcggggctcccgggcactcactggtccagtgagactccagcagtgtagagtagtagacaatggaggggagcagggccgagaggaccagagcaggagggtggggaagaactggctgatgatcgggttctaggagaaaggtcacagcagagagagtcacaggggccgtgggccacgcggctctgaggccatgacctattgtatggtcgctcagtggactcccagggtaggagtttgtcatctctgaccccagaaccaaactgtgccaggtacagagttggtagtccataaatgttggctgaataatcagtaacagcacttatatttgtacagctcctcacagcacagcaaagaaagcaatttcacatacgagtaaacccacttatctgactaaccagattaaataaccttctctgctccctatacaaaaccaatgatgatgccatggcaagactgaacaccgaaggcctggagtcctggccggcgggcggggggggggtgccctgcctgctcagctcccactgtccagctgcagcatatcagggctccactgtggtgtccacaatcctgctgtttgttactgggattacatgagctgattgacttattactgtactgattagatgaacataaaaatagagagaaattttctttgaaaactaagttggctacttggaaagacttaataaaagtcaatttctaaaaaaaaaaacaaaacgctgttaattagatagagtaaattaacgataaaagatcaagggatatgcgatctaggaagtttctatattcagatggctcggcaaatatctaaattcttcctttactttaaagaaaccaacactggaatcacaaacaatgaaataagggtgtggttgatgtaaagtagacaaaggggagctctcatcagcaatccatcttcaaaagaataggcctgtccttctattaaaagattggcaaaggaatgcatattataatacctgctttaaatcttaagcaaagctgctgaatttatacttaggtagtttaaactatctatggagtcagataagagcttcaaccacacatcagctcattgattatcatgacacagcctcacgccctgtataatagtgcaggtgttttaactccagttcttggatgaaaaatgaggttcagaattcatcagatagggaatggcaaagtgaagacaaggaggcccacctgcccgtgtgctttcccagggaatgattaaccaaatgcaaagtgaaatttaaaaagaaaaatatctagggagatggtttggcaaagctaatcatgagaaaccaatagctttttgagtagatccagttgagtgagtgtttggctgttatctcattgattcatctaagatttttgaaaatcgtcattacctatacagaatagtttttttttgtttttttttttttttttgagatggagtttgctcttgtcgcccaggctggagtgcagtggtgcaatctcggcttactgcaacctccacccccggttcaagcgattctcctgcctcagcctcctgactatctgggattataagcgcccacaacacgcccagctaatttttgtattttcagtagagatggggttgtgccatgttggccagctagtctcgaactcctgacctcaggtgatccgcccaccttggcctcccaaaatgctggattacaggcgtgagctaccgtgcccggccccaaaatagttttataacaaggtcattagcaccaaaatgtaaaagaaataatttgtgatcctgccaccccaatcaacgaagcttttttcttccttcctggcccctccccgtagtgtccatgatagacatgcctcactggtacatccctcttctgtcaggagccctgcatgggtgccacaaaatctatacaattttgaatggatgcttatagtctaccaacctgaatataccacattcaactcaaatgatccctaccattcagtattagatagtctattaaaatatatatgtatgcatgtgtgtgtatatatacatataatgtgtggtgtgtgtgtgtgtgtgtgtgtgtgtgtgtgtgtgtatggcattactataaggactttgaataaatgtggccatgcctgctcagggcttaaaagcaaggatgtgagctgagcaacatgcccactggtttagttccccgcacacaccccactcctgtccccactccttccccacccacaagccctcttctcaccagctatcctgggaggggccttgcagaacagttactcacattcacgcatggatgggtttggtgacattaaacttgtccatggtggacaggatgatggagggtgggtcaggaaaaatagccccaggaagagggtgaagttgatgcccagccactgtagccaccgcggaggccctggatagagaggttcttcctgcagcgggagaggggatacaggtctcgagcttgtctcccagtgctcgtggcttaggtgggtcagaaggtcagatttaggcagaccaaggactagcctgggggcaagttctctgcactgaccttcaactacagaaagaccaaatcttagtccccaagagctcagagggaacaattattctctcagatgtggctccccagctaaagtcgggggccagaacctacccaaagagatggcatgagcacccaagcaggccaaacaaggctcagcatggcatttattttttctttttctgtttttttttttttggagacagagtcttgctcgtcacccaggctagagtgcagtggtgtgatctcggctcactgcaacctctgcctcccagttcaagcaattctcctgctcagcctcccatgtagctgggactataggcgtgtaccaccaacccagctaatttttttgtatttttagtagagacagggtttcaccatgttacccagggtgtcttgaaatcctgagctcaggcaatccgcctgcctcagcctctcgaagtgctgggattcaggtgtgagcaccacgcccggccccagcgtggcatttcttagacacatctgcaatgcttgtgactaacgacacattcttcccaacggggctgtagctggggtacaggaaggaggaagcagggacaaaggagtgaaggcatagcttgcacctgccctggcctctcatcccaaagaacgacccacaaagcaatcctgagtttaggaagccttgtgaaccaaagagcaaaactgtcagggcagaactagaaccgagcagaggggagcacttcaagctcattctgtgcaaggagctgagcagggctggacaggcagctgcgctggggcttgcgctgggtgcccttaccctcagcacacactggaggctcaccagggcccccatggacacagctcagctccccagcacggccccaggtgacactggacctaagtaaggctgcacaagctgcatgcggctactgagcattttaaatgggctggtgtgaattgagaggtgctagaagtgtaaaatacacaccagatattgaagactagtgtgaaaaagagaatgtaaaacatctcacatttttcaaaaattgcatgttgaaataacgtttggatatattgggcgagatacattattaaaattaatttcaactgtttctttttactttttagcatggctattaggaaatttaaaattagatgcagaactggcattatatttctgcgggtagcacttgaatgctagggaggaacactggagggaagggctgggcagataccccagtgggccacaccgagcacatcacagcatcacagcccacagaattgcagatgtgtggagattccattgactgccaggtcacacctgtgctccaggtgatgggcagctcccaccaggaaccaggcctctctcccacctctccttggtctaggagcttaccagcagatgtcctcagggtcacagcaaaggtgactgtccacttggaggtatagagctccctgctatgggaggacggctgggctcacctttgcactgaaggctctgacacttgcaggcattgaaatctttcaggatgctgaaggaaatgtagcaacagccaggcccaggctactcaggttaccaagcacacatgtggcagtggggactgagtaggagtgggaggcagtggcataggacctttgctttgttgtgattaggtattatgagtaacgctatgtaagaggtgccacgctagcacagtgtgtggagaattttgttaatcctcgcaaccaccagcaacaaagggagtacgattcccattttacagataaggaactgagggcaacacactgctcttccatagggccatccccctccaccctgcctgttaagctgagctctgatcagtgctactgccaggccagtggctcaacttttcattctgtcactttttcccaggcccaagtgtagcaatagaccacgttacacattgcctgttcccaagcttccctctcagggctcccacctcgaccctcaccatctcaacaggtcacagcttttcctcctttaactcccgtaaggagcccagcagcccctctactcctgcctcagatgccttcccctttcctccgccccagtgtctgcaaggaggcaggaagtcctgtgtgagtccattcctagtgtcacaatcctggggcagtggctggacacctttccacacccctctcccgacccaccctgtgctgctctaaggcgagatgacactgagaccacaggcatgagagcctagagtcccatgccaagggccctgtgaaaagccactccccagggtcaagctccccactgcagtgagcgccccagcgtgcccaggggtcttccccacagctttgcatttgtgggaaggtggggagccacagacagaaggactgtggcccagagcagatgtctgaaaggagggtgcctccatctcccctggggcaaggctgcacatgaagccaacaggatgggtccagggcagcagggaagagcccggcagtggggccagccacatcagctcgagggggtcagccagaatcacccactccgtggctgctgcccacaccccaccgcctgttacacaaacatgggctgggctggctgaaagtgagtgtgggtagctgaggaggagaaggaaacaccacagataaatcccagggatggtgggtcagcagtaccatctccctcgagagggacagtgagttatctggaggggaacagggagtcagccaagaaggggtctgatgtgcctacactcactaggtggccatggacttctcctggaaggtgacgaaggccattccaggggctggtcctggacgtggcgttcttcctctgtgatcctctccagcagcctgtcctcatccgtgtgtagtaagagatggcgtcttcctgccacaagacacatcccattgggatgagtggccccatgctggtatctggggcaccccgatgccaatgcctctgctcccagccgggggtgggacccttacccactcacagcccagcacttcacagcagcaaaactggccacagggctggggttgatgagggtccgctggcctgtcttcacctgcaggtttgtgtaataggtcaggtcttctcagtcttctttctgtaggggtgggagcgggggcacaaacctcagatttagaatctgtggcagggacccccatacccacagttcaaccatcgaacgccaggggagaaggagggtccagggcctcccgcctcccttcctagctgggagatgcgaggccagcaaggaaggaggggcatcttgcaaggcccgcccaccactcacttctccttgcacaggtagatcagtttggcccgttgtagcacagctgcacatcaaccacctcacacgtgggatacgcgtccctgtggccaggagagaaggaggcaaaagacaccgttggaaaagaaaacaccccaagcaggagacgtgccacggatccaagggaaaggatggcagagtgatctcgctgctggtttctgtgccagcggaacctctcttctctttgtcttttatcctccaaaagggggaaattttgaaatttaatacaagagggcttttgttttgttttgttttgtttagagacagggtctcactctgtcacccaggcgctgtacagtggcgcaatcatggctcactgcagcctcaaccttctgggctcaatcaatctcccacctcagcctcctgagtagctggggctacaggcacatgccaccaggctgatttttttttttgtagagacggggtctcgctatgttgcccaggctgatttcgaacttctggcctcagcactcctcctgtctcaccctcccaaagtgctgggattgtaggcgtgagtcactgcacccgctagccttttttagtagtatgaagctaactgcctggaactgacaagtttatacccattggcttggaatcagctggcacttctcctggggaaaaatgaacacatcactatcccctcaaagacccaaaggaacagatttattgtttgtgctaggtcagtatctaccttgagccatcctgaaatcctattcaggtagccttttttaaggtcacagacctttcagagggtctaatgaagcaaaggaccctcagaccagaaaatatctacacacatattaacaaccagcaaggccagtgcggtggctcatgcctgtaatcccagcacttcgggaggctgagccgggtggatcacttaggtcaggagtttgcgaccagcctggccaatgtggtgaaacgctgtctctactaaaaatcaaaaattagccaggtgtggtggcacacacctgtaatccagctacttgggaggctggggacgagaatcacttgaacctgggaggcagaggttgcagtgagcaagattgccccactgcatccagcctgggcaacagagtgagactccgtctcaaaaaaaaaaaaaaaaaaaaaaaaacagcaaaatacatactcactattgaccaggtattgttacatatatttatttatttaatcccatcataacctgtgaggttttgtccccattttacagatgagtaaactgaggccgacagagtaagtggcttgtgcccaagatcacacagctagtgagtgtctgagccaggaggtgaataaggcaacctggctccaaggtcaatgctcatggccaccatgcaataccccctcaccataccgcaaaattatacatacaattccaggggattccagaaccatgtaaatccccacctaccactgccaggcactgttctaggtgctggtaacagggcctggatgtgcttacattttagtgaagagacagcccataggtatatcaatcatgaaattaaacagtaggacaatttctggtctcataagagctgtgaggaagaaaactgcaatttaagcatccctgcttgaaaggcaaattcaacatcaatccccacggactgcaacagcattcactaaaaaggcctcttaaaataggggaagcatgagtcatgcaatgtttgtatgagaatgaggagactttttttttctctttaaagtttacattaagtggaattactgtttccaggtgttgcctagcaggcaactttgaggagttgctcaaggaaatacagaaaaatgattctggtattgagtatttacatattagtaaatatttcaaaatacttagagtttctgaagaagtttttcaaattttaaacattcagtttacgatccttctagcaatttgcttagcaagtgctttcttcacaaatagtgcaaagttaaagtgcagccactcctagtccatgcaacaaattagtggctgctgtattgataaggaatgaagagaggccggcatggtggctcacgcctgtaatcccagcactttgggagggcaaggcaggaggatcactgagcccagcaattcgagaccagcctgggcaacatagcaagactctatctccataaaaatttaaaaattagctgggtgtggtgccatgtgtctgcagtcccagctacttgggaggctgggcaggaagatgccttaagtccaggagttgaggccgcagtaagctattattgcactactaactctagcctgggcaacagagcaagaccctgtctctaaaaaaataggattacaaaaaaggaatgaagaaagaataaaatgtcagctcctcagcccagccttcaggtcctccagcatgggtcctgggagccttcccggactgcttgccctgcccccctgcaccccaccgccacctttctgatgctctgggcctttccccgcatccctggctgcacacgtaatctcctcacaggaaaactttcctccagcctccatctgcaggaattggtggtgcagatactcaaagggagccgctgaaaggaggttctaccagggagagcctggactcagacacagtgctcactcaacagacaccgctcagtgggtggacaaacgaacaaacgcagagatggccccgaggtccttccacctgtagaccctagccctgtgggtccatacaaatgctcagctcacgtctctcttattctgcaaagtgatgctaagaaccccggggtcaacaattttttcccccgtatgctctcaagacgtttatcgcacctacaccctggtctgtgctctggacactgtgcacaggctgcttgaagaggatagccaccagggcgctattcactgcacagcaccagcagggctggcacacaggagccactcctacacgtgtggcagggccaggtccttctcagatctcacctggatacccaagcgagagacgaaggcgctcacctaaggtgctcgccctgcgggtggggctgtgttggtcctacgtggaggggctcagctcccctcccaccccacctgcttaccggaagtggctctccacagtctccttctggcatctctggggagtcctgtgatgaacagggtccgcctcacctgtccgggaaatacgcagggagagaagtcacccacaagccagtgtgccggtatgctcaggtttcctacccaacccagcctctggaaagtaaacaacaggaaatcagaaggctccagttttctccttctgtggcgggggagcccccaaagcatgtcatttacacagcgtcttcttccaggctgtacaaagaaccacttccaaagcaactctatgagccttctttgcatggcaggagactgagaaagaggggagtgactcaaatgcggtcacacagcagatcagaggaggacccaggcctggaaccaagcccagaagctcccctcccctgtgaagctgtgggcggcaaagagaaagggctgctctcaaccaaatttctttacttagcaccagtaactgtccaaatcttgaaacaatccaccaggaaactttttttttaaagatggtgccaagtgtgagcaagaataagcaagcggggctcctgaggcctcccagagctcattgcagtcagggcctgtggcagagcctgggaggcccttccactccgatcccacctgagtccctcccagcacatgtccctaagtcccgcctcactcaccaggttctctctttgtacttaatggactgagtgtggtgccgcatgaaacccacagtgaggaagaggtaatgacagcaaagatggtgtgcagccaaaggaggtcattgctgagagggaaaccacctgcatcagggctgggatcccaggcagggagctgggggtgcagagctggggcctggttaccctagtgggcactgaactgaggaccaacagcttcactgcaagagatgcctcccacagaggtttgtggccagcacccctcagcccacagtgaatacttcagaggggtccccatccctgtcctacaaatgaactccagatccacaggaccctccgtgtttcttaaaaccctggcaaaacagttctgcctgtggcatgttcatgcccacagctcaacaacacactagctgcaaggggccttcgataccagccggccccctttggagtacctctggcctgccccgggctcctgacctgcctttccttgatctcacccatcagcacctatccccacgggctccatactcactcagtctgtagtttgctattgttgtcctcccaaaactatacgggtctttgtctgcagagaagcacagatattagttccagggtcatgtggggaagcaggagggggcgtaaccaatcagccttggtttgtgagctctggggaggaggagcatgtctggaccagcaggaagacaacgtctgactggtcttccagagctacaccatcaaggcctctgcttgaaaccaaaatgctccctgataacttctcaccttccattgcaggtaaaggcataatgtgaattcattttgttttgagaaaactaaaaactcctatgttgttacaaaaccaacgttgggaaccactgggtatcctaagtggattcatggggcattttggaaggtggattcttgcagttgcccttagatataatgccacaccctgatttaattaagtatcatggatatcttctgggtccattaattgtgacctcctaatttgggtgaggcaggaaagtataaaagactctctgatagcccctgattctgtaaatcttggggggctttttccctatttaaatagaaccagacattgatattggggccccagttttagcctaggtttgtccagatctttaatcagatagaaatgttcagagtcaccctgagaccatcttacatctgagtggggcatgactcctggggttctggtctaccacagtgagccctttccctaggactgccctctgccccattacaacatagacaagggtgaggagggtcattacccagcaagtcccctggaggttgacaggcaggatgacacacagggacaaaaagctgaccaccaccaacaggaagagatgtgcctctggaaggacaggtagtggatggcgtcctccccacaccattccaggatctgtcatcactggccaagacacagaggaatcttaatgagcagtggaacaggcctcggggcttgcatgaagtgtctcatatcatcctcaccacactcttatgagatggttcgatcgctatcccacatttttgttcacatatgaggaaataaaggcacaggaaatttgcataactttcaggtctcacatgatataaattccagagcccgtcttagcccctgtaccatactcgaggtaaagaataccagcactccatctgatgttgctagaaacatttgtgcccaagttacgtgtgtgggaaggtacgtaaatacagtcatctcacagccctgtcctgcttctaagaaatcacattcagataaagttagggctgggcgcagtggctcacacctgtaatcccagcactttgggaggctgggcaggtggatcacctgaggtcaggagttcgagaccagcctggccaacacggtgaaacttctctactaaaaaatactaaaaaaaaaaaaaaattagccaagtgtggtggcacatgccttaatcccagcaactcaggaggctgaggcaggagaattgcttgaacctgggaggtggaggtgcagtgagtcgagatcccactactgcaacttcagcctgggtgacacagtgagactccactcaaaaaagaaaaaaaaaaaaagaataaagttgggaatatgcccaggccccaggccccacctgtttcctgtctccccctcaggtggagacctgaggtggagccaagagtcccagtcctcctaccaccctggcctcctccctgtgtccccagagatggggaggtgacttgctccacctttcccacccttggagtgctacacttggaggctctgggtccactggggactcagaaaatccaggttcacacaagccagacttctgtgctacagagggagaaggggcagggcactctgcctttcccactccctgaaggcgctacttctaggctgggaaagcagtgctttgggaagagccaggggggcaagggctgcatcataaaaaggcagatgtgaaagatgtcagcgtgggctttcagtcagaccacagtgtaatccagcgcagcggcctccacctgagggcaggtcatggagctacccgcctctgacctcgagcaaggaaactgcccactgcctacctcatcggcttagcagggctcaagagataataagcatcaaacacctagtcctgtacgtggtatcagcagatgctcgaaatatgcctgttcatatgagtcctgattactatttatctagaggacaaagctttgcattaactacattgttctcatttctaaataaactaactcgcctcctgcttcctcctgttccgaccagagttgactgtctcccatggggctctgtctcctgccagttcccctgggaacaaccctaccaaaccgaacatttacaacatgctctcacatgtattcattcctttgaattaggcgagcatatgttatcctcagcctccttttacagttgggaaaactgaggcccagaacatttatccttataaccaccatatttcattatataaccaccacatttcatcaattctaagatatattttcatatttcttttcttttcttttcttttttttttttttttttgagacagttttgcctttcactcaggctggagttgcagtggggtgatcttggctcactgcgacctccgccttcggtttcaagcgattctcctgcctcagcctcccgagtagctgggattacaggcacccgccccaagcctggctaatttttgtatttttagtagagacggagtttcaccatgttggccaggtggtcttgaactcctgacctcgtgatctgcctgcctcagcctcccaaagcgttgggattcaggcgtcagccaccgcagccggccatatttcaactcctctgaaatgaggtgtacactacgttatagttgatggtagcttagctgacaacattttcttgttcttagtgctatataaaaaacatgcacctgggccgggcgcggtggctcatgcctataatcccagcactttgggaggcaaggcaggcagatcacctgaggtcgggagttggagatccacgtgaccaacatggagaaacctgtctctactaaaaatacaaaaatattagctgggcatggtggcgcatgcctgtaatccagctactctggaggctgaggcaggagaattgcttgaacccgggaggcggaggctgcgggagccgagatcgtgccattgcactccagcctgggcgacaagagcgaaactcggtctgaaaaaaaaaaaaacatgcatcttacaacaataacttcttagattcaatggaatatggcagcggtgagaaccaagactcacatcagtccccgccccccccgcctcctggctccctacaccaatgagaggtaactaactggctcttaatcacctttaataatcttttagctttctctccatggccccattgaaaaaaagaaaacttgtaaccaaatgaattgaatgtattatatttcttccttttcactaattcaaagacatgcaaacctgcctaggagagcgtccattgacatctaatggtgttaaatattaagttgaataattaaagcaaaaaaatagctttaattagtttgtgcatattatgagagatgaacatatgatttccactgaatatgttgaaataaataaagttcatcctatcttcaagaactcttgggatccagctcaatttgggaagccccaggctccagcagggctgtgtgccctccagcatggaggctccaatcctacaggcctccttcctctgcccctgacccaggggctgcctggtcaccttgattctcagccctcacatactgctttggacattaactaaaagtatctaagagacaccatcttaagatcaagcatcttggctcttgcctcttgactgccaaacacccaaaaaaaccagcccaaaggccccccagcagctgcccccgggtgtactcatgcagacggaagatggcagtcagccagggacagcatccctggaaacggagagaacagggttagcttccaacatttgtgtctttgagaggcagatgtaaccattgtctttgacattaaaaaccatttaacctcctgttgtataaaaaacagtgcttttatcccatattcagcaagcatagcccagtacttcacaatatacaccacatgcctggaactcttgctaaaatctcctgacacttcgtggtcaaatcacaaaacttagatcaaaagctgatgaaagctcagggcagctctggcaaagtgatgtgggctgctgtttgattgtttacaatcactgaccaagaggtgaggcaaagagaggaaacaagcctaatggattggacggtccgctggagtgggtgttagggggaaaggtgtctgcaggttttattgtccttcacatctcttaaacttaatacccctaaagctgggcgttatccagctaggaaagacaaatatttgttcaataattcattcaacaatgactaaacactactatgcatcaggcgctgggaaacagggctggagagggcagggctcctgcccacatcggctcataatccagccagcaagtccataattaactgtcatacaaagccataggtgtaaggagagaagtgctggggaagcccaagggattccgtaccccttcctgcctgcaaattcatcagtctcaaggtcccgggtcatccagctgccatccctcctgtggtatttcccaagttcagtgccttcgtcgatgcagaaaagcactttctccagcacttgccgctcaagatccgccctgtccctccccaaaaccatgactgccagtccccaccccctggccatgaccacaactgggcctagataccaaccagctcattttcaaagtcttgttgacctgaggaggaagtcgatgacaactctgaaatctggactcgctagagacacaaaaagaaaaaaaatgacagataattcttagaaaaaaaaaaagccaaacaagtcaaaaagatcacatccagtattttgctgcctcttggactcagaaccaaagctaccagccctcgatggctgggacaaaatataactcactctgtgaagatagagacaaggacaatgaccattcccaggcatggtataaaactctatgttatacgggtgaatagcaaggggtcaacacccagaaaccacaccactgtgactcgtctagctaaactgcttcaaagtgttgcctatttatagcatatttccctatattatcaaataaaacttggaataatactacattttatcaaatctaagataccactggttgtaatttgcacaattattttataaacactaaagaaaaaatgctgccaaataaactatgaccacccatcaataacaagatgcttccaatttcagagatgagaaaatgtcaaaacatatgttttagagtggacaaatgatggactttatattgtggcattttaatcagatcctttcttgcgagtacccccataaaaacacccatgcgctataaatctgaggtgtttgcaatacgtatatgtgactgcttttcttcttttttttttttttttttttgagacagagtctggctctgtcacccaagctggaagtgcagtgggtgatcttggctcactgcaagctctgccacccgggttcaagcaattctctgcctcagtctccgagtagctgggcttacaggcacccgccaccatgcctggctaatttttgtatttttaaagagatggggtttcatcatcttggccaggctggtcttgaactcctgacctcatgatccaccccgcctcggcctcccaaagtgctgggattataggtgtgagccaacatgcctggctgtactccttttctctagtctcctattcctggttctactgcccccctactaaagacaaaacaatgacgaaacttaactttaaaagcctttgcagagacactgtcccttttgaccttcaccggacctcatggggaagagaggacagaaggagaccgaccctattaagtttggggccttgacaaggtcgcacagccagggatacagcagggccctctgatccccaggtggtcttttcaaccgagtacatggccccacttccagctgaatgtgccgtaaaggcatcagatgtcccaaaagttctctccaacagtccaaggtcatcatcacctcaggctttagcaaatcccagagcagggacacggggaaggatggtgcattttcaggtacacctcctcttcccagttcaaaggaccctgcgcacaggccacatgtcaggaggcgcccgagagtggagggtctgccagagcccctctgggctctgggtggcagctggggccagtccctgagttttcatcactcacttcctattaccactctgacacaagatcctgggtgcaaacagccagctggagctggaacgtcaggttgtgcagtccagaattcactgtcacccttcaggcgacatgaacagagaatcctggagccccacgcaaactggaaggacctgaagcctggccgagggagcctgtgctttgtaacagactcatccaacccggcgctgacctggcaggagggtggggcagttccctgatggctctgctgcccttgatctcactcagccctggccccaagctaattaatttcaaagatgatcacttaaaaatactcaggtgagaaagaaaatgggcatcctcttcagaggatgacgaaagccctcagtatctaaagaaccagtctgaagccaacaaggttcatagccttggcccaacagaagccctgagggagctagcatctgagcctgggtttttgtttttgttttttgttttgtgagcacaatgagggtagcaggctgacctcatgggtctgtggtgaagagcaaagagaacagctattggtacaggccagtagatacacttaatgaacacaatctcatagcagtgtcatgtgtgggtcctgcccacatgagggcttcataagcccctagcccattccagggacacacacacacacactatacacacattatgcacacacgcacatatacacactcacgcacatatacacactcacacgtacgcacaccatgctcacagcctaggcgatatgtctttacctgtctgcttctgacaccagggcaatgcgccatagtcccagaatcttcttcttataatagaaaacaccaagattaagaactaaaaacgaaaagaaaccaagtaaaagcatattggatggcttctcattagaagacacagcggtctcggggtaaagcccacctgcccgcactcagcagggctagaaggaaaacacccaggcccagaagggcactgaagtgcccaaggccatgcagctcagtagcccggatgctttgctcaccccctcaccaggctcctgtcacctgtgcccacgccaccaaggctgccagcgctgacgccaagctgcctggagcctgcctagttctgcacgtcagccctgtctcttgctctcaaggcagcggtacaccacaaggcccagtctcgggccctgctctgccttcagtggccccgagcaggagggtaggtctggccccagagcagccccaggaaccagcatccttcttcactttacagaaaattttttctttcggctcactgcaacttcccctcccgggttcaagcaattcttgtgcctcagccccagagtagctgggactacaggtgcccgccaccacacccagctaatttttgtattttagagagacagggtttcaccatattggtcaggctggtctcgaactcctgacctcaggtgatcacctgcctcagcctcccaaagtgctgggattacaggcgtgagccaccatgctggccagaaatttcattttaaattacagaaccaaggtagcagagcctcctcaggctgagccagaaacgtcagttttttcctctgagtttgattcccctgaaggcaggccccgcaggccctgcaatccccagcagagagcatgcatgcaggcagcaaggcaccacgagaacctgtgctcgggctggttggcctccgtaagctgggacacctcagcaagcttgtgtccaatggcaacctcagggctgactaagccgcttagctctagacatctgtacactctagactgtcctcactccccacagtcaccttggcaggctccatgccatgttcctgcctctcttccctccctagacagggtcccttctttgaggttcagggaggtagagaaatacatcttagtaagcacatccctgcctgctctatcagaaacgggggttttgaaggtaggctttgttttcctaaaggaaatccagaagacctaaccccagaggcactgagttctcgtggaattttcttcaggtgaatcaggaagttggtgaatattttcaaaggcaggtgagtcatgttgtaggaaaaccacgaaacctgctcagcaggtcctgccctctctgtccacagcggctgccgccctggcctgtgcagtgcagacacttcccaaaacccatgctctccagggccctctggctcttatgtgtcccccctcccccacccccaaacttactgcaataaaaatccacccctggccgggcaccatggctcactcctgtaatcccagactttgggaggccaaggctggtgaatcgcttgagctcaggagtttgagaccagcctaggaacatggtgtgaaatcccatctctaccaaaaatacaaaaataacccagacacggtggcagtgcttgtagtcccagctatgcaggaggctgaggtgggaggattgcttgagcccaggagaggaagtcgcagtgaattgtgattatgccactgtacttcagcctgggtgacagtgagacttgtctcaaaaaaaaaaaaaaaaaaaaaaaaaaaaaaaaaaaattcaccttcagcagcaaatagagggtgactctcttctcagccaacactgttgcaacaatacccacccagcccagcagggtccctgcccaggtccccctctctgtactcctcaccttggccaaactctccccacctgaagacccaaggccaccctcctctaatcccaccaattctgaaatccacccccacaccctgcccactcctccttgctaccctaagccaccctccccatgttccccacccgagcctagttccagctccaagcagtccaaggatgtttactccatcagagccatctgcccccttcactcgatggtctctgccacatgttaggagacagtatcaagaggcactggccagcccatggcattgtgaaaagaaggggcactttaaccccaataaatctcagccagccaacgttgagtctgctaaggaagaacaatgccatggggcatctttgtgaacaaggagatctacgttaaagaaagccacctgctgaaggtacgctctaagaatcagcttctaattcttttttttgttttttttttttttgagacagcgtctcgctcttgttgcacaggctggagtgcagtggcgtgatctcggtcattgcaactctgcctcccaggttcaagcaattctcctgcctcggcctccagagtagcgggattacaggcgccgaccaccacacccggctaattttttgtatttttagtagagacaggtttcaccatgttagccaggctggtctcgaactcctgacctcaggcaatctactcgcctagcctcccaaagtgctgagattacaggcatgagccaccgtacctggcccagcttctgatctttaaaaaccccagggatgccagaggggaacaggaggtgacacttgggaactgcagctctctattctagtccgtactctccagtcacatgtctcaaccccttgagatgacccttcccagggccttaaagatacgacaggctgagagctctgcaatcacggtagtaatcacaggcatgctatatgagtattctggccttatccaaattccaaaattctctgagataggaattatgactccatttccggagcagaaaggggaggtgcacagaagctaagtaacacgcctaagtcacgagctggtaagcagcagagttgagatttaaacccagctatgtctgacttctcatctaagttcccagaaggccctgggtggggcatttaaacaaataactgaggcagtgggacacgactatgagggctctcaccaggaagcagctgacgtctatgagcaggacagtggggatgccaccaaggtgaccccctggagcacggtgctgtttttggccgagttgtagcaataggagtcgttggccggtccccgagtcccagctgctccctgatggacactgccttggactgccacagctcaggaacggggagtccatcatcgcgcctgtcttccctggagcacaggacaacaggacaagcagacgttcagggctcaaatttcttgcaggttcccaccagtgctggcagagccaaaggcggcgtttcccagggactgatcgggcagtaagccagcagcaaggagtccgggagagccagcattggacctctgcgtgcctggcagtgtccacagagaatggctgcattgtgggacaatccaggggatcagatggtcagagtggatggctcatccagaacacagtgggcagatccccaggggggcgacatggagcaaaggagggacagagttgctgcagctgctgtcttaagaagtccaaagttcctctagcctcgaggactcgtgttgggaaagtcactcctgcagaagccactggggatctagagtacaggcagaggagagggagaaaggcacacaaaggcaggaagaggaaaaaccgggataaacaaccagggaagaagggaacatccaagtattcacgatggtccatccacagccacagacaacacctcactcccactgctcacagaatgtcagagctgggacctcagagtgggtccatctgctatacttggaaaccaagcctcagaggtttaataacttgccccaaagtaaggttaaggagctggtcagggcagaattgaatcccaaacccaatatcctgactctcaatgccacttctctttttactttgccacagaggagaaagtaaagggggtggtctagggtaggacggggagggagtcaggagtcccagggcctcctcagggacctctgggtcccctagcttgcgctttcacacacacatacccctcctgggtaccatcagtctaactgcaaggcccagctttccaaagcaaacactgctccaggctgggttgttgacctttccttcctgaggctcctgcgcccctggtgaagctaatagaaatctccagtgtctgtcccctgacaccagaggaccggagttagtgtccaagttctcatgctgtggctgaagggccagaacacatattcagcctggattgcttaagatcctacctgcccaaatctggtaaatctagaattcccaggggatttttctctaagtctggtgcttctagctgttacagggacaaagatcttgagaacaagaagaaaagaatagagaacccaaacagatgtttggataccagtagtgctggtgaggtgtgtatgttgggaacccctaggcctagagtgctggggacaatcacacatggacacctacctacctacctactacctacacacacacacacacacacacacacacacacacgaagcacaggaagcatgaatagtggaaagcccaagaacatgggagcatcccacagacagccaagtcactttctcaacctctaagagacttggcaatggctggaggtagtgggggttgtgatgccagagtcatggggctctgactctgaacagagtgtcacaagagtgacctctggaacacagatgttcttggcttcctttaaaatcccccagtggcaccacccaatggaacacaccagcccaacacttcaaggccacacctacccctcctccttcctgtccccacacttaccagacactaggggaaggaaggacttggatgggcccgttggagaggtcctcagttggagctgtctctggcaaaggcaaaagcagcccagccacctcccaagctgccaagggccaggcgtcgggcctaacactcatgtcctgcaggctttcctgaccagcgagtcctggggtaccaaactgtagactttcctgaaggatcacaacaccaagcatcacatgggagccacccttttccagtgtaggggtctggatggaaaccctcagcacacacctgtgtatgcatgctgcccatatggacctttaggttctgcccagtgggcccctcctgccttgatctctccccaaactcccagaactggttctccatccatcagtgctctctgtgcgaccctactcctccttcctcggccagcaccacctgtggccccagcctctctctctttgccaatggctcaaggacctgctgggtctaggggagcagccctctcccacagaaacctggaggttgtgggctcacggtagggccccaagcaaaggacttcacctgggccccaaggccaatgctactggggaggctccccagggttccccaagagctagaatcaggaaaagggacacagcagcatgaacaaggaaggcttgaaatgtgaagtggaaagaaaaaacatccccataaatgctcacagagagagcattgtccctggaaaggggagggtgctgtggtggtgctggggtggcataccctcgccagtgctgcagagaggagagaggcctctgcggagggaaacacctcggctcctcttccccctccctccagccccagtcatgcctctaagttacttgtctcttgcaaataggcttcccagggtggtttgacaaagtttgatatgaactcagggaggtggctagcaatactatcagcctgagacagaggtaaggtcaggtggccagtcctgtctgccctctccgtgagcacccaggttagggtagagctctggggacccacaatctctctcagacctttcagccagtcccagcctgtccctgcccattagacacataaagtccagatccccctgaaacagctcgtccctctggctctccatgggacagctcctctgcattttcacaaacaggcacgctctggcaggcagctgggaacacagacaccatgggacagtgctgccaggctgaggagaaggcaggggaggggagcacccagctggcagctgtatagaggaggccaaaccagcagctaggcacttggttgaagtggcactgcctggctgagaacccctggcaatattcagtcatcctagatgttgtgaatgcctagcacttacctgtgccttccagaaattctccattcatccccttattccactcaatatgccgagggtaggaaagccaagaattactgctgaggcccaagagccagagtggcagcaggtgacttcacgctcccaacccaaagttcaacccatgtgcaggcaagcgtctattgtggccagtgggagagggctaaatccaacagctggtctaaatttgccaaagtaaacacctatgctaatccactgccagtctccattggcagcaaggactggcctggtggtcaactgacaagctctagaaataccagcagaatgttgcaggaagtatatggatattgttcgttctgcaagaaggcccgtacaaattcagggtaattttatcatcaccaaatctttcaatcctgtatgacaatagcgaaactacaagcagctccaggccttctgcctcaggagctaactctggttttcagatgcagaataaggttgcaaagtaaagtacaaacttctccttatggcaacaccaacaggacccagtaacctggacaactgtttacctctaccctggagcacaaaggaaatgaccagcccctggctgaaaccagaggcagtgtggctcagggattatgtgagcaggctctggattaaggtctcagcaccacgcagttcagacaagcagcctaaccactctgtgccttggcttcttcgccaggaaatgcgagtgatgactttctctcacggagctgttgggaggcacagatccaaacaacacctgtaaagcacttagcccaggacccggccctagcaagcaattagaagcttctgcctttattttaagtcgcccctccagctaatgggaaacacaagggcaggatcccactgacgtcttctctgttagagcccaacgaacagctaggagagacctttgcccccacactaacaaaggagaggggcgtgtgaagggaaaaggagcctcggcttccgttcatatcccccttaaggcacagcagacttgaggatgacctgagaggtgtcaagggagggtcagtgggtccgcacgctgtccacccctgcccttgaagaggacaccacctgcctggggctgaatgaccaaggccctccagggcctcaggtagctagtcttatcaggtgctggaacctttgcggatttggttcttagcagagctcgcctcaccctttccgcccccgcccttccccccagtccccgagtcccagcctccctcctcaggactccgccaaggctgcaggaagtggtcacccaggaacagcccgggggtggcctctgccttcctggcgtcaggagagtcggacgcttggccctttcccagcccgcctcgtatagggtccgaggagcccatagctgcactcctagttaggtgggaggtcggacccgccgacaaatcccaaagagaggggtggggaagaaggagataccagccctgaaagcgaaagccggagaggaaagtcctgaaaagccgccaggaattcccaaggagcgcagggctggatggaggcgctgcccggaccctctcctcccacccaatcccgcgtcgtcaccccctgcttgggtcgggggctctggggtctgcgtaggctgggagccgttccggaaccggacacctggcggcacgtcccgggaaaggcggagggtgcattgcccctcctcacgccccctgtcccctgtactgcggcggcggcgtgtctggcgggacccagcagcgcggggcgtgttccgaccacttaaagttacaaagtgaaactccggcgcctcctgcacatgcgcagagctgcggccacccctttccaatttggagtcttggcccgcggcggcgcaagcctgtacgcagctgactgcgcctccccggtggccctcggcggtcctctgccccggcctggcctcctggtcgccgctcagccccgcgctcctcccggaggtctgcaagccccggaccggccagctcacgtccaggctccaagaaggatccgccggggcgcaccctcttccgtcccccggcacgagcccagtctctggacgcctcgggagaactgggccaagcacagggtggtcgcggcgcagggagagcatctgcaaacgttgtccctgtagtgctttgaatttccccgaagagctcttagacccgccccgggagagtggggtgcgggggtggtagcatggggagctcagcaggattcagcccgcacctcggctccgggtatcgggaaccgcgcggagcgccctgcaagaggccacggctcccccgccgctgtagaaggcggaccgtgaaagcccggagggtctccgttcgggcaaaaatgtgggggcgggtcgcagcattccaacgccccctggggctagtccattactgctcgagccagggccgccaagggcacctctccagcccaggtccgagagcgcggcatgcctcccggccgggagccaaatgtttccaggagccggtggcctccacaaccggaccgcaagctcgcgagggcagggccggcccgccgcgcagggactgctgggcgctgcgcgggaagcgaggctgggttcggggaggaccgcgcgccctggaatcaaggagcaaaccaacccgtccgcaggcccctgtttccctatctgtgaaatgagggttggaccaaagcttcctctcaggtcccttccagcacccctctctgagctctgagcagcctcaccccacatgcatgcctttgcaggttctccgacctcccttccatttctgagctttatctttttctgtaacggcataaaaatatcctccttatggccgggcgcggtggctcatgctgtaataccagcactttgggaggccgaggtgggcggatcaccttaggtctggagttcgaaccagcctgacccgcatggagaaaccccgtctctactaaaaatacaaaattagccgggttggtggcacatgcctgtaatcccagctactagggagtctgaggcaggagaatcgcttgacctgggaggcggaggttgcggtgagctgagatttcaccattgaactccagcctgggcaaaagagcgaaactctgtctcaaaaaaaaaaaaaaaaaaaaaaaaattcctccttacctcctgtccctgattctagcgccagtctgtggctgtccaggagtggggtggggagggtctcttctgcctctctcagttcttttctgtcccatctgtctttccccttctctccccaaagctctgccactagttattttccagggtttttcctctatgccccccgccagtatcatctctgccctgtccctccatagctgcgcctggccatcccccctccctgctctcttacctccacatctgcggtctgcagagtcctgggtgtggcccctggactccccgttggctccttagactgtcccgtccaatctttcttccactccccactcccgcacctgcctgtcctccttccttcctcaataatggtgcccccacctgtctggtctgtgccatgggtccaggcaagtgcaaggttccggtttggtaattagaatgctggagccactgacaaagatttcagagagagaaaggatttctaatttgttcttgagtaggttaaggttatttcaaaatcaagagaaggccttgatggatcgattgtgagttgagatagccacagcctttgttatgtcagttgtgtgaagtgcttgtaaaatcctattttattttttaatttttaattaattatttacttattgagacacagtctcactctgcgcccaggctgtagtacagtggtgtgatctcagctcactgcaacctccacctcctggctcaagcgattctcctgcctcagcctcccaagtagctgggattataggcatgtgccaccaccccggctaattttgtacttttagtagagacggggtttctctatgttggtcaggctggtccaaactcccaacctcaggtgatcctcaggattatagacgtgagccaccgcgcccagctgacagctcttacagctataaattccagatcctctgaagctttattttcttctctaagtatgatgataattttgatcacagattttattttgatgcaagtaggattggaataaagcccagcactatgcccaggaaagtcaaagtgtcaagaacaaaaaaatttcagtattggccgggcgggtggctcatgcctgtaatcccagcactttgggaggccgaggtgggcggatcacaaggtaggagatagagaccatcctggctaacatggtgaaaccccatctctactaaaaatacaaaaaattagccgggcgtggtggcgggcacctgtagtcccagctactcgggaggctaaggcagagaatggcgtgaacccatgaggcggagcttgcagtaagcggagatcgcgccactgcaccctgccactgtactccagcctgggcgactccgtctcaaaaaaaaaaaaaaagaaatttcgtatcaattctgggagggcaggtaccatagattctagaatcagaatgcattttattttttttattttatttttgagacagaatctcactctattgcccaggctggagtgcagtagtgtatctcagcttactgcaacctccgcctcttgggtttaagcgattctcatgcctcagcctccgagtggctggaattacaggcgcacaccaccatgcccagctaatttttgtatttttagtgaaatgcactctcaccatgttggccaggctggtcttgaactcctggcctcaagtgatcccccacctcggcctcccaaagtgctgggattacagaagtgagccatcgtgctggccctgaagcattttaatcctagtttcatgtattacctaaccaagatctttaccaagtcttggccactcaagctccttccttagttttacaatcaggttgacctaatcgctgtagaactttctgcccttcctcaatttgcagagctttgattaaaatggaaaattacagccgggcacagtggctgtgcctgtaatcccagccctttgggagactgaggctgccgaatgacttgaggtcaggagtccagaccagcctgggcaacatggcaaaaccccatctctactaaaaatacaaaaaattagccaggtgcagtggctcacgcctgtaatcccagcactttgggaggccgaggcaggcggacacgaggtcaggaggttgagaccatcctggttaacacagtgaaaccctgtctctactaaaaatacaaaaaattagccaggcatggtggcaggcacctgtagtcccagctactcgggagctgaggcaggagaatggtgtgaacccgggaggcagagcttgcagtgagccaacatagcgcatctgtactccagcctgggcgacagagctgtctcaataataataataataaaaatacaaaaattagcttggcgtggtggtacatgcctgtaatcccagttactcaagatgctgaggctgagaatcgcttgaacctggaaggcagaggctgcagtgagccgagattgggccactgcatcccgcctgggtgacagagtgagactctgtctcaaaaataattaattaattaaaataaatagaaaattacaaaattatagaataaaatgtgttttattcatgttttacaaagtctttatatctggattggggatgcacaacccacacttaaccccaggtcttaggtccagagtggtgtggaggactttagcccagatccagtgacaggacaagtaaacaatgacacattgggcttttgccctcaggttacagtatctccacatgtaagtgcttagaatatagtgcagtgaataatagaatagagaaaactgagcaagggctctccagtggccaaagattctcattcctgagaagaaaaattaggtgaggtaacttgtcagaggaagcaaattcagggctcactagagagcacaagcatttgtccatcagcagttcagtcatcgccagctctcctggtaccctcgaacacttcgaaacacacacaagtcaagtccctcgatggctacactaggcgcctatggctggagcctcttggcacgagcgcaccatccgaggcacagctgcacttctgcaccctcatgttgggcaggtgaccacctggggcctggtcctgcctccctccttgatgctgacgatcatgggcagcgagcagtctccgaggcgatgcactgtcgaggccccagaaacggccacttgaaggccagggccccgggggctgccggcaggtgcccacacactcataagccaggaagcccgggggctccagccccagttctcggcccacttcatcccctgcaggtcaatgtacatctcctggcggcagcaggggtgccctcggtcattggtgcttcagggtcacagtcgccctgagctctgtgtgggcaagagagcagggtcagcggtcagctgggagggctgaggtcagagggcgtctgggatggagattatgatccacctctcaacttcaaaaagctggatgtttgtgatataggatggacagctaaaataacttgaaaattaataaccgatatttactgaggatctcctaagagtcagaggaagattgtatacattgtctcattcattcccacagcactctgaaaagttgtccatttcaaaataatgtaattgcctgtctctttattccggcttaccagtttgaccctcagcacctacccatgtccccaaggtccagggtgtgcagctccagctggggctccccaagcccggctggcgcccctgcgaggcaaagcggaccagcttgtgggcgccggacgccagcgggcccagatgctcccctgcaccgacacctgtagcagcagcggctgccggggccggctcagctgctgccagaagtcacggcctcggtcacgtcgaaggccttccagccgctctcgtggacggacaccagcctgaacatgacacagagacccagcgccgcttgagggcggggactgggacgggccccgaggacccgcaccgccccccgcgtccccgcccccaagccgggcctagcagcgccctccccctacccgcgcgcccccgcgacccccacctggagtcgatgagggaggtgcggttggagccgtcgtccggacgcgcagccactcgacggtcacccgggcccgggcgctgcgcggggacagccgccctgcctgtgcagcgcggccttggggaccggctcctggaagagccgcagcacggcctgcacagctcgctgttgggcggcagccgctgctccatgccgaacaccagcaggtgtgtgctggctccaacgccaggaacctgccggccacctctggggacaagagcagggtcagcagggcctccccgactccaggggagctctgaggatggcagggccactgagctggcagccaggccaggaacaccggccctgttctatttctggggcaaacccagtttacaaatcttccttggatctggccttgtttagtaacaatttccatccagcaggcaggggcgcctgtgggaccctggctagcagtttgcctcagctgagatgctgggagcagaatcctcacccaggtgcctggcattgggttagctctgggcactgaggagctagggaggcgagaggctgcaggaggattcaggccggctcaggaggattcaggcccg

SEQ ID NO: 5060 - DNA, 37705 bp, Homo sapiens
atgtgacccacgctgaggctaagggaatctaagggaaacggatcacaatgacattaggatcagagctgctgacgtcattcctttcataggattcagaagtcaagactcaggaatggctatatactcagcaatttgggaactcaatatcattacataaagaaccagaaaccaagtgttaaattggcatctatttcttttccataatcgatgtgaagttctctaacagcctagcaggttcatgataattttaaaagataataaacatggctgggtatggcggctaatgcctataatccagcactttgacaggccgaggcaggaggatcccttgagcttaggagttccagattagccgggcaacacagcaagaccccgtctctacaaaaaacataatttttaaaaaagagaatcaaattgactgaattactcgtgaggcaggtaaggtatgaagtaacttctgtgcatcatctcattaatcctcacagtgaccagggagattctgttattcctcccagttcaccaacgaggaagtgacacttcagggactactgctcagggaccacagctagtgaaggcagacccatccaaagcgtgtctgcctgcccagagccctagctcacctaacaatggtcgacttggctgggcgtggtattcatgcctgtcattccagctactgctcagggaccacagctagtgaaggcagacccagatccaatgcatgtctgcctgcccagagccatagctcacctaacagtgattgacttggcgggcatagttgttcatgcctataattccagcactttgggagactgaggcaggaggactgttgagtcagagccagttcaacaccagcctgggcaacatagtgagaccccatctctttaaaaaaaaaaaaaaaaaaaaaaagaccagaccaactaatccacctggtttattatttttttagagggagtctcactctgtcgcccaggctggagtgcagtgatgagctcacttgacatgtatgagctttgacatcccaggctcaagcaatcctcccacctcagcctcccaagttgctggactgagtacaggcacaccccaccacacccaactaattgtagttttttttgtagagatgagtctcactatgttgcccaggatggtcctgaactcctgggctcaagtgaccctcctgcctggcctcccaaagggctggattacgagtgtgagccactatgcctggcctttgatgtccttcctttggtgagtaacactttgctgcagcctgccccagctgcagatctcagaattgtcccaggttcccagggtcacggagattgtcacaaatcaataataaaggcagtgaatgctgaagtgagtctttggatatgtcatcttaacatggtcaggcttggcaaaaatccctgaggaaacaaacaggtggtttacttgcctggtgtgggcacggggaatagtctgacttttcatttactatcaatcttgatatggtcttagttacataaaaatacaggaatacaggccaggtgtactgctcatgcctgtaatcccaacacttcgggaggccaaggcgggtggatcacctgaggtcagagtccgagaccagcctggccaacgtggcaaaacctcgtctctactaaaaacacaaagatagccaggcgtggtggcgcatgcctctagtcccagctacctgggaggctgaggcaggagatcgcttgaatctgggaggtggaggttgtggtgagccaagatcacgccactgcactccagctgggcgacacagtgagactccctctcaaaaagaaaaaaaaggaaaaaaaaaaccacgatacattctgattggcaaaattcaaacaacataaaattctaccagtaccactctcctcccctcaactgttctgttttggagtgtatccttttagaacttgttctatgcatctacctataatatgcacacctgtccatatgtaaatgtgttttacattccgtgtcatactctgtattatctgtaatcgacttatttacgcaacaatatatcttgaacttaccatgtcaatatgtttgagctacttttttcctttaactgctgtaggctatttttttttgagacagagtcccactctccactctgttgcccaggctggagtacaatggtgtaatgctggctcactgcaacctctgcccccgggtttaagcaattctcctgcctctcagcctcccaagtagctgggattacaggcaccgcaaccacacccggctaattttttgtatttttaatagagacgggattttgccatgttgccaggctggtctcgaactcctgacctcaggtgatccaccctcctcggcctcccaaagtgtgggattacagttgtgagccaccatgcccagcctctattttgtagtatgaatgtaccacgttcatttagctcttcccctatggactgttaaattatttgaatttttccctgttacaaagctgctgcaatgggtatccctgtaggactgtctgtccatgtgtctaaaaatttctctagataaatacctgtgagtgaaatggacaaatgatgtgcgtgcactattaacgttcacacagctctttcagtttattcacatcaggaactcataaatacctgttttcggctgggcgcagtgctcatgcctataatcccagcactttgggaggctgaggtgggcggatcacaaggtcaggatttgagaccagcctgaacaacatggtgaaaccccgtctctaataaaaatacaaaaattagccaggcacggtagctcatgcctgtaatcccagcatgttgggaggctgaggtgggcggacatgaggttaggagatcaagatcatcctggctaatacggtgaaaccctgtctctactaaaataacaaaaaaattagccgggcgtggtgacgggcgcctgtagtcccagctactcgggagctgaggcaggagaatggtgtgaacccgggaggcggaccttgcaatgagcggagatcacccactacactcccgcctgggcgacagatcgagacttcgtctcaaacaaacaaacaaaaacaaaaattagccaggcatggtggcgcatgcctgtaatcccagctactcaggaggctgagcaagagaattgcttgaacccaggaggtggaggttgcagtgaggcaagatcgcgccactgattccggcctgggcaacagagacactatctcaaaaacaaaaaacaaaacaaaacaaaactgttttccagctcaaacccttcttaaaagcgggtctatcatttgtttccatttgtcccatgtgatagaaaaaacagcatgccattattttaacttgccttttctctgattactagagagctaaacaccttactgactgactgcgatcttcttcagtgaattcctgtgctcctttaacgtcttgtttctacaacctgtgcccatcttcctaccaggtaggcttttaaaaaatagttttaggcttaaatatttaaaaaacaattattagcctgctatactgatttatctttcctttacactcattttaaaattcaaactacattcctaggaaaaagaatatgaatttcaaaacttgatgcatcaaagtaacaacccctttttcaaatacgctggctcagaagcactgtcttagggcatactctgcaaaacgaaggggctgtaggtgcagtgaacgcttgagtcacttccaaggctcacgctggaggtccagaagcctgggagctttagaatgggtacagccacttactggcgacgctctgtcctcagtctaatacaaaggagtaaaatggggtctgggactatctgggaaaagaaaaccctaagtggccttcttagtggaaaattctctccttatttaatgatctctacatataaaattatatatacattatataataatctacattatataatctctacattattaatcctaaagttttatggaaagaatttatgggaaaagagaaaaattggaaaaaggctaataacatattaaaaatggctttgagtacatgaaattgctgtggtatagatgaagttattcacatggtgtatcacatatccacaagtttctttttgaatcaccatgtttactggtagaggtgatatgataaccttttagtaagcttttttttttaagccaagcactaccctaaactctttatgataattatcaaatattcaatccctttgtagtctgctcccaagggactgtacagttttttgaatcttactagtattttgtcgtatatgattgctacaataaatgggctactgactgaagcaggagatgaatgaaatagtacttgtactgaaacatgatacaatcaaagatttaggatttttctaaaagatggtgcaggtaaaaagcctatccaccactgaaggcaatggaagggtataggcgtctgtgtgctgtgagagagcctccacttcggagtcacagatggccaaaagccatcagtagggctgaggaccttagaagtcctttacttctacttggatgtctgtggtgatgagacccactatacggaggccctacttatgtcgctggattctggggagtgtctgtctaaagctgacaggtgctgccagttcctatccatttctcccttattccctgccctcaaatctaaaaatagtaacataaggataagccaggaaatgatgaaagcaggtatgatgatgaagttcaagtgggttggccactgtaagcacacctgccccaagtgacaagcacaagttcaagatgggctgccactgtgagcacacctgccccaagtgacaagcacaagttcaagatgggctggccacttgagcacacctgccccaagtgacaagcacggtaaaaatgaataacactttcactgaagctggcgtgtggattagagggctgtagctagtgagaatatggttacttagcatgagtaatttaggtactttagtaatccaagtccccatcctaggatctaagagctctgagtgcagaggccagatccctgtgactcactgggttacagagacaagagatggttccccagaatctcctcttcagcagttcaaggattcagttttcatatcttaaaactcccatgtcaaaaacgtatgaaaacttatcttctcatatttagaccaaagactttgtaactgctaatcaacatcggagttaataaggttaagtcagattcagccaaatgaaggaacagactagaagacaaggttctctgttattgggctaaacggggcagtaaattgtggcttgtacctcgcttcttagatctgcttctgaataagcagtttattgacagttatcaccacattggcagaggttttgcaaaaatgaaggctcaatctttcagtaaacgctttcttaatttttaatctgacatagaaagttgaagaagtatctaaaaaatagaaggtttgaggaatagtggttcttcctagagaccataaagagccacacacaaatgatagtgaaaaacgggtttcaatttccattgaaaatactctaagatacacagtttgagaattatatttttctaattgtaacattttgaatttcatttcaatgctgctgtctaagacaagtatgagaaattaatcctaggtctccacaccttaagatacactgtgtaaggcaggcatggtggctcacgcctgtaatcccagcactttgggaggccgaggcaggaggatccctgaggtcacaagttcgacgtcagcctggccaacatggtgaaaccccacctctactaaaatacaaaaatcacccgggcatggtggcagacgcctgtaatcccagctactgcggaggcgaggcaagagaatcccttgaacccgagaggcggaggttgcagtgggccgagatcgcgccttgcactccagcctgggtgacagaacaagacaaaaaaaaaaaaagatacactgggtaatactaacccattattccttgtggcgttacgaggtcggaccaatccttgatatcctcaaattcaccttaatgaggctgacacctttcagcttatcgactggcaactcctttaggtattctgacggctaaagaagaacatttttggcacagctccagccttgagagcgtctgaaatgagctgcgaccttccagcaggatcttcccttgtttttcccgaaatggcctggactttactatttcattacactgctgtagatggaaataaaaaaaaaaacaggtaactatcaacatccttgtactgagacacgcttagttgtaacagaaataaagagctacggagagggccgggcgcggtgctcacgcctgtaatcccagcacattgggaggccgaggcgggcggatcacctgaggtcagagttccagatcagcctggccaacatggtgaaacaaaaacaacaacaaagagctaaggagaacagaagctaattccaaagacgcttattcggccctctgtgcataatacaaaaaccagcggctgtactggaagaagtcctccatcggaaggaggttaaggttccgctgtgcgacgggagggaaacgagaacattcgacaggctcaagaaccacatcacctcagcctcctgtccccggataagctttatcgtagcgaagcccagactcttcccaggtgctgggagcgcgggatgcggctcctcgagcggttgtttctctcgttgctcctgggcactggcctcagatggtgccttgcgggctgcttcccaggagcgcgcttctgttccaccacctctccggaaggaaacaccacttcactgggctccgccgcagcgcccggacccagcgcctcgcgtcaaggtcccaagcctggacacctgcagcaacggtcgcacgacaaacctcgcgggtctcaccagcgccgccatgttcctgagacccgggctgcgtcacgaaagcgcgccgtcggcggctagtgacgtcacggcccgtgcgcccttcgtggactgggctgtacggtgcgcgtgacggctgcgtgcggcgggaatcatgctgctcgcagagctctgcacttcgtattcaaagtgggaaaccgcttccagacggcgcgttctatcgggacgtcctggggatgaaggtgcaggccggggccgacaggggctggcgcgcaggctggaaccggcgcccgagccggccctggcggagggaggggaaaatgggtgtgtcgtaacctaagccggagggtgtccgaccttaggccctgcgcggtgttcagcttcaggagcgtgcgagttgccgttggggatcataggccttggagaagggcctaacacgattagtccccgcgtgtgcccacgcacgtcctttcatttaagccactcgtaaacgtttattgagccccgccctgtggagcttaccgtctaccggaaaagacggtaaataaaatgttatataatgctttctattaatatttgtgttttccggtttggagcctttgatgtagataaaatcagcgtattcagattctgcttctagcaaggctggtctgaatagtccgtttcggatactcagtctctgaatattgctccaactctcaacccatctgcttttcaacagcacccagaagcggtctgtctcgggtctgaggagctgttatttgcaggattcagttggttggggaactgggttttggggacctccttgataagccagggaggtagggaacacaccactaaggaagacttgaaaggtgcaagagccggtttagtgtatagacggtgcaatagacggggatctgaattcgtcaggtcatttttaaatatctgctattttcagggtactacgttgagttttggcaacaaaggtgcaaatgaccctatatatatcctccattagagctcatggcctgggttggggtgggagttggaactggattttacgtagatgatggtaatggaagtcagaatttgatagtgaaaaaccaccaaactttcgaagcagaaaccacagagctgtcccttgttagtatttcctcgtcgatcaaaaggttgttgcaagattaaacacgtgccggcgcggtggcccacgcctgtaatctcagcactttgggaggcaaggcgggtggatcactggaggtcaggagttggacaccagcctggccaacatggtgaaacctgtctctactaaaaatacaaaaattagccgggcatggtggcacacgcctgtaatcccgctactcgggaggctgaggcaagagaatcgcctgtatctgggaggcggaggttgcagtggccgagatcgcaccattgtgttccagcctggatgacgaaagcaaaactccgtctcaaaaaaaaaaaaaaaaaaagattcaacaccttattatatgtatagtatttaacatatcggtaaagtagattatataagtgttagccactattataaaaatacaaaagaaggagcggttttccacctgggtgatgaggaaataattcatgtagaccttgtattcgagttgactttttttttttttttttttttgaggtggagtcttgctctgtcgccaggctggagtgcagtggcgcgatccggctcactgtaagctcagcctcccgggttcacaccattctcctgcctcagcctcccgatagctgggaccacaggcgcgtaccacaacacccggctaatttttaaaaatatttttagtgagacggggtttcaccgtgttagccaggattcgagttgacgtctaaagataggatatcccaggtagatgagaggaggagctacatagtaaaactgaagagccagtgcggagatggcactgtttgcgaagccgctggttttatgtgcctttagttgaggttgcttagttgaagttaagagatgggatatcaggatggacaggtcggcattgcttctaatagtatcttgaatgctatgtaaagaatttggattttatgctgcagtaagatgggagctcacttatgttcttaaacaggtggtgatgggatcagtgctttgtgctttaggcatgtgcttttttggtgttattaaggaagatatcaataaggatttttttattttttattttttattttttttatgttgagacggagttcgctctttcgcccaggctggagtgcagtggcgcaatctcggctcactgcaagctccgctcctgggttcacaccattctcctgcctcagcctcccgagtagctggtactacaggcgccgccaccacgccctgcttattttttgtatttttagtagagatggggttttactgtgttagcaggatggtctcgatctcctgacctcatgatccacccacctcggcctcccaaagtgctggattacaggcgtgagccaccgcgcccggccaataaggatgatttttaatagtctgagcgagcgttgggaacttcaactggcaggagccgtgggaatcaaaaaggagggctaaagctaaacgttgagagcccgctgtgtgcagggttctgtgagatgctttcataacatccattcccacacatgttaggagactgagactcagattctaatttgctcagagttacacaactactaaagacagaattccaaatcagacttttttttttttttgagtttgagttttgctcttgtcaccaggctggagtgtaatggtgcaatctcagctcattgcaacctctgcctcccgtgttcaagaattctcctacctcagcctcctgagtagctgggattacaagcgcccaccaccatgcctgctaattttgtattttttatatttttagtagagatggggtttcactgtgttggctaggctgtctcgaactcccgacctcaggtgatctgcccacctcagcctcccaaagtgctgggattcaggcgtgagccacgatgcccatctttttttttttttttttttttttttttaatttgagtggaattttgctcttgtcacccaggctgtagtgcaggggcacgatctcggctcactgcacctccatctcatggtccaagtgattctcctgcctcaacctcctgagtagctgggatcacagcacacgccaccacgcctggctaatttttgtatttttagttgagacggggtttcactagtttgccaggttgatcttgaactcctgacctcaggcagtccacccaccttgatctcccaagtgctggtattataggcgtgagtcactgtgcccggcccaaatcagacttctttaatgcgaaggccacactttttcccactgcatagcactgcttaccaatctaaatagatttcacaatgatttggtagcctgacccttggtgtcaagctgttcgtccttccactgcttctatcctggagaagtgtaaagctcatttgcttttgttcttttacaagtaaagcttataaatgataattttgtgttttgacattttagtctgtgctaaagacgctgtgagcagtactagcaacacttacaatttattctaaatctcacaccaggttctgcggcatgaggaatttgaagaaggctgcaagctgcctgtaatgggtatgataccttgtttcttaaaatctcctttaggctctgactaacccggataacagaagacagtttctcaaagtgagtataaagcagtggaattaattaaggggcagtaaattagggaggcaacttcaggagcgtcgggaacacatactgtttctctgcacctcatgagtataaagcagtggaattaattaagaaggcagtaaattagggaggcaacttcggagcgtcgggaacacatttctctgcactctcatacaacacctgtgggacacaaagggatctccagctctctaacaccagccggctgtcctgttatttaattgattctgactctacctgagttaatgtcagatcctgcaagttaagggctcagtcccagaagattttccgccacgtcggcgccggtcacagtctggatcttcaggatttccgatgaccaactacaagtcagggctccgctcctgcttccttgggtttgatagtctgctacagtggctcatggaactaagggaaacctggaaacacttacttacatttactggtttatcataaagagtacgagtcagaaatggctgacagaggagatacacagggcagggcatggggagtgggtggcagagcttccatgctctttgggcaggctccaatccagcacctccctacgttcagcatcccagaagctcatgagtctcttgttcaagcctaatagagcccagtctccatccctttccttcccagaggttggtggatggactgaaagttcagtcctctaatcatttgtctttctggtgaccagccccatcctgagtcatgtagaggccccactctaagtcacttcattagcataaactcaggtgtgactgaaagggctcattatgaatataacaaaagatattcctatcaggaaattccagaggttttgggagcttgagacaggaaccagggacaatgaccagatatgtttcatattatgccacaaatgcaaatagtacatgctctagatgaagcagcggctttccagtatctttttttttttgagacagaattcactttgtcacccaggtgggagtgcggggtcattatcctggctcactgcaacctctgtttctgagttcaagcaattctcctccctcagcctccctagtacgtgggactatgggcatggccaccatgcccagctaatttttgtatttttagtagagacggggtttcaccatgttggcaggctggtctcgaactcctgacctcaggtgatcctcccgcctcggcctcccaaagtgctggattacaggcctgagccaccacgcccgtccatctcttaagcttagtaccgtgacaagtggaacagtccaaggcctattaggaatttcatgcttgttgattgatagtcaaggaaataaaggtcagttggagaactgtctttaggattctgttccttgctttacagaaaaggtgaacaatctttccttcaggtagatgctggatagtctttggagcttgtagtagggtcccatgagcctgcccacagctgctttctgtaccatctgaggtcatctcatccttaagagaacttttagaccagacaggaatgctcatctctctgtgcccagtagttctctgggggtggcctgaggctacttgtctgtagtcactgagttcatttacttttattttctaggccttatgatgggaaatgagtaaaacaatggtgggatttgggcctgaggatgatcattttgtcgcagaactgacttcaattatggcgtcggagactacaagcttggcaatgactttatggtaaataccgttttttctagcagagttttggctgggggtaggtggctggttgtaaatttgagtagagtgccaaggtgtgtgtgagtgaagagataacatttgagcagagactcaaaagaggtcagggagttagcacgtggatatctgggggatgcgcgttccaggcagagaatattctggcaagagccgtcagtaacatctggcgtgttcgaggaggtgtaaggaagccagtgtggctggaatagagaacgaaggggagcgtggtaagagatggggtcggcagtgccatggggtaagactgcagggggcctctaggccgtaagtcaccgagtgaaatgagccattggcggactttgagcaaagggaaaacaggctggctgcagtctgggggtggactataggatgcgttttggaaagtttactttggctcagagtgggtaatggatttacaagactggaggcagagaggccattataataaaccgagcagaaacaaggctggtcttctcaaagcacacgtgtacatttctaggcactttgattaaattaaggaaaccttgatagtttgcttatttttgttttgtttgttaaaaaagcaagaacaggcaccttaaataggttgctagctggcagacccaggtaacatcaagatttctgtggctagactttagaattagaagacgttatctttggtgttaaatgaatcagacttcactggcatttcatttctgtcctattattcacaaaggtctgaatgtttgtgggataaaacattgaaaaccttttttaaatcactagaagaaaatgttggatgccagttaaatcttaggtgattttacctaaggcagtaggcaataggggttgggctcattgtcttgttctgtaaaatatctgttgtgatatgtacttggatgtactgttgtttgttgtagggaatcacgctcgcttctagccaggctgcagcaacgccaggaagctggagtggccactgacggaagttgcagaaggtgtttttgaaacgaggccccgggaggatataagttctatttgcagaatcgcagtctgcctcagtcaggtattataccagaaccagtaaaagcctctgtctaaaggcatctttggtgaaaggagagtgaggctgcctgtcttttttttgtagagtctgtgttcacgtgacgtgtcttccccagccagtgttttacctgttatcggagagactacattctcatatcagaacttaaatacatagcagtagggatctagactagttctgttctactggtaatgtagtgatttatgattctttcatctgtaataacagaaaacccaactactttgaacagttatagaatcttttagctcacagagcaggcttctataggtgggaaagatttcaaggttagatgattcaccagctccccacattttctcttctacgttctgttgttctctgcgggtacctctcctagaactagtcccctcaaggttgcagagagctgccaggagcaggtggggccacatgctcccacaatcccatctggtaggagagggatgctgacttctttttgctttttttttttgagactctgtcagtccggctggagtgtacggcatgatctctgctcactgcaacctctgcctcccgggttcaagcaattctccttcctcgcctcccaagtagctgggattataggcgcccgccaccacgctcagctttttttttttttttttagtatttttattaacttttaaaaattatttgttttttgagacggagtcttgctcttcgcccaggctagagtgcagtgctgcaatctcggctcacttgcaacctccgcctcccagttcaagtgattctcctgcctcagcctctccagtagctgagattacaggcacatgccacccgcccagctcatttttgtatttttagtagagacagggtttcactatattgtccaggctgtcttgaacttctgacctcacttgatccgcctgcctcagcctcccaaagtgctggggtgaaggcgtgaaccaccgtgcccggccctttttgctttctttttaggagcagaagaaaaacttcctagaatcttccagcaaacttcctgttcagatttgatatactgtgcctgctcctaaacaatcactggcaagagaaataggatcacccccaaaccatttagccatgcctcctctggaccgaggtcagtttcccagacttgagcgtgggtactcagggatggcatggaagtgaggagccccacgctgactgccacacagaacaagaaggaaactttgcagggtttgttttgttgacgcagaggcagcctcatcagtgtttcattttgtatttaatgcctgcaaattcagctacctctctgacaaaacaaaagcaaaaacggggaaaatgctggcgaatggcaagggcacttgtgcgactcccttacttggtgaacgtatgcctgcaagtgggcctgagaagggagtcctggaattctccttcttcactggtcggcctcctgtccccgatgcccccatgctgagtctgtagaagttcagtgctccttgtttatcatccggtgctcagcaaaagaaagatccgtctgttccaggtgggaggctagacttggctgtgtgggactcgtggagagatggtgtttctctgcctcacggtgatttaaagggtgttgatggtgtttttttgttgataggtgattgatcctttgctgatttaaaacttaacgcttgcagctagctccaccatccattttttctctccagccttagtgtatttcagtgcttaaaataatagagagccccatggtgctaagaagcttttgttctttggatggaaatccccttgggcatttctggttgacaatgtggtcagaccttctgtccggctggattcatctttcctttgaattacccacttctgtgcagcttcacccacgcgttaacttccttcctgcgtcccttcaggctccaagtcaactgggatttgttgattttgaagtaaatggaagaaaaaaatggagcctgccaggcggaggcacttgtgagaaacagcgtcttaatcccaatttgctgttctagcaaacaggactaaggcagtaaagccaaagaaaaatgtactgaatttacgtagtcagatggagacgtggaacagctctttagaaagtcactttacaatgtgaaaagttccagtaacagtaggtgtttcaatatgacttttattctttttacaaaataatcaagtttttccttagacaagcagagaagctgaaaaaaaacacacacacccatgtacccagagagaacactgctgacattttagagtatatctttccaatcttttgtcaaaaatacgtatatataataagtgtatacatttctgtatatccttttttaggagttccatcgtattattacattgtagaagagaaacaattctctattgttggatatttatgtcgttcctagtgttttattgttctagcaacactggtgaatgtctttgtcgtaaaagcccttcatacatccacaattacctttgagtggctgaaaatggacttgttctttcaaaagcaatgagcactttttaaagcttttggtcattccatcaaactattgcccagaaatgtactgatttacacttgtattacatgattgtgttttcccctctacactaacacagttaacactgccaacttttaacattatttgcacattattaacaaaggattttatgtgaattctaatttctttgttgtttgggggcgtcgggttgaattttttttttttttttgagacagagtctcgctctgtcgcccaggctagagtgcagtggccgctctgggctcactgcaagctccgcctcccgggttcacgccattctcctgcctcagcccctgagtagctgggaccacaggcgcccgccagcacgcccggctaattttttgtatttttgtagagacggggtttcaccgtgttagccaggatggtctctatctcctgacctcatgatctgccacctcagcctcccaaagtgctgggattacaggcgtgagccaccgcgcccggcctgatattttttcgtatgttatttgaccattctaattccttgttttgtggattattgctttggccttttgcctatttttctagcatgttcattcttttcctattgatatttacaggtgattacatattaaggactttttgtccaatatattgcagttgttccccctactgtgttgtatacctagttttgattgtaattccttttcttggttgttgtctaggagttttccattttgtgtatttatgtagcagaagttttttcttcatagtttttctatctttggtgtcaggtttaaagaaaatcttcctctactccaaaattgtataaataatcatctgtatctagtattttcatggttcattctctaaacttatttttttaacccatcaggaatgtattttgtcatttatttcgaaatgtaagtttttcttaccaaatgattagccagtcttcttagcgccgtccattgaataataggcttttcatactgtctttgtttttttttttttttttttttcgagatagggtctcacttcacccaggctggagtgcagtagtgcagtcttggctcactgcagcctcaacctcccgggtcaagcgatcctcctgcttccatctctgaagtggctgggaatacacacatgagccaccagcctgtctaatcttttttttttttttttttttttttgagacagagttttgctcttgtctccaggctagagtgcaacggcgccatctcggctcactgcaacctccgcctcccaggttcagcaattctcctgtctcagcctcccgagtagctgggattacaggcgtgcgccaccacgccagctaattttttttattttttatttttagtagagacagggttttgccatgttggccaggtggtctcaaactcctgacctcaggtaatccacttgccttggcctcccaaagtgctgggatacaggcatcagccaccacacccagccaatttttttaaagttttcatacaggcaaggtccagtgttttacctgcattggtcttgaattcctaggctcacgcaatcctcctacctcagttcccaaagtgctggcattacaggcatgggccgctgcacccagcttcatactggcttaaatccctttcttatcataaactgaatttgtaagtatacatgcgcatgttttggtctttctatttattctattaaattgatctgtctattcctgctttattacccaacagatcctgtattaaagtaactctagcagtgtctgatcttcaaaagtccttgaactactggtgtaatctactggaatgaaaatttatgaaaaagatgaagaaaagcaaagggctttgctgggctatgctgataccaggtgagcaatcttggagaagaataacctgttactttgaatttggcttgtaaacgagcttataaatggcttataacctttataaatgaagttaacatgaaggttgttcccatagttcttcacagtgattcaatatttatatagataaacagaagaaaataagtgataaccttacacccagatattaccttgtttatatttggggatatatctcttcagaagtggaattgcttatccaagagattgaatggatttaatgcaagatctttttcatcttctttttctaataacccgcgtttgagcacgatttagtccttgcactttgaccctgcaattctactcctaggaattatttacagatgtgctcaacatacatcggcacaaagaagtgtgtgcaaggttatctgctgcgcattgtctgtaatcacaatgtgtaagaatttcagtgtcctatagattagagacatattcagtaatttacggctcattcatggaatggattactatgtcgctagcaaaaagattgaggaaatctttatgtattgacatggtaacattaagtggagaaaaacaaggaacagaataattgtaaattataccaccatttgtgtaaaaaaaaaaacatagatgcgtgcagtgcttctagaggatacacaggaaactgtggactagttgtctctggggtgagagtaggatagagactcagttttactttattcctttagtatataatatttgaatttttctaccacatacgtgtaatgatgtataacctgttccaaaaaataaccccctttcctatttcagtgtaagctggagctacaggcgtcaagggtggggtggaccatgcagcagcttttggaagaattgccttctcttgccccagaaagaggtaacgcttgataccagatcgtttgagctttctgactagctagttcaaccagctaagaactttgtccttcccttcttgaggtcctttttgattgtggctttagtatcaattcagcagttgtttcaagagcagctgagataataaattcaaacaaatggcgccttggtttttatggtatctgatactcctctaggactgacgagggccgtgtcctgagtagtgtgtgaccctggctcacgttgcctctgttttcctcaagttgccagacttagaagacttgatgaaagggagaaccagaagattctgactcccctggtgagcctggacaccccagggaaagcaacatacaggtggtcattctggccgaccctgtaagtatttctcaggcagggggcaggctggacaggggtttcttcaaggatgtctttggcaggtgtcttttctctttattggtgtaggacggcatgaaatttgctttgtcggggatgaagcatttcgagaactttctaagatggatccagaggaagcaaattgttggatgatgtgagtcccatttctacatttatgtcaccatgggcctggagggatggcattaagtgtgtgtgggaggagactaagcaacagggtccaggttcttaattcagaaccacgtcctttcgctgttgggttgacctcagccaaggaccgatgtcttcactgcacctgtgtagactgcttgtctagacttagcatttgtgccttaccacaacctcaggctgcctggaaccactgctggtggatctgtgcttattctgctctccacatggagatgcctctaccgaccccctcagctctccccatggagatgcctccatccgaccccctcagctctccccaggagatgcctccatccgaccccctcagctctctgcatggagatgcctccatctgacccctcagctctccccatggagatgcctctatccgttcccctcagctctcgccagggagatgctccatccgaccccctcagctctccccatggagatgcctccatccgttcccctcagctctcgcatggagatgcctccatcccatcccctcagctcttgccatggagatgcctccatccgtcccctcagctctccccatggagatgcctccatcccatcccctcagctctccccgtggaatgcctccatctgaccccctcagctctccccatggagatgcctccatccgttcccctcactctccccagggagatgcctccatctgatcccctcagctctgcagctcctttgatcatccttctccattctgcagcatcagtctcttctttccagtgagttattctcgccagcgtgcaacaggcgctgaaagctcccatcctttaaaaaccttttactgaccccatatctcctctccgatttctccttctaaaaatctgagtgcgcactgtttctctctctcacatcctctccagattcttcttctaaaaatctgagtgcgcgctgtttctctctctcacatcctctccagatttttctaaaaatctgagtgcgcgctgtttctctctctcacgtcctctccagatttcttctttaaaaatctgagtgcgcgctgtttctctctctcacatcctctccagatttcttctaaaatctgagtgtgcgctgtttctctctctcacgtcctctccagatttcttctaaaaatctgatgcgcgctgtttctctctcacgtcctctccagatttcttcctctaaaaatctgagtgcggctgtttctccctctcacgtcctctccagatttcttcttctaaaaatctgagtgcgcgcgtttctctctctcacgtcctctccagacttcttcttctaaaaatctgagtgcgcgctgttctctctctcacgtcctctccagatttcttctaaaaatctgagtgcgcgctgtttctcttctcacgtcctctccagatttcttctaaaaatctgagtgcgcgctgtttctccctcttagtcctctccagatttcttctaaaaatctgagcgcgcgctgtttctctctcttacgtccttccagatttcttcttctaaaaatctgagtgcgcgctgtttctctctctcacgtcctcttagatttcttcttctaaaaatctgagtgcgccctgtttctctctctcacatcctctccagtttcttctaaaaatctgagtgcgcgctgtttctctctcacacatcctctccagatttctcttctaaaaatctgagtgtgcgccgtttctctctctcacgtcctctccagatttcttctaaaatctgagtgcacgctgtttctctctcacacatcctctccagatttcttcttctaaaatctgagtgcgcgctgtttctctctctcacgtcctctccagatttcttcttctaaaaattgagtgcgcgctgtttctctctctcacgtcctctccagatttcttctaaaaatctgagtcgcgctgtttctctctcttacgtcctctccagattttttctaaaaatctgagtgcgcgcgtttctctctcttacgtcctctccagatttcttcttctaaaaatctgagtgcgcgctgttctctctcacatactctccagatttcttctaaaaatctgagtgcgcgctgtttctctcttcacatcctctccagatttcttctaaaaatctgagtgcgcgctgtttccctctcttacgcctctccagatttcttcttctaaaaatctgaatgcgcgctgtttctctctctcacgtccctccagatttcttcttctaaaaatctgagtgcgtgctgtttctctctctcacgtcctcttagatttcttcttctaaaaatctgagtgtgcgctgtttctctctcttacgtcctctccaatttcttctctaaaaatctgagtgcgcgctgtttctccctcttacgtcctctccagattcttcttctaaaaatctgagtgtgcactgtttctctttctcgcctcccattttcacttcatctgttttgcactggctcttgttactcagtgaagtgcttttgtttcttgccaaatatagaactacttttagattctcatcaaactcagtaattcagaagcattcaaagtagttgttggtcctagctcctagcacatacctggcatgtactagacgttctgcaaatactttgttgaatattaaaggaacaaattggtctttcttggttctgtcacgtaactctgtgactgaccttaacagttgacttaaattctttgaactttagtcttcttatccaaaaatttcagaaaataagagatctatctcataagattgttatggtttatagagcttggcaaattactgacataatagtgatgcacaattaacgttaaagcaggcaatgtatagaaaatacagtctttatacattttacctgaaggaaagtagaatctgtcatcctctcagctgacaaatttgccagactcttcctctcgctcttaatttaattaaattaattactgaattaaattttttgagatggagtctagcttgtcgcccagggtggagtgcaatggtgcaatcttgcctcactgcaaccttcgcctcccaggtcaagcgattcttctgcctcggcctcccaaggagctggaactacaggcacttgccacatgctggctaatttttgtatttttagtagagacagggttttgccaggttggccaggctgtctcaaactcctagcctcaagtgatctacccacctcatcctcctaaagtgctgggattaaggtgtgagccactgtgcctggcccattttattttatttattttttgagacggattcttctctgtcaactaggctggagtgcagtggcataatcttggctcactgcaacctccacctccgggatcaagcgattctcctgcctcagcctcccaagtagctgggattacaggcacgtgcaccacgcctggctaatttttgtatttttagtagagacggggcttcaccatgttggccagatggtcttgaactcctaacttcaggcgatccgtctgccttggcctcccaaagtgctgggttacaggcgtgagccaccacgcctgggcccattttattttttttaagacggggtctctcctgtcaccgaggctggagtgcagtggcatgatctcagctcactgcaacctccgcctccttgttccagtgatcctcccacctcagcctccctagtagctggaaccataggcgtgcgccacatgcctggctaatttttgtattttttctagagatggggtttcaccatgttgcccaggcggtttcaaacttcctgggctcaatcattcgatccatcttggcctcccaaagtgctgggatatagatgtgaaccattgatgaactcctgctccctgagctctcttctcctctgctgttacgatcctgccatttttcttttttttgagttgggagtctcactctcttgcccaggctggatgcagtggcgcgatctcaggtcactgcaacctctgcctcccaggttcaagcagttctctgcctcagcctcctgagtagctggtagctgggattacaggcacgcaccaccacacctggcaatttttgtatttttagtagagatggggtttcaccatgttggtcaggctggttgagtagccgggtgcggtggctcacacctgtaaccccagccctttgggaggccgaggcgggcggatacaaggtcaggagatcgagaccatcctggctaacacggtgaaaccctgtctcttgaactctgacctcaggtgatccaccctcctcggcctcccaaagggctgggattataggcgtgagcactgcgcctggccatcctaccattttcatcttcctgacagtttctcctcagacacgggacctctttctgtgtctcatcccaaagtgtttttatacccatagccctactttgctgttttcccattctgcattcttcctccactctgatgagagcttacctgcgacctctccttaccttgccctgaacgtaaccatcatcctggctccagcctcctcacttccagtttttaactcctcctcagctcagacaggtggttgttgttgatgaggcataatttaggtagaatttaaatgtttttgacggttgtgtttactcatacaaccactactcagaatacagaccattttcccaggagttccctcatgcccatctccagtgagttggcaccttcatctcccagatcagctgctatctgacttctgtcactgtaggtgagttcgttcttggacttcatacaaatggagtcattcatattttctttccttttgtgcctggctgcttttactcaccatggctttttttgttttttgtttttgtttttttttgagacggagtctcgctctgtcacccaggctggagtgcagtggtaaatctctgctcactgcaagctccgcctcccgggttcacgccattctcctgcctcagcctccgagtagctgggactacaggcacctgccacctcgcccggctaattttttgtatttttatagagacgggtttcaccgtgttagccaggatggtctcgatctcctgaccttgtgatccaccaccttggcctcccaaagggctgggattacaggtgtgagccaccgcgcccggcctactaacatggttttgagattccaccatgtaattgcatatcacagctcttttttttttaattgtgactgatactcaattttatgaatataacaatttgctcattcattcttataatggtggaatttggtttatttctagattttttaatctattataaggaagactgccatgaacattctatgtaaatcttcttgtagatagatgtttcatttctcttgagtaaatacctaggagtagaatgcttttactgtataagaaagtgtcaaacagtcatcgaaagtgatcggaccatcgtttgccacgagaggtccagtaggtctacattctcaccaacacttattttgctttttgtgggtttttagctattctagcacatgcgaaatggtttcattggtgcaatcaagcgatccttctgctcagccaccacatagctagggctgcagcactatgcccagctgatgttttttatgtttgtgagacagattctcactgtgttgcccaggctggcctccagtgatccttccagctcggcccacagaggtttaatttttatttccctgatgactaatgatattgagcaccttctcatgtgctattagccatttacttatttttgtgaattttatgttcaagtcttttgtccattctttaaaatttttaatatttcatgatgaaaattccaaatatgcacaaccgaagagagtacgacaggccttacgtgactcttaccttgactctgtactgtagtttttcatcattccttcgtcactgcaaattcaagtatttttcccagccattaattgagtttttgaagatgaggaattttttatttggtgaagtccagcttatgaactttttctcttacatgtagcactttctctgtccagacgatgttatatcctgagaacctcttcacctaggaaacctaccacatatcagactcagcggtccataacttatcttacctcaaatccattcttcttccagtaatattacataaaggctattgggagtgtagattctgggaaacctgaatctatgttcccgggctgcagtcttcaagctggcccagatgaactctctatttatactaaaaatatgtaaataaataaaaataaaaagaataaatgctactatatcggtacgttcttaagtgctttatttttatttatttatttatttttgagatggagcctcactctgttgcccaggctagagtgcagtggtgtgatctcagctcacgcagcctccgcctcccaggttcaagtgattctcctgcctcaggagagtagctgggattccgagtagctgggattacaggcacccgccaccatgtccagctaatttttgtatttttagtgagacagggtttcaccattttggctaggctggtctcgaactcttgacctcaggtgatcccctgcctcagcctcccaaagtgctgggattacagatgtgagccaccgcatccaaccttagtgcttcatatacattctctgattttttttttttttttttagacggagtctcgctctgtgcccaggctggagtgcagtggcgtgatctcggctcacggcaagctccgcctcccgggttacaccattctcctgcctcagcctcagcctcccgagtagctgggactacaggcgcccaccccacacctggctaatttttttgtatttttagtagagacggggtttcaccgtgttagccagatggtctcgatctcctgacctcgtgatccgcctgcctcggcctcccaaagtgttgggatacaggcgtgagccaccgcgcccagccacattctctgattcttaatataacctgcaaggtgatagcatcagcctttgcaaatgaggaaaccgaggctaagaatgagtaagtcattggcctcacccttgaataccatacactgagtaagtggcaggcaggggcctggatggtgatgaattattccccttcatccctgaagatcacgcactgagtaggtgcaggccggggcctggatgtgatgaaattattccccttcatccctgaagatcacacactgagtaggtgcaggcaggggctggatggtgatgaaataattattccccttcatccctgaagatcacgcactgagtaggtccggccggggcctggatggtgatgaaattattccccttcatccctgaagatcacgcactagtaggtgccggccggggcctggatggtgatgaaattattccccttcatccctgaagatacgcactgagtaggtgcaggccggggcctggatggaagcctttcaggctttacagttagcctttttcttcctctgcgccctgctccctccctggacagtacagcgtgtctgtgatcccgttgttcacgctggaatcctcagagccagttttggtgttattttgttgtgttttgtttttaacatttaatagtcgttttagatttacagacagtcacttttgaccattatttctcctctccttaaattattttagctattagtcaccaagagctgtgagttctacctctgaaatgtctctgcctatcagctttccctttgaaaggcctcattgtcaacttacggtctgtcccaaagaaacagccagtaatttttaaaaccgtttaatccgatagctctctcttgcctctgagataatttcaaactctctgacagagcatgtgacatttttggacattctctaccctctgacctttttcccacctgcctccctaagtcccctaactcatccctattccagtcccactgaactggtatattagctaagatacttcttcttgcatccaacccaaagggttttttccctctcctctttacttgtccttcaacacttaaaagctttcttaggttcagccgggcgcgatggctcaccctgtaatcccagcaccttgggggaccaaggcgggtggctcacctgaggtcaggagtcccgaccagcctgaccaacatggtgaaaccctgtctctactaaacacaaaaaattagccaggacggtggtgtacgcctgtaatcccagctacttgggaggctgaggcaggagaatcacttgacccagaaggcagaggttgcagtgagccgagatggcgccgttgcactccagcctgggcgcaagagcaaaactccatttcaaaaaagaaaaaaagctttcttaggttctccaaataattagttgttctttcctcccactttttatggctcctaaaagacagaaacgtgcatatttgtgcttgtggtttttttaagcatatctttgatttttaaattcttattttcatcaagataataatcagatagtactaagattttttagaaatgaaacggtccaactctgagtcacactacctggacagccactttcaccttcactgtttctaaataataaatatatttgtttcttctttttaattgccacctcatcttgtgacttcctgctgaggtagatattatagcaaatgcttcaagcacacacatgcgtacacacactctgtcatgcaaaatacttgtttccatatctgagttctagctgttctgcacactcctcaaagcttccgactgtctctgctgccacatctgaacccaggtggtacctggctctttttgactacataaatgagtgtttgtccttactaaacaacgaaaggatgcttgtggaaccaaaacattattgttaaggctttgtattattcatttatttttattgtatctgtatgtatatatatgagacggggtcccactctgttacacaggctgaactcgattcctgagctcacgtgatcctctggcctcagcctccaagtggctgtgactataggtgtgccactgggcacggcttaaggcttcctttttaattaagatgcccaaactaaacagaaccacatcagaagagtaggccgggaggagacttacgaaaaaggaatcattccaggcttcatcataaaacatcacgtagagtttcatatttggcctcactatcagactgagtttcatgacactaagattcttgagcgtctgcccagatgctgtgagtggcaggacttgctcttttaccagagtcctaccgcctggcatgcgggtccctgacctcgttggtccgccagccacacttcctggcacaggcttggtttgcccttgactctgccgagtgaggatccacagttgctcattatcaccgtatctcttgccttattgaacataacactctgtactggattaatactctttaaatgttaaaaattttttttatttctcttctcttttttttggagcgggggtttgggtcctttttttatgttaattttttttattgtggtcagtacagtgagatataaagtgggctatgtcttttgttttcaggcttggagtcagtgtatattctatttctattttacaggcaatggcagcagataaagtgacgagtggtttgccaaacacaataaacccaaagcttcaggttaacggaagacatatgcagagcaagcctctgtgattcctgcccagcacctgtgaggcctgacgtgtcagttccaataaatgctcttctgatttgtttcccgtacaggcaaggaggcttgggtagtgcagattgtgtatttcaatctttgaaagctctgatgtaatttagaaatgaaatccaatcatgagtcaggtagagaacgcctgctgtaatctacactgttgctgggactgcgcattctgtatatactgtgttggatgagtgacagatgattgtccagactaggacagcggcatgaacatgacttggttgggattgcggatagttagggttacctctgaatcgtgtagcttttatgagagcagcgtgcaagtgaatccacattaatgccttgtcgtggtgccattcccagcgcctgacgatacctcttctattgtcttattctggcaggttttgacgttttaaattttttaaagaaattttatccttggaccaaaaggtttggttaaccacccccctcttacttgctttcacattttgagttccagaggaaacagaaaggaatgagtgtgtgacgttgctgcacgcctgactctgtgcgacttctttctgtgtatatattttgttttatttttttccgtgtatatttttaatcccgacaaacatcatgtgagatttctttaaaatggattaaacgatttcttcagcctgaaaaaaaagttttgaaaatgttttcttgtagttttgtttggttctaaacaacaaataggttttaatcatcgaaatggaattatattgtgtattcattgaataaattttttttgaaagtaagcttctgaatcaagctgtgataccagtctctaagtctcatcatgtaaagtggtggccaggttcagattttaaaaataaacttaggagattggaagggattgactcagaggatcctggttcccaaaaacacatagagaattacttgtaaatcgtaacctctgctttcctcccttactggcagggctagggcatcgaaattttggttgtatttgagcttatcttcttataggggtgatgctattaaccttcacggagagaaataaattctcatccagctctacaacttttcattcagcttgaatccatatcctagggaagcagtcttgagtttcaaagcaaaccaagttatatatatggccctctctaggtaattggttctttttattttttattttttttttttgagacagagtttcgctctgttgcccaggctggagtgcaatggcgtgatcttggctcactgcaacctccgcctcccgtttcaagcgattctcctgcctcagcctcccaagtagctgggattacaggcatgcgccacacgtctggctaattttgtatttttagtagagatgggctttctccgtgttggttaggttgtctcgaactcccgacctcaggtgatccacctgcctcagcctgggattacaggtgtgagcaccgtgcccttctctttttttttatacatgtggaaattattatatgaactttgaataacaggtaaacttctgcttctctttagaatgtatgttaattttccaattttctattagattataagtaatttttaatgttcatctctagtaatattgtccttgtgaaaagaaactccttttccagtgtattgggctgctataatgtggccctcgaagtttgttgtagtaaaataagtggttatataagtaccgaataactaaataacacacacaggtttcccttttatctgcttatctttattttggcgtaccaaaacgtttttctcctaaatatacaactgtgcatgatagtgggcacatgcagggtgaacagtaatgctgtttgtctgcataggacattttggctttaggagatcgcctccttttatttatttcattgcctgtcatgtctcgctttgttgcgttttgtttttgctttgtttttgtttttttttaagacggagtttcactcttgttgcccaggctggagtgcaaggcgcaacctcggctcaccgcaacctctgcctcccgagtttgagcgattctcctgcctcgcctcccaagtagctgggattacaggcatgtgccaccacacatggctaattttgtattttagtagagacgggttttctccatgttggtcaggctggtcttgaacttctgacctcaggtatcagccacctcgtcctgttggcgttttttaacattttattcatcctaaagccctctaggtacaactttggctttttatcaaggcatccagaagcttgcttctgcacagttcagctaataattctaaaccaaaaaagagtaatttttaaaaattattatttaggccgggcgcggcggtcaagcctataatgccagcacgttgggaggctgaggcaggcggatcacctgaggtcggggctcgagaccagcctgaccaacacggagaaaccccatctctactaaaaatacaaaattaatgggtgtggtggtacctgcctgtaatcccagctactcaggaggccaaggcaggagaatccttgaacctgggaggcggaggtcgcggtgaagcgagatcacgctgtcgcactccagctggcaccaagagcgaaactccgtctcaaaaaaaaaaaaattatttagacgcccattagatcgcaaaaactaattttaaacaaaagtgattagtttcccacatctgggggatatgatcaatagaaaatggcatgaggaagatagctttgcccaagctggtgtttcatttttggtttttggacattgctctatcacgcagggtggagtgcagtggggcaccatcgtggctttctgcagcttgacctctggggctcaagagatcctcccacctcagcctcccgaatggctgggcccacaccacgtgccaccacacccagccaacgttttgatcttttgtagcgaccgtctcactgcgtgttcaggctgcaagctgttgtttcaaacagatgaagttggaaagttcttcagcttctccgagttgtttttttgaatcaaggggttgtggagcctacatgtaaatacaagtgtgccttggttaaatctccgggaagacttagaacggccgtgttgccagagctctcctagttagcctgaggactgtctgaagtccgtgtccgtctgacatgttaccggaattaacaaacctagggacgtgagtgctccttcatgtggctttctggctctctcacctgccactcagtgccgctgtgattagcagccagagttttcaggagacctccaacgtgtccgttgaaattcagggtaagagtgagaagtttccctgtttgttctaagagttcttaccccaacctcaggggaaatcaatagtaatttactctgacttcaatgataataaagaagtgcccttgcctcatcctctttatataagcaatagagccacatggttcaaaaatgaaaacaatatgaaaaggtattgtaaaccgggtagtgtctgagacaagtctcgcccatttagaggtttattttgccaaggctgaggatgtgctgagacacaaccacagatctgtggcccccgcacactttccagagaggatttttagggcccagtatgtgggatatgacgacgtttctcttcaaataatctgatcaatcttttattctttattcatagcgccccgccccctttttctccttttccctttttgcctttgtgagatgcccagcacgccacagcaccaggcgttatcagtaccagctcacattcctttccttatttggaaaaggactaactttctagctcattacagacaccccttccccttcctctccgctttcttttagggcccaccctatctaaaaaaatcaaatgtttagccaagcgcgattagtttagattgtagacctgaccccggccaatggggaaagggtagaggggcaggacttgtgtcaggaacaaagctctcgtgcccctttgttcaggtgtgctctcatgacaactggccaaggaggcacccctcgcacagaagtaaaattgctttgctaagaatcctttgttcgagtgttctatttccttaggttttgagcattattcctaacaagtatttaaaagggaaagagcaggaagggagggaagaggaaaggaaaaatacaggagggtaggtagggagataagtggttacattcttattaggcttgatcagcgctcaccaaatctacatgtcacagtgaaaggagggggtagaggaacagtcagtttgcattcagctcagtaaatctacatttagcactcaccaaatctacatgttacagtgaaggagcaggcagaggaacagtcagttttgcattcagctcagtaaatctacatttagtgccaccaaatctacatgttacagtgaaaggagcgggcagaggaacagttacgcattcagctagtaagtctacatttagcactcaccaaatctacatgttacagtgaaaggagcaggcagagaacagtcagttttgcattcagctcagtaaatctacatttagcgctcaccaactctacagttacagtgaaaggagcgggcagaggaacactcagttatgcattcagctcagtaaatctcatttagtgctcaccaaatctacatgttacagtgaaaggagcgggcagacgaacagtcattatgcattcagctcagtaaatctacatttagcgctcaccaaatctacatgttacagtgaaggagcgggcagaggaacagttatgcattcagctcagtaaatctacatttactgctcacaaatctatatgttacagtgaaagcagcaggcagaggaacagttatgcattcagctcagacatctatgttttgtctcggctggtgagggatggtttctggtgttgtctttgtcccttactatgaagataagctgttaatttatattgtcaggtgagggagaccacctggggagatattggccttctgtcttgtagcttatctgtttaggaacaaaaggaagttttttgcatattcctgactcaatttccaagcttaacttttccttttcgcttagtgaatttggtcccaagatttattttcctttcacagtataccccatgcccatcaatcccattccccctgcatcctataggaacctcttcttaagcaaatacaaatagataaatccttattttctgtttttttttttaaactttattttactgttactttctgctgtcctaattatggcacatttttactttctaggtttgtgatttacagagtggtctggctatgtggacagcttctaaattgtcaccacattttgggcaagatgtattatttttacaattaatttacatttaacatgaatcatgatcctaagtgctcagaatgtcttcataacattcgccaaagaagagagggcagcactgctgttctacagtgggctctcacctggtccacagttaccagaaatagttctttcgttgctgtgatgtcctggggggcttcattctttagtaatgtactttgtctacagcaacttcctgcaactatgtgaacaatcttgaagacacacagtgaggtttggtttcctttgtcctcttaagtctttatggttgtgcttctattgtttattggtcccagtgagaactgcagctgacctgatgtcatgatctgtgagatagtttctattaaagaagaagtaccaggaaatcccatatgccaccgtagacctgccttctggataccatttactactccatactccagccgccatgcacaatggttgtgtatgagctcctgtgatcattaacaggagtagaagctgggctcagacactctggcacttgcataggcaaggggtgtgttgtgctcttgcaacaaatcccacatagacatccatatgcatattgtccaccgtcccctaagcagaaaccagggttaagtacagaatagtcccgggaacattttggtgcccggccttaggtgagcctttctggggctgggattttgacaccatctgctccattgttctaaactgctgtgttctggcgcatcaattgtttcatcacattatcatcacggaaagcttgtctccctcaaaacatgaaccgggtaggccctgtgttccagtgggggcttttggacttgctttagtgtttaggaggacagagtccctctcccctctgtggtgctggggtattagtaaacagccttgaagagataaggggctggggcctcaacctcccaagaggctgtcactggagaaggtctcctgccctcagatcttgggcatttccacagcacactgtccccctcgtccttccaatacctacatacgctcttgtaataggagagctgggaactccacccaaaaccatacaaaagttagtctgtgtatttggacgcctccccagcactcagtcaccgagtttctcctttccaaagcagtcactctcatgcagtttaagtgatttattgatgtctcggctaagcttgcgacagttcaggacatttcagccatcaaggtctaagaagccctttccattcccgaggagccctcaccagcctccttcttcctcatctcctcactctggccgcgtagcccctcatggcgtccatctggacgcccctttgttcgcgctccacgccccccacttccttcttcgtcagctcctccacttggccgcgtagcccctcatggcgtccatcttggacgcccctttgttcgcgctccacgcccccacttccttcttcgtcagctcctccactttggccgcgtagcccctcatggcgtccacttggacgcccctttgttcgcgctccacgccccccacttccttcttcgtcagctcctccctttggccgcgtagcccctcatggcgtccatcttgcacgcccctttgttcgcgctccacccccccacttccttcttcgtcagctcctccactttggccgcgtagcccctcatggcgtcatcttggacgccccttttttcgcgctccaagcctcccacttggccctggctctcacgtcgaggccggagggccggggatgtcgcagtcgccctgggtggcctgtttgtacaagccgtaaccagcagcttctcctgatcgctcacgggacccttcagctgcttgagggccgcgcagctgaactccacttggcacatggggtggtggaggcggtccctggtgctagaagctggaggtgagagttggagtggctgttactactcgatctcagggggaggagacaggcacgcgatgttttgttttgtcaagcacagattgcaagctcggggtccagcgtaaaccccaccatgtttgggtcacacggcgcattttctggggaggaccagccgtcaaaaagcgtctaggatccggaacgtgctgtctggagggggcggcgcggcaggagcgcgttgagggactgtatgtggcgcgagcgggcgggtgggagtggaagcctcgcgtggtgcggccgcgctgggtggtgggcgtcccggggaggcgctcggtgggggtgaactgtgtgcggggcacgcccggggttaccgggtgaggggaatgcggggccggggaatcatgagcccgacccgctgggaccccggaagaggggccgggaggggacggtgcggaggggtctagtgagcgacgtccgggtacctgagggctggtgggaggctctgccggaaggcggcgctgtgcgcttggcgcgctcgttcgtgaggactgcgcgtgccggcggaggctgtgggcggggccgggcggaggttgtgagcaggcctaagcgcggccgcctggctcctgcgtctcccatcgtgccgtgcgtcccgcgccgcgttcgagttctcggagggagggggcgttagccccgcgcagccgccggcgtcgccgccatggacctaggtgggtgccgggctccccggccccgggctgcgtccagcaatgcgccaccagagcggtgctgccccgtcggtctcctcctgtcgcgcacgctcgcgcgggcccggaccgaaacgtcccccgcgtcgggggggtctaggggtcccggggtggccttggcggggggtggtccgggtcccgccgcgcgttggccgcgtcttgccgcctccggccccctgcgcttgaaaacacggagcagacgtgaagttaagcccttggaagcgcccggggctcgcgcacgtgctttgggaaacgggctccctccgagccccctgggcgccccgacggcctcatttcctgaacggcagctgcgttcttgagcaagtgtttaacgctccaagtgtcttacgctcatgacgtttcctcatcgacagagcggggagaatgaagtgtgtctccccactgagttttgggcgactttgcattgagatcgccgaggtacagtgcccttgtggggttgcgcgggtcacacccgcggtgggggcggctgcgctcctgaggtatcctttgtgaacctgcgtgcgtccggattcagaatcttacaggcaaggtctgggagggagccataggaactagatgctccctgctaaatcttggcacacgctgctaagaccaggaggctgtctgggagagctgggggtgaggcaccccgagatgtgtcagcagtagtaggctggggggaatggtctggtccccgcccccagacagcttttcaggagcggaatggcagagctctaagggttggagcccctcagccgtaattgcttcccagccccaccacattcaggctgggacaccctagcaaatcgtttctgcgcctcagtgtccttatctctagagcaggaatactagtcctcaaaggtgattgtgaatagaagagatcttacctgtgtaccacctagcacagtgtctggcatgagtaggtgcttaataaacctaagaagcgggctgtggcaagcactagttaaccatccatgtaga

SEQ ID NO: 5061 - DNA, 21791 bp, Homo sapiens
ggcgaagtgggtggcatgataatccccgccaagcagctccaccttcagattcttgttgcaattggaagcaggttcagcaccagctgtggcatattcaagggcttcctccggcagccagaaaaccaggccctgcaggtggaggctgggggcggctgtgaaaacgccactctgtggttccagatttgtgtttaccacagtgacttccagatcccatccattcatcctcacaacagcgagagggtttttttttttttttttttttgagacagagtctcgctctgtcgccccggctagatgcagtggcacgatcccagctcacaggttcaagccattctcctgcctcagtctcccaagagctgagattacaagcgacaccaccgcgcctgactaatttttgtatttttagtagagacgggtttcgccatgttggccaggctggtctcgaactcctgacctcaggtgatctgcctgcttggcctcccacagtgctgggattccaggcgtgcgccggcacagccagcctgttgttgtgttttttttaacctgtcttcccaacattaaaagcctgttgaagaaaaagggtatgttttcacattgaattcctaattgggaaaaaaaatactaaaaaaagagaaaagggtatgtttggaccagcacatacagcagatgaaaaccagcttcttttccagagcgaggtgacttcctgctttgcttttcgccccttggtacgtccttgaaatcaatggccatcacttaccagaacgcaggagcgagtgctgtgttggcatcggccaagcttcaaatagtaattttcagccagactttgtttttcctgttgcctaattaaagacactgaaaagctgttctcccctcctgctgccttgtctaggacagcaaactgaattcaggaacaatacagacggagccggatgtggcccaggagcgatgcgcgggacctaacacggtgttgccccgtgcagcttagggaggaaatgcaatgtatagaggacacacgtctgggaaccctgcacactgggaagcgtagtaccgggagggccctgacgagggcacacgctgttgacggtgccgttgccctgggcaggcccatgtgttgtgcgcgcgtgggtggctgtgcacacaggcccgcaggttcaggagtagcactgagcagggggctgtggctcaaaggatctttccagtttgccccgaagcagctgaatgagagaagtgggcacttggtacacccctcactgctgccgccagcagacgagggcacacgccctgcttcctccaggctgggctgcgcaagggaaaattctttgggaacaaatagctgttgaccagtagcttcattagtctgggaatataacatgagggcgttctaggtacacctcgtatgtgagcgcatgaagacagtaagtatgcctactgccatttttcaaggcgtgtgtctcacccccttggtgctttgggaccttcccaagcccgagaatgtgtcaggaggtttgggtggaactgttgggtttctgttaaagatacacaactcgtgaaagactctgtccccaggtctgtaggccagtgtgcaatccagagcagagacggcctccagtccggattccgggtgcttatgcctcactcacatgaggaagtcaccacaggtgctagaatgacgacacagtaggagacgtgatctcagggccaaaaagtccattctcgaatgtcagaggacatggaggtcctacttggcaggcttgcagtgagtacgccccgcctcggcatctcagaggagcagggaagggaggctgaggccggagcttgctgcagccgtcgctcctccctccccagccttgttccctgttcccttcctgcatttcttttttttttttttaagacaagagtttcacttttgtcacccaggctggagtgcagtggcacgatctgactcacgcaacctccgcctcccacattcaagcaagtctcctgtctcagcctcccaagtagctgggctacaggcgcacgccaccacgccgggctaatgtttgtatttttagtagagacagggtgtgccatgtttgccaggctgatctcaaactcctgacctcgtgatccgcccgccttggcctccaaagtgctgggattacaggcgtgagccaccgcacgcggcccccttcgtgccttttgagaagcagcagccttggtcatggcccataagaactcagacttcaactgaaaaaagtggctctccctacacaacagtccaggaagctggatattgggagtgtggtgagacgagaactgaccatccataagctattctggattctctgtcactctcagccgtggagcatcaagcaggcttctgaagcttcgggaggacctggcttcagctgctgtctcagctgctcgaatgtaacatggtccgtagttgagacttcagtcatcctgagcaataaaccagctcatccactaacttggctctagcttattacatgtgtgcactccctgcactgatgaaaacaggaaacatggcgggcgcagggctcacgcctggcatcccagcactttcgaggctgaagcaggaggatagcttgaggccggagttcaagactagcctaggcaacgtggcaaaaccccatctaaaaaaaaaaaaagaaacagaggaaacacaatcatggaatttttaaggtggcaacatgttttcttaaaaacaggtggcctgtcagctctgctcctgagggagaggtagcttggtcaagagggcagccccaggcccgcagtacagctggtgattttcagcccagagccctggaaccttggatggggagtgtgtgtagggctgtgcgtggtagaatggcaaaagtggggctaagtgtggcccagcgtggctggtgggacatctggggttgctgtcaaccccggggcaagcagcggaaggtcccaggtgaacggcggtccccagaggtctgtttctcctctggaccttaatgaccaggctcccagccaggagccgcggctggggcgaggggagagtgatttcagcgctctctgccccgaagcaggaaccgaaggccagccggtgggcacccagcgtgagctccaggcacatctggacacctatgctttgcccgagttgcttttctcagaggctgcagtcacagggaaaagttgtgacggtctttcctgctattcccgttcgtcctctttcgcctccgtttttgttcccatgtcttcctgtactccgggtttttcttctgaggtggtctgggacaatctggatgggtctccggctttaacaccccggagccagacagcttgcaaaatgctctctggtggagggagacttcactccatcctcttttcctccttttcaacgatttaaatccaggaaaaaatcgcagccccgcccttcagcactggggtggtttggaggtgtcgcctgccacctcctggcagacgccactgtgacagctacgccaccacaaaaggcgcgggagcgtggccaacatcctgacaatgttcgtctctcggccaagcagtgtttccttgtcaaatgtggctcgttttttattcctgtttactggggaaatggtgacagaacaatgtcagactcaaaactgagaattcaaggtagtgattttccagaatcactcagcaaatacaaccatctgttcccctgtattcactgaagaaaggacaatttgcctccctcctgcacccccctcgtccctactaaattatacccatgaatatataaagtgaactgaaggcaccgtggctataagccacggactctaaagcaaagggatgtaaatttcttttccctctcacacccaggtaaaatgggcttagaattacttgtcagtgttggccgggcactgtggctcacgcctgtaacccagcactttgggaggccgaggcgggtggatcacgaggtcaggagatcaagaccatccggctaacatggtgaaaccccgtctctactaaaaatacaaaaaattagccgggcgcagtgctcacgcctgtaatcccagcactttgggaggccaaggcggcggatcacaaggtcaggagtcgagaccgtcctggctaacacggtgaaatcctttcttcactaaaaaaacacacaaaatagccaggcttggtggcaggtgctactcgggaggctgaggcaggagaatggcgggaacccggaggcagagcttgcagtgagccgagatcgcgccactgcactccagcctgggcgacagatgagattccgtctcaaaaaaaaaaaaaaaaattactttccagtgtttacattgcttttttaaacaaggacaaggtaatacatggtttattctttcactgttattttgtaacgagtcaggggagtataacccggggaacaaatcccacgagattggttttaggctggaaagatgtgagttccttttcgtgactcctgctgcttgagcactgtcctgaggtgtctggggagactggaggggatggatttgcattctccaggccgcctttccgcctgtcctctctgcaccagcctttggagcagtgttggggggacacttgcattgcccattcatgtggagctctgggcaggcccagccacagtggggctccagagcagatgttcaaatattcagatgtcagcctgggaggacacttccctgcaaacacccctcccccaggggagagcaatcccaacctgccccttggcacgtgatcatgcttggtcatttggttttactaggaagagggagtttgactaggaagttgggggagagaagagaaagaaggtttctcctgggcacaccagcaacacacttgacctccctggagtggcagtgtccaaaccattacgggagccgctgggcagaggggtgtggggaaacgcttcctggttgtcttcaactccaactctgtgtggctgcaaaagcagtgctttttttttttttttttagacggagtctcgctctgtcgcccaggctggcgtgcagtggcgcgatctcggctcactgaagctccgcctcccgggttcacgccattctcctgcctcagcctcccgagtagcacctgcaccacgcctggctaattttgtgtatttttttagtgaagacaggatttcaccgtgttagcaggacggtctcgatctcctgaccttgtgatccgccgccttggcctcccaaagtgctgggttacaggcgtgagccactgtgcccggcctcccgaggtgctgggattacaggcgtgagccctgcgcccggcctcccgaggtgctgggattacaggcgtgagccaccgcacctggccagcgtgcttaagagtcccatattccacccacccaccccatccccacagttccttatagatacttgatgaccatcagcacttgccctgacaccctggctacatcctggtttggccgctagtagtaaagatccagcttgccctgggccctggaggggctgagagaacagaagggtcctgccgtgtattgtgggcgttcattctcagaaccttggcctctaaacattgggggatgagacgtagtaggactaacacagggaaccaggaaacagtgacactttcctgacacatgcagggtgagctgccgattttgaaattcagttttccgcatagacttccgtctctgcaaagtcctcaaaaggtatctgcagaggtgccaagaaggtctgacatggcctgttgaattaagccgtttctatgatacataaacagtggctcagtgaagccctgaacaatctcaaagacagaccatctgagccagagcagagctgctggatgccatgagcgtagccctcagcttcctggtgttcccttagcacgtcctcgttaccaggccaaacgtgacaggtactgtgacacaccaacgacacaaaacacttactaacgtaatctgctgctcatagtttattttccaccaaccagtgatcagctgtgatgatgtggctgtgacctatagctggtgcttggcgattacaaacacccaccagctggtgggcaggcgcctccctgccaggatgatgcttcaggaactttctgggcacaaagtgcttcttgtggacaatttttaaaaacacacagagccacgtgggtcacctattgtcaccaagagaaaaagaacctcaaaatcagtgacgcgacaggaagaattcggacctgttctttctgaggaagtcttatttttcctgtaactgtatgacggcatcacaccttcctcctgaacgtgggggccaagtcactgactccgccagcctcccaccagtgtgctggtgtaggaggagctgcagacgtctcaagcagaagtcacttctgcgtcctcagtggtaactcctgtccctgctcaagtcctccccctcccccgcagctgtcttttcccttcgaaaagcaggatgcttgccgccatggccgagtgaggctgtccacaccaggcacaacggggatcagcagcctcttgccaccagtgctctcgccagctgcagggactccaggctcacgccgtaggtctccccgccaatcaccacagctgccgcgcctctgtccagtccgagtcgtaactctgaacctcaacatgaggcagccaatcttgatggctccggtttctacatcttcctcttcctcatacttgtgaaacttcatcactcgttgacacacacccagccatggtcactagctttattagacatctcagcctgggcataaaggccaagttgtcagccacatagacccgagtgtcagggggcaggtaattgggcacggtttcccatccagattattgataatgggcatccggaaatgtgcgcccatacccgcccggagcactttggctcccaggcatccacacagcctggaaaataaaaaggaaacaatcaagatgttacaaatttcccagaccaggggactgtggagtaagtctgatcaattttggatcaggagataaaccattcttctatgatagctttcttgagggatgggaccttctgcctctctctgacagcatccacacagcgactataggagtcactcctgctagtgctgaagatattttatgcatcccttcaaatctcccattcacacgtgccagacactgcgcagaagatgcaaagataatgaaagtccccaccccaaggaacgcacagtgtagtggggtggtattaaacagatggctacagtatcagtactgatgtaaaagaagcacccacacagtcatagaaaacccacggacaaagcagggcgatgggaaaaccatctaaaagaccaccacactgagataaaggcccaggcagaggacagagctagagaggaagcgggagagtggcgcagcctaaggactgcaagcatggtgagccggccaatcgcggtggcgctgtggcggcacaggaggtgagccagccaatcagccggtgggggtgtggtgcacagttgaggtggccaatcagcgggtggggggggggtgtggtggcacaggaggtgagtggccaatcagcgggtgggggtgtggtggcacaggtgagcctgccaatcactggtggtgtgtggcggcacagggggtgagccggccaatcagcggtggcgctgtggcggcacaggagggagccagccaatcagccggtgggggtgtggtggcacagttgaggtggccaatcagcggggggggggtgtggtggcacaggaggtgagctggccaatcagcgggtgggggtgtggtggccaggtgagcctgccaatcactggtggtgctgtggcggcacagggggtgagccggccaatagcggtggcgctgtggcggcacaggaggtgagccagccaatcagcgggtgggggtgtggggcacaggcagtgagccggtcaatcagcgctggggctgtagtggcacaggaggtgggagtgggcaggccaacacggaggaggcctcctatgggaagctgaggagtttggcattttatcgaagacagtatcatgccattgagggatcttaagcaaagcagtgacagaatcagatctatgtttcatcaagacccattgggcttcaacgttcagtctgcaccggagcagggaacactctgagatgaggcaatgaggcaagaggcaaccccggcagcagcctgcgacgcctggcctttccaggggcggctcctcaccacgggcgggctgggagagtggccgagggtggggcctcgcaggactgcatggcctcccaccctcccccgcacagcttgttagcgcaagtcttctcctgacggttattttagaagttcatttgtcaaacctcgggatagacgaaccaggcaaaccagatttaaacggagaataagacacagaggatgtaacagcgcctgcacccccagccacgggctttcctctccctgcaggaaaccagagataggcccaggcgtgtgagaggagcggccgaggctgaccctctgcctggaggggagaagggaaaggggaaaggcgagactcctcccgtcatcctcagtcctggatactgggcaccacaccaagtatttcctaccttctttccctatttcttacacccagccatcagtatcaatgtgaaaaccacaatgcttggattatttagatttatttccaatcccacaacagctatcagagcactaaataatggggcgagtaagcgggtactgatcacagaccccagcacgtagctctcacactggcacagaaacgtattctagcaaggcgtgactgagaagagctgcgagcagcaatttaggcaagtctcaacaacgggtgccactattagtttactttaatggtggctggggtgtttctgatgaatggtactctctgtcccctccacctcccaagtgtaagagacattttaggcgtgctccaactgtgaggaaagtctgtttagagccaagcctttaatccctatttctgatgagaagagacagaaatgtaatgaggcgaatttgtgtgcgggcatgtgacccacgctgaggctaagggaatctaagggaaacggatcacaatgacattaggttcagagctgctgacgtcattcctttcataggattcagaagtcaagactcaggaatggccatatactcagcaatttgggaactcaatatcattacataaagaaccagaaaccaagtgtaaaattggcatctatttcttttccataatcgatgtgaagttctctaacagcctagcaggttcatgataattttaaaagataataaacatggctgggtatggcggctaatgcctataattcagcactttgacaggccgaggcaggaggatcccttgagcttaggagttccagattagctgggcaacacagcaagaccccgtctctacaaaaaacataatttttaaaaaagagaatcacattgactgaattactcgtgaggcaggtaaggtatgaagtaacttctgtgcatcatctccttaatcctcacagtgaccagggagattctgttattcctcccagttcaccaacgaggaactgacacttcagggactactgctcagggaccacagctagtgaaggcagacccatccaaaccgtgtctgcctgcccagagccctagctcacctaacaatggtcgacttggctgggcgtgttattcatgcctgtcattccagctactgctcagggaccacagctagtgaaggcagacccagatccaatgcatgtctgcctgcccagagccatagctcacctaacagtgattgacttggtgggcatagttgttcatgcctataattccagcactttgggagactgaggcaggaggactcttgagtcagagccagttcaacaccagcctgggcaacatagtgagaccccatctctttataaaaaaaaaaaaaaaaaaaaagaccagaccaactaatccacctggtttattattttttgagagggagtctcactctgtcgcccaggctggagtgcagtgatgagctcacttgacatggatgagctttgacatcccaggctcaagcaatcctcccacctcagcctcccaagttgctggactgagtacaggcacaccccaccacacccaactaattgtagttttttttgtagagatgggtctcactatgttgcccaggatggtcctgaactcctgggctcaagtgaccctcctgcccggcctcccaaagggctggattacgagtgtgagccactatgcctggcctttgatgtcctacctttggtgagtaacactttgctgcagcctgccccagctgcagatctcagaattgtcccaggttcccagggtcacggagattgtcacaaatcaataataaaggcagtgaatgctgaactgagtctttggatatgtcatcttaacatggtcaggcttggcaaaaatccctgaggaaaaaaacaggtggtttacttgcctggtgtgggcacggggaatagtctgacttttcatttactatcaatcttgatatggtcttagttacataaaaatacaggaatacaggccaggtgtactgctcatgcctgtaatcccaacacttcgggaggccaaggcgggtggatcacctgaggtcagagtccgagaccagcctggccaacgtggcaaaacctcgtctctactaaaaacacaaagatagccaggcgtggtggcgcatgcctctagtcccagctacctgggaggctgaggcaggagatcgcttgaatctgggaggtggaggttgtggtgagccaagatcacgccactgcactccacctgggcgacacagtgagactccctctcaaaaagaaaaaaaaggaaaaaaaaaaccacgatacattctgattggcaaaattcaaacaacataaaattctaccagtaccactctcctcccctcaactgttctgttttggagtgtatccttttagaacttgttctatgcatctacctattatatgcacacctgtccatatgtaaatgtgttttacattccgtgtcatactctgtattatctgtaatcgacttatttacgcaacaatatatcttgaacttaccatgtcaatatgtttgagctacttttttcctttaactgctgtaggctatttttttttgagacagagtcccactcttcactctgttgcccaggctggagtacaatggtgtaatgctggctcactgcaacctctgctcccgggtttaagcaattctcctgcctctcagcctcccaagtagctgggattacaggcaccgcaaccacacccggctaattttttgtatttttaatagagacgggattttgccatgttgccaggctggtctcgaactcctgacctcaggtgatccaccctcctcggcctcccaaagtctgggattacagttgtgagccaccatgcccagcctctattttgtagtatgaatgtaccaagttcatttagctcttcccctatggactgttaaattatttgaatttttccctgttacaatgctgctgcaatgggtatccctgtaggactgtctgtccatgtgtctaaaaatttctctacataaatacctgtgagtgaaatggacaaatgatgtgcgtgcactattaacgttcacacagctctttcagtttattcacatcaggaactcataaatacctgttttcggctgggcgcagtgctcatgcctataatcccagcactttgggaggctgaggtgggcggatcacaaggtcagggtttgagaccagcctgaacaacatggtgaaaccccgtctctaataaaaatacaaaaattggccaggcacggtagctcatgcctgtaatcccagcatgttgggaggctgaggtgggcggtcatgaggttaggagatcaagatcatcctggctaatacggtgaaaccctgtctctactaaaataacaaaaaaattagccgggcgtggtgacgggcgcctgtagtcccagctactcgggggctgaggcaggagaatggtgtgaacccgggaggcggaccttgcaatgagcggagatcagccactacactcccgcctgggcgacagatcgagacttcgtctcaaacaaacaaacaaaaacaaaaattagccaggcatggtggcgcatgcctgtaatcccagctactcaggaggctgagcaagagaattgcttgaacccaggaggtggaggttgcagtgaggcaagatcgcgccactcattccggcctgggcaacagagacactatctcaaaaacaaaaaacaaaacaaaacaaaactgttttccagctcaaacccttcttaaaagcgggtctatcatttgtttccatttgtcccatgtgatagaaaaaacagcatgccattattttaacttgccttttctctgattactagagagctaaacaccttactgactgactgcgatcttcttcagtgaattcctgtgctcctttaatgtcttgtttctacaacctgtgcccatcttcctaccaggtaggcttttaaaaaatagttataggcttaaatatttaaaaaacaattattagcctgctatactgatttatctttccttttcactcattttaaaattcaaactacattcctaggaaaaagaatatgaatttcaaaacttaatgcatcaaagtaacaacccctttttcaaatacgctggctcagaagcactgtcttaggacatactctgcaaaacgaaggggctgtaggtgcagtgaacgcttgagtcacttccaaggctcacgctggaggtccagaagcctgggagctttagaatgggtacagccacttactggcgccgctctgtcctcagtctaatacaaaggagtaaaatggggtctgggactatctgggaaatgaaaaccctaagtggccttcttagtggaaaattctctccttatttaatgatctctacagataaaattatatatacattatataataatctacattatataatctctacattattaattctaaagttttatggaaagaatttatgggaaaagagaaaaattggaaaaaggctaataaaatattaaaaatggctttgagtacatgaaattgctgtggtatagatgaagttattcacagggtgtatcacatatccacaagtttctttttgaatcaccatgtttactggtagaggtgaaatgataaccttttagtaagcttttttttttaagccaagcactaccctaaactctttattataattatcaaatattcaatccctttgtagtctgctcccaagggactgtacagttttttgaatcttactagtattttgtcgtatatgattgctacaataaatgggctactgactgaatcaggagatgaatgaaatagtacttgtactgaaacatgatacaatcaaagatttaggatctttctaaaagatggtgcaggtaaaaagcctatccaccactgaaggcaatggaagggtataggcgtctgtgtgctgtgagagagcctccacttcggagtcacagatggccaaaagccatcagtagggctgaggaccttagaagtcctttacttctacttggatgtctgtggtgatgaaacccactatacggaggccctacttatgtcgctggattctggggagtgtctgtctaaagctgacaggtgctgccagttcctatccatttctcccttattccctgccctcaaatctaaatatagtaacataaggataagccaggaaatgatgaaagcaggtatgatgatgaagttcaaatgggttggccactgtaagcacacctgccccaagtgacaagcacaagttcaagatgggcggccactgtgagcacacctgccccaagtgacaagcacaagttcaagatgggctggccacgtgagcacacctgccccaagtgacaagcacggtaaaaatgaataacactttcactgaagatggcgtgtggattagagggctgtagctagtgagaatatggttacttagcatgagtaatctaggtactttagtaatccaagtccccatcctaggatctaagagctctgagtgcagaggacagatccctgtgactcactgggttacagagacaagagatggttccccagaatctcctcctcagcagttcaaggattcagttttcatatcttaaaactcccatgtcaaaaacgtatgaaaacttatcttctcatatttagaccaaagactttgtaactgctaatcaacatcggagttcataaggttaagtcagattcagccaaatgaaggaacagactagaagacaaggttctctgttattgggctaaacggggcagtaaattgtggcttgtacctcgcttcttagatctgcttcggaataagcagtttattgacagttatcaccacattggcagaggttttgcaaaaatgaaggctcaatctttcagtaaacgctttcttaatttttaatctgacatagaaagttgaagaagaatctaaaaaatagaaggtttgaggaatagtggttcttcctagagaccataaagagccaaacacaaatgatagtgaaaaacgggtttcaatttccattgaaaatactctaagatacacggtttgagaattatatttttctaattgtaacattttgaatttcatttcaatgctgctgtctaagacaagtatgagaaattaatcctaggtctccacaccttaagatacactgtgtaagccaggcatggtggctcacgcctgtaatcccagcactttgggaggccgaggcaggaggatacctgaggtcacaagttcgacgtcagcctggccaacatggtgaaaccccacctctactaaaatacaaaaatcacccgggcatggtggcagacgcctgtaatcccagctactgcggaggtgaggcaagagaatcccttgaacccgagaggcggaggttgcagtgggccgagatcgcgcattgcactccagcctgggtgacagaacaagacaaaaaaaaaaaaagatacactgggtaacactaacccattattccttgtggcgttacgaggtcggaccaatccttgatatcctcaaattcaccttaatgaggctgacacctttcagcttatcgactggcaactcctttaggtattcagacggctaaagaagaacatttttggcacagctccagccttgagagcgtctgaaatgagctgcgaccttccagcaggatcttcccttgtttttcccgaaatggcctggactttactatgtcattacactgctgtagatggaaataaaaaaaaaaacaggtaactatcaacatccttgtactgagacacgcttagttgtaacagaaataaagagctacggagagggccgggcgcggtgctcacgcctgtaatcccagcacattgggaggccgaggcgggcggatcacctgaggtcagagttccagatcagcctggccaacatggtgaaacaaaaacaacaacaaagagctaaggaaaacagaagctaattccaaagacgcttattcggccctctgtgcataatacaaaaaccaggggctgtactggaagaagtcctccatcggaaggaggttaaggttccgctgtgcgacgggagggaaacgagaacattcgacaggctcaagaaccacatcacctcagcctcctgtccccggataagctttatcgtagcgaagcccagactcttcccaggtgctgggagcgcgggatgcgactcctcgagcggttgtttctctcgttgctcctgggcactggcctcagatggtgccttgggggctgcttcccaggagcgcgcttctgttccaccacctctccggaaggaaacaccacttcactgggctccgccgcagcgcccggacccagcgcctcgcgtcaaggtcccaagcctggccacctgcagcaacggtcgcacgacaaacctcgcgggtctcaccagcgccgccatgttcctgagacccgggctgcgtcacgaaagcgcgccgtcggcggctagtgacgtcacggcccgggcgcccttcgtggactgggctgtacggtgcgcgtgacggctgcgtgcggcgggaatcaggctgctcgcagagctctgcacttcgtattcaaagtgggaaaccgcttccagacggcgctttctatcgggacgtcctggggatgaaggtgcaggccggggccgacaggggctggcgcggaggctggaaccggcgcccgagccggccctggcggagggaggggaaaatgggtgtgtcggaacctaagccggagggtgtccgaccttaggccctgcgcggtgttcagcttcaggagcgggcgagttgccgttggggatcataggccttggagaagggcctaacacgattagtccccgggtgtgcccacgcacgtcctttcatttaagccactcgtaaacgtttattgagccccgccttgtggagcttaccgtctaccggaaaagacggtaaataaaatgttatataatgctttctgttaatatttgtgttttccggtttggagcctttgatgtagataaaatcagcgtattcaggttctgcttctagcaaggctggtctgaatagtccgtttcggatactcagtctctgaataatgctccaactctcaacccatctgcttttcaacagcacccagaagcggtctgtctcgggcctgaggagctgttatttgcaggattcagttggttggggaactgggttttggggacctctttgataagccagggaggtagggaacacaccactaaggaagacttgaaaggtgcaagaggcggtttagtgtatagacggtgcaatagacggggatctgaattcgtcaggtcatttttaaatatctgctattttcagggtactacgttgagttttggcaacaaaggtgcaaatgacccgatatatatcctccattagagctcatggcctgggttggggtgggagttggaactggattgtacgtagatgatggtaatggaagtcagaatttgatagtgaaaaaccaccaaactttcgtagcagaaaccacagagctgtcccttgttagtatttcctcgtcgatcaaaaggttgttgaaagattaaacacgtgccggcgcggtggcccacgcctgtaatctcagcactttgggaggcaaggcgggtggatcactggaggtcaggagttggacaccagcctggccaacatggtgaaccctgtctctactaaaaatacaaaaattagccgggcatggtggcacacgcctgtaatccagctactcgggaggctgaggcaagagaatcgcctgtatctgggaggcggaggttgcagtagccgagatcgcaccattgtgttccagcctggatgacgaaagcaaaactccgtctcaaaaaaaaaaaaaaaaaaagattcaacaccttattatatgtatagtatttaacatatcggtatagtagattatataagtgttagccactattataaaaatacaaaagaaggagcggttttcaacctgggtgatgaggaaataattcatgtagaccttgtattcgagttgactttttttttttttttttttttgaggtggagtcttgctctgtcgccaggctggagtgcagtggcgcgattcggctcactgtaagctcagcctcccgggttcacaccattctcctgcctcagcctcccggtagctgggaccacaggcgcgtaccacaacacccggctaatttttaaaaatatttttagagagacggggtttcaccgtgttagccaggattcgagttgacgtctaaagataggatatcacaggtagatgagaggaggagctacatagtaaaactgaagagccagtgcggagatggcaatgtttgcgaagccgctggttttatgtgcctttagttgaggttgcttagttgaagttaagagatgggatatcaggatggacaggtcggcattgcttctaatagtatcttgaatgctatctaaagaatttggattttatgctgcagtaagatgggagctcacttatgttcttaaacaggtggtgatgggatcagtgctttgtgctttaggcatgtgcttttttggtgttattaaggaggatatcaataaggatttttttattttttattttttattttttttatgttgagacggagctcgctctttcgcccaggctggagtgcagtggcgcaatctcggctcactgcaagctccgctcctgggttcacaccattctcctgcctcagcctcccgagtagctggtactacaggcgccgccaccacgccctgcttattttttgtatttttagtagagatggggttttactgtgttaccaggatggtctcgatctcctgacctcatgatccacccacctcggcctcccaaagtgctggattacaggcgtgagccaccgcgcccggccaataaggatgatttttaatagtctgagcaagcgttgggaacttcaactggcaggagccgtgggaatcaaaaaggagggctaaagctacacgttgagagcccgctgtgtgcagggttctgtgagatgctttcataacatccattccctcacatgttaggagactgagactcagattctaatttgctcagagttacacaactactaatgacagaattccaaatcagacttttttttttttttgagtttgagttttgctcttgtcaccaggctggagtgtaatggtgcaatctcagctcattgcaacctctgcctcccgtgttcaacaattctcctacctcagcctcctgagtagctgggattacaagcgcccaccaccatgcctgctaattttgtattttttatatttttagtagagatggggtttcactgtgttggctaggcggtctcgaactcccgacctcaggtgatctgcccacctcagcctcccaaagtgctgggatacaggcgtgagccacgatgcccatctttttttttttttttttttttttttttaatttgaatggaattttgctcttgtcacccaggctgtagtgcaggggcacgatctcggctcactgcacctccatctcatggtccaagtgattctcctgcctcaacctcctgagtagctgggatcaaagcacacgccaccacgcctggctaatttttgtatttttagttgagacggggtttcacttgtttgccaggttgatcttgaactcctgacctcaggcagtccacccaccttgatctcccaagtgctggtattataggcgtgagtcactgtgcccggcccaaatcagacttctttaatgtgaaggccacactttttcccactgcatagcactgcttaccaatctaaatagatttcacactgatttggtagcctgacccttggtgtcaagctgttcgtccttccactgcttctatcctggagaagtgtaaagctcatttgcttttgttcttttacaagtaaagcttataaatgataagtttgtgttttgacattttagtctgtgctaaagacgctgtgagcagtactagcaacactcacaatttattctaaatctcacaccaggttctgcggcatgaggaatttgaagaaggctgaaagctgcctgtaatgggtatgataccttgtttcttaaaatctcctttaggctctgactcacccggataacagaagacagtttctcaaagtgagtataaagcagtggaattaattaagaggcagtaaattagggaggcaacttcaggagcgtcgggaacacatactgtttctctgcatctcatgagtataaagcagtggaattaattaagaaggcagtaaattagggaggcaacttaggagcgtcgggaacacatttctctgcactctcatacaacacctgtgggacacaaagggttctccagctctctaacaccagccggctgtcctgttatttaattgattctgactctaccggagttaatgtcagatcctgcaagttaagggctcagtcccagaagattttccgccacgtaggcgccggtcacagtctggatcttcaggatttccgatgaccaactacaagtcagggctccgctcctgcttccttgggtttgatagtctgctacagtggctcatggaactaagggaaagctggaaacacttacttacatttactggtttatcataaagagtacgagtcagaaatggcggacagaggagatacacagggcagggcatggggagtgggtggcagagcttccatgctctctgggcaggctccaatccagcacctccctacgttcagcatcccagaagctcatgagtctattgttcaagcctaatagagcccagtctccatccctttccttcccagaggttggtggatggactgaaagttcagtcctctaatcatttgtctttctggtgaccagccccatcctgagttatgtagaggccccactctaagtcacttcattagcataaactcaggtgtgactgaaagggctcattatgaatataacaaaagatattcctatcaggaaattccagaggttttgggagcctgagacaggaaccagggacaatgaccagatatgtttcatattatgccacaaatgcaaaaagtacatgctctagatgaagcagcggctttccagtatctttttttttttgagacagaactcactttgtcacccaggtgggagtgcggggtcattatcctggctcactgcaacctctgcttctgagttcaagcaattctcctccctcagcctccctagtacgtgggactatgggcattgccaccatgcccagctaatttttgtatttttagtagagacggggtttcaccatgttggcaggctggtctcgaactcctgacctcaggtgatcctcccgcctcggcctcccaaagtgcgggattacaggcctgagccaccacgcccgtccatctcttaagcttagtaccgtgacaagtggaacagtccaaggcctattaggaatttcatgcttgttgattgatagtcaaggaaatacaggtcagttggagaactgtctttaggattctgttccttgctttacagaaaaggtgaacaatctttccttcaggtagatgctggatagtctttggagcttgtagtagggtcccatgagactgcccacagctgctttctgtaccatctgaggtcatctcatccttaagagaacttttagaccagacaggaatgctcatctctctgtgcccagtagttctctgggggtggcctgaggcgacttgtctgtagtcactgagttcatttacttttattttctaggccttatgatgggaaaggagtaaaacaatggtgggatttgggcctgaggatgatcattttgtcgcagaactgactacaattatggcgtcggagactacaagcttggcaatgactttatggtaaataccgttttttctagcagagttttggctgggggtaggtggctggttgtaaatttgagtagagtgccaaggtgtgtgtgagtgaagagataacatttgagcagagactcaaaagaggtcagggagttagcacgtggatatctgggggatgcgcgttccaggcagagaatattctggcaagagccgtcagtaacatctggcgtgttcgaggaggtgtaaggaagccagtgtggctggaatagagaacggaggggagcgtggtaagagatggggtcggcagtgccatggggtaagactgcagggggcccctaggccgtaagtcaccgagtgaaatgagccattggcggactttgagcaaagggaaaaaaggctggctgcagtctgggggtggactataggatgcgttttggaaagtttactttggcgcagagtgggtaatggatttacaagactggaggcagagaggccattataataaaccgagcagaaacaaggctggtcttc

SEQ ID NO: 5062 - DNA, 20642 bp, Homo sapiens
caaattaggagtcagtttctttttctttttaaacactgaaactcacactcaacgcagtggaggttcattagggagtggaacatgatggagacaggtgaaagccattctcagttggggccagggagagcagcgccagctgcacaggcagctgaagccatccccgccaagcatggatggggtcaccacactcctggaaacggcacgcccgcccacgggaaatgcagacaacagcaacaggaaacaaaaaggcacctggagaaacaggccatacctgcgaactctccagttcccagtcggatatcgtgtctaattttcttctcctgttcttcattcatatatgggattccgtttttggaaacttaagacagaaacagaacaacaaacagaacaaggagacaagtcagagggatccttgtgcctgatttcacgaggacaggtagaaaggggaaaggagacgggctgtataagccagtcgtctagatcacttgtaagacattcccaggccgggtgcggtggctcatgcctataacccagcactttgggaggccgaggcaggtggattgcctgaggctaggagttcaagaccagccgaccaacatggtgaaaccccgtctctactaaaaatacaaaaagaattagctgggcatggggcgggtgcctgtaatcccagctacttgggaggctgaagcaggaaaatcacttgaacccggaggcgaagattgcaccactgcactccagcctgggcaacagagcgagactccatctcaaaacaaacaaaagacattcccgttcccctcctccaatgccataccttgttatagttgaaccatactgattcaaaaactgaacactggaagcctggaaggagaattctgagtccaaaatccaaacgttgtagggaagagatagaagttacaagaatgggctatatacctataataaaaaaacatacagagaaaaagccacaaccatttaaaaaactctggctcccagggctggcttcgggtgggctctttcttttaggcaagaagaatctgagtgtgcccgagtgtctgctgtgttcaggagctatgattggcactgggggtgctaaatgaaaaaggcagagagcctgccttcaggccagcgtataccacagagacagcccctccacaagctgcccagggatgccaggttaggggtgcaggctggcaccctcaactgctcatggggggtggggaggcatcctgatagttggggatcctttctgcctactgtgtcaggtagtttaaacatcactttcattacaccacactgtgcaggcgcttttattaatataggtgcacactggagacaatggaaatggggaaaggagcactaaggtacagagcaaggctggcgggaaaggtactgcttccagagagacatcaaagacaactggaatccgcagagggcagagtgagtggaggaacagacacaggagagaatacggaagaccagggcaaaagtgatcggggcacctgaggcagaatttgaaggtggcagctgtggaacaaggtgggaagcacctatgtttgcagaagctcttgatacgtacttgtttgcctctccttcatagcggaaaacacagacaatcctggaagaatgaccgtagagggaatgaatgccaaggaaagcaacctgaatttcactacaaagacaaaaacaactcaaacagtactttgcgcccacaatactatgtgggctgtacaacaggataacatctttaatgacaaaaaagaaaagacagacggaagcatgagaaatgtcaaattgtaattcacactgaatttgctaaaatctaattgtggctgttcttcaaatacagaagtaaatattaaaatgacattctcatagttttaaaactatcacagaaaataccaaaaaccattaagatttatatatttaactcatttaaaatgtctattctcccccctcaaagaaaaccatatgcaaagttaaaaaaaaaaaagacttcaggccaggtgggtggcttatgcctgtaatcccaacactttgggagacctaggcaggtggatcacttgagtcaggaattcgagaccagcctgaccaacatggtgaaaccctgtctctactaaaaatacaaaattagctaggtgtggtggcgcgcacctgtaatcccagctactcaggaggctgaggcagagaattgcttgggcctgggaggcaagggtgttgcagggagccaagatcgtgcccctgcctccagcctgggcaacagagcaagactctgtcccccttccccccaaccaaatttgggtaaacaatggaaacataactacaactgtttcctatacttctcaaagaggtcttataattaaaacaaacaaacgaacaaaaaaaaaaccataacagaaaagtagcaaaggatcaggatagaaggaaaacacacacacgttcagcatcattcatagtaaaagcaggggctgggcgtggcagactcccagctacttcagaagctgagactggaggatctccagagcccaaaagtttgagccagcctgggcaacacagcaaaaacccaatggtgcgggagagggcacagacaaacccagaaagtaaaatctggcccagggtctgtttctgtaaatacaataacattttactggaatggagcatgctcatttgttcatgtattctctacagctaatttcacattacaaaagcaggattgatagctgtaaaagaaacagcattacgcaaccgttaacagctctgtcttgaccagcctggcaacatggtgaaaccccatcgctactaaaaatacaaaaattagccaggcctggtggcaatgcctgtaatcccagctgctctggaggctgaggcaggagaatcacccgaacctgggtggtgaggttgcggtgagcccacatcgcgctactgcactccagcctgggcaacagagcgagacccatctcagaaaataaactaataactaaatcaacaaatagatctgtatgaaccgatacaaaagatctccaaatcccatcaaggaaaaaaaaaaagtttctgaaactgagatgaccttaaaaaattatttttgtgtgtaaattttcttaagaaaaaaaaatcacaggccaggtgtggtgctcacgcttataattccatcactttgagaggcagaggcagaaagattgctcgagcccagaagtcaagaccagcctgggcaacatgacgaaaacccatctgaacaaaaaatttaaaaatagctaggtgtggtggtgagcctgtagtcccagtttactcaggaggctgacgtgctagttcacttgagcccaggaagtctaggctgcagtgagctaagactatgctactgcactccagcttggtgacagagcaagaccctgtctcaaaaaataaaataaaaatcgcacacacacagtttacttgaaagagtaacagtgagtgttccttaatactgacttatttaagcacggaaacatgctgctaaatttggtttgctccgaagtgttgatttccatatgtatacaatggcccaaccaaaacaagcatacaaaacgatactcaatatccttgaaaaatctcagagctgtttttacgtaggaaatccaaggacaataaaaataccttcttgaaaaactctaacagctgatattaactcaccaatctgacagactgtaaattgctgaacactctgacgggtctttagataccactcgatggcaaatcaaaaagactgtgaacaaacaggcatctcattccacgagcaatgacatccatcccggcactatggcctccgcggcaggaccaccactcgcaaccggggaggatttttccttgttacaacaactagggagcactaccatcatttagtggacagaaaaaagcaaggtctccaacacgtaggagcaagccacacaaaacgtcctgccccccaaatgccaacaggctgcggccagaaacagtgctggtctggccaggctcttatacagaggggacacagctttagtttacctgatctgctggggcccagacaggttagaacgaaggcccgtgaactctatgtccagactgccaggaaggcaaaaaatagcagtcctcgggtgcagaacatcgccagcactcctcacctgtagatctgcaggcggccaaggcacccgcgctcacctctgcgctcaagccaagtgagtcaggaagggaaaatggaggaaccaaggcaaggagcagccaggcacctgggcgcacgggctctggccaacaagggacgtggggctcggagtgtacttgctgctcaaagtcccaccgcccggggctggagaaggaagcccccctgtccttcccgaggccctctctgaggccctgtggctggcaaccgtcccgccaccccctccccaagctcgcccggggcaaggggctctgtccggccagccgcgaatcccaggctcttcacccacgaagtcggcctcctggacgagctcctgcagagagggaggctctcctcgaactcgtcggcgcccacgtccatggccgtgcagctccgcgggtcgcccagcgctatcacgtgctgcccacgtgctgcccacgcgcttccgtcgcgccgccggtcttaaagggcgcacacatggaaaccaggcagctgcctccgccccacgtgcccagctccccgtgtgctgctggcgtcgcccacacctgcctgcgggtgttttaattgtacgatttgtacagaggtttgattgcaattgcaatcaaagcctgtttacctggctcctcagcaatttcttgcagcccttaacgtgagaatgtcatttacatggacttagaatgttaagaggcgtggcggagacgaagacagagtccagaaagggtgaaatcagaaaagcggagcaggaacaacaccgacgcaactgcaataagcagatcctttgctgcggctcacggtcttctaaatcacctcttccaacttctccatcactgccagtatgtctgtccccattccctctcccacgcccctggactctttttcctcattctgctgtccaccttaccactgtcttcacacctgcaatcaaactttcaaagcctcaagaactgcccattaaattgaaggaatccttggtccccagggattatctctgcactcactccttgcggaaatccctacctacaccatcacatacatgtgagcttaattttacttttgttactgtttccagtgcaactagtccatggtcttccttacagtgtcctccctgaattctaggcttctacttgaacagcgttttggaactatggtcctcaaagtgaggtgctaaatcaatctttaaggttagcggagaaaacattaccgttatacttttttattttttcctttgagacagtctcactctgtcacccaggctggagtgcagtggtgccatctcggctctctcaatctccacctcctgagttcaagcgattctcccgcctcagcctctgaacagctgggatacaggcatgcaccaccacgcccaactcatttttgtttttagtagagatagggttaaacctattggccaggctggtctcgaattcctggcctcaagtgatccacctgcttcagcctcctaagtggtgggattagaggtgtgaggcactgcatccgatcttcaattatacttttaaatgctctccgggacattaattaagcaaaaggggactattaagccatttgattctgaagaccttcagaacaaatcatacttcatacagatgtgttccatttaaaataacacattgaatactcaattggcagaagtaacatatttcacttctaaacaaacatttaattggggtatacattaaaaaactggaaaacaatgctctagaagccaccttaactgcctacaggttttttctcacattatcaaatagccaaaaattaacaccttaatcagctcctttcagagaactgccatgattccatctacccaagctcaaattttagattaacttgcatgcatttcaagtttcatctcctattaataaaatgttcacttcatggcaaattgagcgcccactaaccccaaccatttccaccttgctttcagctcctgatgccacctccttcctctttcaaatttgtttctcttactgttggaaccaagagtccaagtgaggttggcatttggtcctttcattttcacatactgactgttcataatattagattgatactgacatttcctattttaaaaaacaccccacactccgagcagaaacaactgtcattcactgagatcactcgccatgaactagacacagtaataagtgctttcatcaacctcatatgtgctccactgccacagtgagctcagacaatgtcatataaccagaaataagagttcataatatgcctttattttgtaatttataaacaacttctgacttgcccttgaaagttaattataattgatgactgcttttcttagatgcttctgaagcccaagagagggcagaacgtagttcttgatttaaaaaaacagaaaggggaggaggatgaccttaactacaataatattccactgcaacattattgctgtaaaacttccaagctggctgttcttccagatctctcttttgatggctgtagtggctgacagatttatatttacatgttcaaaacaattaagcttccatttattcatagattctctgaggttcccgtagaaccacaccaccttctgtcatgcactttgtagtcgtttcatctggttttgaaaatcagaaaaaaaaggaaaagattaagtagcagcacgagtaggctgaaaatactttcaccttccaaaagacagaaataaattgatttttcttgctaacttcccagcctacaacagtttttcagaaagtgatcttaataatgatgtagtaaaaaggaaatgtagagatgtcaaggttcagcagcatttcaaaatattatatggacagatgtcaatatatgaacaggaaatacagtggctgacatcatggactacagaatcagtcacctgggtttgaaatccaccatacactgactctgggcaagtaagcctcagtttatttctgatagaatgagagtactagtccctaccctatggactgatgtgaggattaaatgaagtaacctgttgagtactcaccaaagggtctgacacatggaaagtatttggtaagtaaaaactgtattattatgtaagttatccaatgccaagaattaacacaataccttttcaataagtacataaaacaaaaataccgagtctgaggctgcctcccacggggttggttggtagaccatgaagtgattcccgcctctaagcatctctgtgccagcactcgtcctatactctcacaagccacccatttctggtactataaaggtgctttttaatagcccactcacgagtggaggccgaaacccaaccttgccattctgatgctccacaagtgcttctacatgatgctgagtccttataactgcaacctaaatggggtgagaagataataaaatcacagaagaatctgtatcctaaagttaattaattgaggtgaataaatgactaaatatttttcaacaatccagtgtttggttaatttacatatttaacttggattttgcttgggaaaagtatttttcctccgcctttatgagaatacctcaataataacaaactaaatagttcaagtatcatgaagaaatttgtttctgaagagcgagttttatttacagatctacttcaaagagatttgaagagacagagctaagttactgaaatatgcatgacatggatatacttactctttgcttttatttatagctagcaccaaaataatataagacggaacaaaaatttaaatgcaaaaactgaaatcataacagtactagaagaaacatgagaaatttttttataatctcaaggtatgcatatttaaatatgacatcaaaccatgcatatggcttttattatttttcagaaacagggtctcactgtcacccagctcggagtacacagtgcaaccacagctcactgtagcctcaaacccctaggctcaagcaactctcctgcctagtctcccaagtagttggcattacaggtgcatgccactgcaccaagataatttttatttgtagagacagggtctccctatgttgccaaggctggtgtcaaactcctggcctcaagcgaccacccttctcaacctcccaaagcactgggattacaggcatgagccactgtgtccagctcatatggccatttttttttttttttgagacagggtctgcctctgtctctcaggctagagacagaggcacgaacttggctcacagcagcctctgcctcctgggttcaagtcatccttcccctcaacctcccaagtggctgggactacaggcgcatgccactgcacccagctaattttttatttttttgtagagacagggtttgccatattgcccaggctcgtctcaaactcctaagccaagcagtctacccacctcagcctcctaatgtgctggggttacaggctgagccaccatgccagcccctcatatggcataaaaaagaaatgatggacaaaatttgctgcatggttaaaaaaaaaaaaaaaaaaaagtaaaatgaagtcaaaagaaaagcaatgaaacaaaaaatatttaggctgggcatgtgactcaagcttgtaatcccagcactttggaaggctgaggcaggaggctgctagagccaaggagttcaagaccagcccaggcaacacagtgacactctgtctctacaaaaatagaaaaaatcagccaggcgtgatggtgtgcacctgtagtcccagctacttgggggctgaggtgggaagattgtttgagcccaggaggttgtggctgcagtgagccgtgataagccctgcactccagcctgggtgacagagtgaaaccctgtcacaaaaatataaaaagaaaaatattttaaactcatatattgttcaaagagctaatttacacaatatgttaaaagcctctataattaacaagaaaatgatcaataacttgtggggaaaagcaagagatcagattgttatgtctgtgtagaaagaagtagacataggagactccattttgttctgtactaagaaaaatcttctgccttgagattctgttaatctatgaccttacccccaaccccctgctctctgaaaacgtgctgtgtcaaactcagggttaaatggattaagggttgtgcaagatgtgctttgttaacagatgcttgaaggcagcatgctcgttaagagtcatcaccactccctaatctcaagtcccagggacacaaacactgcggaaggccgcagggacctctgcctaggaaagccaggtatgtccaaggtttctccccatgtgatagactgaaatatggcctcgtgggaagggaaagaccgaccgtcccccagcctgacacccgtaaagggtctgtgctgaggaggattagtataagagaaggcatgcctcttgcacttgagacaagaggaaagcatctgtctcctgcctgtccctggcaatgcactgtctcggtataaaacccgattgtacgttccatctactgagttagggaaaaccgccttagggctggaggtgggacatgcgggcagcaatactgctttgtaaagcattgagtgtttatgtgtatgcatatctaaaagcacagcacttgattctttactttgtctatgatgaaagacctttgttcacatgtttgtctgctaatcctctccccactattgtcttgtgacccgacacatccccctctcagagaaacacccacgaatgatcaataaatactaagggaactcaaggctggcgggatcctccatatgctgaacgctggttccctgggtccccttatttctttcctatactttgtgtctttttcttttccaagtctctcgttccacctaacaagaaacacccaaggtgaggaggggcaacccaccccttcataacttaataggcaaagcattatccaaacagctgttcacagaaaagaaaaatattaatgactcaaattcacaaaaatatgctcaatctcataacaaaatgcatggacaagacaattcgatgcaacactgtaatcataaaagataatcacctctaggagcgagttaagtaaaatccatgcaatagtattccatacagttactgaaatgatgaaataatgctttataatgatgaagataatagttaacatttactgagcacttagtatagccaggcctgtcttaacggtttatagataaagcttatgtctcaattctattattttttcatatttttttttagctgcagaaactaacacagaaaggttaagtaacttgaaaaagattaaactagtaagtaatggagccatggtttaagtcccagtgtctggctccagagtcaatgctttaactaccatgaagaatctccaagatgtatttttaagtgcgtgcttggggtggttgaggtggtggtgaagaaagatgcggaagtgtttatcgtatgctaagatttattgtttttaacgtttttgcttatatgcatagacaatctttagaaggacacacaagaaactgtactcccttggattttataacatacgtatatgttaccctttaaaaagtcaagtttaagttaaagaaaaacacccaaatcattagattctcactaggattctcaatgtgaaatagaagaggcattagattggaaatatggagtctactcctggttttcctggtggctctagtaaaaaatcacaatcttttttttttttttgagacggagtctcagtctgttgcccaggctggagtgcagtggcgcgtctcggctcactgcaagctccgcctcccaggttcacgccactctcctgtctcagcctcctagtagctgggactacaggtgcctgccaccacgcctggctaatttttttgtgtatttttgtagagacggggtttcaccgtgttagccaggatggtcttgatctcctgacctcgtgatcgcccgcctcgacctcccaaagtgctgggattacaaacgtgagccaccgcgcccggccaaaatcacaatctgttaaaccaggagtcaacaatctttttccacaaagtgccagatagtaatattttaggctttctaggtccaatagcttctgttgaaactgttcgactcagccattgtatgctagaacagccaggtgatgcgtaaacaaatgagagtaggtacagctaggttctaagacctgggcaacgaaatttgattttcatttaattttcccaagccacaaaatattcttttgatttttttttaacttaaaaaaagtaaaaacaagtttttagctcacaatctacctttggccacgggccgtagtttgctgacacttgaaccatttgttcaatgaagggcccgattcattattcaaaggtcatttcctactataatattctgaaattctctacttttaatattgcgagtaagcagacagagaaaaaatgaggaaatacatctttagttatttttaatgatccaaatattaatcaaagtaatgcgttggggccgagtgcagtggctcacgtctgtaatcccagcaccttggaggctgaatcaggcagatctctcgagctcaagagctcgagaccagcctgggcagcagcaaaccccatctctacaaaaaataccagaaaaaaaaaaaaagaaaaagaaaaaaattagcggccatggtagtgtgtgcctgcagtcccagatgctcaggaagctgagatgggagaatcgttgagcctgggaggcagaggttgcagccagctgatactgtaccactgcactccagcctggtgatagagccagagcttgtctcaaacaaaacaaaacaaattagctgggagtaatggcagcgcctctagtcccagccactcaggaggctgaggtgggaagattgctggagcccagggagtcaaggatgcagtaagcagatatcataccactgcattctagcctgggcaacagacccaaccctgtctcaaaaacaaagaaaaaagaaagtaataggttgggtgtttcaaaagattttagccttaagatccagattatttaaaaagtgaactgcctactccctttcttggactccctctctatgagtaaaaatgtattacagcaactgtaacacatcattatccccattccactttcactatgaaacttaagacttttgatgacagggataacatctactttatctttgtaactctgcctctaacgcaatgcctagcaagtgatacaggtatgatgcttgttcaataaataaatatacatcacacagtaatgatttccaatttactcttacaactttacatagtacttaagaatccttaagaaattctaaaaaatcctcaccaagcagataagcagcagataaacctgataacacttacatgctgtagtatagtggtaataacctagcgtcctggctctgaggtcagttaaacatatgtaaatcttagctctggcacttactaatcatgtctccctaaacctcaatttcttgatcctgtaaaatgggggaaattataactgcttcatgatgtaattttaaggattaaatagaaaaaacatataaagcaagtagcataattcctggcaaatgtaagtgttcattaaacaccacctttataacaaagtatctcaagtcatactagactcctaactggtctttcttcaagcctgctccctcaaaaatttaatcttccaaaaagcagctaaaatgatttttttttttttggacagaattttgctctgtcgcccaggcgctcagctcactgcaacctccgcctcctgggtcaagtgattctcgtgcctcagccactggagtagctgggattacaggcgtgcaccaccaccccctctaatttttatatttttagtagagacggggtttcaccatgttggccaggttggttcaaactcctgacctcagatgatccgccttcttcggctggctccctaaagtgctgggatacaggcatgagacaatgcgcccagccagaatgatcttgaaaaaccaattcgggctcaagtttaaatcctctcgtagtttcccactataatgaaaagaaagtctaaagtgctcatcttgcttacaaagctaatcatctgtcgcctccttacccctccatgttcatcttgggccattcacctctgcccattgagcttcagatccacaagcccttcagttcctcaccccagcagtttccttgctaggactgctctttctggcagatgactaggcttcttcctctttcagatctcacctcttaaatgtcacctcagacaggcaggtatcctgtccgctactgtaacatcctctttaaaagcccccatcacacctatttgttgtttgttccagcccctccgcgaaccctgcctctaccgccgcatggcagctacctgggagagtgcctggagttgaatgaatgaaaatagtctgtaggtgcactgcccttgtcaatcacaagcagatttaattacctgtgccagaactcacgggaggaaacaccgtccgccagccccgctctttcctggctacagataaaagctccaggttccggggttccggttggtgaattctggggcgacagcttcattttccacagggtccacttcaggttcgctgccggctcggagctggttgacagggctgcgaacctgcaccctgggcaacgggaaaaccgcacagggcttaaaaatgacggatatggacagcgcacgaacccgctctaacgtcttccgcttttacacccccaatctttaggcccgaggggacgaaaaatacgtatgcccacaggtggagtcagcactgaccccgtccttaacttcctactgtggtcttcgcagtgccgcgagtctatttcgatccggcacgtcgaatacaaaatagaacccgcacgttccaatgtactgtgaagcccaggcgagtgagctgggagaaggggggcaagactaattaccagggttcctgcaaccgagaacccccaaaactgcgaccgaagcgccatcgctgagacgatctcggaaaagcctgcctctttttcctcacggacgactcagtcgctcgccaggcgcagccatataaagtcaggacaagcctttggctgctgtagatccccaaactctccacgccagacgccgccgacccggagtagcaagtcccctgccactgagtggccaagaaggcgatctgttatcctgcaccgccaacatcgctcacgtcgaggggcacgcaggccctggagcccaccaaccacctcgtagctacgccaagaccacgcttgttgcttaagtccggggtcaaaggcacacaccccacaaaaccatgttgggttttctactcggagagcttgggcggtcattgactggtccacacacaccccacctggcaccgcgtaggaataaggcagggcaagatgcagttttctccttaaaaagggtggttgcttcctcgaaccaaaaattttcccgtatggcccgctggaaaaactgccccgtcccacccggttcgcgcccttaaacttacactcctgaggcctggagcaaagccggccgatctgcctccgctccccgagcagggacaaggaaaagacactaaacctaaaacgcacgactcgctcagaccccaactctaacttggagaagggcccgcccctccagttacaccccagctccaagctcccccttcttacaaccttttctagaaggcactagaatggcccactgcgtctgcgcaacatctttgaggcgaaggttcaacctcttcccagcggtccaacatccgacttccgttctccgcttcgcgcccttcccatcggctatctaattggacaaaaatgccgaccccgccccttccccgagcctcacttccgtcacagtcctgtttctctccctgttgtccctgcctctttttccttccgccgtgccccgcggccgggccggggcagccgggaagcgggtggggtggtgtgttacccgtagctcctgggacatcgctcgggtacgctccacgccgtcgcagccactgctgtggtcgcggtcggccgaggggccgcgatactggttgcccgcggtgtaagcagaattcgacgtgtacgctgccgtcaagatggaggggcctttgtccgtgttcggtgaccgcagcactggggaaagatccgctcccaaaacggtaagggcgggccgggcctgggtcgggtttgcggccggggaggccgagtcccaccgcgaccggaccccggctgccctcgtttctctcctttacctccgcagaagggcctcggggccccgcagccggacccagcccacccgccgttctctggggcagggcgtgtggccccacttttcccacagcgaggaggagccccgccgcgcgcggcagggttttgagccggcaacgcgtggatgtggtgtccggggcggcgttggaaacgcgccctccgcgggaaacgggcctcccgggctcgcacgtgcgggccacgcctcgcacccccttttgtttcagggcgccccctgagtgtccatgttaaacgccaggttttattttaggaccatttaccagaaaaaggtaggtccatccgcgcgccctcggatgagcccggtgccctgtccgcccgcagctgcagtgaggtcgggcgtccggcgtccagccgtatccgggttgacagcttcttacagtagagttacccaggaaacgccactcgagtgcattgaccccaggagacggcagcgctaacttagcagacgtttgctgtcaggcctttggatacctacagagcttactgtttcttgatagattcctaattttttcgtaaacaaatctgaaagtcaccaccttccccgttgactaccgatttctctcccacagataaagagagttttaatgagcaaaaaacttgcagaatctgaaggaaaaggctggatagctgtacgaagtggcagagcatgaaattggtggttattactttttttttttttcccgccatcagattccaccccgcatcaaagctgtgccaaataggctcgctttgtttagggacgggtcccacctgtcgcccagacgagagtgccatcatagctcactgcattctccaagcacggtccgcgccgccgcatccggctttgtttttattttttgtagaaatgggtttcgctatgtgcccaaaggggtctcaaactcctggcatcaagcgatcctcctgcctcggcctcgcagtttgggattacacctgtgagccacagtgtctggccccatttacactcttagtaggtggttttaaataattaacacagatttgtagatttgggaaatacgggggctgttggatgtcatttcctttaggctgaaattactgtctttcagagttgtggcttatcctcatttcttttttattttaattgattgtctacagttatggctgcagcttcgattgccaatattgtaaaaagttctttggtccagttggcttggataaaatgttggtggatgatattggtgtaagtacacataacgttgtgttagtttccttaaagtaaaactatcttcagtgttttgctatgttctttctttgctttatcagaatccacgtactggaaggtgatattaaaggtgaacgtgtattataatgggctgtgttgatttctataagtggttcatattttttcctgcgaatttcttaggatgtaaccttactaacgatggtgcaaccatcctgaagttactggaggtagaacatcctgcagctaaattctttgtgagctggctgatctgcaagacaaagaagttggagatggaactacttcagtgtaggtagactggctaaagaatgatcatttttctaaaaacgaccgactttcagaaagttgagccataagtgggtcatttgtgctgtgtcagaaataagttacatattctgaatgcccagagattgagcaagaagaaaaaacaaaagaagttacacatttaagaggggaaataagcttctaggtacagattcagaaacaaaatttgtaagttgatagttacagctagtttgtacagttaagtaggaaagaatttgagttcatttgacatagccccattgttttaaatgttggtattccaagttttgagggcttatttttccttttatggcagtattcagacatcacacagattttttatggtctctcaaaagtcttgtttcctcccccatcaccccttgagacttggaaagctctaacttttctgattatttggaggataaaatgttaccaatctgggggagaaacaatgttttatattattatttttaagagaccatctgtagcacagtctgaagtgctgcagtgctgtcattctcactgcagcctggaactcctgggttcaagcaatcctcctgccttagcctcccagaggcttgggattgcaggcatgtgccaccacaagcaactaattaaaaacctctttttttttttttaagagacagggtctcgctatgttgcccaggctggtcttgaactcctggcctcaagtatcctcccttctcggcctctgtagtgctgggattacacgcatgagctgcactcagcctgtctattttttaaatcctgacaggtaatctcaggaattcaaaatgggagtgtgagaaattataaatacatcatgatatgacagtgtgatcttaccgagtcagtaaatgtgatacacagttaaactcttcatagatcatccagcatgctggtatagtagaaacactattgtttggtgagaagatgttaattctggagaaactagatagtttgtggggaaaatgtatttctagattaaatttagccatgaaagaatggaatctactcctaaaatatgaatatgatctttgtctaacttcgataatgtgatttaacaaatgtagttttccttccataagaagctgacagtctttttgcttaaaaatatttcttagtgttttatcaacttgaagaactatcttttttaaataaaataaagcctaatataggtcatatgaatagtcacactcggtttagcttctgttgagcatttttttaaaggtaatagatgtgttgtcttttacggttgtattgatgaactagtttcttattgctaactagtttcttagaacatttttctggctcctacccagttttggccatttgcatttatatacaataagacctcactgaacatccacagtggcttcatggaaactgactttaagaggaagatgatgtataaaaaaacaagttttcctccccccatcagcgttacaataaacaactgtattgagaaattgctgtccattgttttgcttaaagtggcagtttccaagaatttatgagtacgtggaggacttggagtgttttgtagcgttcttctcccttcacgcccaggtttctaataccagttaattcatttcatcactaccattttggttaataatatatggccattttagtgtcttccatatgtattgcacatgttgaatatccggcacactcagaccggtgaatgttttctcacaggttattattgcagcagaactcctaaaaaatgcagatgaattagtcaaacagaaaatcatcccacatcagttattagtggctatcgacttgcttgcaagtaagattgtttgcattagagaaattttttttgatgtaatagttgtaaactgtgttgtcttaacgttttgattaatactaaattttaatttgaaaaccttcaatttaaatgttttagcatttaagtagtaatattgaagttaaaaacttggaccagtatcttttttctcatttgactaccacattttctcctaaaatagattttagtggctatgcttatgggatagattaaacttgccatgatctgaagaggggggttttttcatgtcctcctcctatatgaaatggctgaacgggtattattacttacgacttttggctctgtgttaagcatgatgaatgcaaagagtttgagtagtgactttataagcgttttctcccccacacttttaaacagggaagcagtgcgttatatcaatgaaaacctaattttaacacagatgaactgggaagagattgcctgattaatgctgctaagacatccatgtctccaaaatcattggaatgtatccttgtggttgtcagataaaatttagactttttaaagcaaagactttgagatgggcatggtggtatgtgcctgtagtcccagctactaaggaggctgagtaggagtattaattgaacccaggagtgccagtccaatgtgggcaacatagcaagacccgtctcgggagtgggtgcgtgtgtgcgcatgtgttgcgcgcacgcgtgcgtagtagcagcgtatcaattttgtgcaataaaattttgaataaccaattttatgcaaattgatatcaataagaggagtaatgctgtattgaaattacctgttgccttccctgcttttttagggtgaaaagtaataaaaagcatgtctaaaagtgatatgaattgcagatagtgataatgttgtaacatttggtgacaagtaatgcttgctgctttaatagattagattactaaaaggaagtcccttgaattacccttgatttttcacgtgtgtaccctttgtccattccaaacctgttactgtcctaacttttggcgtagaaatggtgatttctttgctaacatggtagtagatgctgtacttgcattaaatacacagacataagaggccagccacgctatccagtcaactctgttaatattttaaagcccatgggagaagtcaaatggagagtatgctcatcagtggctatgcactcaactggtggtgggatcccagggtaaggtttgggatttggtttatagaatgagattgctacagataaaactagcttttcttttggctgggcgcggtggctcatgcctgtaatcccagcactttggaggctgagtcaggtggatcacgagggcaggagtttgagagcagcctgtccaatatggtaaacctcatctctactaaaaaatacaaaaattagctgggcatggtggcacctgcctgtatcccagctacttgggaggctgaggaaggagaatcactggaacctgggaggcggagattgagtgagccaagatcacaccactgcactccagcctgggctacagagtgagactccgtctcaaaaaaaaaaaaaataaaaaatgtttttttgtggattatgtgcagtacatctttttgtatttaaagcacatacaacatggtagaaggaatgtgaattaaaagaaattacgtgcatttatgccataaaatttttctaagataaaatgcaatgaattagtctaaatttgtgtgtttacaacaatcgattataggtactctttattatgcttttaaggatagacgtattaacttaatctatgttcaattgtaggcatgcccaagagaatcgtaaatgcaaaaattgcttgccttgactcagcctgcaaaaaacaaaaatgaagcttggtgtacaggtggtcattacagaccctgaaaactggaccaaattagacagaggtatgttgagagattatttttggcctttta

SEQ ID NO: 5063 - DNA, 31130 bp, Homo sapiens
aacctcttttttttttttttaagagacagggtctcgctatgttgcccaggctggtcttgactcctggcctcaagtgatcctcccttctcggcctctgtagtgctgggattacacgcatagctgcactcagcctgttctattttttaaatcctgacaggtaatctcaggaattcaaaagggagtgtgagaaattaataaatacatcatgatatgacagtgtgatcttaccgagtcagaaatgtgatacacagtataaactcttcatagatcatccagcatgctggtatagtagaaaactattgtttggtgagaaagatgttaattctggagaaactagatagtttgtggggaaaagtatttctagattaaactttagccatgaaagaatggaatctactcctaaaatatgaatagatctttgtctaacttacgataatgtgatttaacaaatgtagttttccttccataagaactgacagtctttttgctttaaaaatatttcttagtgttttatcaacttgaagaactatctttttaaataaaataatagcctaatataggtcatatgaatagtcacactcggtttagctctgttgagcattttttctaaaggtaatagatgtgttgtcttttacggttgtattgatgactagtttcttattgctgaactagtttcttagaacatttttctggctcctacccagttttgccatttgcatttataatacaataagacctcactgaacatccacagtggcttcatggaactgactttaagaggaaagatgatgtataaaaaaacaagttttcctccccccatcagcgtacaataaacaactgtatttgagaaattgctgtccattgttttgcttaaagtggcagtttcaagaatttatgagtaacgtggaggacttggagtgttttgtagcgttcttctcccttcagcccaggtttctaataaccagttaattcatttcatcactaccattttggttaataatattggccattttagtgtcattccatatgtattgcacatgttgaatatccggcacactcagacggtgaatgttttctcaacaggttattattgcagcagaactcctaaaaaatgcagatgattagtcaaacagaaaattcatcccacatcagttattagtggctatcgacttgcttgcaataagattgtttgcattcagagaaattttttttgatgtaatagttgtaaactgtgttgtctaacgttttgattaataactaaattttaatttgaaaaccttcaatttaaatgttttagctttaagtagtaatatttgaagttaaaaacttggaccagtatcttttttctcatttgactccacattttctcctaataatagattttagtggctatgcttatgggatagattaaacttgcatgatctgaagagggagggttttttcatgtcctcctcctatatgaaatggctgaacggtattattacttacgacattttggctctgtgttaagcatgatgaatgcaaagagtttgagagtgactttataagcgtttttctcccccacacttttaaacagggaagcagtgcgttatacaatgaaaacctaattgttaacacagatgaactgggaagagattgcctgattaatgctgtaagacatccatgtcttccaaaatcattggaatgtatccttgtggttgtcagataaaattagactttttaaagcataagactttgagatgggcatggtggtatgtgcctgtagtcccactactaaggaggctgaggtaggagtattaattgaacccaggagtgccagtccaatgtggcaacatagcaagaccctgtctcgggagtgggtgcgtgtgtgcgcatgtgttgcgcgcaccgtgcgtagtagcagcagtatcaattttgtgcaataaaattttgaataaccaattttatcaaattgatatcaatagagaggagtaatgctgtattgaaattacctgttgccttccctgttttttagggtgaaaaggtaataaaaagcatgtctaaaagtgatatgaattgcagataggataatgttgtaacattttggtgacaagtaatgcttgctgctttaatagattagattacaaaaggaagtcccttgaaattacccttgatttttcacgtgtgtaccctttgtccattccaacctgttactgtccttaacttttggcgtagaaatggtgatttctttgctaacatggtatagatgctgtacttgctattaaatacacagacataagaggccagccacgctatccagtcactctgttaatattttgaaagcccatgggagaagtcaaatggagagtatgctcatcagtgctatgcactcaactgtgtggtgggatcccagggtaaggtttgggatttggtttatagatgagattgctacagattaaaactagcttttcttttggctgggcgcggtggctcatgccttaatcccagcactttgggaggctgagtcaggtggatcacgagggcaggagtttgagagcgcctgtccaatatggtgaaacctcatctctactaaaaaatacaaaaattagctgggcatgtggcacctgcctgtagtcccagctacttgggaggctgaggaaggagaatcactggaactgggaggcggagattgcagtgagccaagatcacaccactgcactccagcctgggctacaagtgagactccgtctcaaaaaaaaaaaaaaataaaaaatgtttttttgtggattatgtgagtacatctttttgtaatttaaagcacatacaacatggtagaaggaatgtgaattaaaaaaattacgtgcatttaatgccataaaatttttctaagataaaatgcaatgaattagtctaatttgtgtgtttacatacaatcgattataggtactctttattatgcttttaaggatagcgtattaacttaatcttatgttcaattgtaggcatgcccaagagaatcgtaaatgcaaaattgcttgccttgacttcagcctgcaaaaaacaaaaatgaagcttggtgtacaggtggtattacagaccctgaaaaactggaccaaattagacagaggtatgttgagagattatttttgccttttaagtgtgagtgtcttggaggactttaacatttttagccaagtcaaactatttacttccagaaaaattagcctggtggtgtttttagagggatttggggttatacaacctattgaaaatcggcctttttgtggaattttgattgtatgagtctattaatattaaagatgtaaagacaggaatctaatttcctcaaagcagtacagaactcagcagtatagtattgactgtacctactgtttgctagatactggaggtgcaggtgatattagtggttggcatgccagaaggctaatggtggaggtagtgtgaccattgctatagatttgactgcctgacagtcacttaaacaataaattgtttaggctgggcacagtggctcatgcctgtaatcgcaacactttgagagctgaggtggcaagaatctgaagcccaggaggttgaggctgcagtgagctgtgattgtacactgcactccaacctgggtgacagcgagaccctgtctcaaaaaaaaaaaaaaaaaaaaatagtttaaacagtagttaaaccagacctacaagaaagctttgccaagagtaagaaatggctgtcatcttttaaatcagtctgcacgggtattcttttttccttccttcctcatacaaaaagtgtcctttcttccatcaaagccagtccctctacagtaagtgttctagagtctgttccttctgctctagagccttttctttgattcttgtttcatacttgcatcttcaactaatttgctctttcctggattcttcctgtggctcttttgtccttcaagcttcttcgtacatcctgtgctataggtactccctatcgtacatctttacaggcagatgtcatgagtggtttactaacaaaacttctctggtgcttttcttctcatcccttttcagccctgttctccatttgaggactgcatgttaaggtctctagcgtgaaattcggaagacattttcagccttcctcttactgacctttagcaaccctttgattatgtccttcttgaaatgctttcggggatggaaggcttgtgatgctgctttgtctggaccatgtcataatactctccaggatagcccctttgttccctgacttcatgtattatctctctatgccagagactctttcagctgtttctctaagctccaacacacatacctctatctagtagaatgcttttcaagcatctcaaagtgaacatgtctaaactgaacttgtgataataccgcaaatctgcttttgaccattttagtgatggggagtcctcacacaggcagaaaactaggaaatgtccttaactcctcctttttaccaacactttttctctaatctgtcaccaagaccgcttgatttctacctccaaattaaatttacctacttttcatttcttgcctagactgttgtagaaacacacccaagctagtctcttagagaagcttttcttcttcttcaatctaaattatattctgttgtaacttcctgtattttttcttcctggggctattacagtttttaccatgagtttatataacagtgtgtagcacacagtacttgtttagtaacaagctgcttttgaggttgatctgtaattcattttactttaaaaattcttcgaatgattattcacatggcttcactcatattgactcttcaaatctggatctcccatagtttatggttccatgatgtaagtgactgcctcctgggagcttcacctgagtaacagcagagacttcaacttaatcttgtcctcaactaaactctcatttcccatcctgcccccaaaactcttgttattattttactccaggagtcacccaagccataaaatttgacttttctgtttaggttgtcttcagcttatatctcatgttattatcttcttgtcttcagccattcagtgcagtttccacatgataatcagggaatccttttgaaaacacagatgatatactagtcttgcttagagatattagcttagtatctagattgtttggtgtaacctgcaaggtttttcacttttctggttctgcttcttttgtgctttcaactctggactcctgtttttgtttgtttgtttgtttttgagacgagttttgctcttgttgcccaggctggagtgcagtggcacggtctcggctcactgcgaccccgccttccgggtttaagtgatactcctgcctcagtctcctgagtatctgggattacagcgcccaccaccaggcccaactaattttttgtatttttagtagaggcggtttcaccgtgtggccaggttggtctcgaactcctgacctcaggtgatctgcccgcctcagcctcccaaaggctgggattacaggcgtgagccactgcacttggcctggactcatcttcattgtccacctctaggctaaatttatgtcttttatgtgcttgtaatctctgcataccactttagtgacactgccctggagtgtgattggtaatccctctccccactagatccttgaaggcaggacctgtttccctgtttaaccatagttctcaattagtaattcaaatttgggttggggagagctaagggtaatttttaattccttcaaattttccatgaattggactaatttaaattctggtcagaataacaaaggataatacaatttgatctatgattatcttgtgataaatacttaatggaagtaaattatttttaaaaatcacagaaggtaactcaggttacaaaaatactttgcagagaacagatatcaccaaggagagaattcagaagatcctggcaactggtgccaatgttattctaccactggtggaattgatgatatgtgtctgaagtattttgtggaggctggtgctatggcattagaagagttttaaaaagggaccttaaacgcattgccaaagcttctggaggtatgtctgtgctggctgtcacataaaatacttttattatccctgatcctatcaaaggtctttttacttggaatattgacagaaaacagctcaaaaacatttatattctcttaatgctttgtgctacaacacatttatagagccatttttcatgtaactggagaaattttgttggaaatttgtgactgaatttgttcatttctaaaatgacagttccatcttaggataaaaggagttaccgtgtctgcctaactaaattctaaacttgtaatatagcacttttaccacaaatgctactgagtcaaggatattaaaatcatgaaagagcaatattcacagatcctttgtaactctcttattagaactattctgtcaaccctggccaatttggaaggtgaagaaacttttgaagctgcaatgtgggacaggcagaagaagtggtacaggagagaatttgtgatgatgagctgatcttaatcaaaagtaagagccactttctaaaattgtaaagttataccgattttgttaagtaaaagtagttttcttcccatttatttgctgcttgtagtctcacagtgatacgagcagttatacgcatggataaaataacattgggccactgtaaattgagatgaagtaaccattttcatctcttctcagggactagacattgtttctgtatagtatatctaaatatcctgtgtaggcaggacttagggaactttatgtagacttattttattaaaatgccattttttttgagaaattgatggtctggcaaaaaaaaatttttaaaaatgctattacaagaattgtacttttgttttgaacagtctaaggctcgtacgtctgcatcgattatcttacgtggggcaaatgatttcatgtgtgatagatggagcgctctttacatgatgcactttgtgtagtgaagagagttttggagtcaaaactgtggttcccggtgggggtgctgtagaagcagccctttccatataccttgaaaactatcaaccagcatggtaagaacagtcatttcttgtcttagaggcctgagagcagtagctgtgacttcaattttttttttcccttttgtgaagtcacctaattttcttcttttcctaggggttcgggaacagcttgcgattgcagagtttgcaagatcacttcttgttattcccaatacacagcagttaatgctgcccaggactccacagatctggttgcaaaattaagagcttttcatatgaggcccaggttaacccagaacgtaaaaatctaaaatggtaagcatggtttcccgctcttgttaacctctgcagaacaggttgcattaaaaaggatagtagtcaattacatgtcagcaacataagtaacagacttgtcaaatacttaacatgaaaaacttcacagcaagcatttgtgttcagtcactgtaattcaagggataatgactaattattagcactggtgtgtcttcgttactgtgattgctaatctctccctgcttcttttggtagaaagactacctacaagatctctgtctgatttaaaaatcaaccttaatacttgaatgaaatgctggagttaataggccacctatgaaattgtaagcggccgttaaataattctttcttaattgcaggattggtcttgatttagcaatggtaaacctcgagacaacaaacaagcaggggtgtttgaaccaaccatagttaagttaagagtttgaaatttgcaacagaagctgcaatcaccattcttcgaattgatgatctattaaattacatccagaaagtaaagatgataaacatggaagttatgaagatgctgttcatctggagcccttaatgattgatctgatgttccttttatttataacaatgttaaatgcaatgtcttgtaccttgagttgagtattacacattaaagtaaagtacaagctgtaaacttggtttttgtgatgtaggaaatggtttccatctgtactttggtcctctgatttcacatattgaacctagtactttattagtttaaaaagaaattgaggttgttcaaagtttaagcaattcatctctctgaacacacattgctattcccatcccacccccaatgcacagggctgcaacacccgacttctgcccattctctccagtgtgtgtaacagggtcacaagaattcgacagccagagctccaagagggtggcccaaggctatagcccctccttcaatattgacctagcgggggagaaagatttagattgtttattcttctgtggacacagtttaaaatcttaaacttgtcttttcctcttaatgtatcagcatgctaccctttcaaactcaaattttcattttaactgcttagaataaatttacacctttgtgaaaattcatccctgcctatcttacctcgttccttttatgcaagtaagccaatgtctttttttttttttttttttttttaccttgggaagtaatgaactagtcctagtaactagtatttctttaactattacccacatggccaacacctagaagatacatcttaaaattggattgtgaaattcactggtaagctctcagggttacttgtgcatctttccttctctgggtttaatccaagttctttaactattgcagcagagacagctgcaaaggctcattgatttcaaatatgtcaacatcttccagtgaccaacctgcttttgtaacctagaggaagattcatagaaaagaggtctaaacttgggtggaaaggctaaagttaaaccattcttttcaacataaatatatgctgcatgatactggtaactgctactttggtttgttcttaggttatacagtgacattctcacacatttttgccttagtgacatccattccatccaaaaggttagggtgtgatctaaaagatcccttagaaattctaaattgtcttaaaattttgaaccagtacatctgttatgtgtacctaaggctaatgtaacagaatcagttcccctagaaagcatgtgtccaaatgctctcagtggctgggggtagtggctcacacctgaaatctcaacacttgggggcctaaggcaagaggatcaattgaactcaggagttcaaaaccagcctgggcgacatagacttgtctctacgaaatgaagaaggcgtggtgcacctgtagttcgaggtaatgggaggctaggcaggaggaatatttgagcctaggagttttgaggctgcagtgagctatgatggtgccctgcactccagcctggacaacagagcaagaccttatctcaaaaatagaaataaatgctctggttactcttctggtagggaaagactagagctaactacatgaataagctcacttaaggtaacaggaagacaaatttcataaaagggaatagggttatactcacagcttgctttatggtggaattggtcctattcccataatggaaggctccacacccacttgggaccaggaaactaccgtgctaaaggtgtaagcccacgtttatcagcttctgacttcttcataagaacgacagtgcagcaccatcatttattcctgtaaaatatgagtgacttaatttctaccatgcttattacctcagttacatatctgtggcttctttaccacctgaagacatgagttaaatgattttactgttggctaaggcatttactataattcaacagactttacatagaaattatgtttggcatatattgaccacaaaactttccaactagagaaagtggtaggattacagtagtcggggctggcgtggtggctcacgcctgtaatcccagcactttgggaggtggaggagggtgaatcactgaggtcaggagtttgagaccagcctgaccaatagggtgaaagccatctctacttaaaaagaaaaatcagccggtgtggtggtgtgcgcctgtagtcccagccactcaggaggctgagcaggagaattgcttgaacctgggaggcggagattgcagtgagccaagattgcaccactgactccagcctgggcgacagagtgaggctccgtctcaaaaagaaaaaaaaaggattacagagttggggaggggagatctctgacaggaaatggaagaataagcctgggcttcacaaggagtattgggagtttctggtactggaaaaatacaaaggtagataaactgaagttccctaattacttcttcatttgtatgtctagttgggatgtcaagaaaccaaattaattctttcagtaaggttaagtcaatgatcaaatacagagaaatgacatgtttccttaaactgttttaagaaaattttgtacataaatattgagttgggtgtggtggctcatgcctgtagtcccccagctattgggaggttaaggcagggggctcacttgagcccaggagtttgaggctgcaagtgagcatgatcatattgctgcacacgaacctggctggcagagtgagtccctgtcccaaaaaatagacttttgtatataaataaagagaaaaatattcactcggtagacattatagaacatagtatcccccagatgtccttcagaaaatctaacctgaagcattggctggggtgactgttcccgtccatcagtaagaaagtaaggctttagcttggacatggcttctatgttgctcccatggcaggaaactcatctgttttaacttcaataagacctaagcaaaggaaaaccaattactcaaattagtccagagacagaagtaagtgtgctgggaatggtgggttctctgccattaaacataggattcatatttagcagaaaagttttaatatgtgaccactttgatgacaacaggaggaagtacacacaagaattattgtacatgaaaacaatttatgagtatgtccttatgagacactgtgttttccaaatccataggccttcctgaggaaagtagctaccagggacctgtttgtgcaaattctgctatagtttgggtcatagtacttggctggttacgagtgagtggatcaggcgtctcaaagccaatcgtgcactgctggcaggacataagagatatcagttatcaataaggagcttgacgggagcattctgtattagaaaatagcgagtgaccccaaaagatccacccttagaaatgtgaaatggagatcacacagaaacagcgagaagtaatgggtgtccacttctgagaggttgagcctatacaggaaacaggtcagctggtgcctcctaacaaccatgagccagtctccagcttctcatgaaacctgctgtgtgtgcacagtggtcatggacgctctggaaccagagtgcttgagtgctgacataggtcccatgttaccgtgtcctgtaaacccagcatacccctccccacattcatgtatccaggacatatatttgcaacctgaaaaacataactaagataaatttctaaagattcctatgtattactcttttagatgttactcttacctataaataggtgatgtttaaaccactatgatatactcaccttttctagttgacaccaaaactggtacaattctttgtcaaaatggccagctttctgtgcattctctgtcctgttctgggacagaactgcaccttgtcctgatcttctctactcacttgccattttttggctacattttcagctgggaaggagaaaaacagcaaaaaactaacattttcatgaactggcatttgatagctcaagtcgtcacatttgaccaagcactgactgaccacatatgctagcaggctcatggtggcctgtgcatgctctgtgtggggtggccctgcctgccactggcagttggtttggaaatgttgcagtgatctcaggagtcatacttctctccttccctttctatataattgtaaacttacagaaatttcttcacccagagtcaccatttatattttccctccatttgctttaatattttctttctgaccatctgagagaaagttggagatacaatgccttcttactcttaaattttaatttcagtgatacttccccaaaacaaggccactttcttacataagcacagttataaaactcaagaaatgggccaagtgtggcggctcacacctgtaatcccagcattttgggaggccgaggtgggagatcacttgagcccaggagtttgagaccagcctgggcacagcgagaccctgtctccattaaaataaatttagccgggcatggtgtgtgtgccatgtagctagtagtcctagctgcttggaggctgaggcagaaggatcacttgagcctaggagttcaaggctgcagtgagccatgatttgcctctgcactccagcctgggtgaccctgtctcacaaaacaaaacaaaaatcaggaaattaacatgaatcaaacactattatctaatccttggtccacattcaaatttcacctatattcagtaatgtccttctagctcctttatttgagccaataaagaagcatgcattgtacaacatcaatctctctagtttgcttttgtctgtaacagttcttcagactatgcttcttaagctgatatttttgaagaacatgggcgagttcttttgttaagggtcatcaattttgatttgtcgatgtttcctcagaattagattaagattctgccaaaaggcaggtataccactgaatgatgtatgatttttctcagtgagtcttattaggacacaaatgacaatcagtttatcccaggtatgttatctttgatcacttggttaaaatggtttggtattcaccaggtttctagcttttaaggtaccattttttcatttataagtaatcaataatttatcagaggttctttttggattaccaaatatcttcttccccatcatattttcacccactagttttagcattcattcatgacttctaactccaacattccttctattggtaagatattaattggcattttaccataaagaaaccttttccttttctcccatttattcagttatttatatcaggatggactcatacattttcttttattgaataagttataactcattactttcattacttactttgatgctgaaatttttaatacttgggcagttataacccattactatcattacttatttgcacgctgaaattgttcaaatttaggcagttacaacccattactatcataacttatttgcacgctgaaattgttcaaatttgggcagttacaacccattactatcattactgactctgatgctcaaattgttcaaattccactacaggaaagtggaagccccgtaggctgcctcctgtgtgctttcaacatgtcctgagcatgtccttaattttttagcattttttccctagccttggaaagggccatttctcaaacaaccttagttccttttagtggataaatgtatttagaagatctgggtgtcaggactcttgttgttactggtttgtcattgtttctaggtctgttcagtagaaacttccatatgtatatttataattttacatatacacacacactcatggtaacaccttgagttcatactgcatttgagttctccaaaatgcaacctaacaccacaagctacattcttctccctttccgtattgtaactctcttctacaaatgtgagaattggccaggtttggtgggtcacacctgtaatccagcactttgggaggctgaggtgggaggatcccttgagctcaggagtttgaggccagcctggcaacatggtgaaaccccatttctacaaaaaatacaaaaaattagccaggcatggtgggagtacctgtggtcccagctactcaggaggctgaggtgggggttgcagtgagccaagatgagccactgcactccaatctgggtgccagagtgagacccgtctccacacacacacacaaaaagttattgctttgctttctatgtcttgtctttacttatcaagctgtttttctttcttttttttttttttgttggatgatgtctcactatgttgaccaggctggagtgcagcagctataacaggcaaaatcaaccatagtatactatacaacctcaaactgctggcctcaagtgatctcccaccacagcctccctagtagctgggactataggcacctgccactgcaccctgtaaagctattctcttatatatacttctagaagctttacattttttgcttttatttttaaatcatgatttatctcaaattagcttttatatagggtgtgaggtagggatctaggttcatcttcccatgtgagtaatctgttattccagcaccatttgttgaaaagactttaatttctccattcattccattgatgcctttgttgaaaacgagcataagtctgggtctatttctgaactctttctctttctctgtccttatgccaaaaccacattgtcttgtttacaacagctttataggaatgttaaaatcagagcatgtaagtgctattttctgacttcaaaattgttttggctatttgagtgctttgcattttatacagtatttatttacactatttatttatttatttagagatgagtttcattcttgttgcccaggctggagtgcaatggtgcaatatctcagcttactgcacctccgcctcttaggttcaagcaagtctcctcccttggcctccagagtagctgggactaaggcacctgctgcaacacctggctaattttttgtagttttagtagagatggggtttcacgtgttagccaggatggtctcaatctcctgacctcatgatccgcccgcctcggcctcccaagtgctaggattacaggcgtgagccaccgcgcccggctggaagctattcttttgttgttttgttgttgttgtgtcactatgttaaccagactggaatgcagtagatactcacaggtgcatcatagtagactatgatagcattgcccaggctagactcaaactcttggactcaagcaactcttgcctcagctcttgagtaggtgggactacaggcacataccaccatgcctggctccttagtatttcttgtagtgtaggtgtgcaggcaattcattttccttcatctaaaaatggccttcactttcactcttgttttttttttttttgagacagagtctcactctgttgcccagatggagtgcagtggcatgatctttttttaactttttgctacaatttgctaaggtgtaattttcccttgtctatcttggtctttgaacttcttttcacaccaaatgtggaaattttcttcgtttttttctgccccattctctctcttccttatgtatgagattcctattccatgcatgcagtcctatttattttgtcctgcagaccaccaaggctctgttcatttatattttattttttgagacggagtttcattcttgttgctcaggctggagtgcaatggcgtgatctcagctcacgcaacctccgcctcccaggttcaagcgattctcctgcctcagcctcccgagtagctggattacaggcatgcgccaccagcctggctaattttgtatttttagtagagatggagtttcccatgttggtcatgtgggtctcaaactcccgacctcaggtgatctgcctgcgttgacctccaaagtgctgggattacaggcatgagccaccacacctggcctattttttaatttaattaatttaatttaattttttgagacagagttttgtttgttacccaggctggagcgcaatgggtgatctcagcttgctgcaacctccacctcctgggttcaagctattcttctgcctcagctcccaagtagttgggattacaggcatgggccaccacatccagctcatttttgtatttttgtagagacagggtttccccatgttggccaggctggtcttgaactcctgacctcagatgactacccggcttggcctcccaaagtgctgggattacaagcgtgagctaccgtgcctggccgttcatttattcttcattatttttctctgtgttcttcaggtcgtgtatatgatctatctcaaacttcctgaccctttttcttctgtctccaagatgctgttaaggccattcagaattttttttctttttttttagagatgaggtctaactatgttgctcagcctagtctcaaaccccagcctcaagtgatcctcccacctcagcctcccaaggtgctgggattacaggtgcgagccccatgcccggccccatcccagtgaattcttaatttcagattgtgtactttgcaagttctgaatttctatttggttcttgtttatattttttccttttactcctgagatgtccacatctttcctctatgaagattatattttcctttgtatctttaaacatatgtaaaatagagccttaagatcctcatctgataattctagtattgcagggtctgttgactgttgtggtttttttcaccctggttgtaagctatattttcctaattctttgtgtatctagaaagttctcattgcagctgaacattatagttgctacataactggacatagagattttattatctttagagaataattgagttttgtttccacaagcagtcaaaatactggcaaatcaccttgatccttttgagcttgtttttaagcttattagtttgggtctagagtagcttttactctatggctttggcccacccctaaactgtggtctttctgagatgtcaatggagtgtccaaggagttcagtaaggttccactcgcttgtccagaacttttatctcctagtaatctataaaatctccagttcaccttcctttgcagctcttttctactaggccttgtaagctgttatctacaagcttagtatttgtcaaagacttaaggggaaccttttgcagatttctggagctctttttttcttctccccctattctgccccacaaactccagccatctcagaagccccaaattctctgcttcttcagatcctgagaccactgtttccagcttaggctctgcctctccataacacagtttgggaagtgcctgggtagagacagtgacagtggggttttcccttctctcaaggatctcagtcttacatgatattagtcaaaacctgacatacataaaacagtggctttatatattttcacaagttttatcttgtttatagtaggaaatctaatctttgtcaattactccatcatgacctgagcctttttcttttctttttttctaaagaagagcaatttattttcttacagttctggaggctggaaggtaccattcaatccacagtacaccttggaaagggctcgggatctgaatttttaatgacccctctagttatggttgaggcagttggtcacacagtgtcttccattgtctgcctgtgttttatagccttctctgttgtggctgtaagtcgagaagtggtcaagatgccttgagcttctcttgcttcccatatccctaagcccttccttccttcctagcattcatgcacacagttccctttggaatcttgtacttttccccattacctttttcacatatttatgtgttacataaaaccgagccattgctgcatgcatttgagcaaggtgcttaacttctcagggtttgattctttaatctaaaatgtctattctgtttcttaagttttacatgtatactaaagacaagagtgctttgatttcccagttgctttgccattaaacttagaccacaggacccttcagcatgaatgaccataacccaattgtgtagtacaaaaagtacagctaggtaccaaaaaaacaactggtttattctgtcactacctctgccacagaagcactatttgtgggccctgtttcttcatttggtaaatgaggggttgatccagaagaactctgaggtacttcccacttctaacattctctgataacaagagttcacaaagaagagaatacttacttcacttcagttaatcaaagaagagatataaaatccttaagacagtctctggccataaggacgaaagcacctaagaagcagattagtattggtctttttaacctttttaaagctaatacagtttcagccatgtctgccttacctgtaaacccatatgacagttgtgaaatgcatctgtaagaccatcacagagtatactgtcagtcatggcatctcacctatctttactcctgttctcaagtaagccaagtgaggagcctagaagtagaaataaaaatggatttaggcttagttgcaattagtcttctccccagaatacaactcaaactatctagtatttcctaagtcttcatctaggcccctttgcagcccttctccccagtttaggtcctcagccaggccaaggtctaaagacccctggaattagcagacttcatctttccattgttgggaacgattactctcctacctacccattttcaattctccctcaaacctacccttctgtgtcctgtttccttaagaattccatttattctttccatcgaggcaattaattattgttaaatgaagaaatcctctaagggcttaagtaaagctaacaatgtgttacctatttcatggatgacataatgtctacagtgagaataatcaggctaactaaatgatggggagggattctgagtagcggccagtcttaactctcaccaactcaacagcaggtatattagaatggaagagtcattgattggacttagagtcggaagagttgtatttgaatgctggctctggtcctcgtttccttacctgtaaactgggaatggtatcatctaccctatatggggctgttgtgaaccatgtacaaaagcacctggtaaagtactacacagatgtcagtgtcatcccatcaaaatcctccgattatttttgttacctttagcctgcctcctcctgaacctcagcaatggctgggcgaatcagcttctatctagggaatctgcacctcagcccctgagctgcatcagtaggaagcgggggtatagtttttctttcaaccactatgccagtttgaggtatggaacttggtgaaacaatcatgcctggcaaacctactggagaagggcaccacttggtggtcctcttttacatgtctataccctgaaaaggtcaaaaagtctggtccccaggatctccttgtcatgtgcaggaagtaagtggcaacatctgttttttgccttttactcacaatgggaaagaaatttaaaaccaggacatcaagcaactaatatgaatttaattcagaaaatattacatgcttcattaatagttagaaaaagtatattcggttccaatcacactggttgataaacttcttatcaacccggattcccacccaaactgaagaatacttcacattcaagtagggatcaaggttgtcatttctgttatttgttcactgtttggttccagctctgctatgcatctgtttactctgttctggcataacatgagtttctcagtgtgaggtcagtgaaagccacctcatcagagaggccttaccttgtcatattttccatgcctcctgcaaccacaatgctggagtctcctatccctattgactggctgcaaggcacacagcttttaggcctgacccacagatcatctggcagctccatgctggacagagtagggaattcctgcacccacactggcttgtctaacaggattctgcccacagcctgaaagaggaacacagaggactcttagcaatcaaggagaaagacaaaatgtcacagtgaagtgtgtggaaaattgccagttgggttacctgccacttctgaaagcctacaggtcaagtagtgcccactggaggcaaaaaggcctgtatacactctccacctgtcacagtctagcccttaatatatactgccttgtgctgctctgtaggtatttcatagatataagctttctcctccaaaataagtcattaatacattaagaaagaagtgtcatcctcatcttttgatatggcttaatagttgggcgcggtggctcatgcctgtaatcccagcactttgggaggccaaggagggcaatcacctgaggtcgggagtttgagaccagcctgaccaacatggagaaactctgtctgtataaaaatacaaaattagctaggcgtggtggcgcatgagtgtaatcctagttactagggagctgaggcaggagaattgcttgaacctgggaagcggaggttgcggtgagctgagatcacccattacactccagcctgggcaacaagggcgaaactccgtctcaaaaaaaaaaaagtgcggggggtgcttaaataagcattatcaaacctatgtctaataaacacaggatataacctagcattatcagtgtttctaactagggccatttgctcccaagatcatggcttaagacacttagaagaaaaagggttacttaaaaaggaaaacctttgataataagcagttctgttcttgctagtattcattacactatgcttaaatggttatataacaaaatatatacaaactcagaatcacaaatacctttttttctcattctgagtactgaaacacaaatatcttttcataattcactatgggacttcctttagttgggaagaaatacataatttacttaaagtagcacagaagaaatggagttaaaagtttcaaatattctcaatcgccattgtctgttatcagagtcaatggaaatgtttataaagtggttactctattcccagtttcagatatactcaaacctaccaccctccttggagagtttgtggggaagaactagcaaataagtcgctgataaaaacttagagatatattcatcacaatgttatcaatctgggattaggctggaaactaaaaacgggtaaggttcttgagactgaaaacatatgcaggatcatatacatattaaaaagacaggcccagtgcgggcctcaggctgtgagcagtggctcacacctgtaatcccagcactttgggaggccggggggggggcgcattacttgaggtcaggagtttgagaccagcctggacaatatggtgaaacccccctctctactaaaaatacaaaaattagctgggcatggtggtgcacgcctgtaatcccactactcaggaggttgaggcaggagaattgcttgaacctgagacagaggttgcagtgagcgagattgtacggctgcactccaccagcctgggcgacagagtgagactccatctcaaaaaaagaaaaagaagaaatgaggtacagggctgggcatggtggctcatgcctgtaatcccagactttgggaggccgaggcgggtggataacttgaggtcagaagttcgagaccagcctggcaacatgttgaaaccccatctctactaaaaatacaaaaattagctgggcacagtggcaggacctgtaatcccagtcacttgggaggctgaggcagaagaatcactggaacccgggaggcgaggttgcagtgagccaagattgcgtcactgcactccagcctgggcaacagagtgggacccatctcaaaaaaagaaaaagaaagaaatgaggtgctaacacaattaataatgctagcattagcatactacgagcttcatgagaatgagaatttctatctgatatgaacattgcttattccagctgctaaaatagtgcctggcacaaagtaggtgctcaataaacatttgttacatgttgtagaaggtatctggctcaaggaataggacagatctaagttcaagtgctagctccactcaaactgtgaccctggtaagtcatttaacctcttaaactctcatttattcatttgtaaatgaagataataggatataacagacttgtgaggaagattaaatgaggtaatgaaaggaagcatttagcacagtgctttaaaagccttaaacttagtagacatgcaccggtagtcccagtagctcagaagttcaagggcatggtgcaccatgattgtgcctgtgaacagccattgcaccacgcccaggcaacagacagactccacttctacaaaaaaatttaaaaaattagccaggttggtggcctgctcctgtaatcccagctactccagaggctgaggtgggaggataccgtgggcccaggagtttgaggttatagtgggctacgattgattacaccactgcattccagcctgacaacagagtgagaccctgtctctttaaataataataataataattaattaattaattagagtgttcaaacccaaagaatcagaagatgggggcactctcaggactcagctatattccctggggagtgatatgccccatttgcaaggggcatgatgtggcacctattttccaagctcgaactgagccctaagagggcagggaacttacctgtattgttggaaccatactcccagcataagcacagtatggggcacataggaggaactgaatacatttttgttgaatgagtgacacttgaggtagtaaggaggagcaggcatactttcctatgcgtcaggctggccctgctgctgttcttcttcttctttttaaaaggagtctcactctgttgcccaggctgaatggagtgcagggcacaatctcagctcactgcaagctccgcctcccgggttcacgccattctcctgtctcgcctcccaagtagctgggaatacaggcgcccgccaccacacccggctaattttttgtattttagtagaaacggggtttcaccgtgtcagccaggatggtcttgatctcctgacctcatatccgcccacctcggcctcccagagtgctgggattacaggcgtgagccaccgggcccggcggccctgcttcgtaagaatgaaaaggcagtgggccgcctgtagtcccagctactcgggggctgaggcaggagaatggcgtgaaaccgggagacggagcttgcagtgagccgagatcagccactgcactccagcctgggccacagagagagactccgtctcaaaaaaaaaaaaaaaaaaaaaaaaaaaggaaaagaaaaggcagtgtaggtggtgtaggtcagtggtctaagttcatcacaaaaagcatattaatgaagctaagtctttttgtttgtttagagaaggggtctcacctgtcacccatgacggagtgcagtgacacaatcactgcagtctcaaactcctgggctcagtgatcctcccacctcagcctctccagtagctgggaggcacaggccatcatacctggctttttattttttgtagagacggggtcttgctttgttgcccaggctagtctcaaacttctgactcaagtgatccttcctcctccgcctcccaaagtgctgggattacaggcgggagccacctgcctggccaagaagctgagtctcaagctggatagaagctactgacagggctggaagagggggccaacaggaggaatcataacagagggaactctgagcaaaagcaaggaggcaagacttgagtgagtgagagagtgtgtgagtgtgtgagagtgtgtgtgtgtgtgtgtgtttatggctgtttctaataagcctgacttctcctggaatcactgagacttacctgctgccaagaatgtccaaagatgacctcagacacatcttccggagccacagtggccctcttcaagactttttgatgacagtggagcccaggtcctggacaggaacagcagctaaggcaccattgaaggacctacaatagaaaggcggagagcgtggacatcacaagcctgcgggtaatacgggaacccctacgagcaggggagcctcatgaccctgtttggcaaggccacgcgaggaggcagtgcctctcctcccacacgttcctacacctgctggtctgagcaaaggtcaaggtgggtgccacactcgcagcagccgagggctggacaggcgacctccagaacggcctagggacgccgctgtacccttctatttccccaaatccgaaggactggatgcgaccccatgcttcccaaacaaaagaaccggcgggtcaagggcgttgaaaaccatgcggcacgaaggagacgaagtcacgactttagccattgtgtgacagcccgaccccagcccaaagccgggctcagaccacctagcagttcgcccctgccgcaggcattaccgatggcgcctcccggagccggccaatcaggggccccgaggagaacacctccctacgccaaccaatgggagaggcaggccacgcgatggctctacccgggagccaatccaagcacgagggacggagtacgcacatcgggagaggagagggtggggcgtagcaccaggtcagggaacgcgggagccgcagggttccagggatcccgcggctcctcgggcttggcctgaccggcttcctccacatacgcccctctcctacacaagtccggccctcgcgctcctgccgaagcagcaggcgcctcggactctgcgcggctcccgccggccactcaccatgatggtccgcgccgccgagacgatgaccacaggatctgagcctgcattcatcttgctctcctgccgccgtctgccctgcgctgcctgcaagctaggcaaagctcctcctcgcagccacaggcctgccgcgggcgggacctgaggtagccccgcccctcgccctccacctccccgccaccacctccccgcgcatcccactgtgcgcaggcgcaaggccggagcaggggcgggcggggcgcgcggggcgcggggcgcggggcgcggggcggaagtgaggccggggcgcggggcgcgggcggaagtgaggccggggtctgggcttgcgggcagaaccgcggacctcggacgcattacagagcgcctgaaaccccagtgtttctggacaccccaatgttggagttccccgacttgcgtcttgggcttttttttaaaaaatcttagggtttctcgaaacagtaaagactgggggggacaaagacttatctctcgttcagctcaggactggaatcccacgggcgagaatctcgaggcgagcccggcccgcggcgggtctcagcacagctctgatgggtccttttgctctcggcgcttcgggaggtcctatgcgtttctcctggcgccagtcattcgctcgcgtgaggggcttgtaggagcgtctcggtgcgagccccctgccttctaagatcaactctggctgtgaacgggtaggacgccgggagcgtcttagcgtcacaaaagttcctttggttgacgtttggacagtgaaggagcatgtaacaagtggggtcagttttgtttaaaaccctttctgacttcccagcctctactgggcaaagttcataatttttctgagctttctagggtttccaggcaagcttatgagggccaccgttacagcaacttgttgggaacacctggatagtggaacaagaaagctttgtccaaagtcatgaaggggaaaactgttgacggacctggagaatcttcctgaagaactttaagttgattgaaagaatcattaaatcctggaaacctacattaagactttgcagagatatgcgatgggtcagataaatcagagaaggtaaagagtgtaggccccagaggtggggcaatagaaaggaaaaaaattgcataacagtgcaatttcaggagaaatctttagggtctggaatagtgtgaaatcagctgtctactctgctaagaactcagcagcacactgaagtctcttcagttgcttcaatgtgtttcctgtcccctaacatatctgagtccaaggaattcaaggaatgcctccgtggcttttgctctattctatcccattttccccttactccctggccacttctgagtcttgtgggcttactctcacatccccttaacatgttccccaaggctcctactttgcaccagcccctgggtaataccagtcattcctacggcatcaatcaccacctgtatactgacaagtctaaatccttacatctaacctcgtctcctaagctgactgaccctcttcatttaaattcttaaagcacatcaggtcgggcaccttggctcacacctgtaatcccagcactttgggaggccgggagggcggatcatttgaggtcagcagtttgacaccagcctggccaacatggtgatatccgtttctaccataaaatagaaaaattagccgggcgtggtgccgtgcgcctgtaatcccactactggggaggctgacatgggaaaatcgcttgaacctaggaggcagaggtttcagtgaccgagatcacaccactgcactccagcctgagcgacagagagaaactgtctcaaataaataaatttcctataagcacatcaaatttgacatattgaaaccaaactcttccagcctgtttttctgtaatctcagtgagcagtgaaactatcttctgttaaccaaaccagaaatttaccttgaaactccccctaaacatcacttcttccagaaaaaccttccaatctcctgcatttggtcagcatcttacccctaacttcctctttcaacttaccatgtaattcctagtttatctgtccctctactgactacataagctttccaagatgatcctgttacactgctttatgcacagctctagcacattataggcagttatgaatgaacaccaatattctttatggccagtgcctagccatttgaatgagtatgaatatattcttctggagccaagggatatagagtttcctgcctgaggctctatctagagtaagtttaggagccaatcttgagaaggtaattgcatgcttctgcgagtggccaaacagaatctgtcccctgaggagtcctcattatagctactcatatgattactactcatatgagacagacagagactaagaataatgaatgaaggaaagaagaggaatttttttttttttttgagacggagctcgctctgtcacccaggctggagtgcagtggcgctattcggctcaccacaacctccacctcccgggttcaagcgattcttctgcctcagagtcctggtagctgggattacaggcccgtgccatcatgcccagctaatttttatatttttagtaaaacggggtttcaccatgttagtcaggctgatctcgaactcctgaccttgtgatccgcccactcggcctcccaaagtgctgggattacaggcgtgagccaccgcgcccggccagctggaaataatttttaaaattatgtcttggccggccgcggtggctcatgcctgtaatcccagcacttgggaggccgaggcgggcagatcacctgaggtcgggagttcaagacctgcctgaccaaatgcagaaactctgtctctactaaaaatacaaaattagctgggcgtggtgccacatgccgtaaatcccagctactagggaggctgaggcaggagaattgcttgaacctgggaggcggagttgtggtgggccgagattgcaccattgtactccagcctgggcaacaagagcgaaactcatctcaaaaaaaaaaaaagaaataaaataaaattacatctagatctcaaatcataaactcctggactggtgagcagggtgagtgggcaggaagccacaaaaatctccaagtgcttactatgaggagccatcattacagcagtgctatggagccagtttatcctgaaggggccttctcgcatcttcccccgctggaagatgcaatcattcttggttaagtttcataaagagttgcagagtccaagccaggtctttgctacaggctggattcaccaacctaccatgcagcaaattccccttggtctccatgaggggaacagtgaatcaccaaagtggaattgccataggatgaaggcagcagtgtactccttaccactaggggctagctcaacactccctcagcacagccacccctgatgggtccagatcagttaatgacattacctgggattatgaaagtgttcactataacccagggataggtgaactcccaagacagtgacgtagagcagcaggcaatgatttgagtacaggcataactactcatgaaagagggaacatctgagaaagaaagttgtcagaaggaatggcttacattgttttgcaaaagtgtctcaaaaactggagtagtcagttgtatccaatacaccgaggagccaaggaaactgacatctattgcgctctctgtatgaggactaccaggaaccaactggggcaccaatcagggggcactgtgatctttagacttcccagcctccaaaaacagtgggaatgcgcgtgtaaagccacccagtctgtggttttttttttttttcacagcagcccaactaagacagcagtgagtgctcttacaggggagaaaaacaaaacaaaatatcgagcctcgggatacatttgcccaaatcagttaagtgtaataccaggattcaaaccaattagatgcagagccactctatcacctctcttatcacaggcataccagaaaataaagcatccaattccagaatgagaaatactgactctgtgtaccacagaataagtgctctgagttattcatcaaggcgactcaacagaaacatgaaaatgtcacattaacaggtccatattaaattcagtcataaattgtatcactggttgaaaaattaatttcctatcacaaactcttgattacattacaccaaaggacagagaaattacatttttgtttaaattggtcaagttgaaggatgtacataacaaagccaaacacagtatctgatatatcaaacaccaaaatgtttaatcacatgcaaattaaaatcgtataggattttttactcacttgagcagactgtagaaaaggttaatcaaggttgggccggtggctcacacctgtaatcccagcactttgggaggccgaggtgggtggatcacaaggcaggagttcgagaccagcctggccaacacagtgaaacctcatctcttctaaaaatacaaaataagccgggcatggtggcgcacgcctgtaatcccagctactcaggagtctgaggcagagaattacttgaatccgggaggtggaggttgcagtgagccacgatggtgccactgcactcagcctgggtggcagagcgagactctcggcaaaaaaaaaaaagagaaaaagaaaaaaaaaaaaggttaatcaagagacagtgcagtatttaacatactgctgaagaccggatataccttatcagctaaacaagcaaaagcagcaattactttcaaataagttgtacctcagttttcggtattataactccactcccaaggttccttgattgtattacaagttatgtctaaaacaatctttgcttttaacagaaatggaatttcatttcaaccatatatgaaagctacacatttgaggccattcaatatcatacttttatacttaattacctctgagaaaatggagcaaattttgcattcttccaccttaaaaacattttctcctacctacattctaacaccccttactcatatatattaccagatatgttgttagtaaaaatcagtagtgctggccagcgttttaaaacaaaatcactgactacaaagatactctacttgaaatcaggtcacaaaaaaccaacgctgctttcaattaaaactcaaaaagggccaggagctgtagctcactcctgcaatcccaacacgttggaagccaaggcagaaggatcccttggggccaggagtttgaggccagcctgtgcaacatacgaggccttgtctctactaaaattaaaataaatgtagctgggtgtggtagtatatgccttagtctcaggtactcggaagcctgaagtgggaggatcacttgagtcgaggactttgaggtgcagtgagccatgactgcaccactgcacttgagcctaagtgacaaagcaagaccctgttcaattaaaaaaaaaaaaaaaaaaaaaaagcctaagaaatagatgactattttctttatcttttctgtattttaaaatattttgtaacaattataagtcaagaaaaaattttaagtgtgccctaaactccagctccgttttgcaaaataaggcataaattaaaaattgtgtgcaaaacgtaatcgatgcttggtcttaagtttgactgttgtggtacttgaaggataatgagtagaattcaatgactcaatgaaaatgacaaatgctaaacatacacccaaaacaaaacaaaaaactaattaaggagttacaataaaaatctttatttaggtttggtcagtacaggtaagatatctggagtcacagagcaatatgcattaacaggatacaacagttcataaaaactgagtaacatgcacacaaatttcttaaacagtcacctaaagagaaaatgcacagatgtatggtggaaaaactgtatctaacactgaaactactacaggactccatcaatgagtccaacttttagtgtaaaaaactactgtactgggcaaacttggcagtcataaacccacatctactctaacaagctgaatggtgcataagtacagtaacagcatgagtacgaatgcccttacacagcacagatctaaacagacagatttatacagacatcattgtgttgtattttaaggaaaaatttccattacaatttcacattaactcatataaaaataacttgaccctacacaaaatgtccttttagcacattcaaagtaattaactgttacaatttccaaagcggcagaagtattgaagcaaaaaaaaaaaaaaaaaaaaaaaagaaaagaaaaaaaaaacaaagaaaaaaaacaacaaaaaaaaccaaaacgtacacccacaaaaaggcaaattgtgacaaaagtatgcattaattttctggaagtatcctctcccaaattaaatgacactgtataaaaatttgctgaaaaaatattacaaactgaaccctgtacatttacacttgagtccaagccattctgaacgtggcgggaacccacattcgattacctttcccactcactgctttctcctcttgagggtcatgactggagtctgtgcatttgattggtgtgtgagagagttttcactgcccgt

SEQ ID NO: 5064 - DNA, 32623 bp, Homo sapiens
tggggaaaagcaagagatcagattgttactgtctgtgtagaaagaagtagacataggagctccattttgttctgtactaagaaaaattcttctgccttgagattctgttaatctatgacttacccccaaccccctgctctctgaaacacgtgctgtgtcaaactcagggttaaatggttaagggttgtgcaagatgtgctttgttaaacagatgcttgaaggcagcatgctcgttagagtcatcaccactccctaatctcaagtacccagggacacaaacactgcggaaggccgcgggacctctgcctaggaaagccaggtattgtccaaggtttctccccatgtgatagactgaatatggcctcgtgggaagggaaagacctgaccgtcccccagcctgacacccgtaaaggtctgtgctgaggaggattagtataagaggaaggcatgcctcttgcacttgagacaagagaaagcatctgtctcctgcctgtccctgggcaatgcactgtctcggtataaaacccgatttacgttccatctactgagttagggaaaaaccgccttagggctggaggtgggacatgcggcagcaatactgctttgtaaagcattgagatgtttatgtgtatgcatatctaaaagcacacacttgattctttactttgtctatgatgcaaagacctttgttcacatgtttgtctgctatcctctccccactattgtcttgtgaccctgacacatccccctctcagagaaacacccacaatgatcaataaatactaagggaactcagaggctggcgggatcctccatatgctgaacgtggttccctgggtccccttatttctttctctatactttgtgtctttttcttttccaagttctcgttccacctaacaagaaacacccacaggtgaggaggggcaacccaccccttcatacttaataggcaaagcattatccaaacagactgttcacagaaaagaaaaatattaatgaccaaattcacaaaaatatgctcaatctcactaacaaaatgcatggacaagacaattcgatcaacactgtaatcataaaagataatcaccctctaggagcgagttaagtaaaatccatgcatagtattccatacagttactgaaatgaatgaaataatgctttataatgatgaagataaagttaacatttactgagcacttagtatatgccaggcctgtcttaacggtttatagataagcttatgtctcaattctattattttttctatatttttttttagctgcagaaactaacacgaaaggttaagtaacttgaaaaagattaaaactagtaagtaatggagccatggtttaagcccagtgtctggctccagagtcaatgctcttaactaccatgaagaatctccaagatgtattttaagtgcgtgcttggggtggttgagggtggtggtgaagaaagatgcggaagtgttttcgtatgctaagatttattgtttttaacagtttttgcttatatgcatagacaatctttaaaggacacacaagaaactgtactccctttggattttataacatacgtatatgttacccttaaaaagtcaagtttaagttaaagaaaacacacccaaatcattagattctcactaggatctcaatgtgaaatagaagaggcattagatttggaaatatggagtctactcctggttttctggtggctctagtaaaaaatcacaatctctttttttttttttgagacggagtctcagtcgttgcccaggctggagtgcagtggcgcgatctcggctcactgcaagctccgcctcccagttcacgccactctcctgtctcagcctccctagtagctgggactacaggtgcctgccacccgcctggctaatttttttgtgtatttttagtagagacggggtttcaccgtgttagccagatggtcttgatctcctgacctcgtgatccgcccgcctcgacctcccaaagtgctgggatacaaacgtgagccaccgcgcccggccaaaaatcacaatctgttaaaccaggagtcaacatctttttccacaaagtgccagatagtaaatattttaggctttctaggtccaatagcttcgttgaaactgttcgactcagccattgtagtgctagaacagccaggtgatgcgtaaacaatgagagtaggtacagctaggttctaagaacctgggcaacgaaatttgattttcatttaatttcccaagccacaaaatattcttttgattttttttttaacttaaaaaaagtaaaaacagtttttagctcacaatctacctttggcccacgggccgtagtttgctgacacttgaaccattgttcaatgaagggcccgattcattatgtcaaaggtcatttcctactataatattctgaattctctacttttaatattgcgagtaaggcagacagagaaaaaatgaggaaatacatcttagttatttttaatgatccaaatattaaatcaaagtaatgcgttggggccgagtgcagggctcacgtctgtaatcccagcaccttgggaggctgaatcaggcagatctctcgagctcagagctcgagaccagcctgggcagcagcaaaaccccatctctacaaaaaataccagaaaaaaaaaaaagaaaaagaaaaaaattagccggccatggtagtgtgtgcctgcagtcccagtgctcaggaagctgagatgggagaatcgtttgagcctgggaggcagaggttgcagccagtgatactgtaccactgcactccagcctgggtgatagagccagagcttgtctcaaacaaacaaaacaaattagctgggagtaatggcatgcgcctctagtcccagccactcaggaggctaggtgggaagattgctggagcccagggaagtcaaggatgcagtaagcagatatcataccctgcattctagcctgggcaacagacccagaccctgtctcaaaaacaaagaaaaaagaaataataggttgggtgtttcaaaagatttttagccttaagatccagattatttaaaaagtgactgcctactccctttcttggactccctcctctatgagtaaaaatgtattacagcaacttaacacatcattatccccattccactttccactatgaaacttaagacttttgatgacaggataacatctactttatctttgtaactcctgcctctaacgcaatgcctagcaagtgataaggtatgatgcttgttcaataaataaataatacatcacacagtaatgatttccaatttatcttacaactttacatagtacttaagaagtccttaagaaattctaaaaaatcctcaccagcagataagcagcagataaacctgataaacacttacatgctgtagtatagtggtaataactagcgtcctggctctgaggtcagttaaaacatatgtaaatcttagctctggcacttacaatcatgtctccctaaacctcaatttctttgatcctgtaaaatgggggaaattataactcttcatgatgtaattttaaggattaaatgagaaaaaacatataaagcaagtagcataatcctggcaaatgtaagtgttcattaaacaaccacctttataacaaagtatctcaagtcatctagactcctaactggtctttcttcaagtcctgctccctcaaaaatttaatcttccaaaagcagctaaaatgatttttttttttttgagacagaattttgctctgtcgcccaggcgctagctcactgcaacctccgcctcctgggttcaagtgattctcgtgcctcagccactggagagctgggattacaggcgtgcaccaccacgcccctctaatttttatatttttagtagagaggggtttcaccatgttggccaggttggtctcaaactcctgacctcagatgatccgccttttcggctggctccctaaagtgctgggattacaggcatgagacaatgcgcccagccagaagatcttgaaaaaccaattcgggctcaagctttaaatcctctcgtagtttcccactataagaaaagaaagtctaaagtgctcatcttgacttacaaagctaatcatctgtcgcctccttcccctccatgttcatcttgggccattcatcctctgcccattgagcttcagatccacaagccttcagttcctcaccccagcagtttcctttgctaggactgctctttctggcagatgacaggcttcttcctctttcagatctcaccttcttaaatgtcacctcagacaggcaggtatctgtccgctactgtaacatcctctttaaatagcccccatcacacctatttgttgtttgttcagcccctccgcgaaccctgcctctacccgccgcatggcagctacctgggagagtgcctgagttgaatgaatgaaaatagtctgtagggtgcactgcccttgtcaatcacaagcagattaattacctgtgccagaactcacgggagggaaacaccgtccgccagccccgctctttccggctacagataaaagctccaggttccgggggttccggttggtgaattctggggcgacagttcattttccacagggtccacttcaggtttcgctgccggctcggagctggttgacagggtgcgaacctgcaccctgggcaacgggaaaaaccgcacagggcttaaaaatgacggatatgacagcgcacgaacccgctctaacgtctatccgcttttacacccccaatctttaggcccaggggacgaaaaatacgtatgcccacagggtggagtcagcactgaccccgtccttaactcctactgtggtcttcgcagtgccgcgagctctatttcgatccggcacgtcgaatacaaatagaacccgcacgttccaatgtactgtgcaagcccaggcgagtgagctgggagaagggggcaagactaattaccagggttcctgcaaaccgagaacccccaaaactgcgaccgaagcgcatcgctgagacgatctcggaaaagcctcgcctctttttcctcacggacgactcagtcgtcgccaggcgcagccatataaagtcagggacaagcctttggctgctgtagatccccaaatctccacgccagacgccgccgacccggaagtagcaagtcccctgccactgagtggccaaaaggcgatctgttatcctgcaccgccaatcatcgctcacgtcgaggggcacgcaggcccggagcccaccaaccacctcgtagctacgcccaagaccacgcttgttgcttaagtccgggtcaaaggcacacaccccacaaaaccatgtttgggttttctactcggagagcttgggcggcattgactggtccacacacaccccacctgggcaccgcgtaggaataaggcagggcaagagcagttttctccttaaaaagggtggttgtcttcctcgaaccaaaaattttcccgtatggccgctggaaaaactgccccgtcccacccaggttcgcgcccttaaacttacactcctgagcctggagcaaagccggccgatctgcctcacgctccccgagcagggacaaggaaaagacataaacctaaaacgcacgactcgctcagaaccccaactctaacttggagaagggcccgccctccagttacaccccagctccaagctccacccttcttacaaccttttctagaaggcactgaatggcccactgcgtctgcgcaacatcgtttgaggcgaaggttcaacctcttcccagcgtccaacatccgacttccgttctccgctttcgcgcccttcccatcggctatctaattggcaaaaatgccgaccccgccccttccccggagcctcacttccgtcacagtcctgtttctcccctgttgtccctgcctctttttccttcccgccgtgccccgcggccgggccggggcagcgggaagcgggtggggtggtgtgttacccagtagctcctgggacatcgctcgggtacgctcacgccgtcgcagccactgctgtggtcgccggtcggccgaggggccgcgatactggttgccgcggtgtaagcagaattcgacgtgtatcgctgccgtcaagatggaggggcctttgtcgtgttcggtgaccgcagcactggggaaacgatccgctcccaaaacggtaagggcgggccggcctgggtcgggtttgcggccggggagggccgagtcccaccgcgaccggaccccggctccctcgtttctctcctttacctccgcagaaagggcctcggggccccgcagccggacccacccacccgccgttctctggggcagggcgctgtggccccacttttcccacagcgaggagggccccgccgcgcgcggcagggttttgagaccggcaacgcgtggatgtggtgtccggggcgcgttggaaacgcgccctccgcgggaaagcgggcctcccgggctcgcacgtgcgggccagcctcgcacccccttttgtttcagggcgaccccctgagtgtccatgttaaacgccaggtttattttaggaccatttaccagaaaaagagtaggtccatccgcgcgccctcggatgagccggtgccctgtccgcccgcagctgcagtcgaggtcgggcgtccggcgtccagccgtatcgggttgacagcttcttacagtagagttagcccaggaaacgccactcgagtgcattgacccaggagacggcagcgctaacttagcagagcgtttgctgtcaggcctttggatacctacaagcttactgtttcttgatagattcctaatttttttcgtaaacaaatctgaaagtcaccacttccccgttgactaccgatttctctcctcacagataaagagagttttaatgagcaaaaacttgcagaatctgaaggaaaaggctggtatagctgtacgaagtggcagagcatgaaatggtggttattactttttttttttttccccgccatcagattccaccccgcatcaaagctggccaaataggctcgctttgtttagggacagggtcccacctgtcgcccagacgagagtgcatcatagctcactgcattctccaagcacaggtccgcgccgccgcatccggctttgttttattttttgtagaaatgggtttcgctatgttgcccaaaggggtctcaaactcctggcatcagcgatcctcctgcctcggcctcgcagtgttgggattacacctgtgagccacagtgtctgccccatttacactcttagtaggtggtttttaaataattaacacagatttgtagatttggaaatacgggggctgttggatgtcatttacctttaggctgaaattactgtctttcagagtgtggcttatcctcatttcttttttatttttaattgattgtctacagttatggctgcagttcgattgccaatattgtaaaaagttctcttggtccagttggcttggataaaatgttggggatgatattggtgtaagtacacataactgttgtgttagtttccttaaagtaaaactatttcagtgttttgctatgttctttctttgactttatcagaatccacgtactggaaggtgaattaaaggtgaacgtgtattataatggggctgtgttgatttctataagtggttcatatttttcctgcgaatttcttaggatgtaaccattactaacgatggtgcaaccatcctgaagtactggaggtagaacatcctgcagctaaagttctttgtgagctggctgatctgcaagacaagaagttggagatggaactacttcagtggtaggtagactggctaaagaatgatcattttctaaaaacgaccgactttcagaaagttgaagccataagtgggtcatttgtgctgtgtcaaaataagttacatattctgaatgcccagaagattgagcaagaagaaaaaacaaaagaagtacacatttaagaggggaaataagcttcttaggtacagattcagaaacaaaatttgtaattgatagttacagctagtttgtacagtttaagtaggaaagaatttgagttcatttgacaagccccattgttttaaatgttggtattcacaagttttgagggcttatttttccttttatgcagtattcagacatcacacagatttttttatggtctctcaaaagtcttgtttcctccccatcaccccttgagacttggaaagctctcaacttttctgattatttggaggataaaatgtaccaatctgggggagaaacaatgtttttatattattatttttaagagaccatctgtagacagtctgaagtgctgcagtgctgtcatatctcactgcagcctggaactcctgggttcagcaatcctcctgccttagcctcccagagtgcttgggattgcaggcatgtgccaccacaacaactaattaaaaacctcttttttttttttttaagagacagggtctcgctatgttgcccggctggtcttgaactcctggcctcaagtgatcctcccttctcggcctctgtagtgctggattacacgcatgagctgcactcagcctgttctattttttaaatcctgacaggtaatctcggaattcaaaatgggagtgtgagaaattaataaatacatcatgatatgacagtgtgatctaccgagtcagtaaatgtgatacacagtataaactcttcatagatcatccagcatgctgtatagtagaaacactattgtttggtgagaaagatgttaattctggagaaactagatagttgtggggaaaatgtatttctagattaaactttagccatgaaagaatggaatctactcctaaatatgaatatgatctttgtctaacttacgataatgtgatttaacaaatgtagttttcttccataagaagctgacagtctttttgctttaaaaatatttcttagtgttttatcaactgaagaactatcttttttaaataaaataatagcctaatataggtcatatgaatagtcacatcggtttagcttctgttgagcattttttctaaaggtaatagatgtgttgtcttttacggtgtattgatgaactagtttcttattgctgaactagtttcttagaacatttttctggctctacccagttttggccatttgcatttataatacaataagacctcactgaacatccacagtgcttcatggaaactgactttaagaggaaagatgatgtataaaaaaacaagttttcctcccccatcagcgttacaataaacaactgtatttgagaaattgctgtccattgttttgcttaagtggcagtttccaagaatttatgagtaacgtggaggacttggagtgttttgtagcgttttctcccttcacgcccaggtttctaataaccagttaattcatttcatcactaccattttgttaataatatatggccattttagtgtcattccatatgtattgcacatgttgaatatccgcacactcagaccggtgaatgttttctcaacaggttattattgcagcagaactcctaaaaatgcagatgaattagtcaaacagaaaattcatcccacatcagttattagtggctatcgcttgcttgcaagtaagattgtttgcattcagagaaattttttttgatgtaatagttgtaactgtgttgtcttaacgttttgattaataactaaattttaatttgaaaaccttcaatttaatgttttagcatttaagtagtaatatttgaagttaaaaacttggaccagtatctttttctcatttgactaccacattttctcctaataatagattttagtggctatgcttatgggatgattaaacttgccatgatctgaagagggagggttttttcatgtcctcctcctatatgaatggctgaacgggtattattacttacgacattttggctctgtgttaagcatgatgaatgcaagagtttgagtagtgactttataagcgtttttctcccccacacttttaaacagggaagagtgcgttatatcaatgaaaacctaattgttaacacagatgaactgggaagagattgccgattaatgctgctaagacatccatgtcttccaaaatcattggaatgtatccttgtggtttcagataaaatttagactttttaaagcataagactttgagatgggcatggtggtatgtgctgtagtcccagctactaaggaggctgaggtaggagtattaattgaacccaggagtgccgtccaatgtgggcaacatagcaagaccctgtctcgggagtgggtgcgtgtgtgcgcatggttgcgcgcacgcgtgcgtagtagcagcagtatcaattttgtgcaataaaattttgaataccaattttatgcaaattgatatcaatagagaggagtaatgctgtattgaaattacctgtgccttccctgcttttttagggtgaaaaggtaataaaaagcatgtctaaaagtgatatgattgcagatagtgataatgttgtaacattttggtgacaagtaatgcttgctgctttaatgattagattactaaaaggaagtcccttgaaattacccttgatttttcacgtgtgtacccttgtccattccaaacctgttactgtccttaacttttggcgtagaaatggtgatttctttctaacatggtagtagatgctgtacttgctattaaatacacagacataagaggccagccagctatccagtcaactctgttaatattttgaaagcccatgggagaagtcaaatggagagttgctcatcagtggctatgcactcaactgtgtggtgggatcccagggtaaggtttgggattggtttatagaatgagattgctacagattaaaactagcttttcttttggctgggcgcggggctcatgcctgtaatcccagcactttgggaggctgagtcaggtggatcacgagggcagagtttgagagcagcctgtccaatatggtgaaacctcatctctactaaaaaatacaaaaatagctgggcatggtggcacctgcctgtagtcccagctacttgggaggctgaggaaggagatcactggaacctgggaggcggagattgcagtgagccaagatcacaccactgcactccacctgggctacagagtgagactccgtctcaaaaaaaaaaaaaaataaaaaatgttttttttggattatgtgcagtacatctttttgtaatttaaagcacatacaacatggtagaaggaagtgaattaaaagaaattacgtgcatttaatgccataaaatttttctaagataaaatgcatgaattagtctaaatttgtgtgtttacatacaatcgattataggtactctttattatgctttaaggatagacgtattaacttaatcttatgttcaattgtaggcatgcccaagagaatgtaaatgcaaaaattgcttgccttgacttcagcctgcaaaaaacaaaaatgaagcttgggtacaggtggtcattacagaccctgaaaaactggaccaaattagacagaggtatgttgaagattatttttggccttttaagtgtgagtgtcttggaggactttaacatttttagccaatcaaactattttacttccagaaaaattagcctggtggtgtttttagagggatttggggtatacaacctatatgaaaatcggcctttttgtggaattttgattgtatgagtctattaatttaaagatgtaaaagacaggaatctaatttcctcaaagcagtacagaactcagcagtatgtattgactgtaacctactgtttgctagatactggaggtgcaggtgatattagtggttgcatgccagaagagctaatggtggaggtagtgtgaccattgctatagatttgactgcctgcagtcacttaaaacaataaattgtttaggctgggcacagtggctcatgcctgtaatcgcacactttgagaggctgaggtggcaagaatctgaagcccaggaggttgaggctgcagtgactgtgattgtaccactgcactccaacctgggtgacagcgagaccctgtctcaaaaaaaaaaaaaaaaaaaaatagtttaaacagtagttaaaccagacctacaagaaagctttgccaaagtaagaaatgtgctgtcatcttttaaatcagtctgcacgggtattcttttttccttcctcctcatacaacaaagtgtcctttcttccatcaaagccagtccctctacagtaagtgtttagagtctgtttccttctgctctagagccttttctttgattcttgtttcatacttgcatttcaactaattatgctctttcctggattcttcctgtggctcttttgtccttcaagcttctcgtacatccttgtgctataggtactccctatcgtacatctttacaggcagatgtcatggtggtttactacacaaaacttctctggtgcttttcttctcatcccttttcagccctgtttccatttgagggactgcatgttaaggtctctagcgtgaaattcggaagacattttcagcttcctcttacttgacctttagcaaccctttgattatgtccttcttgaaatgctttcgggatggaaggctttgtgatgctgctttgtctggaccatgtcataatactctccaggatagccctttgttcccatgacttcatgtattatctctctatgccagagactctttcagctgttttctaagctccaaacacacatacctctatctagtagaatgcttttcaagcatctcaaagtaacatgtctaaaactgaacttgtgataataccgcaaatctgcttttgaccattttagtgtggggagtccttcacacaggcagaaaactaggaaatgtccttaactcctcctttttaccacactttttctcctaatctgtcaccaagaccgcttgatttctacctccaaattaaatttcctacttttcattttcttgcctagactgttgtagaaacacacccaagctagtctcttaggaagcttttctttcttcttcaatctaaattatattctgttgtaacttcctgtattttttttcctggggcttattacagtttttaccatgagtttatataacagtgtgtagcacacagtcttgtttagtagacaagctgcttttgaggttgatctgtaattcattttactttaaaaatcttcgaatgatctattcacatggcttcactcatattgactcttcaaatctggatctccctagtttatggtttccatgatgtaagtgactgcctcctgggagcttcacctgagtaacagagagacttcaaacttaatcttgtcctcaactaaactctcatttcccatcctgcccccaaactcttgttatttattttactccaggagtcacccaagccataaaatttgacttttctgttaggttgtctttcagcttatatctcatgttattatcttcttgtcttcagccattcagtgagtttccacattgataatcagggaatccttttgaaaacacagatgatatactagtcttgttagagatattaagcttagtatctagattgtttggtgtaacctgcaaggtttttcactttctggttctgccttcttttgtgctttcaactctggactcctgtttttgtttgtttgttttttttgagacggagttttgctcttgttgcccaggctggagtgcagtggcacggtctcggtcactgcgacctccgccttccgggtttaagtgatactcctgcctcagtctcctgagtattgggattacaggcgcccaccaccaggcccaactaattttttgtatttttagtagaggcgtttcaccgtgttggccaggttggtctcgaactcctgacctcaggtgatctgcccgcctcgcctcccaaagtgctgggattacaggcgtgagccactgcacttggcctggactcatcttattgtccacctcctaggctaaatttatgtcttttatgtgcttgtaatctctgcataccatttagtgacacttgccctggagtgtgattggtaatccctctccccactagatccttgaagcaggacctgtgttccctgtttaaccatagttctcaattagtaattcaaatttgggttgggagagctaagtggtaatttttaattccttcaaattttccatgaattggactaatttaattctggtcagagataacaaaggataatacaatttgatctatgattatcttgtgataaatcttaatggaagttaaattatttttaaaaatcacagaaggtaactcaggttacaaaaatatttgcagagaatcagatatcaccaaggagagaattcagaagatcctggcaactggtgccatgttattctaaccactggtggaattgatgatatgtgtctgaagtattttgtggaggctgtgctatggcagttagaagagttttaaaaagggaccttaaacgcattgccaaagcttctgaggtatgtcttgtgctggctgtcacataaaatacttttattatccctgatcctatcaaggtctttttacattggaatattgacagaaaacagctcaaaaacatttatattctcttaagctttgtgctaccaacacatttatagagccatttttcatgtaactggagaaattttgttgaaatttgtgaactgaatttgttcatttctaaaatgacagttccatcttaggataaaagagttaccgtgtgctgcctaactaaattctaaacttgtaatatagcacttttaccacaaagctactgagtccaaggatattaaaatcatgaaagagcaatattcacagatcctttgtaatctcttattagcaactattctgtcaaccctggccaatttggaaggtgaagaaacttttgagctgcaatgttgggacaggcagaagaagtggtacaggagagaatttgtgatgatgagcgatcttaatcaaaaagtaagagccactttctaaaattgtaaagttataccgattttgttagtaaaagtaggttttcttcccatttatttgctgcttgtagtctcacagtgatacgagcgttatacgcatgggataaaataacattgggccactgtaaattgagatgaagtaaccatttcatctcttctgcagggactagacattgtttctgtatagtatatctaaatatcctgtgtggcaggacttaagggaactttatgtagacttattttattaaaatgccattttttttgagaattgatggtcttggcaaaaaaaaatttttaaaaatgctattacaagaattgtacttttttttgaacagtactaaggctcgtacgtctgcatcgattatcttacgtggggcaaatgattcatgtgtgatgagatggagcgctctttacatgatgcactttgtgtagtgaagagagtttggagtcaaaatctgtggttcccggtgggggtgctgtagaagcagccctttccatatacttgaaaactatgcaaccagcatggtaagaacagtcatttcttgtcttagaggcctgagacagtagctgtggacttcaattttttttttcccttttgtgaagtcacctaattttcttctttcctaggggtctcgggaacagcttgcgattgcagagtttgcaagatcacttcttgttatcccaatacactagcagttaatgctgcccaggactccacagatctggttgcaaaattaaagcttttcataatgaggcccaggttaacccagaacgtaaaaatctaaaatggtaagcatgtttcccgctctttgttaacctctgcagaacaggttgcattaaaaaggatagtagtcaatacatgtcagcaaacataagtaacagacttgtcaaatacttaacatgaaaaacttcacacaagcatttgttgttcagtcactgtaattcaagggataatgactaattattagcactgggtgtcttcgttaactgtgattgctaatctctccctgcttcttttggtagaaagactaccacaagatctctagtctgatttaaaaatcaaccttaatacttgaatgaaatgctggagttataggccacctaatgaaattgtaagcggccgttaaataattctttcttaattgcaggatggtcttgatttgagcaatggtaaacctcgagacaacaaacaagcaggggtgtttgaaccaccatagttaaagttaagagtttgaaatttgcaacagaagctgcaatcaccattcttcgattgatgatcttattaaattacatccagaaagtaaagatgataaacatggaagttatgagatgctgttcactctggagcccttaatgattgatctgatgttccttttatttataacaagttaaatgcaattgtcttgtaccttgagttgagtattacacattaaagtaaagtacaagtgtaaacttgggtttttgtgatgtaggaaatggtttccatctgtactttggtcctctgattcacatattgcaacctagtactttattagtttaaaaagaaattgaggttgttcaaagttaagcaattcattctctctgaacacacattgctattcccatcccacccccaatgcacaggctgcaacaccacgacttctgcccattctctccagtgtgtgtaacagggtcacaagaatcgacagccagatgctccaagagggtggcccaaggctatagcccctccttcaatattgactagcgggggagaaaagatttagattgtttattcttctgtggacacagtttaaaatcttaacttgtctttttcctcttaatgtatcagcatgctaccctttcaaactcaaattttcatttaactgcttaggaataaatttacacctttgtgaaaattcatccctgcctatcttacctcttccttttatgccaagtaagccaatgtctttttttttttttttttttttttaccttgggagtaatgaactcagtcctagtaactagtatttctttaactattacccacatggccaacactagaagatactatcttaaaattggattgtgaaattcactggtaagctctcagggttactgtgcatctttaccttctctgggtttaatccaagttctttaactattgcagcagagacactgcaaaggcttcattgatttcaaatatgtcaacatcttccagtgaccaacctgctttttaacctagaggaaagattcatagaaaagaggtctaaacttgggtggaaaggctaaagttaaccattctttgtcaacataaatatatgctgcatgatactggtaactgctactttggttgttcttaggttaatacagtgacattctcacacatttttgccttagtgacatccattccaccaaaaggttaagggtgtgatctaaaagatcccttagaaattctaaattgtcttaaaatttgaaccagtagcatctgttatgtgtacctaaggctaatgtaacagaatcagttcccctgaaagcatgtgatccaaatgctctcagtggctgggggtagtggctcacacctgaaatctaacacttggggagcctaaggcaagaggatcaattgaactcaggagttcaaaaccagcctggcgacatagaccttgtctctacgaaatgaagaaggcgtggtgcacctgtagttcgaggaatgggaggctaaggcaggaggaatatttgagcctaggagttttgaggctgcagtgagcatgatggtgccactgcactccagcctggacaacagagcaagaccttatctcaaaaatagaataaatgctcttggttactcttctggtagggaaagactagagctaactacatgaataactcacttaaggctaacaggaagacaaatttcataaaagggaatagggttatactcacagttgctttatggctggaattggtcctattcccataatggaaggctccacacccacttgggccaggaaactatccgtgctaaaggtgtaagcccacgtttatcagcttctgacttcttcaaagaacgacagctgcagcaccatcatttattcctgtaaaatatgagtgacttaatttctccatgcttattaacctcagttacatatctgtggcttctttaccacctgaagacatgagtaaatgattttacctgttggctaaggcatttactataattcaacagactttacatagaaatatgtttggcaatatattgaccacaaaactttccaactagagaaagtggtaggattacatagtcggggctgggcgtggtggctcacgcctgtaatcccagcactttgggaggtggagggggtgaatcacctgaggtcaggagtttgagaccagcctgaccaatagggtgaaagccattctacttaaaatagaaaaatcagccggtgtggtggtgtgcgcctgtagtcccagccactaggaggctgagacaggagaattgcttgaacctgggaggcggagattgcagtgagccaagttgcaccactgcactccagcctgggcgacagagtgaggctccgtctcaaaaagaaaaaaaaggattacagcagttggggaggggagatctctgacaggaaatggaagaataagcctggcttcacaaggaggtattgggagtttctggtactggaaaaatacaaaggtagataaactgagttccctaatttacttcttcatttgtatgtctagttgggatgtcaagaaaccaaattattctttcagtataggttaagtcaatgatcaaatacagagaaatgacatgtttccttaaatgttttaagaataattttgtacataaatattgagttgggtgtggtggctcatgcctgtatcccccagctacttgggaggttaaggcagggggctcacttgagcccaggagtttgaggcgcaagtgagcaatgatcatattgctgcacacgaacctggctggcagagtgagtccctgtccaaaaaatagtacttttgtatataaataaagagaaaaatattcactcggtagacattaagaacatagtattcccccagatgtccttcagaaaatctaacctgaagcattggctgggggactgttcccgttccatcagtaagaaagtaaggctttagcttggacatggcttctatgtgctcccatggcgaggaaactcatctgttttaacttcaataagacctaagcaaaggaaaacaattactcaagattagtccagagacagaagtaagtgtgctgggaatggtgggttctctccattaaacatgaggattcatatttagcagaaaagttttaatatgtgaccactttgatgcaacaggaggaaagtacacacaagaattattgtacatgaaaacaatttatgagtatgtcttatgagacacctgtgttttccaaatccataggccttcctgaggaaagtagctaccaggacctgtttgtgccaaattctgctatagtttgggtcatagtacttggctggttacgagtggtggatcaggcagtctcaaagccaatcgtgcactgctggcaggacataagagatatcagtatcaataagggagcttgacgggagcattctgtattagaaaatagcgagtgaccccaaagatccaccctttagaaatgtgaaatggagatcacacagaaacagcgagaagtaatgggttccacttctgaggaggttgagcctatacaggaaacaggtcagctggtgcctcctaacaacatgagccagtgctccagcttctcatgaaacctgctgtgtgtgcacagtggtcatggacctctggaaccaagagtgcttgagtgctgacataggtcccatgttaccgtgtcctgtaaaccagcataccccctccccacattcatgtatccaggacatatatttgcaacctgaaaaactaactaagatataatttctaaagattcctatgtattactcttttagatgttactcttactataaataggttgatgtttaaaccactatgatatactcaccttttctagttgacaccaaactggtacaatctctttgtcaaaatggccagctttctgtgcattctctgtcctgttctggacagaactgcaaccttgtcctgatcttctctactcacttgccattttttggctacatttcagctgggaaaggagaaaaacagcaaaaaactaacattttcatgaactggcatttgatgctcaagtcgtccacatttgaccaagcactgactgaccacatatgctagcaggctcatgtggcctgtgcaatgctctgtgtggggtggccctgcctgccactggcagttggtttggaatgttgcagtgactctcaggagtcatacttctctccttccctttctatataattgtaaactacagaaatttccttcacccagagtcaccatttatattttccctccatttgctttaatatttctttctgaaccatctgagagaaagttggagatacaatgccttcttactcttaaatttaatttcagtgtatacttccccaaaacaaggccactttcttacataagcacagttataaactcaagaaattgggccaagtgtggcggctcacacctgtaatcccagcattttgggaggcgaggtgggaggatcacttgagcccaggagtttgagaccagcctgggcacagcgagacctgtctccattaaaaataaatttagccgggcatggtgtgtgtgccatgtagctagtagtctagctgcttgggaggctgaggcagaaggatcacttgagcctaggagttcaaggctgcaggagccatgattgtgcctctgcactccagcctgggtgaccctgtctcacaaaacaaaacaaaatcaggaaatttaacatgaatcaaacactattatctaatccttggtccacattcaaattcacctatatttcagtaatgtccttctagctcctttatttgagccaataaagaagcatcattgtacaactatcaatctctctagtttgcttttgtctgtaacagttcttcagactatcttcttaagcttgatatttttgaagaacatgggcgagttcttttgttaagggtcatcaatttgatttgtctgatgtttcctcagaattagattaagattctgccaaaaggcaggtatacactgaatgatagtatgatttttctcagtgagtcttattaggacacaaatgacaatcagttatcccaggtgatgttatctttgatcacttggttaaaatggtttggtattcaccaggttctagcttttaaaggtaccattttttcatttataagtaatcaataatttatcagaggtttttttggattatccaaatatcttcttccccatcatattttcacccactagttttagcatcattcatgactttctaactccaacattccttctattggtaagatattaattggcattttccataaagaaaaccttttccttttctcccatttattcagttatttatatcaggatggaccatacattttcattttattgaataagttataactcattactttcattacttactttgatctgaaatttttcaatacttgggcagttataacccattactatcattacttatttgcacgtgaaattgttcaaaatttaggcagttacaacccattactatcataacttatttgcacgcgaaattgttcaaaatttgggcagttacaacccattactatcattactgactctgatgctaaattgttcaaaattccactacaggaaagtggaagccccgtaggctgcctcctgtgtgcttcaacatgtccctgagcatgtccttaattttttagcattttttccctagccttggaaaggccatttctccaaacaaccttagttccttttagtggataaatgtatttagaagatctggtgtcaggactgcttgttgttactggtttgtcattgtttctaggtctgttcagtagaaattccatatgtattatttataattttacatatacacacacactcatggtaacaccttgagtcatactgcattttgagttctccaaaatgcaacctaacaccacaagctacattcttctcctttccgtatttgtaactctcttctacaaatgtgagaattggccaggtttggtgggtcaacctgtaatcccagcactttgggaggctgaggtgggaggatcccttgagctcaggagttgaggccagcctgggcaacatggtgaaaccccatttctacaaaaaatacaaaaaattagcaggcatggtggtgagtacctgtggtcccagctactcaggaggctgaggtgggggttgcatgagccaagattgagccactgcactccaatctgggtgccagagtgagacccgtctccaccacacacacaaaaaagttattgctttgctttctatgtcttgtctttacttatcaagctgttttctttctttttttttttttttgttggatgatgtctcactatgttgaccaggctggatgcagcagctactaacaggcaaaatcaaccatagtatactatacaacctcaaactgctgcctcaagtgatcctcccaccacagcctccctagtagctgggactataggcacctgccacgcaccctgtaaaagctattctcttatatatacttctagaagctttacattttttgctttatttttaaatccatgatttatctcaaattagcttttatatagggtgtgaggtagggatcaggttcatctttcccatgtgagtaatctgttattccagcaccatttgttgaaaagacttaatttctccatttcattccattgatgcctttgttgaaaacgagcataagtctgggtctattctgaactctgttctctttctctgtccttatgccaaaaccacattgtcttgtttacaaagctttataggtaatgttaaaatcagagcatgtaagtgctattttctgacttcaaaattttttggctattctgagtgctttgcattttatacagtatttatttacactatttatttattatttagagatggagtttcattcttgttgcccaggctggagtgcaatggtgcaatatctagcttactgcaacctccgcctcttaggttcaagcaagtctcctcccttggcctccagagagctgggactacaggcacctgctgcaacacctggctaattttttgtagttttagtagagtggggtttcaccgtgttagccaggatggtctcaatctcctgacctcatgatccgcccgctcggcctcccaaagtgctaggattacaggcgtgagccaccgcgcccggctggaagctatcttttgttgttgttgttgttgttgtgtcactatgttaaccagactggaatgcagtagatctcacaggtgcaatcatagtagactatgatagcattgcccaggctagactcaaactcttgactcaagcaatctcttgcctcagctcttgagtaggtgggactacaggcacataccacctgcctggctcctttagtatttcttgtagtgtaggtgtgcaggcaattcattttccttcactaaaaatggctcttcactttcactcttgttttttttttttttgagacagagtctcacttgttgcccagactggagtgcagtggcatgatctttttttaactttttgctacaatttgcaaggtgtaatttttcccttgtctatcttggtctttgaacttcttttcacaccaaatgtgaaattttcttcagtttttttctgccccattctctctcttccttatgtatgagattcctatccatgcatgctagtcctatttattttgtcctgcagaccaccaaggctctgttcatttaattttatttttttgagacggagtttcattcttgttgctcaggctggagtgcaatggcgtatctcagctcaacgcaacctccgcctcccaggttcaagcgattctcctgcctcagcctccgagtagctgggattacaggcatgcgccaccagcctggctaattttgtatttttagtaggatggagtttctccatgttggtcatgtgggtctcaaactcccgacctcaggtgatctgctgcgttgacctcccaaagtgctgggattacaggcatgagccaccacacctggcctatttttaatttaatttaatttaatttaattttttgagacagagttttgtttgttacccaggctgagcgcaatggtgtgatctcagcttgctgcaacctccacctcctgggttcaagctattctctgcctcagcctcccaagtagttgggattacaggcatgggccaccacatccagctcattttgtatttttagtagagacagggtttccccatgttggccaggctggtcttgaactcctacctcagatgatctacccggcttggcctcccaaagtgctgggattacaagcgtgagctacgtgcctggcctgttcatttattcttcattatttttctctgtgttcttcaggtcgtgtaatgatctatcttcaaacttcctgaccctttttcttctgtctccaagatgctgttaaggcattcagaatttttttttctttttttttagagatgaggtctaactatgttgctcagcctatctcaaacccccagcctcaagtgatcctcccacctcagcctcccaaggtgctgggattaaggtgcgagccaccatgcccggccccatcccagtgaattcttaatttcagattgtgtacttgcaagttctagaatttctatttggttcttgtttatattttttccttttactcctgagtgtccacatctattcctctatgaagattatattttcctttgtatctttaaacatatgtaaatagagcctttaagatcctcatctgataattctagtattgcagggtctgttgactgtttggtttttttccaccctggttgtaagctatattttcctaattctttgtgtatctagaaattctcattgcatgctgaacattatagttgctacataactggacatagagattttattattttagagaatatattgagttttgtttccacaagcagtcaaaatactggcaaatcaccttatccttttgaggcttgtttttaagcttattagtttgggtctagagtagcttttactctaggctttggccctacccctaaactgtggtctttctgagatgtcaatggagtgtccaaggattcagtaaggtttccactcgcttgtccagaacttttatctcctagtaatctataaaatcccagttcacctctcctttgcagctcttttctactaggccttgtaagctgttatctacaacttagtatttgatcaaagacttaaggggaaccttttgcagatttctggagctcttttttcttctcccccttattctgccccacaaactccagccatctcagaagccccaaattctctgttcttcagatcactgagaccactgtttccagcttaggctctgcctctccataacacagttgggaagtgccctgggtagagacagtgacagtggggttttcccttctctcaaggatctcgtcttacatgagtattagtcaaaacctgacatacataaaacagtggctttatatattttacaagttttatgcttgtttatagtaggaaatctaatctttgtcaattactccatcatgactgagccttttttcttttctttttttctaaagaagagcaatttattttcttacagttctgaggctggaagagtaccattcaatccacagtacaccttggaaagggctcgggatctgaattttaatgaccacctctagttatggttgaggcagttggtcacacagtgtcttccattgttgcctgtgtttttatagccttctctgttgtggctgtaagtcgagaagtggtcaagatgcttgagcttctcattgcttcccatatccctaagcccttccttccttcctagcattcatgccacagttccctcttggaatcttgtacttttccccattacctttttcacatatttatgtgtacataaaaccagagccattgctgcatgcatttgagcaaggtgcttaacttctcagggttgattctttaactctaaaatgtctattctgtttcttaagttttacatgtatactaaagaaagagtgcttttgatttcccagttgctttgccattaaacttagaccacaggacccttcacatgaatgaccaataacccaattgtgtagtacaaaaagtacagctaggtaccaaaaaaaaactggtttatctctgtcactacctctgccacagaagcactatttgtgggccctgtttctcatttggtaaaatgaggggttgatccagaagaactctgaggtacttcccacttctaacttctctgataatcaagagttcacaaagaagagaatacttacttcacttcagttaatcaagaagagatataaaaatccttaagacagtctctggccataaggacgaaagcacctaagaacagattagtatatggtctttttaacctttttaaagctaatacagtttcagccatgtctgcttacctgtaatacccatatgacagttgtgaaatgcatctgtaagaccatcacagagtaactgtcagtcagtggcatctcacctatctttactcctgttctcaagtaagccaagtgagagcctagaagtcagaaataaaaatggatttaggcttagttgcaattagtcttctccccaaatacaactcaaaactatctagtatttcctaagtcttcatctaggcccctttgcagccctctccccagttctaggtcctcagccaggccaaggtctaaagacccctggaattagcagattcatctttcctattgttgggaacgattactctcctacctacccattttcaattctccccaaacctacccattctgtgtcctgtttccttaagaattccatttattctttccatcgagcaattaattatctgttaaatgaagaaatcctctaagggcttaagtaaagctaacaatgtttacctatttcaatggatgacataatgtctacagtgagaataatcaggctaactaaatgtggggagggatttctgagtagcggccagtcttaactctcaccaactcaacagcaggtatttagaatggaaagagtcattgattggacttagagtcggaagagttgtatttgaatgctgctctggtcctcagtttccttacctgtaaactgggaatggtatcatctaccctatatgggctgttgtgaacacatgtacaaaagcacctggtaaagtactacacagatgtcagtgtcatccatcaaaatcactccgattatttttgttacctttagcctgcctcctcctgaacctcagaatggctgggctgaatcagcttctatctagggaatctgcacctcagcccctgagctgcacagtaggaagcagggggtatagtttttctttcaaccactatgccagtttgaggtatggacttggtgaaacaaatcatgcctggcaaacctactggagaagggcaccacttggtggtcccttttacatgttctataccctgaaaaggtcaaaaagtctggtccccaggatctccttgtatgtgcaggaaggtaagtggcaacatctgttttttgccttttactcacaatgggaaagaatttaaaaccaaggacatcaagcaactaatatgaatttaattcagaaaatattacatgctcattaatagtttagaaaaagtatattcggttccaatcacactggttgataaacttctttcaacccggatttcccacccaaactgaagaatacttcacattcaagtagggatcaaggtgtcatttctgtttatttgttcactgtttggttccagctctgctatgcatctgtttactcgttctggcatagacatgagtttctcagtgtgaggtcagtgaaagccacctcatcagagagccttaccttgctcatattttccatgcctcctgcaaccacaatgctggagtctcctatcctattgactggactgcaaggcacacagcttttaggcctgacccacagatcatctggcagtccatgctggaacagagtagggaattcctgcacccacactggcttgtctaacaggattcgcccacagcctagaaagaggaacacagaggactcttagcaatcaaggagaaagacaaaagtcacagtgaaagtgtgtggaaaattgccagttgggttacctgccacttctgaaagcctcaggtcaagtaagtgcccactggaggcaaaaaggcctgtatacactctccacctgtcacgtctagcccttgaatatatactgccttgtgctgctctgtaggtatttcatagatataagtttctcctccataaataagtcattaatacattaagaaagaagtgtcatcctcatcttttatatggcttaaatagttgggcgcggtggctcatgcctgtaatcccagcactttgggaggcaaggagggcagatcacctgaggtcgggagtttgagaccagcctgaccaacatggagaactctgtctgtactaaaaatacaaaattagctaggcgtggtggcgcatgagtgtaatcctgttactagggaggctgaggcaggagaattgcttgaacctgggaagcggaggttgcggtggctgagatcacaccattacactccagcctgggcaacaagggcgaaactccgtctcaaaaaaaaaaagtgcgggggggtgcttaaataagcattatcaaacctatgtctaataaacacagatataacctaggcattatcagtgtttctaactagggccatttgctcccaagatcatggttaagacacttgagaagaaaaagggttacttaaaaaggaaaacctttgataataagcagtctgttcttgcttagtattcattacactatgcttaaatggttatataacaaaatatataaaactcagaattcacaaatacctttttttctcattctgagtactgaaacacaaatatctttcataattcaactatgggacttcctttagttgggaagaaatacataatttacttaaagagcacagaagagaatggagttaaaagtttcaaatattctcaatcgccattgtctgttatagagtcaatggtaaatgtttataaagtggttactctattcccagtttcagatatactcaacctaccacccttccttggagagtttgtggggaagaactagcaaataagtcgctgataaaacttagagattatattcatcacaatgttatcaatctgggattaggctggaaactaaaacgggtaaggttacttgagactgaaaacatatgcaggatcatatacatattaaaaagacagcccagtgcggtgcctcaggctgtgagcagtggctcacacctgtaatcccagcactttggaggccgggggggggggcgcattacttgaggtcaggagtttgagaccagcctggacaattggtgaaaccccccctctctactaaaaatacaaaaattagctgggcatggtggtgcacgctgtaatcccagctactcaggaggttgaggcaggagaattgcttgaacctgagacagagttgcagtgagccgagattgtacggctgcactccaccagcctgggcgacagagtgagactcatctcaaaaaaaagaaaaagaagaaatgaggtacagggctgggcatggtggctcatgctgtaatcccagcactttgggaggccgaggcgggtggataacttgaggtcagaagttcgaaccagcctggccaacatgttgaaaccccatctctactaaaaatacaaaaattagctgggacagtggcaggcacctgtaatcccagtcacttgggaggctgaggcagaagaatcactggacccgggaggcagaggttgcagtgagccaagattgcgtcactgcactccagcctgggcacagagtgggactccatctcaaaaaaagaaaaagaaagaaatgaggtgctaacacaattataatgctagcatttagcatactacgagcttcatgagaatgagaatttctatctgatatgacattgcttatctccagctgctaaaatagtgcctggcacaaagtaggtgctcaataaactttgttacatgattgtagaaggtatctggctcaaggaataggacagatctaagttcaaggctagctccacttcaaactgtgaccctggtaagtcatttaacctcttaaactctcatttttcatttgtaaaatgaagataataggatataacagacttgtgaggaagattaaatgaggaatgaaaggaaagcatttagcacagtgctttaaaagccttaaacttagtagacatgcacggtagtcccagctagctcagaagttcaagggcatggtgcaccatgattgtgcctgtgaaagccattgcactcacgcccaggcaacagacagactccacttctacaaaaaaatttaaaaattagccaggtgtggtggcctgctcctgtaatcccagctactccagaggctgaggtgggggataccgtggagcccaggagtttgaggttatagtgggctacgattgattacaccactgattccagcctggacaacagagtgagaccctgtctctttaaataataataataataattattaattaattacgagtgttcaaacccaaagaatcagaagatgggggcactctcaggactagctatattcctctggggagtgatatgccccatttgcaaggggcatgatgtggcacctatttccaagctcagaactgagccctaagagggcagggaacttacctgtattgttggaacctactcccagcactaagcacagtatggggcacataggaggaactgaatacatttttgttgatgagtgacactttgaggtagtaaggaggagcaggcatactttcctatgcgtcaggctgccctgctgctgcttcttcttcttctttttaaaaggagtctcactctgttgcccaggctgatggagtgcagtggcacaatctcagctcactgcaagctccgcctcccgggttcacgccatctcctgtctcagcctcccaagtagctgggaatacaggcgcccgccaccacacccggctattttttgtatttttagtagaaacggggtttcaccgtgtcagccaggatggtcttgatccctgacctcatgatccgcccacctcggcctcccagagtgctgggattacaggcgtgagcaccgggcccggccggccctgcttcgtaagaatgaaaaggcagtgggccgcctgtagtccagctactcgggaggctgaggcaggagaatggcgtgaaaccgggagacggagcttgcagtagccgagatcacgccactgcactccagcctgggccacagagagagactccgtctcaaaaaaaaaaaaaaaaaaaaaaaaaaaggaaaagaaaaggcagtgtaggtggtgtaggtcagtgtctaagttcattcacaaaaagcatattaatgaagctaagtctttttgtttgtttagagaggggtctcactctgtcacccatgacggagtgcagtgacacaatcactgcagtctcaaatcctgggctcaagtgatcctcccacctcagcctctccagtagctgggaggcacaggccacatacctggctattttattttttgtagagacggggtcttgctttgttgcccaggctagttcaaacttctggactcaagtgatccttcctcctccgcctcccaaagtgctgggattacagcgggagccaccctgcctggccaagaagctgagtctcaagctggatagaagctactgacgggctggaagaagggggccaacaggaggaatcataacagagggaactctgagcaaaagcaggaggcaagaacttgagtgagtgagagagtgtgtgagtgtgtgagagtgtgtgtgtgttgtgtgtttatgggctgtttctaataagcctgacttctcctggaatcactgagacttactgctgccaagacatgtccaaagatgacctcagacacatcttccggagccacagtggccccttcaagacttctttgatgacagtggagcccaggtcctggacaggaacagcagctaaggaccattgaaggaacctacaatagaaaggcggagagcgtggacatcacaagcctgcgggtatacgggaaccacctacgagcaggggagcctcatgaccctgtttggcaaggccacgcgagaggcagtgccctctcctcccacacgttcctacacctgctggtctgagcaaaggtcaagtgggtgccacaactcgcagcagccgagggctggacaggcgacctccagaacggcctaggacgccgctgtagcccttctatttccccaaatccgaaggactggatgcgaccccatgcttccaaacaaaaggaaccggcgggtcaagggcgttgaaaaccatgcggcacgaaggagacgagtcacgacttctagccattgtgtgacagcccgaccccagcccaaagccgggctc

SEQ ID NO: 5065 - DNA, 60158 bp, Homo sapiens
ggattcaaccttaacccaaagtataaattaaatatccacaagtccttattgatatagtgttaaataaatcaattggaaattaaagacaaatttcccatgtggaggaattcaaataattacgtagctactccaccctcaaggaggaggaacataactcctcactccataaatgtgggagtacatagcatttccttccaaagagtgcactatgaaaaaaagggtgaagaaaaacaattactttacaatggagaaatctgacaacactgctgagccaggtgatcaaagtcaatgtaaaagagataaatcatgttgatattatgtacctctgatgtaatgtggtatcaagaaaatagcctttacctctgtggtattcctcctccaaacttaacaacctcagtcaaatcatgagaaaataccacaaaaattcactagaggaatatcttgcgaagtatctgaccatttctcctcagagtattacagccaagaggagcctaaagatacttgagaactaaatgtaatgtaccctggatggagattggaaaagaaaaaaagaattaggtaaaaacaaaagtaacctaaataaagtatgattttagttaataatatattaatattggtttattaataataacaaatcaactacactaattaagttattaacagaagtaactgtgcaggctatatgagaaatctttgtgttattttagcatttttctgtaaatctaaaactgttataaacaataaacctattttaaagtaacatatacttatacaatgtgagaaaatataatggcaaaaaaagaaaatgcaagcacaaactatattcgtctctcagggataataattattaaggtgttcagtgaatattgttctaatcctttttcttgctcatatgtatgtatattgtttaaacaagaaatctcaaaccatatctacatctgctgttaccagactgcttcctttacttactaagatatggtaaatatactatatttacaagtttcatatttacatataccaaactatacaaaatacacacttttatagtattattttaaaatgcttcatggaattctgttgaattgatacgccataatttattgaactatttttgtcattaacaaacatggtatccaaattttcactataccacaaagttccttgtgacaccatttttaatttttttttttgtgcactttatgcctaactccacaagacactgttattaagagccagtgttttctccaccatactttctttgctcttcatcccttcttgcatctcagattttatctgggtcaatttttttctaattgaagcagatttttaaagatgtcatttggaggagtcctttactgtaaattttcagttttagtttttctggaaaatctctatttcaagtttatacttaaaagaatctttacagaatatatatagaatacttaattcacaagtattttctctcagcacattgagacaacattctaatgtctcctaattttcattgatactgttaataatttagtagttgtctcttctctttcttcttgaaaataatctgtcctctctatctagttcctttaaatatcttcttctctctctgatattctgcagtttaattatgatgtatctacttgtgtgtatgtgtgtttaaaaattatcctgcttaagacttattgagcctcgtgaatctgtggattggtatctgtgaaggcagacaatggctccccaaagatcttaaatgtcttaatctccagaacctgtgatagttaagttaaggttgtagatgaaattaaagttaccaatccacagacctcagggtaaaaagatatcctggattatttaggcaggcccagtataatcacaaggattcataaaacggaagaggagacagaagagatggtcagagtgatatgaagtaaaaaggattcagcttactcttgctggtttgtaaatgcaggaagggaccacgagtcaaggaatgcaggtagcttctagaagctagaaaggtaagaaacaaattctcccctaaagcctccagaaagggatacacctgccaatacttcattttatccctgtgagaccagtgttagacttctgacctccaagagtataagacaataatctgctgttttaagccactaagttttgtggtaatttgttatggtagctatggagaactgtacagtgcctttcaatagttcttggaaattcttcaaatatattccccaaatattgccttgcaccactcactctatcctctatatctcttgacctctctttaacattttttattttcttttttggtaattatttaaaacaattggcttcttgttccacttcaaataaattcatattttatatctacatattaagaattagttcataaatgtaattgttgtatcgtatatactttaaaggaaaattgcatttatacttggatattattatattttaggttttgaaatttctttttttaatgtctgataaatttattctgatcaaaattaaaatcttattgtatttacagtagtctataaaagagtttacatcaattctctcctttaaatgctagcaattcagttttgtgtggtcaagataatttagaatccttttatggtaactgatatgatacaaaggatttttttggttgtttcaaatttgtatgtgcgtatatatgtatagggggtagaaaatttggttagtgactctatttggaaaaatgaatgttctttttggagttttagattcccagtgtttcaaaccaagtttgttttgataaggaattcagtgaatctttattttctcgtagagaatttttaaacaataccttcaaaatattgtatgtattcctatataattttgccttggaataaaaaaagtcatcacataagaatatttttaacttaagaaattttttcaagattctttcaaaatgctaactccctcatgatttgaaaatacttttagagtttaaactattatgaccatgtagggataacttaaagttccttctaaatttttttttcattaatgtcatgcttctttctaagaacaaagtgtttcaagttataaacagactgttttttcacatagctttcatacatcctgactttctatatctagtgggtaatacatttccttccaacctttagtggggtgaagttcatttgtcttctaatctaaaaaatacgttaactcctgacaacctctgacactcaacagaaacacaactgtactttggattaatcatccatctttatttcatagtctccttatttatcaatgcaaatggaagtatagcaatatttcacagtgtcatgtactacctaaggaatttcattgcaatagcattgttttgaatgtatcatttgattttgatctaactatcatagatcagttttacccctgtatgttcagccgaatgtctaaccacaatttcacaaaaatcaagggctctgttagttttcatacaaaattggatgacttattatgaagacagtcccaattaacaattgcatgtcatctgtaagaaatcaattttttctcactccccacctgtaattttttttaagcaaagaagaatacttgggtctaggttcaaggtttatttttctgtagtcctaatatcacttcagtaaattaatctgagactcattttctaatatgtcaaatgactgttgtaaggattattataaaaacgtaaggtgattaacaagtatgtaattgttccatagatggcagctcttgtttttttactgtgctttgcttctgcctgcttcacatattatgtaaaatagctggtgagttttaggaggtagtgctcacatgtttgacagtgtttgctgtggacgatcaacagtaacagaagagcatacttcttcgatacacagatttactgaatttggaaaggctttggcattcttatgtcatctgtaatgaaacaatctccaaagtcttttctaaaatgtccttgtaaaaagaaaaaagttatgtttatattttataaaagatgatgttatttataaccagcagaagcagccttatttgaacatcttatgttgaaattgcacttaatacagtgactcataggagctttctagtggaaatcaaatgctcaaatgaaatagatttagtttgttaggcaatagtgatatgtcttttattggttggactctggaaaacacttacaacgaatagtactttacccgaagggcacgtatcatgcaccacatagcctaaccacaacattaaaggtcttgtaactgtgagcctcaaatgaaaatacataaggacagctctcatacatcaaatacaatacaaactagcttttaatttaaataaatatgtaagtaaagttcaagtgctataatgattttatatccctatgtatgtatcacagaaattgtggcaaactgtagaaattattcaaatggaaagtaacaaagcactttcacattgccttgtattcaaaatccctactctcataaaaacttatatttctttaacaaagctacttttctgtttaactcccggaaaacttgtatttataacttaagggggtttctccaaccaaacaatttatttttgctaggtactatactatattttttatacaaaatttgtgacagcaaatgaaattctaatcccaatagaagaacaacaattttcatgtttcgatcttcatatatataattcaagaggaaatatgcttaacttttagatttttacattttaaattgcattgtgtctgtatcaagtctactatcttttacctagttgtctggaagatttaagctcaaggttacggtttgagaaaagggttttgagagtgaccagatagatttaagaattcattttatactaaaatatggccataaatatttttaaatacattaaatagccctttgctggcacattttttcccttctttgccaaaacattcccacaggcggctaagtcacctcattttataggtttagtaggtttagcaggctttatgtgctctagtagggtagtaggttttgttcatatcaggtctctctcatgggagtttccagggacaaggattgctcagttagtatggccttagccatactagggtatttgctttaattctacagaagttttctattaatattctgtagcaaaagaactaagatctggaattccccctcttaatctcttcctagaatgagattcagaaaggacaggactgcatccagcctgtttgggaactcagacaaatgtggttgtcacagacacaaatagaggtctactatgaaataattggcttgctagtgtgctaatacagacaatgctgatttgctccaacctcatacagtttcacacataaggacaatcatctagtttcatgaaagttctatctactttaacattattttgaagtgattggtggtggtatgaataacagtttaaatttaaatcctaaaattcagtgtgaattttttataatagcataaaaatcaaagatgtccatacaagaaaaattaaaatttggttaggtttagcagagtttgagaatcttactaccctcccacatagtattgtaatgtgaatataggcagttactattacaggcatatgatgattatgtattaagcagaaagaagtatcaccaccagtttttttctttgaatgccctcagtacttctgcatttataggatggtagactggtttggtttagctctcaaaagtgaaacatttaaagtttcctcattgggtgaaaaaaattaaaaagagtgagagactgaaaactgcgcccacctacgtttaatcattaatagtgagcccttcagtgaacttaggtcctgattttgagtttggagtctgacctttccccaaagataaacatgattgttgcaggttctgaagagggcactccctcactggctgccattgaaagagtccacttctcagtgactcctagctgggcacggatgcagttgaggattgctggtcaatatgattcttcttgctgtgctttttctctgcttatttcctcatattcagcttctgttaaaggtaagtttgtgttgccttttgctaaactttatttccatctttggagttggaggcagatacgtgcgtgtgtgtgtgtttgtgtgagtgaatgtgaaagagtttctgactaaactatcttcaaaaccatgtaactttggaatgtttgtgaagcatggctgagttgaaatgaaaaccaaattcaaatccctacaaacattaagaaaacagaatttcttttagtttcagttcctcagaccagtgtgttcttgcttcaatttctcattcatgtctgtttttaaaagaaggaaaaaagatacccactattgttacctgctgttgttggtcacttgaatgcagctccttcatttgaattgtaaatgaggattttttttaaaaaccgagttctaaattttcttttagttgcttagcaatgtgacctcaagaagaattagacccaatgaaaaagcatttgatttgccaaagaattatgaatgaaatggcacaacatatatttaattccgttaaattaaaaaatgatagaattcatagtgaattaaagaaaattaaatttcctgatacagattaagaaataagacattatctttggaaaaataatgttgctacttacagtttctattttaaatgaaattaattttaaaaatacatatgaattaataccattgaaaaggcaagtgaaaaaaattttatgaggaatggtttcataaaactgttgtgaagtgtattaatatagaatcatgttcagatcagctacattataaacatcggttttccaaatgctgcattgtgtaaaatgatcacttttagtttcttaggaagacacactgttaaaaaccaattgatataacaacatagcgttaagggaccaattttaaaaccatgtactctaagtaattgatagaaaacaattcacttataacttataaaacctgttagggataaatgtggcttttgatattaaagtaaagtttgcctcagattttttgtgtagaaaatttccacatgaggaaaaaaacctaatcttcattattggagcatagagggttaaatttaaaccaattcacctcagcaaatcacactgtaggttcttgaactaagaaaatattttcaccaatttctaaatatttactatttaaacatacagttcttacttggcaaaagaaattttttaatgagaagaagatttataaattatatctgactgagagtgttattagaggacttactatttcatctgccaaataaactgttgagtagtcaaaatatgtgtgattaaataccatagtatcaaacctaataccataagtattttgagaaaaataattgagacatgtacttatcatgagcttctcctgttttcccattttataaactagaacattgggtgacctatgttttcaaatatacttataaaaaatttaaggccgggcgtggtggctcacgcctgtaacccagcactttgggaggccgaggcgggcggatcacgaggtcaggagatcgagaccatccggctaaaacggtgaaaccccgtctctactaaaaatacaaaaaattagccgggcgtagtgcgggcgcctgtagtcccagctacttgggaggctgcggcaggagaatggcgtgaacccggaggcggagcttgcagtgagccgagatcccgccactgcactccagcctgggcgacagagcagactccgtctcaaaaaaaaaaaaaaaaaaaaaaaaatttaaatatacacatacactagcaatggcataattgggaaatggcataaatgagaaaatgtggtttagaatattataggtactacagtttattgtaaacaagcttagtagtaaatctagatttttaaagcttgaaacataataatttaggggccacttttgagaaaagattacaaaaatatcttactattgcaaaggttctgaaaaagatatggcatgtggatacattgctagggtccacttctggagtctttggaagatcctgggcaagagagcttaagcttcatcagcatcatggtacgttgcttatgctgatatataaattaaaagtgtacaacttgagagcttctttacctagatggaataactttttgcatatggtaccatgatttaattatagattctttgcccttgtaacaactgacattaattagcaacaacttgtgaagagtttaccttaaaatcagtccatttaaaatttggggatcccatgcccattgcctcaaaactcatctctaaattaccaatgcaactgtttggtaaatcctcagatcgggtggatgttgaagggcaggttagaatctaaagaaaattgaggctgggtgtggtggctatgcctgtaatcccagcgctttgggaggccaaggtgggtagatcacttgaggttgggagtcgagaccagtctgaccaacgtggagaaaccccatctctgctaaaaacacaaaattagcaggcatggtagcgcatgcctgtaatcccagctactcaggaggctgaggcaggagaattggtgaaactgggaggtggaggttgcagtgagctgagatcacaccattgcactccagcctggcaataagagcgaaactctgtttcaaaaaaaaaaaaaaaagaaagaaaagaaagaaaggaggaagaaaagaaaaaggaaaattgaatggcagattggaatctgaagagggtattaggataggataaaagagcacatctatatgatttgctgtgtgaactttctaaagactcaagtttccctactttttcttaattatactttgtcatggttggactattttcagcgccttctctgtttttccttatatagtatttttaccttctatttaattttgtcacctttaaacctgtacactccttcatttccagtctttctctcaatccctcaccccacccttactttttagtcaattttattaatcatcttccagttcttttttcttcttacccttcatcttcttttttaacttctgccctttagttttctgttgggttcataaatgccattacctatcacccttatcatcactgctgtctcttcaaacctcaccaataactcagctctgctttgtcttcttgactaagccagtttcagtgattgtactcatataaatctgacaaaggagtatttaaaaaatatttcttgaagatcaaaactaacagttttgttgcttttaagtcacttaaaaattctaaatgcacttgaaggcaaatgaaagagattctgacttttttggctaatattactttctgttttggttttatctacaacagttatcaaaaaatattactatacatactctgaagagcactatcctacaaaaggattaagtcaacaatataaatgggacatgccccaatgcccagtgttgccagatctctgcaagcataaacagagaaatacttatcaaaaaggaaagtataagaggatgacactctagcacatccaccttatttgaaccgttttaggctttatctcctgttgaaagaggtaggaaacagttggaggaataaagggcccattcttttctgtgctttaacatttcctactcatagtcaaaaatgatttattatatggccagtaaagtagaggtaagaaaagaagtgaataacataatagttggaaagctttggaatttaagaaaggttaccttcctacaaatgtttcgtagttattttaacagaggacaccttaatatagtccacagaacttggattttggtaaatttaaacatcaaattgcattatatttgctatgttgggttgaacttggggtcagcttctatctgctgtcacacatgcttacttttcagaattgctctgaggattagataagacaacatgtatttcctttatgcctatgtggaatttgataggtgtcataaaaagaaggcctcctgaccgaaatatttttcctaccagaaagccagtatttgaacccgctatagagtccccaattacaatgcagaagacataagataagagggaatcccagtcttcatccccttcaaggtttttcctgactctctttgcctctgtgtctcacacctcagtttctgcctgacttggtgcttggacacagcttggttttgtgatacacatagatcctttcatacttccttctcctggctcttcttgattcctatgaaaatgttgtcccttttctttgaaggttcgacagattatgtgacttcactacccaaaattctatgcagcgtcccatctcactcaaactccccaaatcttcctgccacccataggtacctcctttccttgtctccttcactgtgtcttttacttatttatttccagcctctttggtctccctgccttcctccattacacctgcaggagccctcctcggggcctttgcacttgctgtttcctcttgaggggaaggggtagaaagggtaggagttgggggagggggatgcccttcccacagataccatgtagctcaccgaaaacctttgtccaaaatgtcacctttccacagaggtttttctccagcatctccattccctttcctgcttcagttttctttatgagcacttctatcatactattaacttgcttatgtactcatttttttattgcccttctccatcgcatttaaatgtaccttcaatttacatttacaaagggtagaaaatttacaaagggtattaaatttacaaaaggtagaactttgtctgctggttgggtgcggtggctcacacctgtaatcccagcactttgggaggtgaggtgggtggattgcttgagctcaggagttcaggaccagcctggccaacaaggcaaaccctatctctacaaaaatataaaaattaactgggcttagtggcgtgagtgtgtggtcccactactcagaaggctgaggtgggaggatcacttgagcctggagatgaaggttgcagtgaccgagatcgcatgactgcactccagcctgggtgacagagtgagaccctgtctcaaaaaaaaaaaaaaaaaaaagtaaagaaagaagaagaaactttctctgcctttctctgcttgttactggtgtagtcccagagccttaaaaagtacttactattcaacaggtactcactatattcagttgaatgaatgaataaatttctagctcactgcctaggaatggaaaataattcaaccttagttttagagatatatagtatagataagagcatcatctttagagacagacagcctggataaaatcatatctccagccagacgtggtagctcacatctataatcactttgggaggccgggtgggtggattacctgaggttaggagttcaagaccagcctggctaacatggtgaaacccgtctctactaaaaatacaaaaattagccaggcgtggtggcacacacctgtattactagtactcaggaggctgaggcaggagaattgcttgagcctgggagatggaggttgcagtgaatgaaatcgtgtcactgcactccagcctggccgacagagtgagactctgtctcaaaaaaaaaaaaaaaaaaaaaaaaagaatcatgtctctatgatgaattacctgggtgaccttaggtaattatatagtttctgtgtcccctcagtctcttcatctataaaatgagactaataataggcctacctcattagatttttgtgaggattaaataagttaatacatgtaacatgcagatgtggatttttgaccaccatttcctctgggcaagtacgtgctgtcatatgtagaggagacatgaacagattgttactgtgtaggtgggtaaggccttttcaggcattgcaaagtaattttgctatcacctttctcagctgctttgcttcttgtctagtcaccccaaaccccttttctgtcctctccccatatgtatatttcctgagagaaaaaaagattatggttgcgtgtcatagtaactgggcaatgcaaccccattagcattgaggaataaggtaaactgaagtcttttttaacatctcctgagagccatacatagaaaatatacaaaagaaaaaagatttatgtgaccatacttttaagtcatctctgggaaagacttgctccttggcatttctttgggctaggtaaactgattggatactgtgtgaactcattcatacatcagttttcttggctcacagtacagatttgatactatttgatctttttaaattaccccatgccaactttaagcctgtactaagatttcaatagtaaaacattattttattcgggcacagctaatttaaagttacatatgtgcaacgctaaatgtacctttgtactaaaagtttgataattacattaatagagtaaattacactgaaggatgtttcttaaatatcaaaaatgtccaaattaaagaacttccttctaaccactaaaacaccttggcattgatctgcttgcatttaaataatacgttaattacgaatggctcatattaatttatcaaccaattcctggtgggtcctctacttgaaatcatgttcatataattaagagaatacaatggcatttaaacaaaaaaaaacccaaaatatctatagttcaaccatggcacttcggataagtgattaggaatacaaactaaggttctctgaaatgggagtttatttgtttgtttttgtttgtttatctatgtttttcaagtcaatgatttcagcagatgaagtagcaccagtttcaatcagcgaatatttaccaagcttcctgagccccactgtggtagagagatgcacgatggtgagacagcatgttcccttacaatgaaaactggatatgtgtcattatctttatgaggtcacacaactggtctctcattaaataatgaccggctgtacaagctcacgtactccatgaagttcttcttgatcggggcaaaggaaaactgcaagacagcgtgggctaccgcatttctccaacgtggatgtggccttactatggaggaatcctgatggtgatgatgaccagttgaccaaataacggtgggcattttctaccagataaatgcaaagattagatatcagaagttttgagaagtgtaccattggacagcacttgtattgggttcccgtttataaatccatttagttcttatctatcactaaaacaagcagttctatgtatttaaaggttttgctgatgaaaagtgactgatctttccaagttattgcaacagacaatagaaggtatatactggtaaacgaccaggtatggtgttcaattctatagatcatgttaatagggaagttatactagagtcttttcaaatgttctgggagagaagggtcaataatccatgttgtatgaaaaacaatttagaccactcaactcaagaggagatcagttaggaggttcctgcattccttgatacaacaggtggaattatgaagagagagtaaacctagtctgtgttcttcctgaggaaggaaccaagtactcccctgataacagtgtttggtcagttaaaatggtttagatttatgtgctgagaagggaggccaaatagttggtctctggggacttttccaattgtaatatatggtgattcccttatttgcttctaagaacctaaagataatagattccttgagtaaagtcagttattcttctacatcttggtggaaacaggtacacaggacaaagtacttggaacaagtagttgctggtgtcctttatattgggtgtcatagcaatacatttacaagtgatatttgcttctttgggtgtctctaattgctctgtgttttccaagttagatctaagcatcatcatccatctctctgagccatttctcaataaacagtaaactgttctccagaaaacattatattcctccttattcagtaattagactttattttatttacacagataaggtagaatagggcaggggtcctttccaacaagtggtaaagaagtgaagtgatcaggtagacagcaaccacaaaaaacaaatgaagagtggcaatgataggaagaatcacactcaagtcacaattattttaagcctaaagtcacagagttctttaagtatgctatttttgccttattaaaaaacctagtttttaaataccttctccattcttttaaagtagtggcaaggtcctataaatcatgaattgaaaaatgacagaagaaattgtggccaactcttctgtttctttatcattttattttcagagatactctgatgaagacagatataggaagtttttttaacagctttctttctgttactccagatgaaggatgtaaatgttgaaaatgtgatcagcagagaggagagaagagcatcttcaaaggaaaaagcccatctaaaataatgggaaggaaaacttggaagctctgcaaagacctacgctccttcatctaatccatggaaaggtaaggggcgtttagattccacaactttttctccaacttcatatttttcttcccttcagtagaattattttgaggtaatcacattgtaactacttttatggtaaatggaatttcttcaagaataaagaacagaggttgtaaattaaatgtttccaaactgaatcaatgccctgagttccctacatttactagccaatttgtttcctatttttctggaaatctttatagtggaatgaagtattatttattgatgaaaggcattattaaaaggtaaatttctcatcaaattataagggattcaaacataatgtaacaaagcaagtcatcaaagcatgattggatgaattcaggaaaggagcaaattatgagactgaaatgatccaactgagattagtaatattgatttgttatgagatttcgatatctggctaaagtacaaggttaaagattttaaaagggtatgacaagtctaaagtgagtttttttaaagcctttagaaattattttaaaactatgacatggaaaagccttttattattaaaataatgattgaacactttataatatatatttgaaaatctgttttaaaaattcatgtgtgcattacttatggcttgattctagtcaattgaaatggtctaaataaatttggattgagaaacaattgtgatcagttgattattaggcattacatatttgtgtttatgaaaatacagatagtgtgttgacatacataaaaatgtgtctaaagatgagagctcaattttaggacaaaagcaggaaaacagaaagggaacattgagttataattccatacgtctctgaaatttactttctaaattcaaaataaagaaaaactgatctttatatactgataaagtaatacttttttattttcaactgaagtatttgaaaacaaatactttggacatttcatatatgtatattctaatcatgatgcacatttttatatgaagttctaaaaaggaactcacaagaagaaatctgtgttttcacctcgcctacaaccaaatatgaatcactatcttcaagaatgctttctcttcttctttacttgtcaaaatacttgccatgtttctgactgctcacatgccatttctgtcaaaagttcatacccttccagccagctggaaataaccatcactctttagaatgctcttagcctttgcagctcactcatgacccttatcactttgtttttggtcatttgtgttcattgctaattatgggtgttggatagaaaaaaatccaattcctctttgtatttcagcctctccccttacctccatgcccttccactccctccttccccaaagcacccagaattatgccttgcactgatattttatgaagccttctccgacatctttccaaacccctgggcctatttctgtcaaaggtttatcacagtgtattgtcactctccttttatgtcttggctctccacattcagaataatttctcatgggcagagttgtatctgtctattcagcaccttgctcataggggatactgaaatagatgcttctaaaataaaggataaacaaataagattatatggggctcaactgagttgactttgataaaggttttacttattgtttacttaataatagctaaaatgaactaagcactactgtgtgctaggtgctgactaaaggcattacacgaactgtctcttttattcttgtaatgccctgagcagtaagggctgccttatcaacctcttgtgatagatgaggaaccaaagttagaaaagttaggaaatttgcctatggtcatacaactggcaggtggtggagttgggacttgaatagagtctatgctcaaacttctatgcctactgtcttccagctggaaagtatttggagaatgcctgcctctttggttgacttgtagtgttccttatttacatcatgagatcagttgattatttgattttcttatggctcaactttgttaacaacaagaaatattgttattttcttcctgagcttccaatgtggcaagacacttgagttcatagatattatttgcatttataatctactgacaaccaatcattttatagctcctttggtagcagctgagtacaaagtcttctgctcacacatgaaaggactcagtaccctcactgttcaaaggctgggatggaactgccacatcttattttaataactgcaatgggccaattctagaggagctatgatttgcgatgatttacttaaccacaggttaaagtacatcattgtatctttcaagtatataataaaatatttgttggaaaaacttaacaatgaggactaagaagccaacaggaagttttggccatgtcactgtcagaagatcattacttaaattatcatttcagtttactatgagagaaattatggacaggcagataaggctatggacaggctattttcttagagagcattttctaccacaggctcaaattaagtgtgctcctgaagtttctgggatttcaaggatgctcatcagcatgtaatttttgtccttcagacctccccctgtctccctttcccatctgaggctctcatatttacattttaaaagaggtccattaaaatacttagatacatattcattgcacatcttcttttttccatgcccactctcttccctacataagtgggcataactctagttttgtctacaaatcattaagttgtaaactgacagttatctgattacgttgattaatgctgacgagtgaaagatgcctcaagttatacatggattcttttttaggcctgaaatgctgctccaattaactggataattaccagatttcatttctggttttggctttgtgttgattaaattaaccacgtggctgctgagtcagaccttattttgtattgtttccgggcattgatttgctctctaaatcagcatggctcttgtacacaactgaactgccacaagaaatgtgacaccttgaaagtccttctgaaatttgttgtatattctttacttgtttgttctccagtgtgtcatttcctagccatgctctgtcttagatagatacaaagataaaattactaatctttgtttgctgggattctttttattatttttattgtttgccacttaatggaatttagtctcctcttattcttaaaataaatataaaggaaggtgtggaaaaggcatcttcttcctaaggaaaaaacaatatgaatgatgcctacctatttcaagaggaactggcccctcatatttggctggaagaggcactgtaccaccttcccagccattttaccagtctccctctagctgtggtttccttgggttaaagacttcgtttgtaaccaggtcatactgctgctgctctttggaagctctgagtactgtaaatttagataagaacctgtgctcttgatgttcagaactaatttcattgctgaatgaagtaatcaactttatggcctgagtataataaacttactcagttcctgttgtgaaataataaatttaagattattgctgtgacagccattggcttgaaatgcaaaattctgatttcagattattattttttaaatgattacaaggcagtcaattctaacagttttgacatttagctggtatggatatcagtactatcttcactttggtctcatcagtctacactaaagaaacagaatttaggccctagaagtagcagtcatataaagaaaaagagatgtgttcatttttctagttctggggaagcaataaaaactaatagaaaggttaaaaaaacttttttcattgtgtttcacagtttatatctatcattcagcctgccaggaggaaaaaaggctctaacaccattttctaagggatccagaggtcaagatcaaaacttgatcattgcagtgggtcagtaacagataagcactgaaccttatgcacagtccaaagattaaaccaagaactgggtttccttaccttttaggtaaaactttaaaaatagctcagatacatttgtagcctggaaggaaagtgacatagtggtgacaatactggtatttttcccacttaggagtcttgctttctaaagtatttaaggttcataccaaaaagacatgggccatatagacatgttgcattgccactgagtgaacacttctgactattttggggcaatctagttatgaacttctatggtcatgatacctggagatacacttccaaatatttgaaaaggaaattacactgtgatattagaggaaggagatatagtttacaaaatagaacttcagaaactcaggcttgggtctggatattgccagtgatttgtttgagaatatgatactgtgaattttcagacactgaggtcatattccagttcctttctaagtcggacaaacactattccaacatttataggttagtccagctaatgactaaaactgattgccagataaagtacctagtaaatccatcactaggcagagttatgtaggaagtaaaaatagagatttgagacacttgtttggataattcaggaaaagtatctcttcttctaaggcacaagataattttcatgtagactaaattactgagcttggtattattggattcattgcatagctattgagctttatgttttactttagaagctatggttggtttaaagagtactaggaaggcattcaggatatttctggtagaaatgctcagctataattatctagaccttgggaatttttacagggaacatgtatctatcctctatttctaaattgtgtgagcatatcaagtctacagggtgaaaaccaacaagctgattttcattaaattcactttgtattttatccttgtttcttaaacattagttaaattatcaaaatggcaaaagacacttatcactctgtgcctataaatatcaaagatgataaaacaaaactaagtggcttactattcctgcaaatcatagtcaccctcctcatttcaacctcctttctctgccttctgatggtaacctcaagcagtgcctggggcaggttatgcagcagtagcaatctcaacctcaaattttccagcctctgaatatatatatacacacatatatatatatgttcatatatatacacacatatatatagttcatatatatacacacatatatatatgttcatatatatacacacatatatatatgttatatatatacacacatatatatatgttcatatatatacacacatatatatatgttcataatatacacacatatatatatgttcatatatatacacacatatatatatgttcatatataacacacatatatatatgttcatatatatacacacatatatatgttcatatatatacacaatatatatatgttcatatatatacacacatatatatgttcatatatatacacacatataatgttcatatatatattcatatatatatatattttttttttacccaataccaatataaagctctggagggtggaaaacattgcccctgtgaaatgttgaccatgggtattatggccatcctggggccttgcaatagcccataaaggctgtgccatctcaggaatctcaaaggtagtgttgccattttcgtccaagaacttttttatttgctattattttaaaccttagttatttttgtttcaagtacagttacaggtagagaacatgctgacatgttcaaacagaattttcatcattctcttccctgggccatccttgttttcatgaggctcccagcctatatcagtgctctctccaatgctgtgcccatcatgcaagagccttcattatcggtctccctaaacttcatattcgatggtctcagagatttaaatagcttcttttcacaaaaaggaaattccagatttggagttcagatctctttctcccaggattaatacaggtaagaatctgaccttgcctgacacttattaaatctgataaatgatgcatttttgcttcatttgtgttctgttcccctctccccaccagtcaaagagttctactcatatcaaaatgaggcagtggccatagaaaatatcaagagaggctggctagcctatttcagacacagttaagctctggaaccaccaatgaggtacttaccaaattaataaggattcagcatctcaataaaatttgtaaggatttctacttatacaatttcatagaagagttactactaaggtaatgctcagaaaaggtgacttgtgtagtgaagtcgcattgcctatgaaacaattgccatttatcccaatgttttgttaattaattacaaggtagagagattagaaatatttatactaaaggagcttcgtggggatcattccagtggttcccagatacactgtgcaccactgtaccatggaggggcttgttacaaatatagattccctatattcatccagagattctgattcagtagatcggggaggacccgaacgtctttttttttgagatggatctcactctgtggcccaggctggagtgcaatggcgcaatctcggctcactgcaacctctcctcccaggttcaagcgattctcctgcctcagcctcccaagtagctgggattacaggcggtgccaccatgcccggcttgtatttttagtagagacagggtttcaccatgttggccaggtggtcttgaactcctgacctcagatgatccacccgccttggcctcccaaagtgctgggatacaagcatgagccaccgcgcttggtcaaacatctgtattttaacagtctttgtggatttttggatgcattgtcaatgtagggaaccactggtctataccaacactgttcattttgcaaagaagaaactagagaagttaggtggatcttccagtatcatacctggagtcaaggctgggtccaagtttcttagactgaattcaaccagcccatgagtgggtgaaaaatctgatggtaggttggaccaaaagaatgttggttagcttgctagaaaagagacctctgcttctgtgatgtggcagaggccccaggaaaaagctcagagaagctagacagagtctgtattgggatacattgcctaaactcaaactgatgatgtagctaatgatgatttgagttaatcccagtggatttaattaatcccacaggattttaagaatttctaatcatgttcagctagttgaagttacacaacacacacacacacacacacaccacacacacacagaatctagatacagcattaacaatcactcccttgccacagaattacccatttatccaaagtttcaattattaccaggccatttgctaattttaattggatttcgagagaagtaggaaatcccacattatttgtgaaaaaaaatagaaggcgctattaagacactcaaccaaagagaatgggagggaatcaatgagctaccagaaccttgttcttgtctttgtatcttatcatcctgggggagaaaaaaagtcccctatggctattagagacctcaattttcaagccacttctcactagaattcaaatggcccacaaggaacccaagcattatgcccttgcctttctttttaggtagatatctctggaaattgtaaagtgcctaccaggctcatcaagacaaagtgatcaaaattaaggccttggattcatgcaaaatacgaggtctggatttacgaccccaaatcaggtatgatagatgtcactttctttgaggcataaaataattacattttgtagagactaatttaatgtaatagaaaaataaagtagaaatagattttgaaacatttgtaatttttagtttaggctacaaattcacacatatgtaatgaataacccatttcaattgttgtaggtgttagtaatgagggatgggtgtaatggggaagctgttgtagactgaaagacagtttgctatttgacttgattcaataatttaaacgatgattacttttataaagatggctatttatttatttaggtcttgggtgtcagttcaaaagctacatctgcaccacctataagatagaagacagctttgttatagctgtgcttgctgaagaaacacacattttggactgaatttcctacaaaccattaaggggaaaatagtatcgaagtaagataatgtaaaatttttattttctttgctattctttgttatattattatacttgatttgtaaatagtctgtgtttgtgtgtgtgtgtgtgtgcgcgtgtagtcatgcattgcttaacaatgggaaaagttctgagaaaagcattgttaggcaatttcatcactgtgcaaacatcatagagtataatacacaaacctagatggcatagcctacactacattatatggtatagcctattgctcctggctacaaacctgtatagcatgttgctgtactgcatactgtagacaattaaacacaatgtaagtttttgtgtatctagacatagaaaaagtcagcagaaaaatacagtataaaagatatatgtaggtgtacctttattcataaaaggtacataagtgaaatttgcagggctgaaagtgctctggatgaatcaccaaatgagcactgagtgaatgtcatagactaggacgttactgtcactactgtagactttataaacactgtacacttatgctacgctgaatttctaaaaaactttttcctccatcataaattaaccttagcttactgtaatatttttacgttaaaaacttttaatttttgttaacttttgaagtactctgtaataacacatagtttaaaacacattgtatagtgtacaaaaaatattttttctttaaatctttataagcttttttctatttttaaatttttatttttatttttttcttttaaaaatttctggttaaaaattaagacataagcatatatatagcctcggcctacacaaggtcaggatcatcaatatcactgtcttcctccagtggaaggacttacaacctccaaatgttgtctcactgaaaggtcttcaggtgcaataacatacatagactgtcacttcctctgataacaatgccttcttctggaatacctcctgaagaacctgcctaggctgtcttacagttaatttttttaataagtagaagaagtacactgtaaaataataataaatgtgtggtataataaacacagaaatcagtaataatcatttgtcaccattatcaagtttatgtattgtacgtaactgcacgtgctatacttttatataacagtagcacagtaggtggttaaccaccagcatcgacaaaaacacgtgagtaatgctttgcactgtgatgataggacgctatgatgtcactaggcaagaggaatgtttcagcttcataattttatgggaccaccttgtacatgggtccatcattgaccaaaatgtccttgtgcagcacatgactgtatttattgtcttcctcatttcaactgtgagctccttgaaaatagtgattatatcttgttcatctttatttttacatcatctacaacaattcacggcacatggtaaataattactttttaaataaaatgtattaaaaatcaattatttattgaacaggttttaagttttaaaaagacaaactacttgttcattctagttcattttctaatttctctgtcaaatgtttttaatattaaggtaaaaaatggtagcatttgtaatttttaagagtttttaaaaaaaattgttgttaaaaaacataaaagttccgtagtgaagagatgtgacaaaatttttgatatgacttatgcaacttaaatatttggcctgtttatcatttgaagaccattctctggacagaattgttctaacaggattaagaatagaatgttaaatcttagagtttctgttattttcagattttaattcagaaaacaatgtttctagcagtgaatgtgttataccttatgccattgcttctcaaaaaatttctctggagtactgtaatattagcaccaaatagatgcaaaatagtagtaaaaatgcctgattaaaatgctgaaattttatagaagtctcatctggaatagaattttgcattctacttcatatactactgtatatctatagtgttttattatattttcatataaaataaatattttaaataacttatcagcctatgagatttccattgctatgtaacaaccccagatttagtggtataaaatgcaacatcactgtactgttctctgtcataatttacaggcttgccttggccttgctaggcatctatatgtagtttcagacagtcaaactattcaaaggtggttcccccatgtatctggtgcatggctggaaagactcaaacatctgaggctcctcatgcaactatctttatttccctgtcgccttcagcattgcagcttcatgtcagacttcttatgtagtagctcaaggctccgaagcacattactgatagtgtgccagagaaaagctgaattctcttttaagacatagccttagagatcaacagtgttactttcagtctcctctattagttgaggcagtcacagagtcctacccaggttaaggagagggatgtagaccctaccttttgatgacagacaggttctggaagagcatgtcaacaaaaatagagttgagactatttttggaaaataagattttctagctgtcttggttaatagtaacacgtggttgtattgacgatatcattttcagaaagctgggctaaattcaaaagactgacattgcatatcttattcatcatccaggcaatttttcttccctgtatactgttgaataatattttgaaaatgcaaacttaaattttcaaatcttttaatataattgttgctccagaagacttcataatgagctttcagttacctctggagatatcacagtttgaaagacatggcatatacaacttgaataaattactatcttgtttgccaaaagaatggcaattagtatcttgtcactcaaaagaatgattataatatagcatttccctttggtattatgcaggcagaaattgagctgaagacaaccgaagcaggcccaagattgatgtctggaaagcaggctgcagccatatcaaagcagttgattcaaagtacacggccattcccattgtggggcaggtcttccagagcagtgtaaaggatgtccttctgtaagtgcagacaaatatgggaataatcatgacatcagctctgttttcattttgtctccagtgaaagcatcaactcattcaatgaagacagtttctaagaactaccagctaccacagagttgtgatgacagcagtctcacaatatgcacctgacatgtgcatgacacatcaataattaacaaatagttaccattcattcctctcaaaaagtgttaaactcaagggcagcctttaataagtcacatctagaattcagggaggatagagggcttaagaagttagggggaagcatatggtgtcaagaatgtggacaacggctgaaccttgaaagtttgtcacataatagttatttgtccacaggtgacatactttactggcctcagtgttctgatattgctgcaaggactgaaaaaggataccaggatctttgcctaaattaggaaacatttattaccccagtttcccctacaattcctgtcagaaatgcgatatctcatccccagggcaaaggtagatcattgtaacatttttaatccaacaaagaaaattttccttttattgcatgaatcgttatgatatacattcagagaaatgacttaccacccagcatttccttatctgtaatctctgtcagaagagcaaaccattggcttcatgctctgtgtgtaactatagggagatgctcttccttcagtattactggtgttcagaaaagtgaaatcatcaagatgtaataccataatttgttaaagtacaagacagtaattgcttattagtttctgaaattgagttagaggaaaaaggaacattttaaaacacaaaatcatcattttcaaacattgtttcttcttttacctgtttttttttcatatgtcatttaatgttctaatgtaattttctaatgctgtatgagatggaaattattaggaaggtggctaataaaactaaacttttcttatgctctgcactattaatttctctccatagatattaaacattatgagccatctaagatttttgataattatttcttaattattaagaaaatgatttatttatgttattgaggaatttgcttttccaaatttggaattccaaatccaaatttgcttttgtaaattctattgcagccctttaaagtaaaacaaaaacaaaaacactgaattcatattgatatgctctctgccttcagaaatgacccagtaaatctttagctaatgcagctggaatttcacttggaatatcttcttaagattacatagctaaaaggcacttgaaaagagaaaaaaaaggatccattgcttattaaaagtaatgaataatttaaaaactggcacaagttattactatagagttagagagttagtagtcactgataggatttcataaaactagggggaaagtagtaaagtatgaaaaataagttcttcagttagtttcaaagccgagagatgtgttaattagaactatttattaggttgttgcaaaagtaattgtggtttttgccattactttgtgacaacctaatattatttttaaaaccgcaatagaataacttagtgtgtgtgagaatacctttatctaaatgctactctaaaaaacatagatataagaaatgaataattcagacctagcaacagcaaaacattgaattttgtacaaataataaaataaagagagagaatagggactcaccgaaaaattgattttcagtgaggtgcaggtaaattagaaacctgatgcaattctcagcagttctcattattttatctctgaaatattttgctgttaattaaagttctgcacaattaaattgcactatggtagtcaaagcctggcctcggataaattcccttggtgtagccgtaaatgacctatatacccagaaaccagttaattattgccctaggatcttcaagctaaatagaatagacaaaaacagtcctcctatagaggaatggttcacagagtggatggaagtcccagggtatgatatgggcagggaactgtcatgtgtattgaggtaaggtacaaaaagctgcttcgcttcagacacaagggacattttattcctaggagaacaccctttgtaaatgtggatgtcacagttatgagtggggtatgagcctgcagtgtatgttttgcagctctcggagctctggggtccaccaggaaatacctgcagcctgacaacctttccaaggctgaggctgtcagaaactcctggccttcattcagcacctcaggactgcgaagaaagaagagatccttcaaatactaagatggaaaataaggaagtattgtaagttccccaacctttgtgtggggttgtctgtcagaacatttctggattgttggttttttgaagtaagaaagaccccttttaaaccaactgcccaccaccaaaacaattattttcttgtactacattttcatcgaaaagttatgccacagtgcgtaatttaatggtcacttgaccagaaatacaatagcagattttcagcagggactaggaaaaacatgttgttgtgtttatgagtttaaatcaggactagattggtacatagataagtgaggcaaggcttcgtcgtgacatcgtggggcatgtgctgcctcgctgtttttgaaattatgtcctcatgctgttaattgacacctgaacagatttgagttcatttaaaagaaaacaacaaaagggtttgacttcttcagttgaaaatgtgatttcactaaacagccagttgaaactatgtttatgtaaaaaattgagaactgaggcgaatggtgaaaagaatctggagaaaataaatcatatgttacttaatatttggtgaaactatgatccattttacatgtgtaataaacagagtgacttaatttttccccaaaacattgcatctgtttctaaatagaatgtatttttagtctacatacagaatttgtgtatatatacaaattgagcttatgataccaattatcctaattgatatatagaacaaggcccaattaatttgacaaacagtgaaaaacagtcattaacataatcaaagtggaaattagccaagttacacacacacacacagcagtagcagtcactgagttcaaaaactgaattccccaacaggaggaaaattgcagcttttttctgaaaagtctgtttatgctaattgcatttatttacttgccttaaggacattaaaaaattgataggaattccaaatgacaatcaaagttggttattctcttcaaaaataaataaaccagaaattgaaaaagaagcaaatcataaattatcaggctctgttttaattacagcatgttaaaatatattggtagagggactgtcttaacattattttttatatttttaagattctttaaaaattttaccactctcaaagacataggcattgtcttaacattaaaggcagacattactgagaataaaagtggaataattggtattaatttagaatagagattacattaaaccttattagcattatctgtatcctaaaatcttaaggcagcaataatttggaggactgcatgatgtattttctaaatcagattatttaacaatattgaaccatataacatgcaacacacatgtagtgtagtgtaatagaaaggatacaagatgaactaaaattggaaaatttagtttaaattctgacctccaacaacagtatatcctcaaggaagtcttttttttttttttttttttttttttttagacagtgtttcgctcttgtgcccaggctggagtgcaatggcgcaatcttggctcaccacaacctccaccttcagggttaagcaattatcctgcctcagcctcccgaatagctgggattacaggcatgtgccaccacaccggctaattctgtatttttagtagagatggggtttttccatgttggtcaggctggtctaaactcctgacctcaggtgatccacccgcctcggcctcccaaagtgctgggattacagggtgagccaccgcacatggccaaggaagtcttttatatttagcttctctgagcctcacttcaacatctgtaaaatagggataataattctttctatttattgtaggctagtgagaggcaggtggtggaatgtaacatttcccaaaaagcctatatgttgtatcctgtaatttgcaggagttaacaggtatgcaaaaaggaaaagattctgtgagcaactgagtttgcaaaactggataaaccttgttaatttctctgttgcagaacttttcagtatctttaatcagataatattctgtaagttttgaatattttctaaaacacatgatcttgaaaatcccttttcttaaagcatttgtaagactagtgttaacatggaaaacactttgagaaacatcactataattaagaaacctggactccagagtcagaaaaacctaggtttcaatcccagcaatgccatttaccatttacagctatatgaccttgaacaaatgactaggtatatctgcgtctgtttcctagcatgtacagggaatattaatattaaactgacagagatgttcagtggattaaatgaggtggtagtattgtaacagctaatatttatcaatcacttactatatgtcaagcactcttctgaatgttttaagagataacataatttaatcctcccaacaatcctgaggtaaatactactttggcttcatttacagatgaagaacttagagattagacacataaaatttttagtacagtgcttgcacaaataaactcaataagtattatgtcttctagttatctaagcttaattcactagttttttgtatgatcaaaatagtacaagtatatcattttttaaaagtataaactactaagcacatgtccattgtctggtgtgcttatataggggtagtatgtaatatttacatacatgtgttaattatatgacaactatttttagaagttttaccatcccgggctcaaaaagccaaagatttttgagactagaatatataactagagttttcctgtaggggttccattctgttcacacatattcatgtggttaaacatagaactatactatggtgtgtttttatttttaaaaagaggaaaaccttccccttggatttaaggttaaaggattttccatcaaataatactgctttagttcaattagcacttctgaaataggtttgtttgcaaagctaattaaagaaagagaataaatttggggaccatagcttttatgtattactcatataggaaagaatttgaacttaatttataattgtattatataatttttacttacaaatcgccaaattatacttggcttaggttaatatagtaaaatagtttgtatattctgagtatacattgtttgagtgagagagaggggcgttcaaggagaaattaaaataaaatggggaggggtctttttgagaaagtcttaatcattttttcatttgttaaattaaaaaaaaaatcacttcttgagaaaactcaaaccaatagaaactctgtgaatggagagatttttaagtattccttcccctaaacattgatatccatgattatgcctttttttaagacctcagctggtggatgctgtcacctctgctcagacctcagactcattagaagccatttggactttttggatttcaaaagtgacagcagcattatcctccaggagaggtttctctagcctgtggatttgcttctcatcccaatgaagaactcctgagagccctcattgtaagtcaatagaaaataaagaccctcaactcctataaaacttcttaagaatattaacagtaattaaagtttcttagatctgaatgaaggctatcaactagagacttctgagtattcatattcaaatggggtattttctatccactaattattaactgtataataaattatttcagttagtgccttttcgtaatttcagtaagtagtataaactatatggaaatttaaagattgtgttcacctacatgttatatagcataggacagaatttcagaggggagaaatctagcttatgcttcagtatcaattttacaagatttgttttgacttcaaaaattctcatgatatttaatacacctacatgaagagatacaattcttctgctgttaaagatttatgttgaaaacaaaagctagacttccttgtgtccaagaatgttatctatttaattgcacttgtctacctatgatctagtggaatgttcataatctttatggaaaatgtacccattcagaatctgataaaagtgatgaggccccttttactcatacataaaattttataaccctcacccctcctttttttttttttttttttgtcattgaccccatgaatccaatccataaatttccagggttaagaattccctgtaccacagttaaaaatccctgaaaaggggattaactcttcaattcaaagctagatagcaaatgtgtagtgtctcaaaagcaaaattctgagtttgcaatctagaaacataaaaatactttaccaatatgtgtttattttttaactaaaagtgttccttggaaatatttaaatgtcttggtaaccattttatccctgtttggttaatagagtaagttcaaaggttctattggtagcagtgacatagagaaactgttatgatcatcactgggacacttgtcagaaagttgtgtcagaatgaaggtgcaaactcaaagtaagtgcaaatccaatctcatgtattacatcattctacaccattgtcatttgatactcaccatgctgcctactattggcactcctaattctctttactctattctcttaccttatttgcatagcaatttttgccatctaacatatattaaaattcagtcatttatatgtttattgtatatttctatttcactagaatgtaagttccatgaagaaatggatctcgtttttttcaacaccaattgctcaccagttcccggtacatagataatatttaataaagattgctaaaaagtgaatagtacaataacctccctacccatatactttattgagtgcccacatgtactcagttttaaatggtgtgtatgatatacttcttgttttcagagaaatattagatctaagtctatctcctagagtagaactttgtatatagtaagtgtggtttccagttttaattttgatagtagaaatttagttacttttaatcacagagaactttatattttattttcaattcatttgcctaaagcttttccacttgcctgagtggactatcaattttcacgtctttctattaaaaagcaaaaagcaaaaacactttttaagtataactaaatatggaaaaccaaaatgattaatgtctaacacagtccatctttctataatgcaaataaagatgctaaatatataaaacatagtctttttttctgtccacattatacagccagtgtcccatcagcattttttctactcagacagcactatatatcattttgcttactaagtgcttgctattaaaaatagtagggaaatgttcttgaaaccaaatggtcccaaaagaggcaagccaaaactagaatatacattagtatgaaaaagatcactaaaaacagtagtactgaaaaggcttgggtattaacttattaattctggcagaaattaaatttattatttttatattagggaagcatgacttcttatattttcaatttccataattatttgagtagctgatttacttcagctatttgtgtattaaatatctggcaaaagataaaacccacatatcaaaagatctattcagcagtatttaatgagcatctatctgtactaggcatgatgctagtcctcaaataaaaagataaataaaatattctaccatctcaaagaactcctagtctgtttatcaaatataaacaaataaataatattgaaatataaaaaagtgctcagacaatacagaagatgcagcaacgttttctgtttgagtgtgctcgagaatttccaccaaaataacaatttttgcacttaatctagaagaggtttttaagtgaagaggtaaagtatggaatgaaagacattctaggagacatacaataatgtatgaaaaggcccaaagcaaaataggcctggtatggttgggaacagtgagaaattctgtggggttggaacataaaaatgtatgtttctgggggcagataagtgacagtggagacacaggaaagatgggaaaagagtggaaggtgagccagatcttcattaataacaagctaaggagtctggccttcattccacaaaagaagagaacagtgaagtctttaggcggatgaatgacatactcagattttttattaaaaagaagcaagatgttttgtggactgattgtttaactggattagagttagtgagatctgctggaagcatttgcaataacctaggcaagaattagtaaaggtctgaattaatgtaggggagagggctgagaggagatagattcaagggccactttatttagtgactgataagatgtggaaatgagaaagagataagaatccaggtgactctaaagctttcagttgaggttaccaggttatggtgatgccgaccacttaagtaaggtttatacagcctggttgggggtgggaggagatagagctattagtttgttttggccatgttaagttcaaaatcctttgggtcaccaggctcgttgtccaacaggcaggtgtccacattcacctgcagctcaggagagaagttagggtcagaatagagagtggctgaaaccttcaaagagactggggttacctaggaaagtcatgtagcaaaggaaacagaacaaaggatcaaatttaaagttcttctgataatggacagcctggttctatcacatctttaaaattaccttgaaggtagctgcaaaccatctactatcactggcattcattttgttaatatttttgagcaaacattttttttcatctttgaggataataagatttggcatagtgaatttactacagaagaactgtagtaaaggttcagtttttcttttgaattttcgctgtgaaacactcatctacgttttgtccaaatcaaagatatatgaaagaaaggaaagaaattatgtattgtattaaataagcacaaatttaaggtagctactgggcacactatatgctgctgtgtaaaaggaacctgccattctgtgtagttctatagcctttcagaacttactagataaaagctacagtcctgtgacagtctgaatggcagctagacaagtgcacaaccagtacatgccacatgtttcttttttatgtttgtcttttgcttatgttttgacctcccggcatccaattccttattttcactgaatttgtacttgaaaaaatgtaaacctacagaaaagttgtagaatagtacaattccatgaacacccagatatctttcatctagattcatcagttgttaactattttcatctttgctttatctctttctgtcttattttagttgaataatttgataataattgcagacatctgacattttacctctaaatacttttacttcttattacttgagtgccatgcaactagtctcttacaatgaaaaaaatacatgtatttaccaaattgtgagttcccactctatctctaattctaattctaattcaacactacagggttattttttccctcatttcatcttctattttccttctcccactgtgacaactgtggttttcgagaacaccaatatattgatcacctgctcaattctaaaacatacacaatatatttttggaattgccatactgatattacacagaaacaaactaaataaagttcaagacttttacagttctttttgtccttagaatatatccatcgcatgtacacaaagttctatgctcaaaagttacttggattaattctttttcatctcttctgtttagtcatattatcaagttgatagacatttagtttcatttgtttctggttaactgaattttgataattttccatcctgttgatttaattttatttcttgaacatgtgaatagtaatgtggttcaaaaggcagaactgtgttttaaaagtattaacagagaggtctcatgcttctcgatgcttttcccccaatctcacctacttcctctaggtaaaaaaaatcactcataaaaaaaatttttctttctatgtttctttttgcaacagtaaacagatgttcacacattacatacttttttgcacaaaatatatcattctatacatactctttttgtatcttacattttcacttaacaatatatcatgaaaatattccctacatagagatctttttcattccttttgcaactgcctagtactccattgtgtctatggactatgttttatttaatatctcctatgaaggtcatgtaagtggcttccactattttgctgttataaataatactgaagtgaataatctaggcacagatttttgctattgttgagatgtagcttcagggatagagttgctggtcaaaagcagttctgtttgtttttctcacattatcttccataggaattgtaccattttaggctttatcagcaatttatgaaaaggcctatttccccatagtctcacctacaaaatatgttagcaacttttgaatttttcaccaatttgatagttgagaaatgtcacttctctgattaagtgtgtgtttagcatctttccttctattgggagccttttgttaatacttctccactcttccccaatcatccattctccccaaccccatgtatgtgtgtgtgtgtgtgtgtgtgtatgtgtgtgctgtgtgtttgtgtgtgcttgtagcctaatttcagaggttatgaatcctgtggatgaatagatcttaaaaccctttatttttaaaaaatttttcagcctagactctgtcatacaaagatctttattttaaacatgaaactgaagcctctaaaacatatgtagtggcaaatataagacagaacccagatgtccctatttctaatttgctttcccattaaactattaacttacactcatccccctttttctcagactaggacaaaaggacttttctgattgtagaacatatttgaaagtacctagtaaagtacctaccacataggaggtactgaggaaatattttttgaactatatgcagcattaattaaatttggaattaagtgaaaacaaacacttttaaaacatttagagccgactttatggttgaactctaagaggtctcacccaagttcttacttaaggaaaggtgtatgtgacactaagactccatctaattgttgctttagcaattcagtgaatgagcagttttttaataaccaatcacaatgaaattaaaaagtggccttatatattcaaaatgtgttcaaaacaaatatgcccattattgataatactcattgcttcttaagaatgtatatgtattttttttaaaaaagcataacacctttatcaagctttacttgtttgcttttattccactgtgtgcctagtcaagcaaccaatgcaaaactttgtaaaactgtaggttgctttcttggacccaagaaaaagccagtctcacccaagtcttcttcaatgtatggtcatgcatatatctaaggtatatatttttcaggcagtagtggaagctaagaagttaatcctgggaggacttgaaaaagcagaaaaaaagaggacaccaggatgtatctgctggctttgaagaatgccctgcttccagaaggatcccaagtcttctgaagtatgcagaagcaggagaagggcccatcagccacctggctacactgctctccagagatatgatctccctttcataactgatgaggtaaaatctccaagaattttgcaacatttacagaagaaaaaaaaaaagcatgctgaacatgagtcaaatgcaaattcgctcaagtcactctgtattttccccaaatagtcttctctcctgcttaaaaataactctaaattgcatttgcggctattctaaatatcctcacagggtaacgtcctatatctatatccgaagcataaatattgaagcatattctcttattttaagaaacaaattcttttttgaaataatttacttttataagttttaagatgctgttacatttttcaatactgaaatatcctggttaagtataactttgtttgttactacaactacatttttcaggaagccatctaaattaaaccttgttagggcagagaatgtctataaatctcaagataaaccatctgccgagaatggtgttccagtttatagctaagcaccttcccaccagttttgtgttgaagttggtggctgcaaatctgatggttaggggcacaggcttttgagaaagacagacctacgtataaactctggctctgccttccctggttgtttgttcttgggtgacttgtttaacatctacatatctgagagcaaaccaagatttgagggagttagtaaaaggtaaagggaaatgaaattaaagaaatatttataatgcttagtatagatccttacacattgaatatcattaggcagttctaataatcaatgaattacttgttgctatggaatgcaattattttggcacgttttcttcgatgctaatgttttgttagaaaacaaaaggatcctaatgtaacctacagactttgggtaataatgaagtgccagtagatttattgaatgtaagagatgtaccactgagggcattgttgatacaaggggtgatttgcgtgtgtagggttaaaaggtgtgtgggaactctctgtactttccactcaattttgcttgaacctaaactgctctttaaaaagtctattaattaaaaaaaagagagatgggaagatttgaggtacttcattgtaaggaaacattacttcatataactacctttccccagagccccagccatgtagtatccttaaaattctatattagttaggtaacaccaggttatgctgcaataaaaatgtccctcaaaatctcagcaatgtgttaaaagtttatttctgagccaggcatggtgctcacgcctgtaatcccaacactttggaaggccgaggcgggtggatcacgaggtcaggattcgagaccagactggccaacatagtgaaaccccatctctactaaaaatacaaaaatcgctgggcatggtggcacacgcctctagtcacagctacttgggaggctgaggcaggagaacacttgaacctgggaagcggaggttgcagtgagccgagatcgtgccactgcactccagctgggcaacaaagcgagactctgcctcaaaaaaaaaatgtttatttctcaggctatgcctatgtgcataaggaagtatgtggtctgaagttcactacagtcatggaagaaagagatggaaaagccaccagctcttaacggcctcagcctagaagtgatcctcatagattctatccatgcgtattagccagaactagtcacgtggcccccaccaaatcacaaaggaatctgggaaatgagtaacacatgtatatttttatgaacactcactattcctgctattcctgctgaaatgtcattttaaaaatctagatgtgcactaagtttgaacatcttatgaacaggtgaagaagacctaaacagaatataccaccaaaaccgtaaagttcatgaaaagactgtgcgcactgctgcactgctatcattttaaataacaatccatcctacatggacgtcaagaacatcctgctgtctttggggagcttccccaagaaatgaataaatacatgctcgccattgttcaagacatcctagttttgaaatgcctgcaaggtataatacattgcacatgtctctctgtgtattcaagctttttgtgtgttcatggggtaccgatgtagctaataataatgatgtggtcattatgcagggtacgttgcataaaaccaaagagtgccagatttcccataatagggctatttagggggccaatgaaacaacttcactttggcactatgagtccatgactggtaactctgggtataattttagtagggatgtcttgttcagtctggcaagtgtatattgccaaatgttttaaaagctaacgcattttcaacaggattttaaaaataagtacaacaaaacaaagtaaattcttaccaaatgttttcattgtaacatttcaagtgttaggaatttttgaagcctcatttatcacagatcaataaatttcccatttaagtttaaaatcttaggcacggcccacatttcaaggtgattcaaatttaaagagtgcaatcagtagagttcatcactctataactcttgctgaattaatttcctccagttaccaagtctgtcctcccaaatgcaaagtggctcccccaaggtgcctcctcccggaattagagggtcagagaaggaagtttcatttttcctgagttacatgcagaacactaccccacgaaagatcagatttaagcattcaccacagagattggaagggtggaaaataaaggaaagaaaatgaaaaaagacagcattaaaaggttgaaagaaagagaaacaaggactaagatgaaggaagacataagaaacgggtgtgagtagaacagagataagagcaggacattcaggaagagcaatggagcaagtgagtgagaaaagaagccaaatctctctgcagccatgtattttagttgaacgcatttagcttctccatttctttgtttgcttttatgagaccctgtgaagggatcctgggtgtacttgctgccttcgtcttatggctctagcatttcagggacccggaaaaggagacagtggggtagagaacagactagaaattgtgaggaaaatatcaccaacattatgttcagagtctcagaaccaaaaacattagagtggggaggaacactaaaggctcccttgctggtatctctccactgtagggctgtagtctcccagcaggtggtattcagactttgcttcctctcccgatgacaggaagctcaccatctttgagggaacttgtgccagtgttgttcagaactctcaccattatgtctttgtataatctgaaatcttcctattggctctggttttatccaggagcaaagcaaaacacgtctagtcattcatccacaagaagaccctttgaatatctgagatagctgtcataacccttctcatctttgcttctctaggctaaaatcttataacctagtatattggaggggaaacctctcaggatgccattgcctcccctcaattattttctaccttaacctaggaccagatttctataattgattattttgatgttttgctatgttgtcataatgtgctattactgatatgattaatgttatgtaatcagaaatgaacatcttaacactaattactagacaagatggacgcaatggggtaaggattaagacttactccagaggagacgatgattctatatgggttttactgagctgtttctgtaattggaaacttcacagatatagaagaaatctggaaatgtactgttatatgtcattagtgagagagactattagggaatgcagaaaaactttaaagaaatattgtgcaatctccccagtttggcacaattttcctttaagtgtatgcatattaaacaataaaaccatgacgaatcaaagaattttgccatgcctgaaatgtgtctacagtcaacttaagccacctcaaagctggacacccttgccttgctgtcattttgataccaactaaatttcaaatatctgagtaatgaaggggctagccctaatcctgatgctaccacgccgctggcaccaccctggctcttggaaaggcatgaggaaaatttggcttcctcttttttccctgaggattttttttttccaaatttgacttgggaaacagtcattacaatgaatgtgcagtttttttttcctcatatgttgcagcaaaattgtccgtcgagttctgaaggaaatggtcgtcacaattatgaccgtttctccaggagtggatcttcttctgcctacactggctacatagacgtatgtacaccaaaaagaggttctccttccataccccacaacttagcattgctggaatgctattaaattacagttattgtgtgtcatcaggtagtccccgttcggcatctacttacgcctagacattctctactcgggttctggcattctaaggagaagtaacctgaacatctttagtacattgggaaggctggtcttcacggtagccaggtaactcacttctcatggattttgttaataaagtatgcaagaaatcaggctgaggtaaaataaaacatatatgctgtgggtaagctatagaatgtataagttaatggtggcttctgtcatattttgcccatgatttccttattgtaagaggctgtatggtttatagtcactcagagaaagtttcgaatttgaacttgaaactaagtaatttgatccattgaacttgacaaatgtccatttgtcttttcaaaggtgcacatttcacaaaactgaaattgtgccaatatttcttacataaacgtttaaaaataatattttattttattcacagatatatttcttagcctcctctcacccccaagtatttaattctagaattattttccttttctggttgtttctatgaagagattgattccccataataaaacccttcaaatagaatatgatgctctaaagagtcaatctgtatttctccaacactgctagaagagaaagaataaaatgtaggcattcaacagctggctgacttccatccctttagtgttatccaaatgaggtgatggtctataaagacttcctaataatgacatgtactttctttttagtttttagtacatgaaattattaccttgtaaatacagccatttaagtttttaaaatgatccaatgcataaaaacttgagtctttatcaatcttatattactataccttttggtagtactgtagtcgagtactatgcctttctgtcctgaggaatcacaatctgttttctgatatgtactttgaatgcaaaacatccaggggttaaagggctgggtatggaggacagaaaatatgtaggattccatttgttgtggaaataagtgtgttagccccctcatggtgtttatcgactttttttttttttttggctagggagaaaagtttgacatggaatggggtgagtcatggcttagagaatacctgtcctcacatagcagcagccttagaatgactctgccaacacctttccatctacttttaatgctctgcaagacagctgatgcgttgtatatgacagtcctggaaagactaagagtctgaggatgccatcataaaatagaaagctcatggttttcatagtcagacagaaggggtatggtcccgcctctgacatttattagctgagtaaacttgaaaactttttttgcctcatctacaaatgggtaatatcatatgtacttcaaagagtggttgtgaggattcaatgaaaaactaaccaccttatattcaggcacagaggtttttgtctgttttagtttttgtttttagctgttgcaatatttaagtttttggccccttgagaagttctagctgcagctcagaagcttcaccatttttacagagcaggcagggagcttgcgtcatgaacattatattgattttatccaggtggtattgaagcccaaggactggaagccttaatcgcagccacccctgacgagggggaggagaacttgactcctatgctggtatgtcagccatcctctttgatgttcagctcagacctgtcactttttcaacggatacagtgatttgatgtccaaaatgctgtcagcatctggcgaccctatagtgtggtgaaaggacttattctgctaatagatcattctcaggtaattcattcagtctggagtatttattgagtccctaaaatacgccaggcacgttttaaatatgcttagttcttggggatacaagacaaaattgtgcccatcttggagctcatattccaagcacttggccctcttgtattggtcccctttctcctttactatagatatgttataatttcatatattagatgattataagtgcctttaattggaggcaaagagaaaatgttgatgttaacagaaacaagaaagttaggacacaacagaatagagctaccactgtctcctcacttggctctctcaggcacgaggcttaggtgatatttatcctgaaggcaggagctgaactatgtggccttataagtcactgagacatttgtaatgacagagatgatgaagatgcatacagtgcatcattttgaccctgccaattagtagaggcacaagcaaccacggccatgagccacatgcaagaaatcatgaagactcttgcccaaaattctcatgtatataaaatctcagaaagatgtgttcattcttagagtatagagtactttcattctctagagccacattcttcaaaatggttttcaattttttgtggcccaaatcttatgatactgtaccaaaaaatgacaatactatctttgatgcagtaagatttaatggccaagatactgtgggatggagatggtctgcctaattagattttctgaaaaacagaaagggttaatctgaataacctttgagtctgaatgtttggtgcttaaaatttttctttaatgtttgatttattttctgcttcactaagcatagcaacataaaaaatgatatatttgctaataaaatcttatgaggaatcaaagtgatcactgtgtactctaattcatacttattatattagaatatataaggagattgaaataaaaatttacagatgattggattgacttgtaaagttactttattgttttaatacattaatggataatagcctacgtttgaattttgcctccgttacttcttgctatgtgctcttgggcagttacttaatagccttaagccacaatttcatactataaaatgaggcacctggaacaggtggtctgaagattttatcagcttttttgtttgccagtaatttgaggattctgatttgttaggttctggttatgaaatcatagattttaagggctggagatatcttaggtattagactgtattaaaactcctccaaaagctcattatttgggattaacagtgttaattttctatctttcttgttcctcatatcagctcaggatagctgtatatacaaaaacaaaaagcaatttagagtggcttaactaaatagtttcacttttatagtgtaacaacatttggaagtaggtggtccagggttaatatggaaatcttaagatatcatcagaatcaagctgccttccttcagctcagccattcttacttgtgacttttgacctcatgcttgtcacttgtgattatcagatggctgctccacttccagcaccacttcctcattccaagatggaaaagggaaggataagaggtcacagagtctgactctttttcaagaattgtttggaatcccttctaggttttggaccaaaacggtgttacatggctatctctagctgagagagaagcttttaacatagtttttcaatgggtgtctgaacaaaattgtttctgtcaatacaaatgtagaaagacaaagagcagtgcgtcttgtatcccttaatcctcaagtcacacatgaaaaaaacagtctcaaattatatcagaattttacattgcacaattccagttttaatgaaagaatcgtctaaggcagcataagtactgaaaaagtagtccacgttttaggacacagaggacagctcaacacacctgtatgtgcttagctacccataaacaatgcctgaggatttgaatcggggtgtaaaccatgaggagtaatctagatctgggtcagcaaacttgttctgtaaagggtagaaagtaatattttacgctttgcaggccacatggtttctgttgcagccactcaattctgttactgtaagtgaagacagccatcagcaatacattaacaaatgagtatggctgtgttccaataaaatttatgtacaagaatagccagtgggccagacttgcctgctggccatagtttgccaatcccgatctagattatcttgtacagtttttctattcactaagctagggcagctaaggcaaggctattctatgagaaagattgccccctagctattaaacatagcccagtgtctgtgtgtcagttggagtatttggcagatctgaggttattatacaaattaagctgtctgaggccccctggtctgcagagcactccagtaatgccatcctagcttcagagacacataccactctaggtcagtgctgacactgaaggaaatgttggcagtgggtagcccatcacagccaccagggcagatgaattactctgtgcttgctcacactttctctcttcagctaattggattactcttcagagaagatgtctcataaagtcagtttaataaggggatcctctttagccagtaaagaacatattccctaaatggaagcaacaggatgagttgtcaaaatgtcagcatctgagctataagaaaacttatgggaccaagaggatcaaagaggtcacattagctacaaagttctaataacttttcctctagttcataggaaagaatctaaataaatatgcactctgggccaaacaaggacataacctatgctctctctctctttttttttccttttttgcaatatttcttagaacaggctttttgtacaccaggagacaaaagagaggtatgagtttgtgatagccatgaatattagtagaaagtcttcacccaggccaggtgcagtggctcacgcctgtaatcccagcactttgggtggcaaggcaggtggatcccttgagctcagaagtttgagaccaggctgggcaacatggtgaaccccagatctacaaaaaataaaaaaattagctgggcatagtggggtatgcctgtagtccagctactcaggaggctgaggtgggggtgagaggattgcttgagcccagcaggttgaggcggtgtgacccatgatcacaccactgcactccagcccgggtgacagagcaagaccccatccaaagaaagaaagaaaagaaatgtcttcaccctagagacaattggagtgtttattctggttcatgtgtagcctctgagcctgatttttcctttcaatcttaagatataatgcctaccaggaatattggtatgaggattaaatgagacaccaaagctttgtagagctttgggcacacatatgtgctcaaaacctgttagttctacttactttatactgcttaaaaattagcaccatgggcttagtccctttcaaaaaggaaagagtgctttgtttttctacaggagtcagtggttttctttataagggggtccaagaaaattcctctttgcacatgcattcttcttttgtcccttgtgtaaggaagtagaattttcccagaaatccaaggcactcctcataacccaccttgcaaggaaatgctctctccccacaaaaggtgcgttgtctaacagccatgaaatggccttttcctggcacttggtgtattttgccttccatttaatatatggttggtgggaaggccaagatcccatcacaggcctctgctggactgggtggatgaacaagattataattttcaaattaggaaagagaaaaagatgcaaagaaaggaatatttctgaggtgaggcacaccatagctttcattggaaacaatcatgtttggagtacacatacagaactctcatattttggtcccatagttcaaggcataggtgaaaatgtgggcatgactattgtgttttcttcaggatagtttgtgtccacacattagttataatgcctcaaacaaccccttcatcccatgcagccatattttgtcctaatcaaatgtctctttaagtatccttagagctatctcctaatgtgtcctgagcatggcacgagaatctcatgcttccatcaaagagtgtccttcagactgaaagtagcttcatgccgcaccgtacttttttaatacacctggttgtaaaccaagtcctttgcctggggtttcctgtgactttttttggaaagtgaagagaactcagggagatcaacacaatccttgctagaaagttaatcatggcagttatagctggcaaatgcatggcttgtttggtctgagtagggcagttacaaaagaagttagtcatcctgccggttgccaggaatttaagatctttggaggaatatcaaattaaggatactgagtctctttctcaaaatcattatcacttccaacactgtccccaggcatctgattccaatccaactaaaaagttttgtgccaacatcacctcaactaatgtacatgaaaaaaaatgcaagacttaaaggctaaatgcaggcaaacagcacaaaacaatgggtttcaacaaccacaaaatttgctcaggatgggccatgtttgtaaataattactgtccctatgaaaatactattgagttcatgttgaacttgactattaactcagtgtcatttcaaatgtcaaaagcagggtattaggcttagttaaatttgccttcgttttctagttggatgtaggcaattctggaacttgtatacagttggcgtctctgtaaccgctggttcctcatcaaattcaaccaactcagatcaaaaatatttggaaaaaaaacaccaaacaataaaatatagcaaaacgacagatatattcatacaatttttaaaatacagcataacagcaacatagcatttacactgtattggtattataagtaatctagagatgatttaaagtgtatgggaggatgggtgtaggttacagcaaatactatgcctttttatataagggacttgagcacccttggattttgttatactcaggctgggcataggtagtcctataacaagttccccttggatactaacggacaaacacactcactgggagttttaaatcttgtctgttattttctagcaggatgcagttgactgtatttgcacagcacataactagagaagtgctgaaggacctcgagagatcacctgatccaaacctctccccttacttccctggacaaaaagccacagctagatttctgatggagatgccttcatttccttagttcaaaagtttccaaatttaggtggatcagaatcatacaagggcttgttaaacatagattgctagaccccatcctcagagtttctaatttagtaggtatgaaggggaactttaatctgtacttcaaaccagttcccaggcaatgctgatgctgttgttcacagaaacacatttgagaaccattgttcctttcaaagtgtagcaatgattgaaggaaaacatccttcttattggcacttcatcactctggtattttaattgactaattaatttagcaaatcaacagagttacttccggtgcttaaaattaggacagcatgtttccaagcctagagaaagactccaacacaacacaactcaaatggaattatctacagcaggaggtcaaatgtgccattggaaaggggttaactaaattgtacttattatttttataactattattatgcttttttcttctaggaactcagttacaatctggactaaaagccaatatagaggtccagggtggtctagctattgatattcaggtgcaatggagtttagcttgtggtatcgtgagtctaaaacccgagtgaaaaatagtaagtgtttatgcattatacatttatgaattacatataagactatatacagagaacttcgaaatatgttttgggaattaatcttctgacttttcaaaatctatgctttctatttggattataaaacgatagagttggaagtgatcataggaaattattctgtctatagcttcttatagcaggtcagtacctaatatgactcagccaagaattttcctgcttttaaagacatacatgacaggatgccctgtgaatcagatggttcatcttcttttggtattccaccaagagaagaatttcactttaaggtaaactttcctcttttgttgtcttcagtggggaaaaataaaatagtaatttcatctgtgcagaaactaactattaaatgttaagagtccttaagtcttttcatcgcattcctttttctaaataaaatactctaagctcctttaatttttctaatctacctgtggatttaatgaaagtgttttactttgaatataaaacaatgtctttgaactagtgtgaagagaaaattattagccttctgttacagaatttttaaaaaggaaatagaaatgcaactaatttaattttttgatatttaaaaacacattcaggcaaaagtgagatatgtgataaaatcaaattttgattcatcttgagctatggatgaaggaactgagagcaatcaaacagtagcacattaatgtgaagtgtgacccacagtgttaccaaaaggaaacacagaatgaaaaatgacactgtcatcaaaaggttcacaatataacttagggcttcccacataatcagtcatctttcaccttttccaaagtactttctagacagaagtttttccaaatgaaatggaattgaattctttgcaagagaaatcaacaacagcaacaacaacaaaaagtaatttggattttttaaaaaagtaccagtatccttaagaatctacccttatccatattgtaaccaatctgtcttccatttccactgttcatttgaaaaaaatatcttttaaacctttgctgaatataggacatcagaaggtacctaagtgattcagggattaaaacgacctctgacctatttttacactgatcataacagcacaggggttttaatttgcgcagcaaaaattaatattcctgtcaaaacataagggcataaactctcatttaattgtgaaagcagtttctcacagtttgatttaaagtccacaattcaattcagtagaagtaagtcttctgttgaaattatttatcctcttcatcattatccagggcacatccccagccaatgcaatctgtttatccagttatctagagcatcattaaaggacccaccaatttttcctcctaggacctactgtacatgccccactgtaagaatgattttttgtaacacatattttttcaaatatcttggcaatcaagggcttacgcctctagagactctttggagaagtaatgaaatggaattaaaatagctgcctagaagccaacagagagatagttaacaaaaactataagcatcgattgtcttcttggtgagtttagactccattttaatataacttgggtattctgacctgctgagaggactgggttccaagaatgttttcattttggtctttgttatgccatacaaaacaatgtagtatcttacagacactccccacatctgcaactgaaggcagggggagctcaggggaagggcaaaccttccctgcccaatatctgagactcaccaggccctggtaccagcagaactctaagcacatccaggtcacctctgaatcccttaagtgtttccttccatcactggcatcatacgttcagaccctgtaaagttacagctgttagtccaataccattaatataatatgaacaagttttttctttttttctcaaatgtttagggtgactgtggtaataacactgacatcacagtggactcctcttttgtgaaagctggcctggaaaccagtacagaaaagaagcaggcttggagtttatctccacagtgcagttttctcagtacccattcttagtttcatgcagatggacaaggatgaagctccattcaggtaagatgcagcgttcaggtcatgttcaggaccatccccagtgcaccaggaacttgcattcagtttagaacattcagtttcagaataaaacaaaacagtagaaacccagggaaagatgaattttctttaaatgagtagaagaatattgataaggccaaaaaaagtcagtttctgggataccaaaaaaaaatctaatgactagtcatttgattctggagatagttatcatattctaatccagaaacaatttatccaggaaagaaggcctatgatttaccataggagttgccacatagtttcataaaaaaaatcagatacacattactgtctggtatcttcacaataaactgctggacaaaagatttcaaataaaacacctgcaatccatttaccatgtttaagggccaaaatgaattcgcaatttttaagtattccatatgcagcaacttgaccctgtttaagttttggctcaagtttcagagtttgggattctgaattttttaaataatgcttttggtaaaatagttagtgttttaaaatacaaagatataatttcctgtaacatttgtgctgtgtcatttgaattttgtaaccattatttgtaacaatactatcaatagagctagaatgccttgagtctaggtagcactgaccctttcataatagttgacctacgtaagcataagggtcatttgtacagttaaaacagcaagccacatcttacatcatctcctttttaagtaggccaaaattgagcaccttcattattttactgacatttcatgattcatataaaaaacgcattgattatataaaagtaaacgagtcagttgtattttcagagaataaaagttgtgctttatagttaaactattaagctgtcactaacttacattaagttatatctagaagaacctccacaaatgcattttaaaaaccccaaccttctaatggttgaaatgcagtgaccccaacccacccacatgattaattggtttggttccacatttgccttgggccagagctcttgaatgtttctctgtccgcattctctgcttaaatccagctgggcttgcctgttactcaaaggagagtgctcccaaggtggggcttctggaatgaagggtgagacacagcacagcctgcaagcttaatggcatcaccaaaaagctgaaatgaatttagtctttcattctagaaaaatgttggcaggactcccatatcccaggcatttgaagtgtttctgttgatataaaaagaaatgaaagaaaatcacccattcatggagtagcctttgacactcatatcctttctcagattgcttggaacagaaacttcaagtacattcagtaacttggctggagaggtatagggtgacttaacgtgtgtgtaattctgttattgttgctgttgttgtacaggcaatttgagaaaaagtacgaaggctgtccacaggcagaggttatgtctctcagaaaagaaaagaaagcgtattagcaggtgtgaattcccgctccatcaagagaactcagagatgtgcaaagtggtgtttgcccctcaccggatagtacttccagcggatggttttgaaactgacctgtgatattttacttgaattttctccccgaaagggacacaatgtggcatgactaagtacttgctctctgagagcacagcgttacatatttacctgtatttaagatttttgtaaaaagctacaaaaaactgcagtttgataaatttgggtatatgcagtatgctacccacagcgtcattttgaatcatcatgtgacgcttcaacaacgttcttagtttacttatacctctctcaaatctcatttggtacagtcagaatgttattctctaagaggaaactagtgtttgttaaaaacaaaaataaaaacaaaaccacacaggagaacccaattttgtttcaacaatttttgatcaatgtatatgaagctcttgataggcttccttaagcatgacgggaaaaccaaacacgttccctaatcaggaaaaaaaaaaaaaaaaaagtaagacacaaacaaaccattttttttctctttttttggagttgggggcccaggggaagggacaagacttttaaaagacttgttagccaacttcaagaattaatatttatgtcttgttattgttagttttaagccttaaggtagaaggcacatagaaataacatctcatcttttgctgaccattttagtgaggttgttccaaagacattcaggtctctacctccagccctgcaaaatattggacctagcacagaggaatcaggaaaattaatttcagaaactccatttgattttcttttgctgtgtctttttgagactgtaatatggtacactgtcctctaagggacatctcattttatctcacctttttgggggtgagagctctagttcatttaactgtactctgcacatagctaggatgactaagagaacattgcttcaagaaactggtggatttggatttccaaatatgaaataaggaaaaaaatgtttttatttgtatgaattaaaagatccatgttgaacattgcaaatatttattaataaacagatgtggtgataaacccaaaacaaatgacaggtgcttttttccactaaacacagacacatgaaatgaaagtttagctagcccactatttgttgtaattgaaaacgaagtgtgataaaataaatatgtagaaatcatattgaattccttttgtctttgttacttccaacaccatatttctcattcctgccactttctgagcctagacacatacacgttaagcctctgcagcaatacaggtcaggccaggttctctagatgggagaccagacccattgaaaaatgggccactgaaaatatcagcagtcagaacctcttaaggacgtgtgagcttaaaacatgccataaccccagttttcataaagctctggactggcccctttactgtcatgtactaaaaaggaagaaaggaatcagaaactaaggtggtgggtggagcatggtatgtggtacatcagccttggggaaaccactctgtaaagatgctgacgtcgcagggaaagtgagttggctagggtactaagctgaagatgttgtggactcaggcgcttcagccctgtgaggtttaacaatcacagccacctctgcaaaatgtaatcatttacttaacaatgatgactgtggtgctcgaatgttagtgttttgccatttcccaactgtttactgggctgctgagccaagtatctgccacccagtggagaatggatgatcctgagcaactctaacatgctccaaagaaacaagaaacagcagcataggacaaacagtaactcctttgtagataaacaagacagaaaatgaagagggtagagtgatagtccacatttggaaataagatattggagccagaaaaataactttaaactcatttgcagtcctctagttctgactacttctccattataaatgccagcatacagacactttgtcttctgaaaagacatctatttgggaattgtatagccccctaatgtgaatctccagcctctgtccagtcagatctttcctgcaagctttaagattagcgtggcttcttttcttcgtgaagtgttattgtcattccctggctcatgttgcagtcctgcctgtgacaagttgctcctgcttctctaaactgaccaccttcaagtaagtgttaaagctaacacttactgagtgccattatatgcgaggtattttaaagccttttccgtacattaatttaatcttcataaaaacttatttaataggtagcattatttccatatgatagatcagcactaagagaaatataatatggtcacataagcaatttggaatttctagtagccacattaaaaatgtaaaccaaaacaggcaagtaaactgtaataatatattttatttaacccaaaatatccaaagtattatcgtatcatatataagtaacataaaaattattaatgggaagctttacttttgtggggaagattaggtttcaaaatgtggtatatatcttgtatataaagcacatttcagtttggatgagacacattcaagtgttcagtagatgcatgtggctagaagctgctgtattgaatagtacaatattgggacacaagacatttaatttgccccacagaagacactttctcacttagaaagtgaaagaacaggactcaaatatgagtagtttcacctcagaacctgctctctgaacccattataggatgttcccacatgcttttggttttaaagatttgctgccaaacgaatacagacagtaggttataaaatgagaaacatgtgacagcagcaataaagctaagagttgttgccctttcttttttttgagacagagtcttgctcggtcgcccaggctgcagtgcagcggcgcaatctcagctcacgcaacctcttcctcccaggttcatgccattctcccgcctcagcctcccgagtagcagggctgcaggcgcccgccatcatgcctggctaattttttgtgtttttagtagagacagggtccaccgtgttagccaggatggtcttgatctcctgacctcgtgatctgcctgccttggcctccaaagtgctgggattactggtgtaagccactgcgcccggcggacttgttgccctttcttgtggtcgttcagtctcctcctctgatggaatcagaagcccaccataatcaattgtagacgcatccatcattccaaaaagaaacctgtacactttagctatcacttccaatgtacccactcccagccctaggaaatcactagcctactttctgtgcctagattcattgtggacaattatataaatgcactcatatatactatgtagtcttttgtgactggcttctttcacttagcatgtgttttcaagtttcgtacacgttgtagcatgtatgagcactttattcttttttatggcaaataatattgcactatacagttatgccatgtgtttatccattcattagttaatggactttggtttgtttccaccttctggatattatgaataattccgctatgaacatttgtgtacaactttttggtgggcatgtgtttacatttctttatacttagcagtacaattggtgactcaatggtaacactatatttaactttttgagaactgccagaattttctccaatgtaactgaccattttacattcccaccagcagtgtataagggttctgatatttccacattctcaccaaacttattaatatacttctttttgattatagtcatcctagtgggtgtgaagttagcactaatttcgaataaataaaaaaatgtatttggctgggtatggcggcccacacctgtaatcccgcactttgggaggccaaggtgggatgattgcttgaggccaggagtttgagaccagcctggtaacataggaagaccctcatctctacaaaaaataaataaataaaaaaattagctgggctggtggcacatgcctgtagtcccacctactctgaggctgaggtcggggaatcgctcaagccaggatgttgaggctgcagtgagtcgtgatggtgctaatgcactctagcctgaatgacgagcgagaccctgtctcaaaaaagaaaaaaaaagattcaagtccttgccctttttaaagtgaatatttttccttttatttttgaattgcaagaattagttatatattttcagtgtaagcccttatcacatacataatttgcaaaaatcttctctcattctgttggtgtcttcactttttgataacggcctttgaagtacaagagtttgtaattttgctgagatacaatttatctctctttttcttttttgtttgtttgttcttttggtgtcatatctaagaaaccattgccaaatcaaagtcacaaagatttaacactatgttttcttttaagaacttcatattttagctgttaattagtccatcatggttaattttttatatagtgagaagtagaggatcaaaatttattccttgtgtatggatttccagttgtcccatcattgactgttgaagaaacaactctgtccccatgaattattttggcatccacaaacatgaaggctcatttctggactgttagttttattccttaatctctatgttgatctttatgctagtaccgcactgccttgattactgttgctttgtgtaagttttgtacttgtgaagtgtgaatcgcatattttgttctttttaaagattgttttgcaattctgagtcccttaagttttcatatgaattttaggattagcctgtcaatttccacaagccagcttggattcaaatggagattgtgttgaacctgtgcatcaaaaattaattatatgtctccaggtccatgaacacgaaacatctttccatttatacacatcttgaatttctttaacagtgttttgtaattttcagagtataagctttgcacttttttcgttaaatttatttcaatgttttattctttttgatgctattctgaacacatttgttttgtttcattttttcattttcattgcaagtatataaaaatatagtttttttttgtataatatattgctcctgtaaaacaaattatgttgcaacactgctgacctcatttattcattctatatcttttggtaatagatctttagaattttctatgtaaagaataatgtcatttttgaatagacatagttttacttcttctttcccatctgaatgtttttctttttttattttcttgactaattgccctggcaagacctccagcacaatcttgaatagaagtggtgagagtggacatagcaaagatgataatgctgtgaaaaatgtggtggtggtgacagcagtgacagacactaataaccacgggacatgaaagaaggcccaaattgtttggcagtagctctagttctattttcactaagtaatatacagttttccttggtatctgtgggggattggttccaggacccctgtgggtactaaaatctgtggagctcaatcccttatataatggcatagtatttgcatataaactacacacatgcttgagtaactttaaagcatctctagattacttataatacctaatacaatgtctaaacatcacttcatcacatggcttcaacttagtagtcaatgtggggcaaattcaagttttgctttttgaaacttatgaaatttttcttccgtatatttttgattctcagttagttgaatctatccatagatgagaactcatgcatatgaagtattgtaagttctgctgtgcttgaaaattaataaaagctatttgaacgtttaaaacactttcaagatagtctagatgtctgactgcacagagaagagaacacaacttgaggtgcctgtaccagcactaaggatatgtttgagattcagattggttgagcttcagtgttgtcaacttagtcaacttcctcccctagaaggaagcggggagagaaaggaataggacagggaggcctggcttagaaatccagttccactacctgctggatcttggacagggattcaacctatctgccatttccaaaatgggtattataatctttatttcattgtgttttttaaggattcatggagataatgcatgtaaagcatactgcccagcacatacttggtagatttggttaatgtttttaattttggagatgtagtgagcaatatcttataactgatcagtttaataaaaaggagtttgtttgcactttatttctacctcttccttacaggtagttggaggcatagtagtaattttctctctaactctccagaattggtgcagaatggcatgaaaaccttcccatgcagcatccaggaaggtaggaggcaggggattgcagcagtgaggagatttggataagatactcctgcatacgtgaaatctcacctcttcttcttactactgctacataaacctcaagcctctcagcttctacattgggaaaatgagcagcacctcataggttgttgtgaggtgaagtaaggtaataagcaagttcctggcgcataacaagcatttaataagtactcattatactaacttttcatgtgcagtcttatacaatttctgagtaaagcaacattttatgttttactcaatggagtgaatctattttctggacattcatccatgaacatcataagttttggaaggctaccagttttgtttatttatcatgaaaacactactttcacattataaaaaattattctccattttgtaaaaacatgactttcatccatttctctgcatacctaaattgacctgagtttcactgatcctttctttaccatttttctttgcttttgtcctctgtaaatatgataataccaagagtaaaagaataagtcttttcactagggggcatggaatgaatttaaaattcatcacaaaataagaaagttctagtagaaagtttttggagaaaatcttaagagaactctacacataaataaaatggataggatttttgagaggaaagaaaataccagaagacaccactccactcagtcattcttgtttaggacttgagcagaatgtca

SEQ ID NO: 5066 - DNA, 66224 bp, Homo sapiens
ggcattggtgtccatggccctataccgccatcttacacgaaagccacagagttgaaagcacagagttgaaagccacagagttaagtgacctcaggtaacataatggtgatggttggcctttgagtctttgtaacctaggaaagacaaaggtctgattcagattgcatgggggattttaacatatttgaaactcagggggaacatgattaagaacacaaactggtagctacacatgaggtttacttgagcttttgtgattcaaagttcaggggtggtaaggactctggtaccagggagagggagaattaatttattgtgcaaatgctggtatttcttacatgattttttgttttctctgttgctagataaatagaaactaataatagctctatttctctgccaatataaaatctcctttcatataatgctacattgaaggcacagaatttgctaccatctctctctccccctactaccaaactatccacaatttaaataaagaactgctgtgtctgacttactctcaataaagtttgtgtctttatttctggtctctagactttattttgtttagctgccttttaaactttgaaagaatccttgtatatcagcagctactatgataattaatgaatacctcttcagaaataagagaacactttattttagttcatttgcattatttatttcaaaaaggtcttaaaatgatgtatataaaattgtaaaaaggatttctggtaggtagatatgtaatatacatgaaaaattttatcattttttaaggaactgagatcatgtttaagatgcatcttaacacgaacaacttaagaaatctctgtaatcatcagagtaatacatttaaactatgctgacattttcatagcatcgtttctgcatatttacatgggatcatacttttggcatattttcaaatggagaacggaatttaagtttttcaatgtgatagggaaaacatttaaaataagtaataatagagaattatgagaaggataaagcaccagagtataataaagaagaaatatgtttgacagtatgagaaagcaaccacttctcttaaaacttgaactttcatcactctaaaaaacaataggattgtaaaagcaatgtcaaaaactatatttaccaatattaaagtatcagacagaaacataccacaatgatatgggtttctgataacccctacaatattctacttaacttcaaaactcagtattgtttaagacaatgaaaatgtgtatatagttcatgaagaacatgagataactgagccaggcaataatacaaacacaatgacatgggtagtagtaagcagctgaactcactcagaacatggcaactacaaaatcaaatgatgatctctagtagctaactgccagcacaggagaattttggaaagaatttagaaagtaatttggatgtttacctagaatttaaagttacatacttgattcctttttataataacttcagtcgatcagatgcaaaagaaaaagtacttaaaaatgtttaattcaacatcctttatactccacagttttagttttattctccccttagcaaatgttttcaggcatctttaacacaattcacttacttaatctttggcttctcttgtttttaagctaatatgttaaaactagcaaatttggggtagttgtttgaagcagaagacatgtgtgtaatcttcaacaaataacaagcaccctgataattaagaacttgattactccttcaagtttggaaaatggttccagagtgtaagttcacttgagatacttttgtgcagaaggccagatgcagacaaagcttacacctgaaagagttaaaaatatctaaaaacattttattttctttatgttgtgaatagaactcttgatatttctttcttccagatcaaagcatcaaaaaaaaaaatatatatatataatatatatatacacacacatacagtatatttacaaaaattgctatgtttttgagtggtccttaaaaatctattcatgctatgaaaaattttaatttaacatctaatataaagggtttatatatagatgcttatgaccaatatccttaaactggtaaatatctgtcaatcaataataaacagaaagctcttgtttttgaaaaaaatatttattacttatttgatggtgactcattatagaaacagcatattagaagttgctgtatttgctggaaaatgagaattttcccttgtgtttgtatgtgtttttacaaagcaaagattcacataaacttgcaaagcgactctaattgaaagataactattgttccattaggttgaaaacagaggcattaaatctgtttagtgtgatgtttttttttctttctttgagatacagacaccaccaacacctggaatactatccattaagctcattagggatatataatactttatatggcttattcaaaactgtcaaaaaataaatatttgtacaatatctctggttaatttttttttctaattgtaaggcattttgtcttgtagcaacattgagtaacccatgcaaaagttgttgcaaaagcacagtagtgacaacctacacaatgataggaataaaaagtcatggtttgtgttttaaaggactccaactttttaactttttattttgttcaagatgagcaatctgctagctttgattaaaggttggagggatcaagggttggtatattaatacaggagtcattaaaaatttattttaggccattagaaagggtaaaatagttccggtggatttttcctttaataaaaagcagcccccaagccacttattttctaacaaaaagagcctgaaaagtcaagttgcaagtatagatatgcaagctagaggctcccatatgtaaagtagcagctgtacctggaagccaggcacattcaatatggtgattcctgctcccttttcctgtcaccaggtgtgtgggtgacatggcactggtgaagtgaagccacgtgtgcaaatgtcaggtgacagccaggtagaagatgcatttgcataataaaaggttagggtgggagggccagtttttcaccggctatgtaagtagtatacctggttaaaccaatccccgggccctatgtatacaatcaccgcctcctcaagcctctgtatgaaatcaatcaaatcttgccccaaacccagaaaccctctcttgagcaactgtctttctcaacatgaggaagctttctcactctcttcttttctattaaactttccactcctaaacccactcctcatgtgtgtctgtgtcctgaattcttcttggcatcagacaatgaaccatgggtatttccccagaaaatggagctttttcaatattttcacagagaaagaatcctccacatgtccacttctttctttcacatttggtccaggagagaaaaagaataggttctgcatgaagtcaaagagatagatcacagcaaaacatgtgggggagccatgtttatacctacacatcaattggttaccacagagagagagagaccatgcttctttttctgtttatacaacatccaaaagaggccaaaggggtttaattcaatctcatctcaaactgtggcatcagtaatctgagaccaagaaacttttaaatgcacccacctgagatgacaccctttgtaaagaagaaaattaattatatagcagcatggtatagtgagagaaatttttttgagccagataaaatggaaactgggttttatctcttacttgtgggatgaccttgggcaattaccaaattcctcatctgtatgtgggagttatccttcttgttcatataacagggagaagagagtcatttgatgagttgtacccatcagtgagatgggacacatatagcacctacacaatagtacctacacacactcaatgataattagttcctttcttttttcccatcacccaatgcatttttttgttttaatccaagattttggggctttcttctgaggtaaaaattattattatattttttgagatagagtcttgctctgttgtctaggctggagtgcagtggcgcaatttcgctcactgcaacctccacctcccgggtacaagcaattctcctgcttcagcctcccaggtgctgggattacaggcgcccaccaccatgcccagctaatttttgtatttttagtagagacgggtttcaccatgttgcccaggctggtcttgaactcctgacctcatgatccacccacctggcctcctaaagtgctaggattacaggtgtgagccactgcgcctggttggtaaatttttttcttgtattctgaatataggaattcaatcagagatgttaaaacaaagaaagatggtacctctggcatgtttcaatcttattctattgcatgagtgcctgctagaaataattacaagcattcatgaaatcaaggttggttgggaatattggactcctatatactgtaaatggtatcttgcccctctgcagtcccaaactaatactagaagtaaggtgttttaatatctaaaagaattttccaaattagtgtggcgaagctaataatacattgtgatcatggcacatggtggtttgtgtgaatgacagctgaggggatgtcaacaagcagtattaagcaaatttgatgctggtgaagaacaagattgtaccaacaacaactgtgtcagcttacaagagagtagggcagaagcgcgggtaactgttgaaaaggagaaagaaattgtgcaaactgaaaagtctcagaagcacttaatggcttggtaagttggttagtgctgtcaaatattatcaagaccacccttgtattcaagtaacaagatgcatagactttttttttttttttttaaagtaaaggcaatgacctaagctatccagggaaaaatctgtagctcctgtaacacagcctcctattgaagaattcagtgctgataggacctgtctcatccaaaggtttatcactagaattaccagaagaccgagtagcatgttacctttattctaatctcctgaaaaaatttagaaggctatgcttaagaaaatgttggtatagatgtaataataaatcaatacactcaagtttaggcccatatagattcccaactagtgtcagttccttgcttcttagagtaactgagcaaatatatgatgaaaagcaatgtataaaatctatccaagaacaaatttgtgatgttcaaaaacaatcctttgttatattgacaatataatttaaatatagctttatataataagtttgtcagggtaaagtcagaaaggatgtgaactagaggactgcagaagtttctgttaaggaaaaaaatccaacttcctttagttgatataccaaagataagtgtattcaaaatgcaattcattttttttcagaacagagttgacttctttgggaaactattttcggataaaaagagagcctatatacccgggggaaaaaaacctctcaacttttttagttacatgaagaattacatgaggcacctagcatgttcagtttgtcagtaactaattagtcttttgacaactgacttgcgtccccccatcccccttgccccatatggctctgtttgaaaagaattagagtcatgcatcatttaataacacaaatacattctgagaaatgtgcattaggcaatttcatcattgtgtgaatatcagagtgtacttacacaaacctagatggttaggtagcctactacacacctaggctatatggaatccctgttgctcctaggttacaaactgtgcatgttactgtattgaacactgtaggctattgtaacatcatggtgagtatttgtggtctaaacatagaaaagcacactaaagataccatattattaatataatcttttgggaccatgtcaaatatgtggttcattgttgactaaaacatcattatgtgtcatataactgtatccatttcctagtcattctcttactcatctgcagttttcaattatatgaagaaaacatcttaatatgttacaaatgtgcagaaatagttctttttcccattcttagttatagttttgctttacgtaactcattgggagtcaaaattaaatgttaaactaggagtcagaatgaaagatactagtttcacaatcatctcaactgaacaaaagtttaaatttaaaaaaagaaaaaacatataacaagaatatagtatggttgtcctccagggacccaatcccagcaaagaattgtgtatcctttctaaggaattctgtgaagcagatttgttcgggccagtgacctgaggcattagaatagccctgtctctggaaacctgaattctaatcttgattctttgactaacttgcctgggtttaagatttttaggtaatttatcctctcagcatcagttttcttaccaaaatgaatgcaaagctatcctgatttctaaggtgtcttctggtatgccaaagtattggtatgcttaagattaaggctttatttggatgaaatcagtatttaacttttcccaaatttgtcagtgttctcactggttcacactgagggctttactcttttttccttcatagagatactagatccccttcttttttggccaagtccagcggaattttttcttaactctcttcctaagacttgtttacctcatcctttcccctttcatgatgtttccttcacttcattttccctttgaaatattttagaaccatttttcgcatatttcatccctgtgaatgctactatatctaaagtagtattttattattttatataaaagaaactttcagcagctctatttctgctttactcatttcaactcctcttattggccctgcactagagtgcattcaatgcttaaatgcatttttgattactacagtgtgtataatccagccttttttcattgccttaaaaaaaatccacatgaatctaggaagttattgtatcataaatctttaaaactgtagttttaaaagcacaaaatgaactgaaatagtgttcaacctagaattaaataagcatttgaaggcctcttcttcctcacttaaatttttttccactattcagattgggaaaaaccattatgtaatttagatcaaaatgctgccatcaagcagggtaccagcagtagatcaatactatttcaaactgttaggtaagcatgcatgtagtctggaggatttcacaaacgtgacagctgtgggcatctgaggtcttctagccataagaactcaagaatttttgtttgatgaaaaaatccccaaataaaggactaagttaagttctcattgatcattctacttgtgggccagaagagctgattattaccaaacatagtcattgggaatatcctcatctttctcaagtccttctgtcttcatttccagttacctgttagctttcacagggaaatttcatgatgaggtctagcatagggtggaaagcaggcaattcaaaggccacccagttccgaaaaggacttcagtccaatgttggactgttttcctgagtcatcttttggtattccaaatatgtgatttataaaaaatcttccattcaaatgttattaaaattgaaaatttaaactaccgcgagaaatatagtttccaagttcagtgttattttcacagtatttaatgggtttactatataaaacatcagttacacttcaggcttcataatatttttcaaatttccacttttgatatggttcactgggtcacaggcagctactttcaggatcttttgagaaaaatttccttccaagcaaataattgctgattgttttcaaaaacaatgtgattcacctggagagaaagaagagctggaatgagccacaggctgaatttgataactgcaatatgaagaaatgaaaatcaattaaaaaatggacaggcagttatatttttgatttttaagaattcttctgaactaaattattaacataacacagactttgaaaagtattaaatttgtctctgtctcagactaagtaatcatcctccccaagctataagacttttaagtcctcaggaggcaaaagaaaaatttcttgatgatatggtgagaactatactctttaaagagaaaacattacagatgacatttattggatttgatagagataactacttcattgatggtaaagaaagaatacataccgtaacaaaaagttaattaattttaaagtaggtgtctttgtgagtttggattacaaaattctggaagtgatgtattttattatgagctccttaccataatctctgacaattcataataactgatgtccaaaatccagataggaaaaagtcaacagcattaaagaaagttatattattgcttaatatttagtgaatatctagaaatggtagataaattagatagaccttactaatggcttatatattttttcatctataattttcttaattacgtatgactatgacaaagacaatcttaattacacatgttgtttttaactttaaaaagttatcaaacaggggtgactttcataataatttattttaaagattgctctacaaaagtattgtcacccttgcaggattttggaaatacgatgcttgagtattgtcaagatttgtaaggaagtctcattttatacttctcttgttgtttaagacttacatataatggagacctagtagcaatagcatgaaaactactgaaaaactgaaaaaagaagaaagctgatcccaagctattcatctccaggacatttggtaacatcaaaagggaaacccaagacagaaggagctgtgtaaaatgttccaaagtcataggtacaaacaaggtagggaaaaggctttctaattttgctatcttaactaaattacctcctttaccaaatcagcttaccgcttaagagaaacgctatgcttgaactctttcccaagattcaattctggagatgaagaatgtgttttagttccgttcttattcatattctctctctctcactctctctctctctccttaccacatcccccctttctccttccctccctcctgactttggcacagggagaaggtaagatgtaagttattcatacactgcatgtttatggatttcctaacactatgcaaaataaaattagtggcatatatgtaataattcctaatctttctgaataactcaataataaccattattactaaagagaaaaactgttcagaaagaattgaaatacaacagagaagatctaatgggagaaatgttggagaatcattactcaggccccagttttggctctgagcaggaagaaaaatgttgagaaaagaatagcattgtgttgttaaaaggaacggaggcacctaaaggaagcaaaggtgcttactttggggtagcccaggacaaactgagagtctccaaatacccaaatatttactgtagacagtagattggtggctacctgctggagagattgtagaaaatttaagaaggcaattctgagactattctgccaatcccaagctcctacaccaaggcttatgactccgtattctgttaaaatgtaattggacaaatggagaggactttgagaatgaatacagtagaccaggaatgttctggtaaatggacaactggaccttcagaaaagtatccctgatccagtaacatcttccaatttctgtggtaaaatactcccaatatggccagtttccagctaccaatgtggtatgattaaatgcaaagctgcaagggtgtgcacaagtggctccagcgagctggtgagagttggctccagcagacccttgaagccccggtttctgggtaccacaggggatgggaagagtctcttatggaaagggggcaaatgaggaaccagattcactctaaagtgcaggacttgtaggagacatgctgcttcctgtttgcccatatcctctccttataagcattactgatgaccagtggggaccagttctagccttaagcctgactttcggtgttgttgattgactgaagcaaatgatagcaatgcaactagaaaacttggtgatttctatttaaaataactcatttgaaataaattttgaaaaataaaaaaaaaggacttgtcaactttcgaaagatatccatgcatctctgtgaatgaacttttacataacccatggtcacaaacacacaaaacttctgactgaggaaggtgacaatgagaattttatgcctatttgatcaaaagtcaaatttgtggtaaagaagaggtaccaatcttttgcttaccattctggatgaaagactgatgttgatttatgcagccattttagccctttgtttctgttatacaagggtgcagccttacggctcctttatcagggatgggggctatacaccattctccactttaataagtcttaaccaggtgtaattaaattgttgaagctgtgggggaaatgaataaaaggtcacttcaggcagcaaacacaggcaggggctttgtcaaacatttttgttaacaacattaagaatataggaactatgatctgacattttatattcaagtcctggtattatcatttgaattctgatagtatgggcatattatttaccctgtctaatcttatttttctaactattttaagttggatagcgattgtgtctatctcagagggttggggtaatgactgtcaagtgtttacacacaataagccttcaataaatgttagttacaataataaaaattattcagtgcaattattctgtctgcatatggatgtcatttcagtgttctgaatcccgacaagcctggtgcttaagaattggaatgttcagtctaccacatgattaaggttctaagccacgggtggctacaggggataccagtcatagccctaaatttcttgggtggagattttatgcttccttgtataaaacatcataaaggctttgtccgattgtaggaaaggtggaagtccttctttgctactagcatgggaatcatcaggttgctaccaggttggcatcccccagttcatagaaactgctcttggagaattgccagtgtctaaaataaataccaattcaggtaatgaaaccatgtttttaattctgaacatttttcttcagttgtttacaacctactattgtctacccggtcaatttactctaatctctgggtctgtgggaaatttatcgttttgtactaatataaacatatttgaaaaaaatagcttctggtaaaatctatctaaatgcctttacctaatgaatcatttgtattgtaagtgagtttaactttgattatcaggttagatcaaagtcattgtgttggaccttgccattggaaggtggtccttggaccaacatccgcatcagctgggagctacttagaagtgcggagtctcagcacatcaccgacctactgattcagaatctgcagtgtaacaaactccccaggtgattcactgaacattaacatgtaggaagcatggaagtatggcataatataaggaagttatgtgctataagagaagctagatattaccttgaaaaaatacgtttcaaccgctttaaaggttaataataaggaaactttttaggtaaggtaagggatagagcttgatgattcaatctaagggtcttttctttctgagcctttttggatgaatgttgtagtcactggcttggtattaagcctcattattctgctgaaaatgagttaacttcctccacatttctttactttttattacccaagcaaccacaagaggcagaagctaaaaatgagcaacaaagactaaaagggagctggggctttgtgaagtcgaaggctgcataatttatacttttgcctctcagcatccaattgagaaagactcatggtcatcaagaatagaatttgggttttcagataaaatgctggttactctggcacaaaactccctgctatgatgattcctaaaaaaaaaaaaatgcattatttaatactttcctttctataatgtgaaataattgtggttttgtttttacaatttatgactttatttcctctttgtagtaagtgaaatttatttcttttaatgagttttaacacttcttcacttccctttgactctttctttcctaattaaaaaagagtggccttggcttcaggtttacaattcacagctaaattagcaacagagataccttttcttctagtagtagctctgagttaagaggtagagatgggagcaccaaaaaatataaacagtatcttgaagtcaaagcaaagatgtaagacttaacaagctagattaccattgcaaaataatctctgtaccaaagaacaatctgcaattttgggaactgtttctattcatgaatccattttcctctgagtcctatttgccactcaaaccaataactgttccacaaacacagaactgttaaggaatgtatgttagagagggaagtgtaatcactcagactcacctccagcactgtggaaggagtctctattccctgcttcctggcccgactccctctctaaccattgcgctctgagtttggggagttttcctataggagtttctaccatggatcatgatttggttatttccattactcccttaaaatgcgggaaaatgaggggaaagaagaatggatcagacaataagactgcttccttagaatgattatttagaaatatgttgtctctttagttctttatctatgttatgcattttttacatttttatctttattattattacagcaaacattacagagcagtaagcattaggtattgttctacatgcttcatatgtattacctaactccacctcacaccagttctaaaagtaggcatgattatcactaccatttacccaaaggttaaggatctgcagacgttaacacgcttttgcaaatgatggtgccaggactggattcattctggaccagtgagttgactgccggacccacacctttattcccttagtcactgtctttgtgtttatgatggactctctttttacaaagaaatttagaaaattatttttctgttgggcaaagatgatttctcagttgagcaatgaatgtgtcataccctgcacctatcagctaccatgagatagaaacagtttagcatacctctttgctcccatcgcagtcttccagaatgactgtagtgtttcaatggaaatgcatttacccaaagccacattaataagctaaaaagcaaaatacgaaacagaattacaaaatattttaaagtaaaacaagacattcagacacatttagaaaatacagaaataaaactataataaggttaaaagttaatagcttagcattacttagcactatccagtttattggttgctatctctaacagagacataatgtaatcttgtaatagtacagcttcaatctttaattttggcctgtgatcagccacagagccaacacacagaagcttttaattaacccttcctggaatgctaaataacaaatgagcaaaggtggcaagaaaagtaattattttcttgtctaagtttatctaatgcatatactaaaagtcaatgcacctataagagttatgagctatgtccctgactgaccccttcaagccttttgactgcttaagcactgaatcatagataaattgatccttcaaagaacagcagattccagctgattccctgtcagaatcttcttaatgacccaacaagctacaattcattataggaaagtcacgaaagctaatacagagccaagcataaaggcctttctggcaggcccccaggtttttaatggatttacagggtcaaatatggaggtagcttctttaagtcaccatttaatgcagaaaaatgttgatttcctttccccctttgacatcctggcagggctaacaagatgatgggttaacagtgcaacttagggttttcagatttctcgaacgctgtgcagagccgaatctatatgacatgtcctgggaaagcctcctgagctgggaggagtgaagtctttgttgccagggacactatttgtgtccttcctgttctatgatgcctaacaagagctctaactcagggtgctgcactgatgcagactggatgctcacagaattgccagactcataaaagggggctcagtacattggtcctcaattttacatgcttagcttagtgaacaagaagtaagggacatcttcagggatcagaatatgcggaaaaaattaaaggctacagggaaattgcaaaggttggcaagaaagacttgttccctcatatggatggaagaaaaacagaggtagtgtaaaccaaaaatctggaattcaggtcttccacataacagcggaaaaacagatcttcgttgaatgctgcactgggaaaaacaatttgcccattagcaaagggagaaaacaaggaagtggattgtccctgagaatctgaaactttacaccaggcttcatttggatttgagatgaattttacaccacctgccttggataggaaccatcacagactttcaaggcatagaaacaaacataaaaatagtaccaggttgttaattacttctgaggtgcctggcacaggcagaaacaaagaactatggaaggatggaatctctatcaaaaatcctcagagaaagctctattagcaatttaaatgacaaatatgggaggagacagctcactgttagtaaatgtgggcatcacaaggcacgaaggattcaatgcccccacagtcccacccctgaacttcagagaggaaggtgaatagaagacatgaaggtagaataatctcggggcttaaaggaaggaaagcatgctgcaattgctcttgtactgaagcagagataaatattatgtaagctcctgtatttgtggatcatgcagaaatttctatcttcaaacaaatttggaaaattctggtttccacagagccgaacaggtggttctctccagaacttctcaaaatcttcagggtgttaatgttcagcttgctgtcagaatgttgtcaaatgtttctcaaatgtgcttgaccatggaaccctgagacagcacaagtaacattggtaggacagtgtttgggaaccccctgtttaactatttgtgtctattttgtataatccttccagaaccgaaaagcattggaaggaaagataaaacttttctgtcccttacatgtccctccccatttgacctgaagatttttttttcctttttcttagaaattactgaggaaactatttaatgaggtttttgccatggaaggtacttttacaccaacctaatacttttcttcatatagactcatctctgaagtgttttggaattgttattcttcatttcattattagttgttttcagaatttcctttttatttaaaaataattgatccatgtttttactgtaaaccattttaatctttaaaaaaataggcagtgtatgaattttaaattatccatgttgtattatttcattttccaattaggaagtagacattccgcacaatttatgacagaattgttaaacattaggctatttgcagcggtttaatccagtgtaaaaatacattattggtgagattctttcattagcttcaaattcgtcgtttcaataagaaaatatttcttcttattacaaaaaaccaaaactttcactggattaaatttctgcttgtggaggttgaaaaaagggaaacggagctatagactgtttgccagagtttaatccagtgaaaaatacattattggtgagattattagcttcaaatattgttggtcgataagaaaatgtttgttcttattacaaaacacaaaactttcactggatctaaattcctagtggaggttgaaagaagggaaacgaagcaagtaacaaaaagaagttgtggagtttatttcttggaactttccacgattgtctatctaaaataatgatctacttaatttgttgtaaatacctggagaaaggtcctaattttttaaaaatgttaataacgctccctgctggtttgctcagaagggagcaaactacatcttcactgaaatttgtttaaggaagacaacaaaggaaaaagaaggaatttgttaaaatcactttttaaaatacttggtgcattttgatatagtatagcgaggcatcagcagaaggctgtttcattaggagagctctccagaaatttcataggaactcctcaggttagcgcaacagcggagcccaaaggtagttttctagtgccctctggtggttaagcttattattactctgactgagattctgcgttgctggaatgggaaatattagaatagtgaaattcctttctttttttttttttctgctcagcggttgaaattaaaaattgtaaatttatttacagttatatttgacatgttgttatttgaacagtgtatataaatccaaaatgtctgtaagttaccaggttgagccacttaaagtagctgccattctatttggacccataaaaatgcaattttataatacagtgcgttatctaaaaacaggtcacatatacttatttatcagttgattttgtaaaaaacagaaccatttttttaagactagtttcttgtctttcatagctttccggatttcccgaatactttcaagggggaatattatagtaagtttttgctatcaggagatttccagacagaaagcatggtataatccactctcaagaagaactgaaaaaatttggcctaaagggcgggataactaatggtcacatttttaaagaatttcttggatgaagaaaaaggaagtgaaataaaacaaaaacactggggttagttataagtcaaattaaattagaaataaaagatagaaataagcatgactgtctaagaaccccagctgaaggcttgactaatcatatctaaaccacgtgtcttaccatcctcttcaaatgcagcttcactcctagaaggggtttgaaatggttttccccagcttctcctctttcttgatgttttctcagccttgtactctggctaccttactggcttagcttcttccctttggataccatccttcatgccctggaatgttatctgctatctctgatattttctgttattttaagttcctctttgaaatctttacaaaccccaattaaacttatcacccccttgcttaactctgctcaataacttcccactgctttcagaagaaagaagaagcaaggcaggaaagaaggaaggaaagaaataaaatccttactttgcttacaaggactgtgtgatctggctccttccttcctcttcaccttcatctggtgccattcttccctccttacaccctgacaacattcgtcttctttccagtgcttggatggagaacactcacctgtcttgggctttacgtgacctttaccctctgcctagcactcttctttagagcttggctgactgaacttagtgttttaggcctgagttacaaagtctccttctcagagaggatttctcagccacctaactgaggagtcatcaactgtggcctgttccctaaatgagagctattatattttgtattacacttgacttgcttatttgtttataatctttcttctctacccaaattaagctccacaggaaggaaccaagtctacttcattcatcaccctgtaatccaagtctgaaatactcccaatctacggatactcaatagatatctgttgagttaatcaatgaacatgaccacttggtagcttcctcaagtttacctatatttaattctcagccatgctttgtcccatctttgctcatattggtgtttatttataatgtaattactcattctttccacacatttttgaaagagatttttgttttgtttttatggagtaagattttaaattgccacttgaacttaccacaccactagcctcacaatgggagcccttaagtcaggaaagacattctccaagtaccatttgaaacttttcacttcagtttctttcgcagctccctttgctgggtgaggttgccaacatctagcccttgtcgatgaggtggtctccgtggccatagaacagctccttatactcatccagccagacctcgcaacccgcaccaagttccgctccactgtcttcatccggtctttggggaaggaatatggttgtcatttctgaatatatggcccactcgggagcagggaatgatctcaatttcaccacccacatccacacctggaagaatttgatgataagcatcaattatcaaatgattatccacaatcatcggcacttaacaatgacaagaaaccaccttgtttccccctacctgaagtaatactaacttcaaaaacacttttgcaatagaaaatcaaactcaacaggcttatttaattttgtgattgctgtggatcattttaggattagtaaaatgtaattttttctttcctaactttcaattaagttttttttaatttgtaaataaatcttcacagaatcccattttgtaaaacatgagtcttgttttgattgaatcagggaaagaagtatagatgtccatttgttcacgttcctctacctcatttttgggaagaaccaaaaggcttgtggaacacaactcaaaaccatccttcatgacagcagctccaaaattacacccttttacatacatacagaacacccacccaataggaaagaattactttttggacactctctactactgctgttgccaaggctttctcagaagttaatcatgattgtataatagattgtataaagtgcccaaaggagctgtactataaggcacacctgcctgttggtgacctgctttagaggtattttaatgtacttctgtcatttgtgttctctaaatgatccattacagattgagtctattccttccaacattctagacagatgttccaggagattattttgtagcacgtatgactcccacagcatttactctgagtggcagaaagtcatttccccatatttataagcagaaatggtgttgtgaaatattagggaatgctaataaattttatacagcaattgattcttccaaattcaatctgagatatgaaaaaattaatccagagaccctaaatttctgtgaaatttcctctcagtggcagtcacatacctgattatggtagtaaaatcaaccatttaaaattgattaactcattatcgtaaagaaaagttgggaaacacctggtaatccttgaatgagagctccatattttccccaccccaaacatcaaggccagggtcgtatgttcaagttcaaaaaagtaacttttgtcaatagaaaacaatccaccagccatgacagggcactacaaaaagaaaagtttgttttttaaacttgcatctcatgaaagctcgacttttagagtgttcctctgtacatctgtacgggaggtaggaggcttttcagaatagctacctgatgcaggaagccctgggatggagtcacaaatagggcttaagtgatgcgatccctggatcatggtgcagagctagattaggttcagcaaagatgcatcctggaactagtattatttgtcctttatctgtgacacaaactgtccaggaatgttatttttaacacttattcagggctaagggagtacaggcactattgtaagtattatatatatattccagcccagacttcacaaaaaatcttgttgtgcaattattaagaatctgcaacactggatgtgagggcgatctggctgcaacatctgcagcccattgattgccagggttgattcggctgatctagctggctaggcggctgtctcctcctccctcaccgctccatgtgcgtccctcccgaaagctgcgcgctctgtggaagaggacaccatccctgatagaggagggccggtcttccggtcttctggtcttccggtcttccggtctccgtcaagggtatatgagtagctgcgctctctactagaacctccaagcaagcgctcagaattggcaacacggagaaggtaagaaactttcccaaggacagtagacaccttgggtttgtctgggcagtctgaggggacgctgtgccactcactccactgtactgcctctcagccgttctggaaggaaggccgtgagtgtgagttgtccaggttctgggtattttgaacaaagagttaacaaaacacactaacaaaggaacgaaacacatgaacgaagcggcacaagcagggattcttaaagcgggaaagcgctccacagggtgggagtgggccggagcaaacggttcaagggccggttaccaagttttctgggtttcaagtactcctttcgaggtccctaccagctgcccctttctgaatggaggatttggttggctaatgaaaggctgcggtgaattggcgccctgtgcagtgaagggaaggtccctgcttggccagtccaaggcagagactctccctttccttctgagagtggtggaaggggagggctgtagggagagtagccgttgatcctttgttactcgggtgtgggaaatggggttttccttctggtttagctttaggaagtgggtgttaatcggccttagatccctgcccctagacccaggtgttttccttttgatccaggtttgggaagtcagcaggaatggccttagattccctgcccccagaccttggtgtttttccttgattcagctttaggaagtggcatgaattggccttaagcttcttgcctccagaccctattctcctgcctcacaaccaccacaaactttactgacagcgtgttatatggcaagcacctttcaaagcactttatatgtttctgattcagttcttaaaacaatcgaagtagcagctacttttatgagtctttatgtaaaataaaaaaacagaggctcaagatgataagtaaccttttcaagctcataccacttctcagggtacagttgagattcaaactgtctccagaaccttcactaataatattgatcatggaggtagaaactacattttagtcagcagttagccaagactggaatcacttcctatggtggtcacactcagccagctaaagtagtttctgtggagagcctgctttgtgcttagggtatacagtatctcaagggggagataattcctgtcccacacctctctcccctccgccaccatttatgtcattttctttctgctctccaattttcctactagactatccagaacgcattctcgtcctacattatgttgaatatagtctgaactcaaccactacattggccctcaacatgagagtatgaaagagcagaggttctttaggtgtaggttcagaataagagtgttaaatccaggtaattcgggtttgagtctcaaattcttctttgattagctgcgtattcctgggaaaattacttaatcttttaagtctaaatttccccatctctttaaggtgaattcttccacctccctcctagagtaggaagagagttaggtgcctggcacagagtgctcaataaatggtagaaccttcacttcttgcttggtggaataattctgaaggcatcacacctggcaaggaaggcgggtatgactgatgaggggtaagtttggggaaaacacgcttcggtgcacggtctgggcttggctttctgttgggctggcttacttgtgtctgtttaagtggtcactacaacagggaaagtttaagcccccgcagctcttcctgtggctggcttaatgcttgtgctgcaggcttatattctgaagaagtataggaagcctccacttcagcttcaagtctaagctgtgttcttcaatgcagtttcttggaataaaagcccaaacttgaattcatatccagcttctgaatcaatttttaaatttattcatgaatttggcacttttctcatggagggggtaggattaggctgtaaaagaaaatcctaaccttgctatcattagaatgatatttctattaccattatttacttttaatttgcacttatgttactttaatattacatgtgtttgtatagtatgtatgcagcacattttgctagtttgtgttcttaggttgcaaatcctaggggacaggatagcattagtgaatttttctgtgttcaggctgagtagggtacaaatgaccagtgaagaatgagttttgggaacgaatttctcaagaacatgtgtttgctttggtaatctattggctagaactgtgattcttaatgttctatagaataaaagatacagctgttttgtagaattttttaatgcttttacaaaaagatacatgactgcttctagtcttaaatttcccacacttaccttattgtatcagtttctttaattctgttttttgaatgacatctggaggaattgttctccaaccaaagttcatgggccacacaaagatgcctcttgaaagttatccactgtcatgtaactaatccaggaaatgaaaaacaaagtgttatctggattatatacatctttatatactttatcgatttggcttcacgatgtaatcaaatgaatgaacaagtgcttttgatgagtttagatcaccaccttttaataatagttcaagaatgtttaaagtacaatttgcattagtaactgattggcttatttgtgcttaacttatacttttataaaacaatatgctagccagttttgaagaaaaaaaatacaagagcaacttaaaagcacatatcgcttcccacagaaataagaactaaatttgaggtaaataaatatttggggttcagctaatataaaggggaaaaactaggtcatgagtattaggatttattggtatttagagttaagaattgtagtgaccagatagattattgcatcagcagactctgatcccaagatatcgaccatgttttccatttatttaagtagataaactgtatatgtcttggattttgaaaaaacacacatttaggcatatactcagcactttctgctgcttgtgattaaagatgtgcttgaaagtatctgtggaatgtgtaaatattacctcatatccttatcattgatgacttcgattactggacagccactttctttctacttaaataaactctttccagaagaggttccaaccaaccaacgttaattccacatgagaatctaaaaatgtcaacacatcacctagagggccaaacacacacaaaaacttagaaaatacgatatattgaatgtgtgtacttcatgttcaaaggtattgatgattctccagaaatgtggctataaatgcagtgaccttttttttttttctgaattcgtggtcacataatttcatttcatactgaaatgagagaaactttgctcctaggagtcctgtggtgcaacataatttatgtttggaaaaaattgataagccatttagaatgggcaaaagaatctgaaagaatacttggtattaaatgtagttgctgaagtcccctctgagagagtgtgcccattaacctgggggtgcaggatttgggactttgtttttaagaagcagacagactgagatgacaagttggccttaggaatgatgaagaggaaaaattacttcacacaatagggatgaaagaaattaagtggacaaaccagcgaggctaggaggtaatgaaaagagttataggagacaggagtgggaatgggaggttactgattaatgggtatggagttttatttttgcaaggtaaaaagagttgggagattgcacaccaatgtgaacgtatgtaacactatgggcctgcacacttaaaaatggtaagatggtacatttttatattctatgtattttatacaatttttaaaaagacttagaggggaaaaaaaaaaaggaaaagaaacttggaggccagaaatagtattaagaactcttttattccctgttagttgtgtgaagtaacactctctctctctctctccattgaaacctcagtagatctacattgctccagaggatcttatacaagtgaagtgtgtgtgtgtgtgtgtgtgtgttgtgtgtgtgggtgatgtgatgtgtgtgtgagagagtgtaacaacccaggaaataagctctggtccacatcctatgtgtgatctttcaggcccaaccacaggtaatacaaaggctctactactggggctcatgggggaaacctgctttctcactcagacttggtgcccagccagtgtttgaagtctctaaagggagttgcggtccaggtctcagaccctccactcggctgcagcactgctcttctgcctgtctgcattcctaactcaggtgcctccattcaggccaaaacctctgcaggaccactttattggagatggaatgggtcttgaagacactttgctcgactctgactcctattcagtgctttcccactcctagcctttcgctttcttactctggatcccagggccactaacagaaggagccttttgtgctgggttccttgggcaggcagtgagatgcccctcttgttgctctgttctgctctgatccatcactcagcaacattccagggggaaaaatggaacatagaggagccagtgccttctcctgttcagcctcctgttgatactgttgcagtaagggattaggcttgactactgctttcattttggtttatcattttaattgactactttgatacctggggctcagctcagctcttgacatacctgtaagagcaaccatcatctaagtgcttgttctatccagtctctgttctaaacattcttcatgcatgttttatgtagtctttacaacaaccctgagtatagaactaatttttattcccacttaagagacaaggaaactaaagaacaaagacccaggtaacttttctatggttgcgcagctaacaaacagcaatgtgatattagaaaataagtgctcattccatagattacattctttaaaaaatgctagaaggaggcagagctttgagtatagaaggcttagagaacaagatgaggatagttatctagatgacagatcattatcactgaatctgcaaactacctctcaattaatagaatttagcatcgtattaattacttggttaacaaggcatttttgcatgagggcaaggtattggtgtggagtgttcttgaggattctgtttagtaaaccatctgtgagaagcaaacccgctccatgtagtcttctgttcttggagatagcagttcatctcctgaccaggctggaagggtcctattttcagggcattaatgcttgtttgacaagacagggtattgtcccctgcatggtctgaatgtacgtgtcaatccaaaattcatattttaaacctaactctaagatgacagtattaggaggtggggcctttgtgataagatcatgaggtggagtcttcttaagtaggattagtgctcatatgaaagaggctggagagtgtttgtgagtccttttgcccttccaccatgtaaggtcacagtaacaaggtgccgcctttgaagcagacgtgagctgtcactagacaccgaatctgctagtgccttgatcttggacttcccagcctccaaactgtgatcaataaatatatgctatttataaatgatctagtctaaggcattttgttaagcagcccaaaaggactaagccatctcctaagggtgtcctttggggatggcacctttggacagctgtctcccctgtcatgggaagactcacagagtcatgtaggtgtatgaagcgtggctgctaaagtccacttggctagtggtatacaatgtagtagaaaaagattcctggccggggtggtggctcacgcctataatctcagcactttgggaggctgaggtggtaggatcatgagctgagagatcaaggccatcctggccaacatggtgaaaccccatctctactaaaaatacaaactcaaccgggcgtgtgtgtgtgcctgtagccccagctattcaggaggcctaggcagggaatcacttgaacccaggaggcggaggttgcagtgagcagagatcacggcactgcactcagcctggtgacacagcaagactgtgtctcaaaaaaaaaaaataataatacgatttctactgtggtccattcagacctagagtttaaagagcattctttactacgccacctgtccctatcccatagcagccttatgaagtcaaaggggcctggattatctttctcagtccccagtggcgcaggatgggtccccaaacctgcattcacttcccacctggcccagatccctatgaaaatctcattcatttgctgccaggacctaagggaagcagcatctgctcaaaacatagtctggattttatattgttttattttggggaagaggagaatcctcctgtgcatgcatgctattgcttactttcagacactttgttttaaaataagatcctaggactatgttaggtgagaaaacaggagctctctgcgtagctgactcttggtgggatttctgattggcgtggttattgtctatgacattgtacgcactgttcctgattcagagaggggagaggcacagtgaaataagcatagcttaaagttacatacaacagccttcaatccgagctctgcttttcctagccaggttagatagttacttaacttttttgagctttgccctatgaagatatttctaagagctacctgatatcaaattctttaaaaattgctagtataatttactgtcagaataatcaacccaatcacttaaatttttaaatgacacataataattgtatatatttatggggtacatagtgatatttgataataaagtgtgtagtgatcaaatcagggtaattagcatatcaatcacctcaaacatttatatttatctgtattgggaacattcaaaatcctctctgatagctacttgaaaatatataataactattgttaactatagtgaccctatagtgctacagagcactagatttggaaagggtagagagaggggatatagggagaggcgggttaaagaatataaaattttagtccaaccttgatgctacctgttaggattttctgttttctaaggataggtcccaataatactggattgtttcagatgggtttcatttgtaacttaaaaatctggggggggggtgggtggtaacataaaacgttcaatgtgccaaaaattttgggtccttgttgagcatggacccccacttatatccagttaccagcctggaatattgctgctgtaccagttaatgctagatggttatgtctaggattcttgagggatgttggcttggcgtgccgtttaattttacataatgcctcctaagtaatgctaggaaaaaatttttacctgcagcagatacaagttataaaagtttgcagacagatgtctatgttgctttttaggagaccttggagtttgctaggagttagatgtcacttgtccagttactaaagttagccaagtgattatttagaatgctcatagaaatgtcaggaattttgccaaatccatgtcatgaaggaaatgaaaacctaatatttactttgactctctactgcctgactgtactcctcttggcagggcagtaaatcacttggtctgttccatactaggaagggatatggggatctacttcttccctgatatctcatttactctatctttttaattctgttggcttcataagtgagcaattcttagagatccattgccccggcctacctgtcaattttaaaatcctactgggcctctcaacctcctcattcacagcaagcaactgattggacctaatctttttgcctgattagattcagatgaagaactaacatgccctggaaactgaatgcatagtagacattgctatggtaaggccgatcactgcttggccccttattattttgtagatgattgcagactttcaagagcctcttgcagaacttcagagagcctcataataccctgggaccaaaataggccatcgacttctatttctgcatgtctttggatctctggatctcacccttgcctgttacttccctttctttgagtcctaaagggcaaattttagggaacagtagcatcaaggcctgtcagattcggactcagattcttatctttaaactccttgtttggcgaggcatcctagagaaaattttttctgctgtctttgctgatctctaatttacaggaactcttcaggaggcccttagtctcttcttatctctactcttgagagctgtggcacacccaggggagtttgagaggacccaccacgctgccatctctgctcaatgccagtctctgaattacattctctgctaaaactgatcctgcttgccttgaattccccacaggggacaggtgtacttcccagcattggatgtatccttgggaaggatacatcgagacaaacctttcttctttccaaactctcaggcacccaagctccactatgctgctccaagtgtaggccacagaccctgctgtctacagggtgatagcaatagaaatgagaacaaatattttgaaactttatagcaatttgtcaaatttataaatttattatttattactgtttttatatacatgtagatacatatgcatatatatgtatatatgtgtttgtgtagtgtatatatatatatatatacattttttttttttgagacagaattttgctcttgttgccaggctggagtgcagtggtgtgatcttggctcactgcaacctccgcctcccgggttcaaagattctctgcctcagcctcctgagtagctgggattacaggcacctgccaccactcccactaatttttttgtatttttagtagagacagggttttgccatgttgggcaggctggtctcaactcctgacttcaggtgatctgcctgccttggcctcccaaagtgttgggattacaggatgagccaccacccagccatatatattttgtatgtaataaaaatgggtttgtgttttataatctactttcctttttgggtaattaatattgattataatttacaaaggggtaggtcaataaaaattggaaattaggggaaaaaaattccttttcagatagtttgggaagcatcactctctaggcagtggcaagcaattaagatacacctagctggggtttttcaaactgagagctgtgattcccttagtgaatcaatcactaaatcaatttattgagattggctaggatctaaaactaaataacatagaaaagaaggtattagaatctattccacatgttatttgataaaatgtcactgtagttatatgtgtgattacacatgtactgagttgtgatgaaacatttatttctaccaagccattgtcaaaatggtttgacagttactgagctaatattctcaaggctgttaatgatctgaatttacattcagatttgctaaattcaaataaattacattatggatgttaactgaagcacttgagcaagcagttgcaactgctttaatcaagctcataacaccccttctaagaactccacccatgttgtctaatagtttggactgtgttggaggccgttactagcatactcttgctccgtgcaggcagagagaaaatttttaaataagtaacccatatttggttctgtatttactttctgtgcatgaatatctcattttcatctcaaatttatatggacaaaatcaaaaccaactgcaattccaaacctgctcctccagttttgagcctaccacccaccaagttgttcaataccagtcctagggtttgtttctgattggtgtcattcttactctcttcacatcttatcgacggcaagtcctatacgttccatgtgcacaatctatgatgaagctgaccatttctccctttaccctggcacctccctggtacttggacaactatagtagcctcctaactggcctcccacttcctttttcatcttcctaatatccattctctacacagtggccagaatgagctttgaaatgtacatcagacagtttcgttcctatttaatattcttcattggcttcaccttatactagaataatgcctacaatctttaagtgatgcacaaaactttagaaaaatttgcttttttcttctccccaaatgaatcttttatgactctccccatggtcagcacccatgagtcaaaatgacttatttctttaccttgaatatgccaagctcatttcttcattaggacatttgtacttctgttccatttgcttgggaatattcttcacccagacctcagctcaaaaattacctatttaactagttcttgagtatcctatttttacatcatttatagataattactttccaaaggaaataagcatggaatgccattaaatttttctgaatgcagtctctcatcaagaatcttaactgcactgcaatgccaattttggtgtgatgtatttgttgcttacttaaaatttcctctacaagagaagacatttgttagcaaaccaatgaaatgagaagagcttcaaatatggggtccagtatgagaaaattaaactcaggtaagcagaaaacttcccatcagaacatgcttgaatttaactggtggagacctgtaaaagcagggcttacagggccagagtggtggctaaatgtctagagcctcaaggtgtagttgataagaggacggactctggggtcagggcattcaggtgccagcttggatttaccactggctagatgggggagcttgcataaggcacagcctcactgtgcctcatattctcatatgtagaatgaggatgtgattgtactcatctcatagagttattgtgaggttcaatcagttaatacacaaagtattcagaatggcacctagcatataaatcagctagtatacagggcacagatccttccatagaaatgtatgaacatgaacccaaatgtttgatgttgttttagaatactcataaaatagattcacttctcattcactcaccaacacctgcacactaaaaggggagaggaaaagaaggcatatggcctttggggaaggcagaaagaaccataggaaaatagacatgggtcagagaagagaggggtgaggattatagaattaaaacattacgaaatttgaaatattgatgggtcaggtcaaaagggcacaggcttgaagaagctcctagtggtcaatttgggacaatttgaacaccaacaagaataatggtgatataatacacatttaatttctagccataaatccatatcgatgaggggatgagagggaggggagagggagattgaggggaagggaggaagagttagaaagcaggagagggagagatagagattttctccttacacatgaagccagctaaataaaaaagaatgaattatagaaaagcaaattttcagtcctcagtgtaatattgatttaagcaaggatgatcaatggatactaaaaaccattgggtaaaacattgtaagaaaacagaatattttcatggatcaatgtgtcattccacaaattacttcttaatcccaaataaaggtttagctgtcaacatcttaactaacaaagttagtatcaacaatactggtgatatatgttatattatatgcctcttgatgagatgtataccatttctatcacctatgtagtagattctatataatattttcactccaaaaacatttatcctgcaggtaacaagaggaaatcaaaatttcagaacatggtcactggtaccaaacaaatggcatgaacttaaaatacacacaccacacacacacacacacacacacacacacacacactggtatttaaacaaagtgtgtgagagttgacttttcagactaagaagaccaaagtatcaaatgcagagtatgaaacttaattattcccgaatttaaaaaaacattttgaggcctgtaatcccagcactttgggaggccgagggggcggatcacgagttcaggagtcgagaccatcctggctaacacagtgaaaccccgtcttattaaaaatacaaaaaattagccgggcatggtggtgggtgcctgtaatcccagctactgggaggctgaggcaggagaacggtgtgaacgagggaggcggaggttgtggtgagctgagtggcaccagtgcactccagcctgggtgacagagcgagactctgtctcaaaaaaacaaaacaaaaacaaaaacattttgggaacaatgagaaaacttgaaaagagcatatagtaggtatatatttagttatgaaagctgtgcttatttaagagaatgcttctgttcttcagagctgccactgaagtacttaggggtgcagtatgatgatgtctgtaacttctttttcaaaggttcagaaaaaagtatatacaataggtgtctatgtgtgtttatgataaagcacatattataaaaatgtttaaaattgatggaactaagtgatgcatatataggcatcattgtgctggtctttcaatttgctgtatgtttgagaaacattttaaattaaaataaaaatgtaacaaacaaaaaaagagtaacttcttacctgttgcattctgtgctcctgccagcctggcccttattaagccattctctctttgaggcgaagaatccgaacttttggaaactgggacatgtatttatccaaatatcttttagatagtctacatcagagtaaagataaaccaggaaatacttgaattaagtaatccggatagtatcagaagtgctccccaaagtcaaatgccaaaaactatgacattaccatatcactgaattttattccttgggtcataattttattttctgatgtcattttcttggaagattctatctggtttcagtattcaaagctgtctgatttttcaaaccccaaatgtttgtttcagtgttgtaaggtgatgtagtggagggcacacctttctgagtatttgtcaaggtggggcagatttgccttaaaatatatgtagctcaggcttctgcacaattctgcctctactctcaccccacctcttgcaaaagccccttccatgacccaaggaagaggctaaacaatgtgtgcaataagaccctttcattctctactctgacatccccttccattacaccttttctctcttatagatggccatggagggatccagctaaaggaacagttttccgggggctttatgagctatgttatgtgacttacagtcatttctgtgtgtaatcaagctattgacagctatcctaggttgaatggcttccagaaaactttctaagaaagtttttcttagacaggaccctgaaaactgaaaagcttcaggtcccacagaatctggacctgcccctcataaagggactcctatctacttataattgggtactattcctgtttatgcttccaaggccacattttatgtttttcagccagttttctctatcatcccacagcttcttgagctcagtgtgattatggcagaaactctgaagcaaagaaacttcccatgttgctgtggtcacagctcaagggtaagctgttccattagcattccaagtctttgctattttctaaacttttctgaaaaatgggttccatttgggaatttgtatgtggctgtcagaccacctacatacacaggttatttgacaacccaaagagtgagattctcactgtaataagcaaaaatgaacataaaggctatggtggattctggttttgaactttgtggaatcacctcatctctcttgtcctattggcaatttgtcttcttaacacttaactgaaccatcatatgccttgctctcaaggaagaagccataagatcttaatttctttgccttccatgagtctaactgtaactctagttattaccagtaggcaaggcctcccgttaattgtgattcattaaaagggatttgtgcaattgtagaggacatctaaactccactacttctaagtgccctctccaaggagccatagttagatcattccaacatggtagcagagttacaactgagacaataactgaacagagctccagatgacttttaacgtccatagatgcttagacttatgtctctaggctccacgtaaaacaaagcatttgtacgatgtttatgcttcatcaaattatcctatattttgccatccaaactgctactaaactttgcttctgccaaactttgaaatttcaagagaagcctgagtggttttcttacctttggtgctgaagtcatctaccagcagaatctccttgagaggtgtggaggagagcgattgatgacactgtgaacagatctcaggagagtggaccacattcatccacaaagcacatgatgacactggtggttgggaggttattgtgaactagctgcttgcacatctgggccagaatataagcagagcacaagagatgtgctaaggagatccacaagtagttttaaaagtcacagagtgcgatggtgtgcatatacacacacacttaatctgtcatgatctgtctggtctatctatcatctatttatatataccaatgatgattttattatttatatgtgcctttttttggggaggggtacatgcaaaataaaaaagcagaagaattacccgtaccgtggttgttataaaaggactagaaatgcaagacatgagaatgtcccatgcagacatccactgcagtggaaaggacagggtttacaggtagttagactctatttcaaatctcatggcaatatttctcaggtctttaaccattaatgccttctttaacttctctgtgcctcagtttctcatctgcagaatgaggtaataaatggttcttattcaatagagttttgtagcctagtgaaatgtacatacaaagcctagcagggttcctggcacaggaatttatgaaatggtagttatgctatcattactagattatatgctagaagatagcattctgacttatttaatgttcccaatggtttatgattgcctttccaactggctgtctgccaactgccatgggatttattctttttcccattctgcttgtgtatgtacttatggcataatatatatgtgccaaataattaaacttttttagcttccgtatccggggcttccttgctgatactctgctacagaatagccacagtgaaaaaccattttgctggcataggaatgcaatccaggctacagtgggagttagtattcagtgggttgcaactggcctgggttttttcccatgccctgcagaatacactgcctcactgcggcattctttcaccccctgcctgtgccactcttcataagcagtgcccagtggaacctcaaaaatgtatttgccatcttactaacacagctactgtcagtaatgtgataattaatgatgtcataaatattataagcattctatattatttcaatgtcgacctcaaattaccagcatcttttccctttttattggtgaataatcaaaatcatggaaagactagtccatgattctgcagtagtaaatggcagagctgggactcgaacactgatccagtctggctccaaaagtaaccatgaggaagccttagatccacaagaatagaagcagctggcagtagatgcgacattttgtgaagctggcacttctgccaaataacatggttatactttacttattccataaataagaaatagtaagagcaaaaacgatagtaaagcaaatcacatttgcatgacactctagtgttgccaagtgctattctgtacataattgaattcagtcttcataacaactgcttgagatacatattatatacacttcttcaaatcttgggaagttaaatgacttacccacatcatccacctagatagatatataaggaaatatgaacaaataatgtttttactttactgctggttttttttgtagatgggctttggaaatagatatgtgctcaaatatcagtttttctaattactgatttggaaagctttactacttctttgaacctcaatttgccaactacaaagctgaaattaaacatgtactataagattacatataaacattatgtaaaactcatctaatatatatctgacacataggggtacttaagaaatggtagacaaatccagctgtgcttcataatttcaatggtttcctagtggttgtttatcataataattgacaaagccttagaaaaacataaatatccaatcctcagcccagaaaatcaatttacaaggtttgctgagggcccaagaatccatgtcttaaaatacaacaaataaaagaaaacacaaagaaaccaacccaccaacaaacaaaagaatgactcacaatcattgattggtgagtttaagaacttgagctcaagataaagttaatttattcttattattgaggctaatattaaaaaaaataaattgacagctgataggagcatgtcctaaatgttcagtgacagagaattaaaataacacattttgattcactatcttcatgtagtgatcaggtattaatgctaacttaaaatatcagactgtctaaactaatattagtctacactaaggatccagcattagcacttctgaataatatgagaagatattcctctcttcacttaagagctttatcgtttactttggccaccataacaaattactgaaaattctgcttaacagttccttcctgaagtatctattttctctcacatttgtactctgaacagaaagaagatatcagtatgcaccttaacattttgcttggtactctcctcagctaaatatccgatttcatcattggcaagttctgtaattttcacatgactataggacacagttaagccaagctcactgccactatgtaacacgatcattttcttccatttctcaatcatgtgctctatatttccttctaagcctgcaccagagtacttacaatgctcatatttttgccaacattctgctcaagatagcatacatattttcaagatgattgatagaagctttctttctttctttctttttttctgaaatagagtcttgctcgtcacccaggcgggaatgccatggcgcaatttgataggagctttctctactgtgccgctacttccttctgagccctcaccaacagcatccttgatattcatattgctaccaacagtgattcagggcattctaggctttttctatgatgcttcacagaattcttccggcctctacctatagcgaattccttggtgtattaggccatttttgtgttgctacaaagaaatccacctggcgggcacctgtaatcccagcactctgggaggccggggtgggtggatcacttgaggtcagggttcaagaccagcctggccaacatggtgaaatccagtctgtactgaaaatacaaaaattgctgggcatcgttgcgggtgcctgtaatcccagctacttgggaggctgaggcagggagatcgcttgaaccctggaggtggaggttgtagtgtgcagtgagctgagatcgcactgctgtctccagcctgggtgacagagtgagacttcatctaaaagaaagaaagaaagaaagaaatactgagactagctaatttgtaaagaaaagaggtttaattggctcacggttctgcaggctgacaggaagcatggctctgccatctgctcagctcttggtgaggcctcagggagcttttaccatggcagaagacgaagtgggagcaggcatgttacatgacagagcaagcaagagacagtaggtgaggtctctgacacttttaaccaaccaaatcttatatgaactgagggagaacacaatatcaccaaggggatggcactaagtcatccattatagatctgcctccgtgatccagtactcccaccaagtctcacctccaacattggaggtcacatttcaacatgagatttgaagggacaaacatccaaaccatatcacttggctattccttggatgatacttctgtatttttgggacttgttatagcagcacctcactccttgataccaaaatttatattagtttcttctgactccatgacaaattaccacaaacttggtaacatattctgtcacatttctggggtccagaatctaaaaccaagatgtcagtaggacctcagtccctccatatgttgtaggggacattctgtccttgcctctttcagcttctgctggcagtctttgacttgttgaatcactcaaatctctcctctgtcttcacatcactttctcctctgtgtctctctgggtgaaacctctgcctggctccttttataaggatacatgtgatttagggcatttggggcttatctgggtaattcagggtaatgtctcctctcaagatccttcatcacatctcttgcttcagaaggtaatattcactgttttccaggtgaggtaataatcacaggttctgagaattaggaagtaaatatatttttggagaccatgtcttttagcctgacacaagggcttaatgagttaaggcaagaaataggctgggtaggtagctcatgcctgtaatgccagtgctttgggaggccaaggtgggtggatcatctgagtcaggagttcgagaccagcctgacgaacatggagaaaccccatctctactaaaaaataaaaaaattgaggtctgttccaagatggccaaataggaacagctccgatctgcagctcccgcgtgattgacacagaagacgggttatttctgcatttccaactgaggtacctggttcattcattgagagtggttggacagtgggtgcagcccacagagggtgagccaaagcaggttgggcatcacctcacccaggaagcgcaaaaggtctggggatttccctttcttagccaagggagctgtgacagattgcacctgaaaaaatgggacacttctgcccaaatactgtgcttttccacagtctcagcaactggcagacccagagattctttcctgtgcctggcttggcaggtccccacccatggaaccttgctcactgctagcacagcagtctgagatcaaactgggaggcggcgcctggctcggggagggacgtccaccattgctgaggcttgagtaggtaaacaaagcagccaaactgggtggagcccaccgcagctcagcaaggcctactgcctctgtagactccaccttgtgagtagggcatagctgaacaaaaggcagcagacaacttctgcagatttaaatgtcctgtctgaccgctctgaaaagagcagtggttctcccagcacggcgtttgagctctgagaaggacagactgcctcctcaagtgggtccctgacccctgtgtagcctaactgggagacacccccagtaggggctgacagacacctcatataggcgggtgcccctctgggacgaagcttcagcagaggaaggatcaggcagcaatatttgctgttctgcagcctccactggtgatacccagtaaacagggtctggagtggacctccagcaaactccaacagatctgcagctgagggtccgactgttagaaggaaaactaacaaacagaaaggaatagcatcaacatcaacaaaaaggaatctacatcaaaaccccatctgtaggtcaccagcatcaaagaccaaaggtagataaaacacaaagatggggagaaaccagggcagaaaagctgaaaatcctaaaaaccagagcacctctctcctccaaaggattgcagctcctagccagcgatggaacaaagctggatggagaatgatttgacaaattgatagaagtaggcttcagaaggtcggtaataacaaacttctctgagctaaggagcatgtttaaacccatcaaaaggaagctaaaaaccttgaaaaaacactagacgatggctaactagaataaacagtgtagagaagacctgaaatggcctgatggagctgaaaacatggcaagagaacttcgtgatgcatgcacaagcttcaatagccgatttaatcaagtggagaaagggtatcagtgattgaagatcaaattaatgaaatggggtgagaagacaagtttagggaaaaagaggaaaaagaaatgaacaaagcctccaagaaatatgggactatgtgaaaagccaaatctatgtttgattagtgtacctgaaagtgatggggagaatggaaccaagttggaaacacacttcaggatattatccaggagaatgtccccaacctagccaacattcaaattcagaaatacagagaacaccacaaagatactccatgagaagagcaactccaagacacataatttcagattcaccaaagttgaaatgaagggaaaaatgttaaggacagccagatagaaaggtggcttacccacaaagggaagccgatcagactaatggtggatctctcggcagaaactctcaagccagacgagagtgagggccaaaattcaacattcttaaagaaaagaactttcaaccagaatttcatatccagccaaactaagcttcatgagtgaaggaaaaataaaatcctttatgacaagcaaatgctgagagattttgtcaccaccaggcctgccttacaagagctcctgaagaagcactaaacatggaaagaaacaactggtaccagccactgcaaaaacagaccaaatttaaagaccatcgatgctatgaagaaactgcatcaattaatgggcaaactaaccagctaaatcataatgaaaggatcaaattcaaacataacaatatcaatcttaaatgtaaatgggctaatgccctaattaaaagacacagtctggcaaattggataaacagtcaagacgcatcagttgctgtattcaggagacccatctcatgtgcagagacacacataggctcaaaataaagggtggaggaggatctaccaggcaaatggaaagcaaaaaaagaacaggggttgcaatcttagctctgataaaacagacttcaaaccaacaaagatcaaaagagacaaagaaggccattacaaatggtaaagggatcagttgaacaagaagagctaactatcctaaatatatatgcacccatacaggagcacccagattcataaagcaaatccttagagatctacaaagagacttagactccacacaataataatgggagactttaatgccccactgtcaatattagacagatcaatgaacagaaggttaacagggatatccaggacttgaactcagctctgcaccaagcagacctaaagacatctacagaactctccaccccaaatcaacaatatatattcttcttagcaccacatgcacttattctaaaattgatcacataattggaagtaaagcattcctcagcaaatgtaaataacagaaatcacaacaaactgtctctcagaacacagtgcaatcaaattagaactcaggttaagaaatttactcaaaactgcacaactacatggagactgaacaacctgctcctgaataccactgagtaaataacgaaatgaaggcagaaataaagatgttctttgaaaccaacgagacaaagacacaacataccagaatctctgggacacatttaaagcagtgtgtagagggaaattatagcactaaatgcccacaaaagaaagcaggaaagatctaaaattgacaccctaacacacaaattaaaagaactagacaagcaagagcttacacattcaaaagctagcagaaggcagaaataactaagatcagagcagaactgaaggagatagagacacaaaaaacccttcaaaaatcagtgaatccaggagctagttttttgaaaagatcaacaaaattgatagaccgctaacagactaataagaaaagagagaagaatcaaatagatgcaataaaaaatgataaaggggattcatcactgatcccacagaaatacaaactaccatcagagaatactataaacacctctatcaaataaactagaaaatctagaagaaatggataaattcctggacacatataccctcccagactaaaccaggaagaagttaaatccctgaatagaccaataacaggctctgaaattgagcaataattaataacctaccagtcaaaaaaagtccaggaccagatggattcacagccgaatctaccagaggtacaaagagaagctggtaccattccttctgaaactattccaatcaataaaaaagcaggaatcctccctaactcattttatgaggccagcatcatcctgataccaaaactggcagaaacacaacaacaaaaaaagagaattttagaccaatatccctgatgaacatcatgtgaaaatcctcaataaaatactggcaaattgaatccagaggcacatcaaaaagctttccaccatgatcaagttggtttcatccctgggatgaaaggctagttcaacatacacaaacaataaatgtaatccgtcacataaacagaaccaatgacaaaaaccacatgattatctgatagatgcagaaaaggcctttgacaaaattcaacagcccttcatgctaaaaactctcaataactaggctttgatggaacatatctcaaaataataagagctatttatgacaaacccacacttaatatcatactgaatgggcaaaaactggaatcattccctttgaaaactggcacaagcaagttgcccctctcaccactcctattcaacatagtgttgaaatggccagggcaatctgcaagagaaagaaataaagggtattcaattaggaaaagaagaagtcaaattgtccctgttgcagatgacatgattgtatatttaaaaaactccattgtttcagcccaaaatctccttaactgaccagcaaattcagcaaagtctcaggatacaaaatcaatgtgcagaaatcacaagcttcctatacacgaatagcagacaaacagaaagccaaatcattagtgaactccgattcacattgccacaatgagaataaaatacctaggaatccaacttacaagggatgtggaggacctttcaaggagaaatacaaaccactgctcaatgaaataggacacaaacaaatcgaagaatatccatgctcatggataggaagaatcaatatagtgaaaatggccatactgcccatagtaattatagattcagtgccatccctatcaagctaccaatgactttcttcacagaattggaaaaactcctttaaagttcatatggaaccaaaaaaagagcctgcattgccaagacaatcccagcgaaaagaacaaagctggcggcatcacgctacctgacttcaaactatactacaaggcccagtaaccaaaacagcatggtactggtaccaaaacagatatatggacgaatggaacagacagaggcctcagaaataacaccacacatctacaaccatctgatcttcgacaaacctgacaaaacaagaaatggagaaaggaccctatttaataaatggtgctgggaaaactggctagcatatgtagaaagctgaaactggatcccttccttacactttatacaaaaattaattcaagtggattaaagacttaaacgttagacctaaaaccgtaaaaaccctagaagtaaatctaggaataccattcaggacataggcatgggcaaggacttaatgactaaaacaccaaaagcaatgcaacaaaagccaaaacagacaaatgggatctaattaaactaaagagcttctgcatggcaaagaaactaccatcagagtgaacaggcagcctacagaatgggagaaaatttttgcaattacccatctgacaaagggctaatatccagaatctacaaagaactcaaacaaatgtacaaaaaaaaaacaaacaaccccatcaaaaagtgggcaaagaatatcaacagacgcttctcaaagaagacatttatgcagccaacagacacatgaagaaatactcatcatcactggtcatcaagaaatgcaaatcaaaaccacaagagataccatctcacaccagttagaatggtgatcataaaaagtcaggaaacaacagatgctggagaggatgtggagaaataggaaggcttttacatgttggtgggactgtaaactagttcaaccattgtggaagacagtctggcgattcctcaggatctagaactagaaataccattcccatagaaataccagtgatcccattactgggtataacccaaaggattataaatcctgctactataaagacacatgtacacgtttgtttattgcgcactattaatgattgtaaagacttggaaccaacctaaatgtccatcaatgatagaatggttaagaaaacatggcacatatacaccatggaatactatgcagccctaaatgatgagttctgtcctttgtaggtacatggatgaagctgaaaaccatcattctcagcaaactatcacaagacagaaaaccaaacaccacatgttttcactcataggtgggaattgaacaatgagaacattggacacaaggtggggaacatcacacactggggccttttagggggtggggggctggagagggatagcattaggagaaatacctaatgtaaatgacgagttgatgggtgcagcaaaccacatggcacatgtatacctatgtatcaaacctgcacattgggcaggtttaaagtatattttaacatttattaaagtataataaaaaaaatacaaaaaattaccctggcatggtggcggtacttgtaatcccagctacctggaaggctgaggtaggagaattgcttgaaccccagaggggaggttgcggtgagctgagattgtgccattgcactccagcctgggcaacaagagcaaaatctgtctcaaaaaaaaaaaaaaaaaaaaaaaaaaaagcaagaaatatgctgttttcaataaaaaatttaaaatggcttccctatccctcaacaaaatgtaggtttattttgaatttaagaattgttagtcatgctgtttttttttccctaaatttgaagcttcttttaagtttgagaatttgcacattgaagtccacgaaagtgttaattggtgataccaaattatgaactatcaattgaaactctattttagaaaataaagataattagaaaaaaagaagaaagaatataaatgagggatttccaagaagtactaaaaaattggtctatttggttgcataattaccaacaatccaacaattagaggacaattttggaactggacaaactttagactctgaaatgtttttcaaaggcaaaaaagggaacatctccaaaataagattctaattctcagaatctcttgtgatgccattaaagaccagagtgatgagactaaagtttcccaacgagagaattggtggggctaggcacaatgaactgcaaagtaaaaggtaaatgaacaatgagacaccatctcataccagttgaatggcagttattaaaaagtaaaaaaacaacagatgctgtcaaggctgtggagaaaaggaatgcttatacacttccatactgtcggtaggaatgtagttcctaccaattagtttagcactgtagaaggcagtttggaggtatctcaaagaacttaacacagaactaccatttgagcagcaatccaattactaggtatatatccaaatgaaaataagtcattctaccaaaacaattagcactattcacaatagcaaagacatgtaatcaacctaggtgcccctcaatggtggattgataaagaaaatgtgatacatatatatcatggaatcctatgaagccataaaaaataacaaatcatttccttagcagcaacatgaatgcagctggaggacattatccttagcaaattaaacaggaccagaaaaccaaatatcacgtgttctcacttataggtgggagctaagcattggtactcatagacataaagatggcaatgatagacactggggactactagagagggtaaggaggaggggtaacagttgaaaaactaactgttgagtactatgctcagtacctgggtgacagatcatttgtgtcctaaacctcagcagcatgcaatataccctgtaacaaacctgtacatgacttcctgaatctaaaatgttgaaattatttaaaaaaggagtaaaaggtaaatgagggaaggatagtattttgtggacaattttgggagaaaacctagaaaagaaagaaataggagggagataggtgggataccaggaaaatttgtcatccctgttctcccttcctctgttgagtagcatggacagaatcatatttatgagcatcagagtaggtacagatagagctgagagttgaaaaaaaatcagtaattgataggattatcaatgaagcaaggtctctttatattaacccacctacaatggcagttgatgcaattaacaagtctagtttcctttggccactctctattttttattttttgtcccatgagacactacaccctcctagttttcacccatcattcactggctttcaccttcagtttccttcttagctttcctttcctcttaagaaacacaagattctcagagcgggtctggggctttgttttcttctatgtgtgatatgattgtatgagcccatcatgctcaagttttaagtgtgataatatcttcatagtttatatacaggtcagatttcccatctgaatgcagacttaacttatatccaaacaatttctgaacatcttctctgcatgtctcacaggcactcactcataatgtgtctgaaacagaaaccttgacttcaccccactcaacccaaccagccctctgcatttccctcataatggcatcgccacccaccttgctgcagaaatatggattctatctagacttcaccctcttcctgaccataaatacaatcaatccatcaacttctattctggtgttgccaacagatatctcagctataacatctttatacctccacagttgcctcccctactcttgagcatccactctctttctccaggattattgctggagtctcctaaagggacactcttccacagtttgtcagatcaacaccactcttctgtttaaaatcctcagtcaatttctagggacaaagtgaaaaggaaaaaaatccaaattctttagtgtataggacccctgctcaacttccaactgcctgtcattccactctcccctcacacactccaccttggccttctttcagtccctgaagaacactccagcttttgttatttgcttaacttctagcatttttgctacccttccatgtcttcgcagctggctgcttctattcctttagttcctatcttaaatattcccttctagagatgccgtctctgacaacgctttcacattttttttttttttgagacagagtctggctggagtggagtggcgtgatcactgctcactgcaggctccgcctcccgggttcacgccatctcctacttcagcctcctgagtagctgggactacaggcacctgccaccacgcctggctatttttgtgtatttttagtagagacggggtttcaccatattagccaggatggtctcgattcctgaccttgtgatccacccgcctcagcctcccaaagtgctgggtttacaggcgtgagcactgcacctggcctaccctctcaaaattaactattcttttattattctctattattgttttctgtcacagcattcatctatcaatcttatttccttatcttctgcatccaaaatttttgagggtaggacaaatctgccttgcttactacagtaccacaagcttccagcacagttaccaataaatatttgataaatatgtattgaatgcatgaatgaatggatggagatgagatggacttaaagcttaaatagtggaagaaatatttccctttgagatagaaagtacaaaaaggtgtaacgtatacaaatatatttatgcacatgggatgagaagttgaaaatattcatagctctactggaggaagggttatctgttaatgtaataggctaggggcttgaggagaatggagaaattttggacagatactatgggcaatgggagagaatgctggccagctagctaggatttcaaggggcagtgagcactttcctgaaactggagatgccaaaattttatgaaatttcaatattgatttgctccaccagtgcctgccagcctgcgtgtaagaagagataaagcaaattgctgattaatatgagtctaagggatatcagagcacatgaggtagaaagagaatgggtagtgagtttgaggggactggtgtaaggtggttgaatgttccggcatgggctctgggtcagggaaaaggaagtaaagctaaggggagtttaatagcctgagtgaaagggagggtacagaagaaaaagctacagcctatgacttcctcatctctaactttataatataaattaatgagaaattcaatttcacagttacattttttttaatggtatttggtgctgaaaaaaaaatcaaatcagtttgaaaagaaaggatcaattacacaaattcggcataaaccaacaagcccggctgtgaagtctgagagttgctttatggttaaaatttggttggtctgagaaacatccagtgacaaaaggattgtatcaggaggagttaactaagcaggctcatgcaaatgactcttcctatattttaattagtagagtttttgtcctttttagaaggaagttctaaaaagtgctagacagtctaaaatggaggtaagaaaaattctcagaaatttgagagatttggggaagacacctctaatcaccaatatctaatcctctattcccccgattatgtcatggtgccttaatttcactattagtacctacatgggcagatcatgagagattccactagatgctaatatcccagcaaataagtagtcctctgccaattgttgacaaatatatatcttagatgtgtttaaagaattacaatgaagaattctgtggaagattatatggtacagatcatattagtgcctggtaaaagcaatattacagatgggaaagagggacccaaaagagatgcctgagatttccaatacaaagtttcagggtggccttgatttggggtgactgacatgtcaaggcactctgacatttacagagacctgttctctgcattactaaacagattaaacatgtttccgggtatctagcaaaactagtgtgcttgtttgttcaaaggaacagtgggaaacccccgcaaagctttcagcattttaaactcttactcagtctttcatactggaagaaaggttacttgctaatgtaatagggtaggggcttgaggagatggagaatattctgggcagacactatgtcatctagttggcataggttgtaaaaaccattcaagttatcctacaccaacctaattcaagcaagtttcctttatttcagtttttccttatttctgcctatatcatgggaggagaaattgctgctaaagtctaatttgaatgccagatattctaggtttgtaacttttttgaggctaagaaatcacatttatattctatatgcctattattatacaaattaggtatttagagtctactggtcccatgctatacttaaaaaattaatcaatctctttgtcttgggggggaatctaggcttagattactgcagccaatccaagttctaaaacaaatggggcctctaatgtggggagtttcactatcctgcacttagctgacatactatgtggtggacagaaagactctggacttgagaaagatgacaagagactaagtttttagttattctagcatttattggccctatggccatgggcaagtcagttaggcccctagaaccttatttcctcacttttaggatgaagattacaatgccttcatcacagaacagtggtgaagattgatgagataatggatgtaaaaatattttgtgagcttcatgctgaaaaactcatgtgagacctacgattacccataatgcaaatacacacattttgagggagcacactgcctttttctgagcagtcctttaatctgaatctatcaagtgctcaaccatttatcgagagacccagaaaggatgcgtcccaccctcctggcttctgtgtgctgaatgctgagccactaacctgatttgatgtagcctatcaaatagagaaggttttaaatcataagattgagggaatgataacattcttcatttctatgaatttttcattttattccgagacagtcaagatgtactatgtgggtcaatctcagccttcacaggtttgaacagaaggtcaaggagaatattttcttaacttctatttcaattcaactactgccttcatgtgagccttcaggggccttcactccccaagcactgatgctcaggaacatcaggaggagaattgagcacacagctgaagagctctgcctgggattttatcttttctcccagaccttagaattgttggggctgctttccctctcactgataagaaggtcagtgatataaaaactgtattttcatgttttgttctttctagggtagactatccatgacttcagtcaaaatcacctggctactgattcagaaaatttaagtcacactcatcacttctatccaaagttcttagccagctgcggctgtggttgccatggtaaatgtaaagtcatcaaaggacaggactcaggcttagaaatataagccaccagcataaacattcaccacttcaacaatgtctgttttgagcaggaagctgtcacagtgaaattgggacggcagggagaagaggaggagtggtgtgatgtggcagaaatagtactaggtggggatgttctgtctttcctgctgtgtagaccttgggcaagtcatttttctcctggaacattgtctgtaacataaaggactagattaaaaactttcaaatcttcacctagtattaacattctgtggttttctatgcaactttagcattacctgtaagtgctttcctttgggtcataagtcccctgagaaaaggcaaattaaattgtatttctatggtcttaaatcatttaacggtttcccactggcccttggaagaacctgaagtcctgagtgatctggactctacttacttctgtggcctcatttacgtcctcattgctctctgcaacccatgtcagatttccctcgatttctcaatggatcatcctttttactgctttctcatttctctgactctctactctttcaggttgcagctcaaacatttttgttctctcccagacaggtttagctttttatctcctttttcccaacagtcccctgtgtttcggcatcacatttgctgtatacgccttgaagtcaatgaccatgctctgatgccatactttgcagtagcagccagagagatttgttcactgcagggctgtggttatggccaagttttaaagaatcacctttcttagtgctatataggaaatgctttcctataatttttttctctgatgaggtacatgtcagcaaacttaattcccatcatgcatctcttacccatgtataaggaagagaggtgttttaattctgccaatgtcatatgactataaggaaacaaaggaaggaaaagctgtcacctgtggaagaacactagaattaaaaattgggaaattttcttttgaatcccaaatttgctattagttgctgggacaatggataaatcatttattcttttacagtctcactcttctcaactgtaaaaatatgaaagttaatatctcatagggttgctgtgaggattgcttagatacaaacacacaccaaacacacacacataagtctacatgcatacatatatgcatacacacacatcactgactaaacaaaactaagcattttctttgtgtgtgaagctgagcaatggagggattcccctttacacagggccttggcaagctaaggagacttgcaggtgatgatggtcactacgtggggagattgctggaggtggagagggaaccagactggtgcagtggaattattactgagtgaggaaggtcagaaaactagaggttgggtcccaacattggcacttgtgagctgtgaggccttgggcaattactttaccatttgctcttttttcccccctcatctgttaataaagagaggtaacacttgctaatctggcatggccacaaggatcagatgaaataatatgcctgaaggatgaaaggctcaactgcctggcatggcgcaccgctcctgattgataggcaatgagcaaatatcacgtcaatgaaatgaactgccactgtctgaaatatctgctattatctgaaacctcagcttccttgtctcagtttttctataggtaaagctgggatgatgatagtatctaccttgaggaattgtttaaggattaaatgagaaggcaagttgtgaagcctttgtaaacactgtttcctcatatgctgcttctcacacatgtccatattatcaacattttagaagcaacgccagttgaggaggacttgagtttggtataatatagctgtttttccaggagactctaaaaagctcctttcattcgaaagcaaacagcaaaatacagcttctaaacattgctattttccctgaattttctgaacttgagcaaaaaagttgtttctctcttgagaggctctgttctgattggatcagccagaaagcccaataggaagttattttcagggccaagagtaccagggcaatattacagcaaaagttgatatattatgctgatggttaaactgggccttgtgttccgtatatgaaaaagtatactctttcaaattcctgcatatactaactactctctcccaggagtgtttctagggctttcacgtatttaggaggaaaagtcaggaattcactttaacatttctgttttctattaattaggcctgtttagctgttttctttttagaaagaaactagtagcagaatttgaactagtagcagattgtgctttccattcttctcctctaatctttgttgtctttgttattccctttgttataagagagtgggataaataaaagtattcaaaggcccagttcattgtcctttggccatatttcccttcattatgttacagcctagtctgaacccttttaacaagttttcctttttatgtcctctctcctacatgacttttgagtgaaaaagagtactgtgctctaacacacaaacacaaatctcacaaatgcatgcacgtgcacacacaaatgaacacatacacactattcaaaaggcacactgcattgcttacccatagaggtgaaagcaggaagtaaatccttttgaattcatctcagaggtttttttttccctgcctccaattggtttctcaaggagatctcatagcttctccaacaattttaattaatgttctccaatcactattagtcacaaaatcacgttcatttcatcaataagatttgtgtcccatgtaaaaattaaaaatttaaatttaatttaactttaaagtttcttttttctctcagcctgataaacttttagaagctcaaagtttgggaggatacctgatcatttattttctctcttctgtctcctccccctcctcctcttcctcctccagtaactcattcttatagtttttgaccctactaggatcaaaattaaggttccagaaagtttttctttcccccagtaatttagattggtttgtggcaaatgcatggtgctatcttttgcttttcaaatgtgcaaaaaaaaacctttctttagctgtgtaggaaggaatcaaattattggttgacagtcctgctctgggctaagagaataaagaccattttaattgctttattgaggggcttgccagagtttgtagggaaagcaaagcattaaattaagcagttgagtaacgttatgaggacacagcagggtagacaagcacgccagaattcttattgtactttaaaaactaaatgctggcagcaaaattcctttgagtcatttttctctaaattcagattcaggaagtgcactcttaaaataagttatttttggagttccatcttaactatagcttcaggccaaaagacagacttctccaagtagactgccctgcataggatcacattttagcaaaacctgtgtgtacgtgtgtgtgtgtgtgttgtgtgtgtgtgtatgtgtgttgattgttgctgacagaaacaaacttcaatcattaggacaagaactgaaaggattagcttttaattaaaaaaagattaaatatggaactttaactgtaaaaaagcattttatttcaagcaaattttataggcaaaatttctaggcaacaatgaagtgtattttacatactgacgtaaaacattcttgtaaataaaataggctttcctctcttgaagccaaaacattaaaattaagaaccaaaacaataacaaaaatataaaataagggataaaccaaattaatgaatagattatagtgttaaacagaatgtatttgccttaaatcagattttatatcttctatatattcataatgaaaaattaagaagtcattattaatttataaacagactgctgcaggtttcatttgaattgctaccttttgattatttttaaagtagtatcaattttcaaaatcatttcagagaaacaaattgtaaattcatactgtgtaaacctgttgcttctgaagtacagcactgtgatcagtgctaaaggagtacaaaataaagctaaagacaaagtttcctcagaagcttataatttcactaggaaggaaaaacagacgttcaaggattcagttaatgaaaacacagaataaacagtgtttcagtaactaggatgcctgtgtacactaagagtaattgcatttagaggtcacagctacctcatggtccaggtggaaggaagccacagttggattctgacaacattgaattagaatgtgtgcaagagaatggtgaggatggagggaggctgtgggaaggaccagtgaatgaaaacctcagtggatggttacaactgtaaagggtggagaagagcaaaagattagcttttcttatgctaagggcccagcttggagaaaatgtcatgtgcagggtgctttgctataccacaaaggggagaaacatgggcagacagaaaaggacagtgtgagtaacccgagaacagaaaggagttcttgtgctttagaaaagaggtgtgggccggatgcggtggctccgcctgcaatcccagcattttgggaggccaaggcgggcagatcatgaggtcaggagatcagaccatcctggctaacacggtgaaaccccgtctctactaaaaatacaaaaaattagctggcatggtggcgggtgcctgtagtcccagctactcgggaggctgaggcaggagaatggttgaaccccggaggcggagtttgcagtgagccgagatcgcaccactgcgctcagcctggggacagagcgagactccatctcaaaaaaaaaaaaaaaaaaaaaaaaaaagagttgtgaaatgaatcttaacattttagcaatggtcctttgggactccagagaaaacggagtgaaaaagaggtttggaaaagagaatctgattttagaactagagtaagagaagttgtcctggaaatcctgcctgtctcctctacctttttattgttgttgttgttgttgttgttgttgttttctgaacaaggtcttattctgtcacccaggctagtggcacaatcttggttcactgcaacctcgacgctcaggctcaagtgatcctcccacctcagcttcctgagtggctgagactacaggcatcaccaccacccttgggtaatttttaaatttttttgtaatgatgaggtctcactatattgccaggctgatctcaaactcctgggctcaagggatcctctaaccatgtcctcccaaagtgtgagattacaggcttgagctaccatgcctgtcctctacttcttaatggtaacctcacccagcacatcagctcattcatctttaagatgatgttaactaccgactagttattatcttcatgggtgaagttgaatttaaatgattataccaaatctgtgcgctttttttttttttttttacattttttggttcattctgtatcaatgagcagttgtgatatgacagttatgtgtgaatcatctataacagtggattttggggaaatgaataggccaaaaaggaagatattctccaaactcttaaaatttaaaggttgcagtaggatgctactccagctaattttaagctagccctctgtattcttacagttatttctctctctctttctttcacacacatgtactcattttcttatctattttataacaatttccccttatgctgacttcgaaaacttattatcttaaaaaatctattgcatgcattcctgtaagcagctacctcaaacgctttttgagccaggctgaaaataataaagccaaatttaaaaaaacaaaaacaaaaaacactccaaatcttgccaaactgatgatcaaatgttttttgattgtattttctttaacctttatctatatgaatacataatttaccatatttatagtcaaggtgtttgggtaaaagaacaaaaaatgatttatcctctttcaaaaagaggactacaaaaggactgaaaaatactttgggaggccccaggtccaggatccctggggtagacccctgagtggagcgtagcatccgccaggcagcttgagacacacctatatttaccaaggtgggttatgtgataagagggaggaggcctggccacatgctctctgactcatccctcaagcacatgtgtcaatttttcctacagttgggacaacctccttcagaagacagagctgactgtaactttcctgggctgcaatgcttaacttctacagaacaaagtatagaaactagaagcactgggagtccccgagctttcaatgagccacactagtgataacatcgttattactgctttgagcacccccacccccgccacgcatgtgccttttctctggtttggaactggagttgtgcttctgtgcagtgtctaattcctccccagactccctagcagcctgccaggtcaaaagggcatgttaaaatgaaactgctttaacggctacttcatttccttgcactttgtgttaaagctggcatgtgtaatcctgtgatacacaggactttagattagagctgggccaacacatttttaggatcctttttgaggggagattggcaagagatggaagagagtgcagaataatttgagcatgaattttaatcatttctctacaatgactagctttgtgaccacaggcaatctgcatcccagggcctcagtttcctcatctttgagtatgtctgcattctcctcaagactgtattatcaccagggtgagaagcgtgaatggcacagtgcttggtataagcagtgcatggctatagctgtttgctgatggctaagagatggaaaacgacctggttgtagccgacatcacaagaagagactcttctttctaatgtggataaagcttctcctgtatctgccttcctcctagtacactgactaaaatgtaatgctgactacctagatcacaaagaagaattttctacagaagcaaacaaggccattgtttacatgccacatgtgctaagtctcaatcttgacattccccaaccaacttcctggcaaatattgtttgacttagggaactgagttaacagatattgaacataggctgttgagtaccttcacttatcagtgggccaagaaaaaaaatgccaggaacccaatttatttgaatcagattaaatatctatgttttgatccacatctggtgatatagttataggatttaactttttgaaggactggttactgaaggcccattgggcagctttagaactgcattacttgagaaagtgttgtaacttctgagcgccctcgccagcttgttaatttgaaccataatactgcctcctcctttgcagggctcatatggagttcatctatgtgtatgcaggctctttgaaatagtgaatgtctacaaatataagtgattattattatgctttttatacctcctgtagtgtttgctggtcatggactgattgactttttccaacattatgattcctatgtaactgattcctgaaatatctaccatctccacctataaaggagattaaattttagggagtaaagtcattctcttgctatcctgcttatcattacttatgattaggcagaattctgctggttaagattgattccagggaggcctagaagagtccttctgtgtgcttctttcccaaatatattcctgcaaacttgctaataatgaaaagttccaaaattgggaattcacttcattgtcactattctatggaattacactttaagctctaccatttatatacacgttattatgaactgagttcatcaatcattttaataggttttcaacagagggaagaaaattgaacatgagctaatggtagggccaaagtctcagagaacaagaactctgcaactgctaataagagaatttttgtctctgtactggtgaaatatttgaatgatatccaatgattaatgtttctttaattctctaggtgaccaaaatcacacagaattatctagcaataaatcctctttacataacagccaaagcacttgggttgaggaaagagaagagaaataggtcttacccagcaggtctggtgtcttcaatggctcatccactgggatcaaatcgctaaggtagacattgaagtttccttctttccatcttcttttgcctccttctcctttccatgggggacaactacaggacgcccaaactgccctggagcttggggtcccttggagaaagtgtcacatcaattcttaacacctggtgcgttccactgtcttaggtaaaagggcttttatatgactctggttgtattctgtagagggggctttggcagttagttgatttttgctggctctagccctccagttaaagcatggttagtttgggacagtggcatctatgtggagcaagtgaagaggaagacatctcacttctattcctggaaatgtgtttacttggcttttacccaatactttaggaaatattgttttggttttagaattagagacctcttggggtctgccttttgctcttcctctttggttataatcacaagatggctttcagagaaatgagtttcttcccatgagcccctctagctccatcatcctttgacaaacttcccaaaggtgctcattaatagattgcttccttaagcgatttgaattgacagtgaacttaggaaaaggaaactcgtattggctttgtgtttatttgcattgacttctttgctctgagtcttagttttgttaaggccatggcttccccagacttcggcactgctgtgctggcagggtgtgccctctcgttgctactgcctgtgatcgctgctttggtctatcagtactaagactgatggtcacattcagtccctttcagctgctagttttgatgtgtcactgctgggactatgactcttccggggctctgttttaaactgacacgtcccatgtgtactgatattttgactacctgagttccttttgtgctatgaatgaggtctttggagccccctgagctgtcgtttgctttggtgtcccctggtagaggaggcttcaggtttggtgcctctcccgtctgtcttctgcttgttaggagtcacaggagggtctgcagatgtgcaggatgccacaacggcacaaccttgccccttcccagggcatctgcatttttctttccctctgggtttggtccaagtccacctcaaccttgagcacactctctcagtttttctaacattctctttgccccatgcccctttcccatgtccccttaggggagtttcatctcttttatgctgctgtaaaaaatttttccttggtctggctgaactctgaatctatccgctccctcctcacaatgtcttccttgatgacccgagtgttgatctcactgaatggaggcggagagctgccatgtcaaagaggagccagatgacagaagctacaaagataaatgcaagactcgcccacttcctcggaaaaactttcggatcctgttcatggtacaaagctttcctagcagcctgccctcccttagcctgcttaccttgagtggagaggaagctgaagtagcacagcagcagcagcagcagcagagttgccagaaagtgaccccctcccctgaacacagcagaagcagcagtccaaggggaaagctcagttcctaccgcttgtcagtctctgcctgcgtggatttcatagcagagcatctgtgcctgcttggctggccctggctaagttctgataaacacggccttaggtcactccaggagcagttgattccagccaccgaacagttcaacatatcactgtcttgtctccgggagcccatgtccaccttcctacaagcccaagaaaaggtgggggccaattgagactgccgtttctctcctccccgttctccgtctgcacgctgtaactcaacaccattctcataaggaaaacatttcatgccattacccagaaaacttcattcagctctcacctttgtgttatgtgagagcatgtgtgtttaaacggcaattaaagaggaaaaaaagctatctacttggagggcatgtgttcctggtttgtgaccccacctaccctactcctgctcattaacctgttgtagccaggtgccaatgctctgcctgaggaatttatcactgaagttaacatttcactttaagacataacagcttaaagaaggggcctggtatatcctcacttccagagatgtattgtttaattatttagatcattcattcaaggggtttcaatgtatttctttgtaagccaacatttttttttcactaatccatctgtttttattattacatttgattacaaataaacttaattgtcatactgctataaaagtttctaaacactttgttatggtctgaatgtttatgtccaccaaaattcatatgttgaaacctaatcataaatgtgatagtattaggaggtagggctttgaaggtgatttcattataaggatagagccctcatgaatgggatcagcacccttaaaaaaaggccctattgccttgccattccacaaagtgaagacataatgagaaggtgccatctatgaccaggaaatgggccttcaccagtcaacgaatctgctggtgccttgatttctgacttctagtctctagaactgtgagaaataagtttctgttgtttatgagtcacttagtctatgttatcttctatagtagcctgaacagattaagatacacttactctcagtttcagtacttatctgtcttaaaccagcaagcaacagtttcaggaccacaccaggacttggaccagattttgaggatgctggttgactggtagggtagcagttccgccacaggcttttcattagaaccacttgaacaagatccccaaaactctggtcaattgatgagagaggaggtggagatgacatttgggtgatattgtattaaatatatatatatatatatatatatatatatatatatatatatattttttttttttttttttttttacaaagcttcccaggtctttcaaatgtgcagctaaagttagaaacactggtctagaaaaaaagtctcaattttttgtttgtttgtttttggtttttgacattgcctatgagacatttaattttaggtgtctacttgactgggctaaggaacacccaggaaccagtaaagcattatttttaggtatatctgtgagggtgtttccagaagagattggctttgactcagtgcactgagtggggaggagatgccctcacccaatgtgggcaggcaccacaattggttgagggcccagatagaaaaaaaggcagaggaaaggtggattctgtctctgttgtgagctgggacatctttcttcttctgcctttggactagaactttagattctctggcttggcctctggggcttgtaccagtctgcccccacaacctccacatccctcactaggttctcggcttttgacctcagactgagagtgatgttattggcttccctggttctcaggcctttggctcagaatgtgccatgttactggctttcctggttctccagcttgcaggtggcctggactaggtttctcagtctccataaccacatgagccaattcctgtaataaactgcaactcactttctacctctatgaatcctattggttctgtttctctgaaaaatcctggccaatacagtctcaacttgtgtgacattccttccctgtctaaagtacagtctaataaaatctatgcattccataacaactaaatcagaatacacattttgacattgccagttgtaaagattgtccatagatttgagaagcacttctcgggaccactgtccttctctctgaggaactctgagtgatttgtgacaacactgctgttcattactctagtgtggggagggtctagcttccatgctttgaggtaacttatgttcccaatgacttgggaggggaaggagagattccaaattcatatatatatccaagcactttgctaagttctttccattgactatctcactcaatcctcacaagaatctaagtgaaggagtaaattacaatatgtattttgtagtcagcaaatgaaaccttagagaggtaagcaacttctggtagagattggaggggttgggtcttgaatacacgactgtagtccgtgtcttcaatatcacacaatactgctctctagctgtatgatcttgcaggctagttaattttagtggttactgagcaataaaaaaaaattctgctttgcagattaatgtgagaatatttaaaatggttaaagttattgttatattgaaggtactctttaaatgttagccattcatattgttctaatactttgctgtaataggagtgtcggatgcatgtgggaggcaatgtaccagctcttccaaaaaaacaagtagaaaactagtgactaacatgattctggcaatggggaagaaacaatctgagtattttattttattcttgccattcttatttcctctaattatagatttaacaagccattgttcactgagaactccctacatgcccaaaacatgaagtaggtgacattgtctctcccctaacaaccttaaaactcccctcagtagaacgccaccagtataataataataataaaaaaaaagaacgccaccagcaaaaaacatagcacacatctttagcatccacattcgaaataaagtgagaattttttttagcatcatggataaatggtttgcattacaatattgttttaacatgaaaatagaatactttaaaattattttactctgcatgattcaatcttgtccagccccatcccaccccaaatggcagttggaattactcaaatgtcttttaggaaagtcaacactgttatattctatgcttggcagtttaaaacactgcttgaaatatattcttgtttccatataattttatcaaagagtactgatttctttttatccctctctggtttgtccttgcgaatcaaacacaaattacttgcaacaggagagcaacatgttaagaaaattaaaagggaatcttggttatctatcatgggtaaagcaacacattaactctggcttagtcttcggtctatttgacaacaattcagaatgaaatgtgaagagtgggtaggagagtaaggaaacattgattaaatatctagaaatggaggagtagatttgttgtcagacctggtctaaagtactgacttggccactatagccatatgactatggatgtgtcacacatggaaaagcttgtgtaaggttctcttcccgcctcttcttggtcttttcccttgtgagtttatgataatctgtgatgatggtagaagttgttataagccataccactaattcaacactatgtgtcttcaggcactcagtaataatttcgtggccctcatagctgtacatctttctccttttttttctcttttccgacacacatgctgttcacatctcagatcaatgaattgcataggtaaaaggaatagaaaaaaaaggatattagaaattctaccttttcatcaacacacatattgcccaacacatgacatttgtatattggtaatgacggtgcttctaaaattttagttgtattaatttccatgttaccagcaggaaactaatacgtaagtgggttggttatttgaggtaccccacagttagggagcctggcttgtcatccaagtcgtagaatgcaggtacctttggctggtcaaatttctcaagaatctgtacatacttgttggagatgatatccatctgaaaatctggagttacgaattatccttgggagacatttgaggggttattccaattatcagtctgactccagcttgtactaaacatttaaaaacagatttagtttcttcttctgtaaaacgagcataatagtaggaggacttgccctctactctatttgttgttgtcaggataatcatattaatagcaacctttcattgggaatttactgagggcctccactagtcacttcacggtatctcatttaatcctcaacatttaattttctcagactagacaaaaactgttcagcaaaacagatctgcataaagttagagtgaaaagtatatttgtgtttattctcatggcaaatgtctttgaatcatcctcattgttaatcaagtaggagctcagtaacactgttttatatctagccttaaatctccctgatggaagtacagaatcttagaaacacggttccagctctctggctttgcatctacagttactttatctgggtatttgaagatttctgactatgtgagtatatcctaagtaactaatatctgttttattttatgatatttactcaatactcactcctaagtaaaaagaaagatgtaaaaggaaaattaatttaaatgtatattttcagagaataatgattatccatggatgcatcactgaatttctttttccccagttttactggctataattgactaataaaatgatacatatattaaatatttaaggtgtacaacatgacttggatagccttatacattgtggtatgattgcctcaatgcagctgatctccattatctcaataattatctttttttgtgtgtggtgagaacatttaagatctactctcttagcaagtttaagtatacaatatattattatcaactatggtcatcaggctgtacattagctctccagaattactaatcctgcgtaactgaaactttgtattctttgaccaataccttccaactttctcatcccccaacccgcagtaaccaccattctactctctacttctatgagttcaattttttacttccgcatatgaatgagatcatgcagtatttgtctttctatgcctggcttatttcactagtgtaacgtcctccaggttcatccacagtgttgcaaatgataggattttcttctttttgaggcaaaataacattcttgtgtgtgtgtgtgtgtgtgtgtgtgtgtgtgtgtgtgataatatgtatgtatgttgcactttctttattcattcatctgttgatggacacttaggtgaatccatatctaggctattatgcgtaatggtgcaacgaacatgagactgcagctatctcttaaggtgctgatttaatttcctctggatatatagccagaagtgtgattgctgggtcatatgtaattctattttttagtttttttgaggaaactccacactgttttcgataatggttgtataatttacattcccaccatcagtgtacaagtgttcccctttctccatatccttaccaaccttgttatcttatatctttttcatcatagccattccaaaatgtatgaggtgatatcttatgtggttttgatttgcacttccttactgattagtgatgttaagcattttaaaaatatgctgttggccatttgtatgtcttcttttgaaaaaggtctactcattttttttccctattttaaatccagttgctttcttgatattgagttgagctctttgtcaatcagtaggagcgcaataacatggttatatatttgagatattaactccttattggatgtatggtttgcaaatatagctgtcatccataggttgtcttttcactctgttgattgttttcttggctgtgcagaaacttttagtttcctgcagtgtcatttgtc

SEQ ID NO: 5067 - DNA, 18992 bp, Homo sapiens
ttcagttctggaggtgagaagtctaaaatcaaggtgttggcagggctgcactccacacaaggcttcagaggaaaacatttccttgccttttttggtttctagagcaaagcttgtccaatcattgcctgcaggctgcatgcagcccaggacagctttgaatgtaacccaacacagattataagctttcttaaaacacaaaattttttctctcactcatcagctagcattagtgtatttttttctctcactcatcagctagcattagtgtattttatgtgtgccccaagacaatcctcttcttccagtgtggcccagggaagcaaaaagattggacacgcctgttccagaggctgccacatttgttagcacatgaccacttctcgaattactacaacgtcttgcttctgtgtcacttttctactactctctttgactttcctgcctccctcttattagaactcttgtgattattcattggatcccatcctataatccaggataatctccccgtccttaatttaattaatcccattgcaaagtcgcttttaccaggtaaggtaacaattcacaggttctggggattaggatgtgacatctttgagggtggtcatcatttagcccacaacagtcagctagaggcattagggacctcagatccacccaggtacctcctaatatgcactttccttgtgatcaaaagagactggtacctggtacattgtttaaatctttgtttttgttttgttttgagatggagtctcactctgtgcccaggctggagtgcagtgacacaatctcagctcactgcaacctctaccacccaggtcaagctattctcccctctcagcctcctgagtagttggaattacaggcacgtgccaccaccccagctaaattttgtatttttagtagaggtggggttttatcatgttggccaggctggtttgaactcctgacctcaggtgatccacccaccttggcctcccaaagtgttgggattacattgtgaaccatggagcctgaccttgtttaaatctttggatccaaacaagtacaaagccattctgaatttaccagtcaaattagctattgaattcagtttatgattctttgaattaggttctgtaatctctaacccaaacatgcctgatttgtacacttgcccaaggtcacacaggagaggctgaatctctcctctttaccctatgagggtcactgatgagaatgctcatttgtccttatttgaaggggactcttaactgtcagcactctccctcccagcctccacttcagcccatttggccacagggtcctatgttcagggccacactcttctctaatcctcaccaaatactcacctgtttcttccagtgcttttctttaaaatgatattcactggatcactagaaggccaggtctagatgctagagccacagagatatacctttcctaaggtgtaagaaatattttatattagagggagaacagataattatcccctcccctgcctccaacattgaaaagcatgcttctttaagatgcagttaaattttgaaattctgttacattaaacccttaatactcatgagctaccatagacttcagtattggtttcctgggataaaccattatttacttcaggaaactgtatcttagaatggcagccattattccattcttggcataaaagtaaaaggaaagcatgaacatgcacacgataatcaatttaatctgatttataccaggtggcaggcaattattgttttgtgaataaaatatatggctgttgattgattttgttgtgttatgatagtctgtatttctgtaacgttcactttagctgggacggcccttcaatttggaattttaatccctgaagtgaaccaatgggatgatcctgtctcttcaggcttgtttagggttgcacattccctgggtcattgctctttccttatagaaaattctatgggttattggtaggattgtgactgttgtatgtcagtctgctaggctaaactaaatttccctgaattttctttcctgaatgattcctgaaaaagaaacggagccaaagtaaacattgttctgtgagcttggtggggcggaagtgaagcagctattttgagctggcacacactgctgcccgtctgctgcctcacctggtgcatgggcagcagctgggctgcaactgttccacctccctggatcttcctccagcttctatgatcctgggccgggcttcttgggagggcattccaaccgctaaggtcagaggcactgagagccgacgcgggtttcagttgcccccgtgtgtccagcttatacctgggaacccagtttgttcttgctctccccctttagtttctatccatcatcccttcccaacttcctgccctgcagacttcaggctccagcatcaatgcaacagcagacatatagaggcagcttcactggcacccaccattgtgtaaagtcaaacccttctgattgatcaatcaattgatcgattgatagatggattgctccatctcttagtgttctgcctttcccttccaaccctaattgaaacaatacccctgtcccaactatgtaagtcatgtttgtttaagattggcttcaagctgccaggatcaacatttttcttttaaatgtattcttgtttttattcagtgctctgtgaccatctcttagccataacattagcttgtggcttgcttttcacatatgattaagattaaagatcaagattttatgacttttccccaaatcctgatctggacctaagatagccttaacattaagcatttggtattggacaaatggaaagtgaattttacataattttattttgattctttatattcttatatgaaaatcttttcattacctttttttggctttagatttaataatggttacatttgtacaatgtcctttagcattaagaatataactaggggccaggtgtagtgctttatgcctgtaatcccagcactttgggaggccaagcgggtggatcacctgaggccaggagttcgagaccagcctgaccaacatggagaaatcctcccgctactaaaaatacaaaaattagccaggcatcaaggcgcatgcctgtaatcccagcactcaggaggctgaggcaggagaatctcttgaacctgggaggcagaggttgcagtgagcgagattgtgccactgtactccagcctaggtgacaagagcgaaattcttctaaggaaaaaccacaagatccagtaaactacataaaataaaacagtcatgtttcatacagtgaacattcgcaattgtatttgaagtaaggatgatagtgcaaattctaacatactttctaagtcatagttgttacaaataatgggagacaacttacctctttatgaacaaaatagcctatgttttattagtagttggatagactcatcttgttgctaaatgtgtctcatgttgccgtctacttgtagaaaaaataatacacgttacaaaccatttacccgacctccattattccctagggcagcaaaaagcatgtttttaaataaatgtaaacacatggttagccaaggatgacagaactctggtcatttctctatctttccaaaactgaaataattttaaggccataaaaaatgtcacagcaggttttagaaagaaggcaatccaaaaataaagacacgaattcccataaaagctaggctagggtatgaggtgcccgttgccatggggtaatagaaatctaggagtaggagagacaatgatctgaactgtctcaactttgctatgtccctggattgaggtacttggcagccccgagggacggagtgattggaggcatgacctttggagctaatgtatttctgtactcctgtgtttatccagggcatttggttgaattagtgccacttcctgccctaaggatctcacaatctagtatgccccatttgttcctaagcttggtcttagtttctgcattctcccatatgattccactcaaatcttctcaacagtaagcttgtagttgaatttcttgggaggacgctcccagaacatcatctcagcagctgcagggtgtctctggggcaggtcttgagactgccttaggctctctgctgcctctcctggccacaactgtctctactgccaaggtgctaatgccgaacccctgtgggattctggtccaaggaaacatctgcacacaggccagggatggcgcttagcttcatctgtgctcaaactctcatcagtaggcttgctggctctgtgaccttactagctgaactccttaatcttctgcacttcatttttctagtctataaaatggagataacaacagcacctacctcagaagctgttatgaagagtaagtgtattactatttatgagtcaattaggacagtagcttgcacaaataagtgtgatatgagcgtttgttaaaacagttaaacaatcaaacaaacatagaattaagtgctgactagagaacagctggtgatgacgcgggagggagatctaggatctattagagtgtcttccaaggacaagggagaggggattatacaagagtgaggtgttgtccctgatataacctgaatgggctcagccctagacacacttttaaaggtgatatgcttactacaactcttaacacctattcttcttctctttaaaaatgatctgaaatttattctcttggggataaaattattgtatatattatatatataatataattcttgttatgtatgtgtatatatataattattgtgtatatatgtgtatatatataattatttttattgcgtgctactattccaagccagtgctaagtgctggggacacatgtaagcaagttaaactggcccctcgccagatgaaacttgtttgcagttggtgaaacagacattacagagataattgtgcagttgcttatttagttacaccatgaagaatactctgaagggcaaagacaatgtgtaacagagtcctgtcctaatcctgcggttagagatagtgtagttaaggagatgatatttaagcttaaaaacagaacttagggagctggtcagcccagggcttgggcttgaggaagagaagggcatttcacatagaaggagcgtgtgggcaaaggctctggaaccattttgtactatgagaaatccaaaaaagaaaaagattaaaaaggaaggggtggtcagtagcagtcatttaacataatcacctgtttctcccaaggcagattgcattggtcctctacattttaccagcattgtgtaatatcagtatggaatagaaggattgtaattctgattgggggaggagaaaccttcatggcgataattttattagggtttaaaggatcggctgggcttcagcagacataaactagaggataagaagctatagactaagtaattactctgaaattataaaacttttggtattagcaagttggtagaatttgtttatttctaggtcccttctccagcctgctggaagcacaccatcaaatctgcagccagaaccatttaagtaaagttgtcctgtttataggttttttccataagctgttttattttttaataaataaaaacaatgccattgtcctttacaaaatagctgaggttttacttgaacaaaatctgtttgaaatgttaagctggttacacagaactaatatgcctcaaggtggtcattctctctggattaagctgtgggacaattgtggctcctgttacagggaaaattacaatgggccattatgaaagggacaaaaatctctgttcccagagggggactgacaagctgaaagtccctctctacatgcaacacaaaagcctgattgcttcagattgtttgtttatgtaaatcaaaaggatgcctttactctgccagggaactggcaagcaacaaagaaggtggtgattggctggattcttgctcaggctcctggcagatctgacaaatcctcttgcttttgctctaatctctgtctggatactttaggaaaagaaccttgttattatgtactaaagtgaataatttgtgctcttagagtaggattggaactataggacttgaaggcaagagcaggtatcttatcaaggatctactcactcagttccctaaagctctctctccagatcggattcaaccgcacatcatgacagatgttccggcacatttacccaggctgagtgtaatggggataaaccacctgaaaacggtcaacaaacaatactaaaatcagtgaggaattgactgatgtggacagccccctgccacactacagggtagacccagtctggaaggtgcactcaccaaaggaagtcaggaggaaagaagaaaattacaaggaacatgctgctcaactcatccatggaggacaaaatgctaaaaggtaaagtgtttccctttccttaattttcttgttttgacttataaatttaccctggatttttttgataaactattacgaaatgagctggacaccccaaaaatgtagccctttattctactacgcatagtataaggctaaacctctgcctctggtgaaatccaggctggtctatttgacagctgtgaccccagacactttctgtctcccgaagcctgagtttttttcactagaagaaggcggaataataataatactacaagtctagggtaagtattggctaaatgttaactactgtatttattatgattatgacagccccatattatttgaacaaagagaattcaaaatgttaaaatttccttctaaatatactgaagttctctgaatttatggttctatatcttatatatatatcttatataaatattaaggagagattacaatcaataaagtgatcattaagtaaataaattgaattgataaagaataatccaaagagtgaaatagtaaattttaatgatcagatttaaaattaaagacttctaccagagtttaaattgataacttattaactgttgaacaataaatattttaaatgttaaaatatgattttatatttttttcctagaaaacccagaagagaaactctttattgttcataaggcatcacagatctttctctccaagaaactagtgctgatgaaatgacattcagagaaggtaaaagaactacagttttgtacacagaaattgtttgactgagtatggatgacagtctttccagaaatgttgcatgagcgtggggttgacaaagcaatccaggcaatgacttcaaattttcaagctgctgtaggcagataagagagtcttaacttatctgtgggttccaccttataaagcatccagactgttcaaggctgaggctgcatggaatggcatagctgattggcataccaacgtatgtctatctcttaagttagtccactgagtcaaccctactttttgatttggtgtgtccaatctgtgtgtgcaccttgtgaaaggtaaatgtttcaaaaacgggtctttcctaaaagtcacaattaacatacagcttttttttttttttttgagacggagtgtcactcttgttgcccagctggagtgcaatggtgcaatctcggcagactgcaacctctgtctccagggttcaagcgttctcctgcctcagcttcctgagtaactgggattacaggcacctgacaccacgcccagcattttgtgtgtgtgtgtgtgtgtgtgtgtgtatttttagtagagacggagtttcaccatttggccaggctggtcttgaactcctgacctcagttgatccacctgccttggcctcccaagtgctggggttacaggcgtgagccactgtgcccggccaacatacagtttaaagtaatctacgaaatgatttactttataggcctctaatgtaaatacaaaattgttaactatttcatgcaaagaaagacagggtgataaagttaattttaattgtgttctttaagaaaatggaagaaaaaaagaacattgaagtgattatgttaaattttaaataaacttaatagactaagagacaaaaatcctttagatttttctaagacacctacatttaaacagttcccaaataaagtgtagataaaatctattaattaatcatttctttcctctcttgcagccatacacatcttatgtcaattgaagtcagcttgctaaacctaaccaatttagctttgttaggactttaacaggcaaatattgaagagactattggttgaaatattagaacatcacataaaatagtagatgtcaaggggacaggaatgtgattggctatttcctacatctgctccctttgcctgaacacctctcatctatgtctgcttagcagtgtagcaacacttaaggaaatatgtagcaagcaatagacagttcaagctgtcacattaccagagataatttttaagacttaagacttcacaatatgaacttataacctctttgccctaattattctgcttccaatgtaacaagttctcagaggcagaatccaacctcctatcatctagagcccctttcaaatgtttgatcaggagtccattgcaggtaaagttgtctagatctttcattttcatcaaatggagaatgaaagcaggctgtagttttcagtagatggtctcgctggttaagttttccctcaatgaatcctttcctgtttgatggagtattttttcctccataatagaggcacagattttggtgtgttttatcttcacagtggcaaacactataaaatcttcaaaaagaatgttactggattaaaacatataaagatgctaaaaatatgaggaaaaactataatttaaattcaaggagtaattttatatgtgacaatctcatggctggtcatgaatataaacaaaatatcacttactttggttcttgtggaaaacaaaataaaacaagcataagattatggcaaacattctaatgtgtatttatggataatgttaggaacattgagggacactagcgacctgatagcagctgtgtgtaacaaattagggtgatcacccatctttcttctatctctgtaagtttactatgtattccctagagtgagaaaacaacaaaaaaataaagaactgaacaccttggatgaaaatggaattgtgaacatctttcggagagagtagaatatgtggaggaaaaagacaaagaggaacattgcctctcaccttacttatagactctcacgggtcaaaagaaaatggtgaactcaggcctgacaaggggtgtaacccagacagatttctgattgtgtacaccacagactgaaacttcccacagaagccttgcagggctgaaggctcagagacaacctcagcttccttataattaattcttaccatattcaataaatattgttgagggtagttggtatgatctagctgtttgaaaagtgaccagacatggacagtcatcattttcagtatggaaacgagcatttttttctttctgaagtatttttctaattttccttgaggtgtgtgttgtgtgtgtgtgtgtgtgcgtgtgtgtgtgtatgtgtgagaaaaagataagtccaaacattccttttacatgtgcacgtatccagttgtgactggctagacaagaatttttttttttagtgtgtctcagggaacaccagtctcactaaatacagtagtccacaacagagttccatagcaaatgaagttaggttgttgactttcttacagatttacaatactcgttagcatttcaaagcttgtaaaaattctgaagatgcttatttaactgtatttaatgcagtgtttttgaaattatttggctgtgtagcctgtttgtgcaaaacatattggtaacccacagaatcatatcccaaaaacatgtgttgggaagtgattagcaagaaaaattatttggagaataacagactaatgctgggtattttggaatctctacacatctcatctaccaattgattttgctacagggcatcgtgggagaagattcctctgagtggcagtaaccaggaaataagaagacagaaggagaggatactgagcagcctctcaaagaggaagaagatgaggacaggaagaacaaaggtcaccaggagctgaaattgaatggctgggatttcgaaaacctagccaagctgacatgttacattctaacatgatgaggagcagaaggtttgggatgaagaaattgatgatgatgatgatgataattcaataatgatgaagatgaagttcgagtgatagaatttaagaaaaaacatgaagaggttttcaatttaaagaggaaggtgatgcaagtgaggactccccactgagcagtgccagttcccagctgtgacacctgatgagcagccaaccttagggaagaagagtgatatctccagaaatgttattccagatacaatacaatatcctatcggaaaatcagaaagggaaataccaagcaaaaattgatgaattcgagtctatgatgcatttataaactaactggaactgagaaattctcagcccactaaaggaaaagctaattctattgccccagggtgcatatttctatgccttatttagttatcacttggagggaggtggaagttgactctctttttcactgtagaataatgtggaataaccctagataaaaattcagtctgataacctcaaatcaaaaagctttaaataaattctgggcatttatcttttaaaacttcactaatatagcattgtgtgataagcactaagcagtagtcccctgggggaatctggcataattcggctataaatgtagcaatgcttggaaaggtatcatcaaatgagactatttgaggggactatttgaaatgattctggtatttcttttggtactttcttcctgtacattggagtgatggaaagtctggtattaaaacctctcttacttttaacttgattttgcagactctggcaataagccttccaaaattctgtgccttttctattatcccaaacaatatgttaagtggctttccttggcatctacagagaaaacattctatagccctcttcctaggtgttaccattcactgaatcttctctcagagggagatgagcaattgtcagtaggataattctgtttgctaaatgttgcctttatgctttcaaactgaattaaacccattggaggttgacactgggaggggctagaagattggtgggcagcagactaaagagttatgttgatagttttatttctgtggctgaaaataaaatcttgtctagcacagttaaagtcattaaaataaaaatgacagctttagcacaattttaagaaaatgcccctctctattaccacatttttcttattaacagtatctcagaataattttctttccttagaaacctgagagaatgctagtataactgtactagttactatgaaaatggaaataattatcttagaatattttcaaagtaggcgtgagcatgtatttttagtgggagagctctgatagttgttgggaatatataatttacggacctcagcccaaatcaagatgcttaaaattgtacttgtggagcttcactcaaaccaagtgtcaaataacgtattgaatatttatgaaaagagagactatatttatattcttagatatttgttccacaatttttcatttcatgcttccatatatattaccctgaactttctatcacacagataaagattttgttttgccctgcaaataaaaagacaattccttattgtctgaatgaatacagtcttcattgtactattcaaccctttgtttctttctttttcattttgtgaaaactccatgttagtcctcttagatgactgcttatttatgtgtaacataaatcccacatatttaatgacaacttctttaatccttccgggtcatatattatatttccatagtatcacatacattatttagttgtttacaagactccaatttgaattcaggattacagtgctcctttcatttttcaaacagataacataaaagttctgttaccctcattctatacaacctatggatttcagtgttacaatatcagtttccagaataaagtgagggaaatcaggtctttattgataaagtagggagaagattgatgcaataggacaatttccaatttaatttagatcctctaatctttcacatggacaagctgttttcttttctaggttactgataacccctacaattttcgacttaattcaaaacacagtattgtgttatctatcacataacaggaccatgtttttaacctaccataagagcctgtattttgagttattccaacagagatgatggattcctgtagaactagaggtggtgacctatggttatgtggcacggcaaagcaagtacctcttaagggactctaatatatctaacgctggtcctcttagctctgtgctctcaccagacaatgaatgaactatgaaagattagtcaacagaaactattttagggtatgtttagttggtaaatgcttcatgttcatggatacacaatgtttttgcaaaaaaaccctgaaactattctttggcattggtgtccatggcccataccgccatcttacacgaaagccacagagttgaaagccacagagttgaaagccacagattaagtgacctcaggtaacataatggtgatggttggccatttgagtctttgtaacctagaaagacaaaggtctgattcagattgcatgggggatttttaacatatttgaaactcaggggaacatgattaagaacacaaactggtagctacacatgaaggtttacttgagcttttgtgttcaaagttcaggggtggtaaggactctggtaccagggaagagggagaattaatttatttgcaaatgctggtatttcttacatgattttttgttttcctctgttgctagataaatagaactaataatagctctatttctctgccaatataaaatctacctttcatataatgctacatgaaggcacagaatttgctaccatctctctctccccctacctaccaaactatccacaattaaataaagaactgctgtgtctgacttactctcaataaaagtttgtgtctttatttctggctctagactttattttgtttagctgccttttaaactttagaaagaatccttgtatatcacagctactatgataattaatgaatacctcttcagaaatcaagagaacactttattttagtcatttgcattatttatttcaaaaaggtcttaaaatgattgtatataaaattgtaaaaagatttctggtaggtagatatgtaatatacatgaaaaatttttatcattttttaaggaacgagatcatgtttaagatgcatcttaacacgaacaacttgaagaaatctctgtaatcatcgagtaatacatttaaactatgctgacattttcatagcaatcgtttctgcatatttacatggatcatacttttggcatattttcaaatggagaacggacatttaagtttttcaatgtgaagggaaaacatttaaaataagtaataatagagaattatggagaaggataaagcaccagatataataaagaagaaatatgtttgacagtatgagaaaggcaaccacttctcttaaaactgaactttcatcactctaaaaaacaataggattgtaaaatgcaatgtcaaaaactatattaccaatattaaagtatcagacagaaacataccacaatgaatatgggtttctgataaccctacaatattctacttaacttcaaaactcagtattgtttaaagacaatgaaaatgtgtattagttcatgaagaacatgagataactgagccaggcaatcaatacaaacacaatgacatggtagtagtaagcagctgaactcactcagaacatggcaaactacaaaatcaaatgatgattctagtagctaactgccagcacaggagaattttggaaatgaatttagaaagtaatttggtgtttacctagaatttaaagttacatacttgattccttctttataataacttcagtcgacagatgcaaaagaaaaagtacttaaaaatgtttaattccaacatcctttatactccacattttagttttattctccccttagcaaatgttttcaggcaatctttaacacaattcacttcttaatctttggcttctcttgtttttaagctaatatgtataaaactagcaaatttggggagttgtttgaagcagaagacatgtgtgtaatcttcaactaaataacaagcaccctgatattaagaacttgattactccttcaagtttggaaaatggtatccagagtgtaagttcacttagatacttttgtgcagaaggccagatgcagacaaagctatacacctgaaagagttaaaatatctaaaaacattttattttctttatgttgtgaatagaaactcttgatatttctttctccagatcaaagcatcaaaaaaaaaaatatatatatatatatatatatatacacacacatcagtatatttacaaaaattgctatgtttttgagtggtcacttaaaaatctattcatgcttgaaaaattttaatttaacatctaatataaagggtttattatatagatgcttatgaccatatccttaaactggtaaatatctgtcaatcaataataaaacagaaagctcttgtttttgaaaaaatatttattacttatttgatggtgactcattattagaaacagcatattagaagtgctgtatttgctggaaaatgagaattttcccttgtgttttgtatgtgtttttacaaagcaagattcacataaacttgcaaagcgactctaattgaaatgataactattgttccattagttgaaaacagaggcattaaatctgtttagtgtgatgttatttttttctttctttgagatcagacaccaccaacacctggaatactatccattaagcttcattagggatatataatacttatatggcttattcaaaactgtcaaaaaataaatattttgtacaatatctctggttaattttttttctaattgtaaggcattttgtcttgtagcaactattgagtaacccatgcaaaattgttgcaaaagcacagtagtgacaacctacacaatgagtaggaataaaaagtcatggttgtgttttaaaggactccaactttttaactttttatttctgttcaagatgagcaatctgtagctttgattaaaggttggagggatcaagggttggtaatattaatacaggagtcattaaaatttattttaggccattagaaagggtaaaatagttctcggtggatttttcctttaataaaagcagcccccaagccacttattttctaacaaaaagcagcctgaaaagtcaagttgcagtatagatatgcaagctagaggctcccatatgtaaagctagcagctgtacctggaagcaggcacattcaatatggtgattcctgctcccttttccttgtcaccaggtgtgtgggtgaatggcactggtgaagtgaagccacgtgtgcaaatgtcatggtgacagccaggtagaagagcatttgcataataaaaggttagggtgggagggccagtcttttcaccggctatgtaagtgtatacctggttaaaccaatccccgggccctatgtatatcaatcaccgcctcctcaagctctgtatgaaatcaatcaaatcttgccccaaacccagaaaaccctctcttgagcaactgctttctcaacatgaggaagctttctcactctcttctttatctattaaactttccactccaaacccactcctcatgtgtgtctgtgtcctgaattctttcttggcatcagacaatgaacatgggtatttccccagaaaatggagctttttcaatattattcacagagaaagaatcctcacatgtccacttctttctttcacatttggtccaggagatgaaaaagaataggttctgcagaagtcaaagagatagatcacagcaaaacatgtgggggtagccatgtttatacctacactcaattggttaccacagagagagagagaccatgcttcttttttctgtttatacaacatcaaaagaggccaaaggggtttaattcaatctcatctcaatactgtggcatcagtaatctggaccaagaaacttttaaatgcacccacctgagatgacagccctttgtaaagaagaaaataattatatagcagcatggtatagtgagagaaattttttttgagccagataaaatggaaatgggttttatctcttacttgtgggatgaccttgggcaatttaccaaattcctcatctgttgtgggagttatccttcttgttcatataacagggagaatgagagtcatttgatgagttgacccatcagtgagatgggacacatatagcacctacacaaatagtacctacacacactcatgataattagttcctttcttttttcccatcacccaatgtcatttttttgttttaatccagattttggggctttcttctgaggtaaaaattattattattattttttgagatagagtctgctctgttgtctaggctggagtgcagtggcgcaatttcagctcactgcaacctccacctccgggtacaagcaattctcctgcttcagcctcccaggtagctgggattacaggcgcccacaccatgcccagctaatttttgtatttttagtagagacggggtttcaccatgttgcccagctggtcttgaactcctgacctcatgatccacccaccttggcctcctaaagtgctaggatacaggtgtgagccactgcgcctggttggtaaattttttttcttgtattctgaatatagaattcaatcagagatgttaaaacaaagaaagatggtactctctggcatgtttcaatcttttctattgcatgagtgcctgctagaaataattacaagccattcatgaaatcaaggttggtgggaatattggactcctatatactgtaaatggtatctttgcccctctgcagtcccaaataatactagaagtaaggtgttttaatatctaaaagaatgtttccaaattagtgtggcgagctaataatacattgtgatcatggcacatggtggtttgctgtgaatgacagctgaggggtgtcaacaagcagtattaagcaaatttgatgctggtgatagaacaagattgtaccaacacaactgtgtcagcttacaagagagtagggcagaagcgctgggtaactgttgaaaaggagaagaaattgtgcaaactgaaaagtctcagaagcacttagatggcttggtaagttggttatgctgtcaaatattatcaagaccacccttgtattcaaggtaacaagatgcatagacttttttttttttttttaaagtaaaggcaatgacctaagctaatccagggaaaaatctgtagccctgtaacacagcctcctattgaagaattcagtgctgattaggacctgtctcatccaaagtttatcactagaattaccagaagaccgagtagcatgtatacctttattctaatctcctaaaaaatttagaaggctatgcttaagaaaatgttggtagtagatgtaataataaatcaaacactcaagtttaggcccatatagattcccaactagtgatcagttccttgcttcttagataactgagcaaatatatgatgaaaagcaatgtataaaattctatccaagaacaaatttggatgttcaaaaacaatcctttgttatattgacaatatagatttaaatatagctttatatataagtttgtcagggtaaagtcagaaaggatgtgaactgagaggactgcagaagtttctttaaggaaaaaaatccaacttcctttagttgatatacccaaagataagtgtattcaaaagcaattcattttttttcagaacagagttgacttctttgtggaaactattttcggataaaagagagcctatatacccgggggaaaaaaacctctcaacattttttagttacatgaagaatacatgaggcacctagcatgttcagtttgtcagtaactcaattagtcttttgacaactgcttgcgtccccccatcccccttgccccatatggctctgttttgaaaagaattagagtcagcatcatttaataacacaaatacattctgagaaatgtgtcattaggcaatttcatcatttgtgaatatcagagtgtacttacacaaacctagatggtgtaggtagcctactacacaccaggctatatggaatccctgttgctcctaggttacaaacttgtgcatgttactgtattgacactgtaggctattgtaacatcatggtgagtatttgtgtgtctaaacatagaaaagcacctaaagataccatattattaatataatcttttgggaccaatgtcaaatatgtggttcatgttgactaaaacatcattatgtgtcatataactgtatctcatttcctagtcattctcttctcatctgcagttttcaattatatgaagaaaacatcttaaatatgttacaaatgtgcagaatagttctttttcccattcttagttatagttttgcttttacgtaactcattgggagtcaaattaaatgttaaactaggagtcagaatgaaagatacctagtttcacaatcatctcaatgaacaaaagtttaaatttaaaaaaagaaaaaacatattaacaagaatatagtatggtttcctccagggacccaatcccagcaaagaattgtgtatctctttctaaggaattctgtgagcagatttgttcgggccagtgacctgaggcattagaatgagccctgtctctggaaacctaattctaatcttgattctttgactaacttgcctgggttttaagatttttaggtaatttacctctcagcatcagttttcttaccaaaatgaatgcaaaggctatcctgatttc

SEQ ID NO: 5068 - DNA, 41041 bp, Homo sapiens
gattttataaaatgcaggagcattttctttttatattaaatccagaactttaggacccggatgtttagaagagagcccaagggcactaggattctagaacctggagaggaggcaggactgaaagcaccgatggccaagtcctatcctcccgccagagctccacctggggattggttgtagatgactgaggtcaactgctttcatttgatttattttcaaacaggaaagggaaagatagaagatatattgtgtatcttctcaatgaactctaaaaaaattgagtacgatattcatgaatcaccttatttcaggaccagcccagcagaaatctaggcagtgatctgatgtttattccaatcgtttggtttttatatgtagggattgggatggtcctttgcatttataggcaatacttaattccttttcaaatatcttcatttaacacagctaactgaaaggctcaacactccaggaagaagaaaccacaaatgatgaacaaatgttttgtcactctttcagattcagaaatttgcttgaaaaaagtctgaagaaactaatttaggaaagaaacctctgccaataactctaaaagtttgaattggttgcctttattcctaacactatgatgttttgggataggaactagtagtggtattttttctttcccattggcagtatatcatttacaacagatgttcccgactcaggtaaaatgtaactggcagccagagtcacccaccagcccctgaggaaagggctcaaccttggaacatctggctggcttcaagaaggtcacacaaatacaagatgatgctgaggataagacagtggttttgagagaggaaaacctttaaaaatatttggaagagtcctgaagaccaataaataaagacactgcaatacttcatggacaccagagagcaatttaacactgaaatgaaagcacatgttgcacctgaacactgaaaaaagcccatgtgttaagaggaagaagaaatatgcattcactgcaataaatattgaacctttaaaaaacagaaggaacatgaaaactaaaggacatgggccacagcaaataaggtggcggcagccatcccataatgattacatgatctccatgatgtaaaatgtatatgccacctgaatttattcttagaccttctctcaaagatgtctgcatcaacacaggcaataactgcaggtaatagtgaagaatccttcaggcatgatagaggaacaactaagtgtgggaaaaggaagaactaggccgggcgcggtggctcacgcctgtaatcccacactttgggaggccgaggcgggcggatcacgaggtcaggagatcgagaccatcccggctaaacggtgaaaccccgtctctactaaaaatacaaaaaattagccgggcgtagtggcggggcctgtagtcccagctacttgggaggctgaggcaggagaatggcgggaacccgggaggcgagcttgcagtgagccgagatcccgccactgcactccagcctgggcgacagagcgagacccgtctcaaaaaaaaaaaaaaaaaaaaaggaagaactagtcaaaattgctaataaggccggtgcggtggctcatgtctgtaatcccagcactttgggaggctgaggcaggccgatcactaaggtcaggattttgagaccagcctgaccaataggatgaaaccccatctctacccaaatacaaaaattagctgggcgtggtggcatatgcctatagtcccagcgactcgggagggtgggcaggagaattgcttgaacccaggaggtggaggttgcagtgagccgagatcatgcccatgcactccagcctgggcaacagagcgagactccatctcaacaacaacaaacaacaacaaaacagcaaaaactgctaataaaaattttaacgagaatatttcaggaagtgaatgagttggttcatcttcaaatgtgtgaaaaattattcagtgaaaagatgggcagcttagtcttatgtgctctagacactatcatcaggagcattgggtacaaataggaaaacaatcagagcagtaatacagggaatgtgtattctgcagtcaacataattgttggagttgttagagaggttactgtgtgtggagagaagtatgacgaaagtccagtaatgaagagttttgttttgttttagcaagatgactaagtgataagaaattcatttgatgcctgtgtaatggggcattttgctataagtaagctgttataatcagacttttcttgttcatagattggcaaagcatcatattggatacttagattactgacatcttaaaaaattaatcagcctaatatttttaaatgcatttcttttgagtttacttttagttgaattttgagatttgtttcaatcattattggaattttgtagagtcttctgatttccctagggaatgcctttgtgtccaagaacaagaaacataaccaataagaacaatacatccgtagttttcctatattagtagaaactatttaaaggagatgaaaatgaaagaagatcatgaaaaaaataaaactccaaaaatggagctacaaaaccgacttgtaggccaagatcaatgaaagtagaatacggaagtctggaaggaactatacattgtccctgactacgtaacagagaagaaagttgggaagaaaagtgtgggcaacctccccacaagagaccagttaaaagccaggaagaaggctgggcacggtggttcacgcctgtaaacccagcactttggagcccgaggtggacggattgcttgaggtcaggcgtttgagaccagctggccaacatgtgaaacctgattctactaaaattactatatatatatatatagtaatatatatactaattattatagtatacatactctatatataattgctatatataatatatactatatataattacttacatacagtatactatatatatacacacatactatatactatgtatagagacagtatatatatatatacacacacatacacacacacatacatatatatacacacacatattatataatatatataaactgtgcgtggtggctcacgcctgtagtcctagctactcaggaggccgagcaggagaattgcttgaactcaggagccagaggttgcagtgagccaagactgtgccactcactccagcctgggtgacagagtgagactcagtctcaaaaaaaaaaaagtgaaaccccactccactaaaaatacaaaaaaaaaaaatagctgggcttagcagcagacacctgtaatccagctacttgggaggctgaggcaggagaatcgcttgaacctgggaggcggaggttgcagtagcagagattgcaccactgcactccagcccgggggacagagtgagacttcatctcaaaaagaaaaacaacaacagcaacaacagaaaagaagtaactcaaaatgtttcaaagaagtaatcaaaatgtttttctttctttcttcctttttcttctctctttctttctttttctcctcttttttcttctctctctctttctttctttctttttctttctttctttccttcgttctttcttctgtctctctctcttttctattttttttttttgatggagtctcgctctgttgcccagctgaagcgcagtggcgtgaccttggcttactgcaaccactgcctcccgggttcaagtgatctcctgcctcagccttccgagtagctgggactacaggcgtgtgccactacgcccgactattttcgtatttttagtagagatggggtttcaccatattggtcagtctggtcttgaattctgacctcatgatccacccaccttggcctcccaaagtgctgggattacaagcatgagccctgcgcctggcctagcaccttctagttctaattaggctgcatccatgagggtggaagaatgtctctggaaacaagcagtaattaggatgagaaaagttgtgttttatggggttatgcatggtgagctttgtttgatcgtttaatgggggaaaacatggaaactcatgccccctaaaagtttatataatagtatccccgcactgaatttttctaagtcagacttggcccatacaattagagttgatatcctgtgcttttatgttgctttcccagtttctctatttccatcagcagcgatatctttgtagttgctctagagcagagggctcagtcttttcaatcttgtggtcccttacactcttaagaattattgagaaccaccaggaatttttgttaatgtggatgggttatattagctatatttatatattttaagttaaggctaaggaatttaaaaatattcatttattgatcattttaagatagtgatgcacctatttcatgctaacaccaataacttatttttatggaaaaaaacaacaaaatgaaaacagcgctttagttcacatttttgcaaatctctgtaatactggttgaaacggagacagtgggagtctcctcactgcttctgcatttgcagaaccacacccacactcttgggagcatgagaatgagaagggcaagtaacacagagggtcattagataaaggttttgaccttatggactctctgaaaggaataggaagtcctcaggggtcccctgcatcaggcctccctgatcaagggagccaagctccaagggttgctggggagctggaggaggtgaatggggcagagaggccgttgtcaccaaaagcgtgtttaggctccattcacttcaccccagtggcctactgagcccacatggccaccagcgcaactgaagcagaccccgatagaatccttgtagaattattttaggattcacccatcttggcatgcacaagccatttcaattgaagaagttttctaataacaaaacattgtaaacctaagtatgtggcaatagtaatgattaagtaattatggtttcccgaagcccagtgctctgcagccatcagagagtaaaagcgagaatgtgtcagtggagatagcctcaggatatttaaaagcagagagcacaaagtatagaatcgtgttggtatgttatgacctttttttctgtgcttttgaaaaagagaatacacgtatagcaggaaagacacaccaaactactttatataattggttgtttttgtgtttggtaagatgtatgcactaagaggaaggtttcgattttttttttttttttttttttttttttgagacagggctttgcctgtcgcccaggctggagtgcagtggcgcgatctcagctcactgcagcctcgaccgcccggctcaagcgatcctcccacctcagctgtcccagtagctagaactacaggggcgccacccgcctggcgaattttttgtagagatgggttctctccaggtggcccaggctggttctgaatcccgggctcaagggatcttcctgcttcagcttcccaaagtgcggggattaccggcgtggccaccgcgtcccgcctgtttttaatttttagcagttttaaatcttctggcaatgagtatgttatagtgtcccagatgtttggtcctttaagaaaaggatagcaggacgggttatctcgtgggagcgtgttccacctctgccctccgccagccgccctcgccggggatgcacccaggattttcctccggatgcgtgagtggctcgcccgcggacacgccagccccgccccgcgagccggtttccccgccccctccccgcccacgccctgcgctcccttcctattggtcccatgcccgctttcccgttcaatcgcagcgcttagcgccagaatttgaatcttcgttttcgtttgattgggcgggcgcgccgggctggaagaaggaagtggagggctgacgctgcgggcgggcggcgggcgggaggactcgactcggtgggagccgctagagccgggcgcccggggacgtagccgtagggccaccgggtccccgtcagaggcggcggcgggagcagcggggactgcaggccgggtgcagcgaacgcgaccccgcgggctgcggcccggtgtgtgcggagcgtggcgggcgcacttaccgggcggaggtgagcgcggcgccggctcctcctgcggcggactttgggtgcgactgacgagcggtggttcgacaagtggccttgcgggccggatcgtcccaggtgagctgcggcgggactcctgggagctgtccggggtcgagggctgagccgcggggaccccccgagctctcggggacgggcaggggacagacgcgcggcctgggcccgactcctcctgggctctggcgaggcgtctcggtggaagctcccaggaggcgcaggcgctggcgacaacaccccagctgccgactttggggcgccgggggctgcggtcggatcgtcctggggtccccgctagctagctgcgtgtgcgcttctgtggccggggataggtgaattgggcacggggcccttcttagctcctttctatcagagtaactcgcacctcttttgcagtggaagagttgtaaatttgcttctggcctcccctacggattatacctggccttcccctacggattatactcaacttactgtttagaaatgtggcccacgagacgcctggttactatcaaaaggagcggggtcgacggtccccactttccctgagcctcagcacctgcttgtttggaaggtgagccccgcgggcgcgcgcggacgtttagctgagaaagaggaaaataccttagtcacagaataaagtccagaaacgcgctctaggttgggtcctgccgtcacttttccttggtgcttctcccattcgttactaagttgacatagtgtgtttttttgttttgtaagtataaatttgatgctagtttgtatgtttaagtggttttaaaatcaagccaattaaaaaaatcgatttgctaatgttgcggtaaagaaagatgtagatatcttcatatgtcactggctgcaggcaggcgtctgaagacactgtgcgcccccgggtgctccacagtgggcatccctggccactggggacacagagaatgaaggaaggaagccatacattgcctcttggctccttgtggcaataggaaaatgggacagaaagtcttcctgcctggaatcgagaacgtttcctcttatattgctgtcctgtttggtggtggtaataaccctgtcccttataacaggtatagttgctgacagtgccccatcagcctctgacatgtgtcccactagagcctgagaaggggggtcatttcccgtgtggtcatttcccagaccacacgggattcaggcccaccctgtcctcccaaccccatcccggcctcaccctgtcctcccaaccccatcccctacttgttcctcccgcctaaggcattccaagcctttgttcaccttggtacttcttacacactggaagtttacaatgggaaagttctccccttcctcaagcttgtgtgatttccatcattcagcatcaggtgaaatgtcacctctgaggaagccttgcatgaaaacttgtatttccaacccacagcttcaggggtgagttgtgggtttgtctcccactaggctgagctccccaaaggcaagactgtcttgttactaatcacgtgtgtagggccagggatggtgtctggcatagggggtggatcaatacctagcattctggcaagggtcagtagaaacatgggctggagccatggatttcaatctcttgagaacagtggttctcacaggagggtcatctaaccttccaggattcatttaatttccatgtcacaatataggacaggggcatgcgctgtcatcgcggaggagaggtcaggtgggcatcctaccaggctcagggcagcccccacaatacagaagcatctggcccaagattcaacagtgccaaagctcagaaacacccatctatagtcgtcctcctgccaaacaaattccagttgtaagggatagtctttcctttgctctgatgtcctgttaccttaaaatcaaattatttattggggttaaggaagcttttcactttccatagatacctttctcttgaaaaggaaaatataaacatttcatctccagtggcagtccttttgcttttttatacagtactccttgaaatatcttcatgcaagattttataatttagaaataattcctaagtgtttggtcacatgactgggtaggaagagagattcttagactccaaaggttcagatggagaacagacaggccattcatagtttattcaaatttttaagatcacaggctagaacaggaacactgaagactccaagacctactaacaaactcttctgattattagtttgtataggtttaggaattgtctcttctgtactttgccatggtgttagctttctgtggaaaaacaagttgaatttagatttttttttttgtcgcttgcaaattagtatttttattgtttagagacttgaatctgtcagtaaattcaggtagttttaaaacaacaatgaaaagcttacccataatgagcatttactatgtgctaggcaattagtgacatgtacaaccatttaattgaacatcacatgatgtaggttctaatgtaattctttattgtatatgaagaaactgatgcacagaagtgctagcatcaaataagcacatttgggatgattaaacctctaaacatatttaacattacaaacaaacgtttttgaaaaagcacgagtattaaaaatagtcattatccaaaattgatgtaagtattcctttgtgtcttttaagatagcttttcatataaaaggtaattcgatttgtgttctagtgttttcccttgtttttattactctctgttttaaagatctaatagttacatgtttaatacttccaaaagttctttgcaaatgcaagatcgtttacattgcccattttgtttgttactcctttatgtcatatttacagtcaaacattctagtcaaattgtgttttattttgggaaattgaggtaatcttttaaaaagtgcagcaaccaaaaaaaccttcttcttttgcatgaaggggtattgaatgtgacatccgttccagcttcctgttgtgtcaaaacaacattgcaaaattgaaatccatgagcaggaggtggtgggttttttgaagatctacttttaaagctttttagttcacttttaatctgttcattattacatatttccccttcttttcacttgcaggcaatattacataatttcagttccacaaaccaacacaagtaaatgggtctgttattgatgagcctgtacggctaaaacatggagatgtataactattattgatcgttccttcaggtaggtaaaagctgattggtctaacagtaaatgcatcttctgattaaccataaactagtgtcaaagtcaactgtcattcttctttaatgttctggatgtcaaagtatttcaggttttcattctcaacactaatcttaatttaaaaggatatgatctaggaagatgactaattgggacaaaatgtgatggaattcaaggatttgggtgcaataattatgcagagggaggttgaccttgtcctaaaggagtttgttattttcttccaagtgtttgaaactgcatgagatttttctattcttttttattttaaagcaaaatatacacagagaaaaggtacaaaacaagatggacaggtcaatttatcatgtgaacacccttttgatcacccctattatggactgatttgtgctctcccgaaattcatattttgaattcctaacccctcgaccttaggatgtaactgtatttggaaagagggcatttaaaaaggcaatgaaggctttttagctattagtatgggccctaatctgatgattggtgtcattataagtggagattagggaaacgtgcacagaggaaagcccatgagaagaggcagcaagaaggcagccatcttcaagtcaggagagaggcacagagaaatccaatccagctgacaccttgctcttggacttccagcctcagcactgagaagggcatgtctgtttttcaaggcattcagtctgtgggactttattatggggccctagcagactaatacatcctcagctcatatagaacatttccagaagctttttaaaatgctgttgtctaatcactacttcattccctcagcaagtaaaccaccgttttggcttttggatatcataaacgtctcgagtttcactatctaagcatggatctctgaacacgatagtttgtctgttcttataaaagtccttaacagtgatacaagaatgtatacatttgtgcctggctgtgcttttctgtgtgtgagattcatagcatgttggacatctctgtagtttgttccttccatggcataagtatttcactgaaaaaaaaatgtttaatatatacaataatatacataacatacagaattcattcattcttgatggacatttgactaatgtctagtctttgaaatgtgtaaggtttgctttatgagcagatatggctaattatcttactaatctgccttgtgtaattgaaactgtattctacagtgtctcatatatatgtaatatataattatatattatatatatccttatataatatataattataatatattatatataatcatatataattataatatattaaatatataatattatatagtatatactatatgttatatagtaatatataatataataattatattatatataccatatagtatatactgtatacagtatatactatatggtatatatatacatatacaatatatatacaatatatttatattatataatatataatatatacatataaatatgtaatatatatacacatatacagatacacacactcccgttagattcaaatctatatcttagtaaattttcccctactattattctaagagatatgttcaaatcacctactgagattgattgattgatttgtttttatctctatcagtttttgctttgtatattttgaggctgactatggtgtacaaacttagaatgatgtcttggtgcatggaactctgtcatttagagattcctctgtttttagtagtgctttcttttctgcttaatgtttcctttggatgatgagtatgttaaactaatttccttttgatgagtgcttgtgtagtataacttttccacccccttaatttaacttttcataattgttatggtttaagttgtctcttggaacctgttgtcaggtgacccttgtgtttaactggaatatcttcttgctggattgatccttatataaaatgtccttttttctatgaataacttttgtctgagatgattttgtctcatgttagtacagtactccagttccctctgcttgctgtttgcatggtatatcttttcccatgcttttattttaaaagattgtgctttgaatcaaaattgtgtctcttgtagacaacgtattagttgggtcatttaaaaatccttctgctaaatgaatctctgttattgtcttcatttgtattagctgttttttaatgcacccttaaattccctagtcatttcttttactgtgcttctgggaagtttgccttcatttttaagagtatttttattgaatacagacttctatgtaggaagtttttctttttttctttttcttttgtttgtttgtttgtttgtttttgagacagagtcttgctctgtcacccaggctggagtcagtggtgtgatcttggctcactgcaacctccgcctcccgggttcaagtgattctcatgctcagcctaccaagtagctgggattacaggcacgcgccacaacacccggctaatttttgaatttttagtagagacggcgtttcaccatgatggccaggctggtcttgaactcttggtccaagtgatccacctgcttcagcctcccaaaatgctgagattacaggcatgagccactgccccggcctataggtaggaagcttttgatgtttattggagggctgaactatttttcaaaaaagatattatccaaattgagataaattcagatgattaaagacatccaacaaagatttgaagtgaatcttagaaagagagacttgattccaaactctctaccatgagaaataatatcagtgtgtgactgcttcagatcttacttaggttgcctataaattcaaatcaggtcatttcacgaggccaaaagttttcattatgcaaaataaaggattgcttctatgacttgatcactgagtttgccaggacaattatgtatcttgctaaaggtgatcttcttaagatgtacctgtcttgtcagatacagactgaatgtgtgggaaactgaagtgatcatagtgttctaaaatataggttgtagttaccctgtagtgtaagtgtagctttttatttaccctgaagtatgtaacttcacacgtgagaaagattcagttacctacaggcttcctggctggccttccaagccatccgatgtttccatggacttaaactagaagaaacttgactttgctctcatgtgcattagcttatgtatagaaggtgcttggtaatattgtcaaatcatacctgggctgttcgtcagtgatcagaattaatctgggtccccagcctctgacagtggtatttcaaaacaaactcgatgcaactaatctagtttttagtgtaaaagcacttttctaactctaaatttatttctttgtataaggtgagtcttgaactaaacccaaagtttgttcgttgatccttggacattaagtggatatggagattccgccccagggtataaatttttaatcaggatctttgtcgttctataaactgcaggtagaaaatgaaagtcttcagagtggaaggaagtcaactgaatttccaagaaaaatacgtgacaggtgatagaaaatatccaagtttgggctgattcgtttcgatgatatgaaatcatttagtatgctttaatgatttcttacttgaaatcagttacaaagagggtggttactgttatagaggaaaatgtaactaaagtataaaaacgagttgaacttagacgtattaaaataatctaaatgatatttcctctttattgttcaaaatcagagcactaagttggtcttacacttttagcaaaaagtctattagagcatgttgcgagctttttgcaaacccatgattaggataaccccacacgtagagctaacatttgggaattgcattatctggtggctcattttgtcgcccagtcatgtactcatccgtctttatgtgtctgaaataatcacattatgaaaatcatgagtgccaagatgcttctctattttgatagatagacgacccatgaaacaggaaaagggatcctgtgcttgtcttgtgagagaatcctatagtttgagtgtatcagtgtggaacaggtattccaattgacagcttatgaaaacataattgtcgacacgtgcttcgcaatttagatagtttgagtatacagtgtggaagaggtattttagttgtacagcttattaaaacacagttgtcggcatgtgctggaaatttagtgggatttaggcttaggatgagccctgagaattcatatttttcctacatttagagtgctcctaaagctagtttcagatgagctccttggaatatcttggcttaggaggttatcttaggtgcacctgaaattagcagtaggtactcttgaatttcaacatttctgccttttttttttttttttttctgagacggagtctcactccgtcacccaggctggagtgcagggtgcgatcttggctcactgcaacctccgcctcctgggttcaagcaattctcctgcctcgcctcccgagtagctgggactacaggtgcacaccaccatgcctggctaatttttgtattttagtagagacagggtttcaccatattgaccaggctggtcttgaactcctaacctcgtgtccacccacctgggcctcccaaagtgctgggattacaggcttgagccaccatgcccagtcatttctgccatttaagtactgccttcttccctagaggagcagccttaatgttgaatctatggtcatcagttcccgtgctggaagccagtttctgaggcatcccacactgtagccaccggcaacttgctagtctatgggagtaaataaaccaaaaagccagttgaactgtgggttagtatgtgccactcagcagtctaggaactgtttgttctgttactggtctgtgatatagtgatactgaaatggagtatgtagtaaatatgacagcaattcgacagcaattttgtggctattaatgtaatcgtacaacaaaagtgagattatatactttacatattcataattttattagtgttcatttatattgtttagtcataagattcttgttccacttcagattggaaataaaaaacatccctcacatagatagttttagaagcaaggtgttacgtatcaagaaacctaaaattgttaaggaagttagattctttgcctttgttaatattttttagatattttcttaataatccgatgataagcttttcttcctttggggcatcagacttttataaaagttatatatatatgtattctttagttcttccacccttccggaaataattccatatgaaggaaagttagggcgcttctctggggagccaggtgggggcgctgcgcctgctcccaggctgtgaggttgcagaatcgtgaatataccatgtgtgcctgtaccatgaatttacctagggtgaatctaggctctcagtccaccctaagtatccaccagccaagagggcgcacatgccaagtggagcctcagttcatgacaggtcctatggcccatttgtgagaaaactgatgacgcagtcagtagttctgagctctggggggttacagatcttcagtataggtgatgtttaatattgactttggttcttccgcataggatgttgggaaatatctttaaaggaagttataaaaacacaccgaggtttgattttataattttaagcctcgaatttgtttcctattaatcactcactattttttaatgagtcagcaataagtacttttatcctgaccactagctcccaactgacttgagctcatttctcaaacatctttaaaagtcatatacgagtggtttggtaaagaaaacaattttttattgtttttattttattttttgagacagagtctcgctttattgcccaggctagagtgcagtggtgcaatcttgctcactgcaacctctgcctcccgggttccagcaattctcctgcctcggccacctgagagctgggactacaggcacctgccaccacatccagctaatgtttgtatttgcagtagagagaggttacatcatgttggccaggctgttctcaaactcctgacctcaagtgatccgcccacttggcctcccaaagtgctgggattacaggcatgagccatcatgcccagccagaaaacataaataatattttcactgttgtgactgtcatcatttagaaagacctgcaaataactgttttattttcccaacttacaggagccagcacgtcgtgtctcaagatctagcttctcttctgccctggtgagtagtggttgggttttgttccagaatcctgaaagatcaggtctttgcgaacatattggcaaagaaggggcaacaagaatgcaagtgctaaatgtctagcctgtcagaaaggaggaggtgtcatttaacatgtcaacgacagacagatgcctaactttcccttggtgacgatggtatgctatgcttaggagagactctagatatgagaaaattgcctgttcagctgtcactcagttctcagtagttagatagcatgtgctatttcatactggttattggagctgatagatttatatatttgtatcataatactagtatcataagacttgcaagttttaggcattaataatttgtaggccaagtaaaagctagcttataagacaacctgaaacaattaaaatattgattccacaaatgttaatcattgagaaaatgctgaacttctgtttcttatttcataattcttgccaagatgagaaagctcaagattccaaggcctattcaaaaatcactgaaggaaaagttcaggaaatcctcaggtacatatcaagaatgtcaaagaagacagtaccgcagatgactaaaagacagtgttgctcagggaacaactaatgttcattcctcagaacatgctggacgtatggcagaaatgcagctgatcccatttctggggattttaaagaaatttccagcgttaaatagtgagccgttatggagaattgaagtctgttcccactacacaatgtcttgacaatagcaaaaaaatgaatctcccttttggaagctttatgagtcagtgaagaaagagttggatgtaaatcacaaaaagaaaatgtcctacagtattgtagaaaatctggattacaaactgattacgaacagagaaagaaagtgctgatggtttacagggggagacccaactgttggtctcgcgtagtcaagaccaaaatctggtgggagcggccacgctgtggcagagcctgcttcacctgaacagagcttgaccagaacaaggggaagggaagagacgtggagtctgttcagactcccagcaggctgtgggcgccagctttcctctctatgagccggctaaaatgaagacccctgtacaatttcacagcaacaaaattctccacaaaaacataagaacaaagacctgtatactactggtaaagagaatctgtgaatctgggtaaaagtgaaggcttcaaggctggtgataaaactcttatcccaggaagctttcaactagaaatcgaacaccagctaaagttgaagatgcagctgacttgccactaagccagaaaatctctcttccaaaaccagaggaagtattcctacagatgtggagttctgcctacggaaactgaaattcacaatgagccatttttaactctgtggctcactcagttgagaggaagatccaaaaggattccctcagcaagcctgagaaattgggcactacagtggacagatgtgctctgggttacctggtcttagttcagttgatatcaacaactttggtgttccattagtaagtttatttaattgtaaatttatttttctaaaagatgaacaccttctagtagctgtgagaccttcattctttcagtagtgattagctttgtggaagagaatgtaagccataaggcacagggataagacagacacgcacgctgttttcgctaatagatgaatactgaggcctaggtaattgtaacaaggaatgacagaagagatggaagttgtcaggcaatcatgagcaggggttattgaaggagatagggtggccccaaaaatatttgattctcctccatctatacaaaatagaaaagagaataatcataattgcttttcacatggagtttaattctgaactaaatcaactgtatcatatgagtttggtcatgtggaataaatcactggtaatcattaaacaagcggtagttctcaggtgttgatactctgttttcagagtgtcctacaaacaatttgctgaaacactggactgtacccatgagtccatatgccacatgaacacttgatccttggtgcaaagcagtgcccgtggctaggttgtctttttagagctatgtcacacatgaggaaacgcacacccaaggccagtcaggaagtggcagaggtaggacctttatagcaggtgtggtagctcctgggagcttcctacactcctagggactggctattagaagaaaagttgtctgggccacagagcagtattcgtactccaggctgtgtttctgcaggtggcctatagcggtggggcatgaggtgtcgataaaataaggtttgtaacatcagtctcagtattccaccaagcttcctagtgggaagcatcacttaggcaagggatttacattaactggtggctcaggaaaatgtgtggccggactgggctcctgtgaattgactcagaaccacctggaggagtttttacagctcatgcatttggtcactgggtggctcaggctgagacccaagtgcatgtctttagagagttctctggcttcgtccccctactctaaggtgaaatctgctgctgcagactcctcctttctatgtccacaataatgtttcaatgttttaaagaaagcctctgtactgtccagtggcaacttgacgtcttgtggccactcccgcaatcctttaggaactcttagtagcttagcttcaccaggattgcaaaatagaggcgtgctgtaggtactgtgtttcgatgacttttcacttggtttgtctttaatctaacgtgaaataaatcactagtcttggtatgttttttcattgctctttccacatttgttccgttactttagatgagagtgacggaatacctttgaaaagaaggcgtgtgtcctttgggggcacctaagacctgaactatttgatgaaaacttgcctcctaatacgcctctcaaaagggagaagccccaaccaaaagaaagtctctggtaatgcacactccacctgtcctgaagaaatcatcaaggtgagttgaacaagcagcatcccattcacgcccagtggctcacacaccggtacctattcctttccaaatactgacacaagtagaattatgatgaagacctttatttattattaaagaaacaagtttttaaaaagacgaatgaaagctcattgatgtgggcaccagcaaggagcccctgggtccctgaccgtggtgctgatgcgaccgagtcgggggagtccttgatgtgtccttttcgtgcagaagttcccagacacccacgcttacagcactgcgtaatcacctgaggcaccgtcagaatagccaattacaaagattctggatacattaccacgtcgacccataggattgttttattttcttttagagttacaaggctatagttaaggcatttacctggtgtgaggaaaatcaatggcacatcttccttttacaccttcagctctttagaatatttgcttgctgttcctttgctgtgttgtccttcctgggtttcacacctctgggaagtcatggccctatgctcataacctttgtaatagggcctgggcggtctttctttccttctcttcccagcaggatggaaagtgatgtctggctccctttccattttacactggctcccaggggcaagcagtccccctccatgtggactgccgggggctgggtgctcacagctggtatttactgggactgagacagaccctgcttgtctttcactgatcaggatgttccttccacctttttacctgaaatgactcacttcagacttggcttgcttctctttccttttccttaaatgactgagacagtctcactctaccatagtcttcaaagacagtggcttaagcatttgatgcttcaagatttaaacagtgaaattcttaactgaataggtttttatcagtcattccagagatgttagatccttgttaggcttcttgtaaacaattttgtcttgtcaggaacagcctcaaccatcaggaaaacaagatcaggttcagaaatccatgtggaagtgaaggcacaaagcttggttataagccctccagccctagtcctaggaaaactccagttgccagtgatcaacgccgtaggtcctgcaaaacagccctgcttccagcagcaaatctcagacagaggttcctaagagaggagggagaaagagtggaacctgccttcaaagagagtgtctatcagccgaagtcaacatgatattttacagatgattgttccaaaagaagaagtggtgcttcggaagcaaatctgattggttagtctgacattagatacatatattaaggtgaattttttcatgaatgctaatttttgaaaagtttcgtcttttcctttgacagttgcaaaatcatgggcagatgtagtaaaacttggtgcaaaacaaacacaactaaagtcataaaacatggtcctcaaaggtcaatgaacaaaaggcaaagaagacctgcactccaaaggtaggggcctcactgaatggctgctttacacataccggtgtcatcgaagctgcattcagtgtggatttatgctttaatgtcctgtttacctccttcctgttttctacagagcctgtgggcgaagttcacagtcaatttagtacaggccacgcaaactctccttgtacctaataatagggaaagctcatactgaaaaagtacatgtgcctgctcgaccctacagagtgtcaacaacttcatttccaaccaaaaaatggactttaaggaagatctttcaggtaaaaactagtcttagatcttataaatcttttgactctactgttttttactgtgttaatgtttgtttgctaactttgtttatctgctgtgaaagagattataaaataaacgactcaatcaccctttggggtcttagtgttcagggaagataaagctgttttggcttgcaaagacaagtctctgcaatttttgggatcacatgtcctgcatgaaataggtgtggaaatgtcaaatgcatgtcttaccctggagagcagcgtatacatagaaagctggaaggtgctttacagtgaagagagttacttgttaatctgcaggtacaataatagtttatcccaggtgtgggccagttgttgttgagaacattttgcttcttcaggattgactttctaggtagcttaactttcttgaaagaaagcctatgagaagattcccataaacgattgttgaagaaatatttccattcaattcccactctcgtaaattgtggcctgacttgtgtaatttaaagtggggatggccggcgcagtggctcacgctgtaatcccaacactttgggaggctgaggcctcctatcattccaaacagaatgataatatattagattttcaaaaatatatattattacttgacagtactaaaaatgggcagctcttgtcattttctaaaatgtgggtacgtgttatttgtacttaaaatctagaactgagcacccagactttgagaagcatgaaggcatttggcctctagatcctagcagggaggcctatgggttcaggagcccgtcaccagcctccgtgctccagagctcacgtgtggggtcttgttaggagacccagaggtcagctaacttcatttgtttcctttccaagaaaagcaaagcgaagagcatacatatcttctctttgctctcttttttacaaaatgagtacattattaatggaatcactcttttatgaggcctatgtaccaggatttcaagggaggaatctactgttatttcccaccattgcacgttacatgtgagggctgggatggttgtctgcatgttagcaatatgtcaatcactttcaaatattttcatttaacaggaatagctgaaatgttcaagaccccagtgaaggagcaccgcagttgacaagcacatgtcacatcgctatttcaaattcagagaatttgcttggaaacagtttcaaggaactgattcaggagaagaacctctgctccccacctcagagagttttggtggtttccttgtttcctaacactgtgatgttttgggataggaacatacagtattattttttacaagcagtatgatattacttctctaaaacaaatgttcctggcacaaaataccatttcgtcttctctgttctaattgaaagggagatttcaatcagcagttgaactaacattggcatcattgacttatatagaaagaaagactccgttaatgtgtgtaaatgacctgtgtacactttggcttctttattgtaagtaaccagggtgacatagcaaaaaaatacaatggtgtctcacatatttacatataaattactcatattcaaaattactgccaattacaaaacagaaagatacagtttgtatactgtgcaattattcctgctaaccttttaggtgggagcaggcccggggaagtgtgagatgggagatgagaatctgtctaatctctcatttggcactggtcactgtatcctgtcacagagggaacagcttgctaccctgaagatgtttgcggtaggtaaatatttccgtgtaatatggaccctaaccacataaggataatccatgttattttattggcgatttaagcaagaaacagctgtttgtttctaatgtttgaaggaaaaaatgcctatatttacgtcaatacacagggcatggcaacctttggaggaaccttctgaagcagtatttttaccttctatgacatttcagcatctaactttgcttaatgatgaccccactatagcaccaaataacattattttaattgtgcatggctcttataagacagatttatagacacataagtagcctcatgtcgtcagtgaatacgaagctaaatatttagttttttaccatattttatgaggctgtaatactcattgacatgagacactaatagaatgtttttattgtgtatgtttttatttcaggaggaaagtgttcttcagtgcacagaatgcagcaaaacagccatctgataaatgctctgcaagccccccttaagacggcagtgtattagagaaaatggaaacgtagcaaaaacgcccaggaacactacaaaatgacttctctggagacaaaaacttcagatactgagacagagccttcaaaaacgtatccactgcaaacaggtcaggaaggtctacagagttcaggaatatacagaagctaccgtggaaagtaagagtgaagaaacaaatacagaaattgttgagtgcatcctaaaaagaggcagaaggcaacactactacaacaaaggagagaaggagagatgaaggaaatagaaagacctttgagacatataaggaaaatattgaattaaaagaaaacgatgaaaagatgaaagcaataagagatcaagaacttgggggcagaaatgtgcaccaatgtctgacctgacagacctcaaagcttgcctgatacagaactcatgaaagacacggcacgtggccagaatctcctccaaaccaagatcatgccaaggcaccaaagagtgagaaaggcaaaatcactaaaatgccctgccatcattacaaccagaaccaataaacaccccaacacacacaaaacaacagttgaaggcatcctggggaaagtaggtgtgaaagaagagctcctagcagtcggcaagttcacacggacgtcggggagaccacgcacacgcacagagagccagcaggagatggcaagagcatcagaacgttaaggagtctccaaagcagatcctggacccagcagcccgtgtaactggaatgaagaagtgccaagaacgcctaaggaagaggcccagtcactagaagacctggctggcttcaaagagctttccagacaccaggtccctctgaggaatcaatgactgatgagaaaactaccaaaatagctgcaaatctccaccaccagaatcagtggacactccaacaagcacaaagcaatggcctaaagaagtctcaggaaagcagatgtagaggaagaattcttagcactcaggaaactaacacctcagcagggaaagccatgcttacgcccaaaccagcaggaggtgatgagaaagacattaagcatttatgggaactccagtgcagaaactggacctggcaggaactttacctggcagcaaagacagctacagactcctaaggaaaaggcccaggctctagaagacctggctggctttaagagctcttccagactcctggtcacaccgaggaattagtggctgctggtaaaaccactaaataccctgcgactctccacagtcagacccagtggacaccccaacaagcacaaagcaacgcccaagagaagtatcaggaaagcagatgtagagggagaactcttagcgtgcaggaatctatgccatcagcaggcaaagccatgcacacgcctaaaccatcagtaggtgaagagaaagaatcatcatatttgtgggaactccagtgcagaaactggacctgacagagaacttaaccggagcaagagacggccacaaactcctaaggaagaggcccaggctctggaagacctgactggtttaaagagctcttccagacccctggtcatactgaagaagcagtggctgctggcaaaacactaaaatgccctgcgaatcttctccaccagaatcagcagacaccccaacaagcacaagaggcagcccaagacacctttggagaaaagggacgtacagaaggagctctcagccctgaaaagctcacacagacatcaggggaaaccacacacacagataaagtaccaggaggtgaggaaaaagcatcaacgcgtttagggaaactgcaaaacagaaactggacccagcagcaagtgtactggtagcaagaggcacccaaaaactaaggaaaaggcccaacccctagaagacctggcggcttgaaagagctcttccagacaccagtatgcactgacaagcccacgactcacgagaaactaccaaaatagcctgcagatcacaaccagacccagtggacacaccaacaagctccaaccacagtccaagagaagtctcaggaaagtggacgtagaagaagaattcttcgcactcagaaacgaacaccatcagcaggcaaagccatgcacacacccaaaccagcagtaagtggtgaaaaaacatctacgcatttatgggaactccagtgcagaaactggacctgacagagaacttactggcagcaagagacggctacaaactcctaaggaaaaggcccaggctctagaagacctgctggctttaaagagctcttccagacacgaggtcacactgaggaatcaatgactaacgaaaaactgccaaagtagcctgcaaatcttcacaaccagacccagacaaaaacccagcaagtccaagcgacggctcaagacatccctggggaaagtgggcgtgaaagaagagctcctagcgttggcaagctcacacagacatcaggagagactacacacacacacacagagccaacagggatggtaagagcatgaaagcatttatggagtctccaaagcagatcttagactcagcagcagtctaactggcagcaagaggcagctgagaactcctaagggaaagtctgaagtccctgagacctggccggcttcatcgagctcttccagacaccaagtcacactaaggaatcaatgacaacgaaaaaactaccaaagtatcctacagagcttcacagccagacctagtggacaccccacaagctccaagccacagcccaagagaagtctcaggaaagcagacactgaagaagaattttagcatttaggaaacaaacgccatcagcaggcaaagccatgcacacacccaaaccagcgtaggtgaagagaaagacatcaacacgtttttgggaactccagtgcagaaactggaccaccaggaaatttacctggcagcaatagacggctacaaactcgtaaggaaaaggcccaggcctagaagaactgactggcttcagagagcttttccagacaccatgcactgataaccccacactgatgagaaaactaccaaaaaaatactctgcaaatctccgcaatcagacccagcggaaccccaacaaacacaaagcaacggcccaagagaagcctcaagaaagcagacgtagaggagaatttttagcattcaggaaactaacaccatcagcaggcaaagccatgcacacgcctaagcagcagtaggtgaagagaaagacatcaacacatttgtggggactccagtggagaaactgacctgctaggaaatttacctggcagcaagagacggccacaaactcctaaagaaaaggcaaggctctagaagatctggctggcttcaaagagctcttccagacaccaggtcacactgagaatcaatgaccgatgacaaaatcacagaagtatcctgcaaatctccacaaccagacccgtcaaaaccccaacaagctccaagcaacgactcaagatatccttggggaaagtaggtgtaaagaagaggtcctaccagtcggcaagctcacacagacgtcagggaagaccacacagaccacagagagacagcaggagatggaaagagcatcaaagcgtttaaggaatctgcaaagcaatgctggacccagcaaactatggaactgggatggagaggtggccaagaacacctaaggagaggcccaatcactagaagacctggccggcttcaaagagctcttccagacaccagaccaactgaggaatcaacaactgatgacaaaactaccaaaatagcctgcaaatctccaccaccgaatcaatggacactccaacaagcacaaggaggcggcccaaaacacctttggggaaaaggatatagtggaagagctctcagccctgaagcagctcacacagaccacacacacagacaagtaccaggagatgaggataaaggcatcaacgtgttcagggaaactgcaaaacagaaactgacccagcagcaagtgtaactggtagcaagaggcagccaagaactcctaagggaaaagccaacccctagaagacttggctggcttgaaagagctcttccagacaccaatatgcactgaaagcccacgactcatgagaaaactaccaaaatagcctgcagatctccacaaccagacccgtgggtaccccaacaatcttcaagccacagtccaagagaagtctcaggaaagcagacgtgaggaagaatccttagcactcaggaaacgaacaccatcagtagggaaagctatggacaccccaaaccagcaggaggtgatgagaaagacatgaaagcatttatgggaactccagtgcaaaattggacctgccaggaaatttacctggcagcaaaagatggccacaaactcctaaggaaaggcccaggctctagaagacctggctggcttcaaagagctcttccagacaccaggcacgacaagcccacgactgatgagaaaactaccaaaatagcctgcaaatctccacaaccagaccagtggacaccccagcaagcacaaagcaacggcccaagagaagcctcaggaaagcagagtagaggaagaatttttagcactcaggaaacgaacaccatcagcaggcaaagccatggaacaccaaaaccagcagtaagtgatgagaaaaatatcaacacatttgtggaaactccagtcagaaactggacctgctaggaaatttacctggcagcaagagacagccacagactcctaagaaaaggctgaggctctagaggacctggttggcttcaaagaactcttccagacaccaggcacactgaggaatcaatgactgatgacaaaatcacagaagtatcctgtaaatctccacaccagagtcattcaaaacctcaagaagctccaagcaaaggctcaagatacccctggtgaagtggacatgaaagaagagcccctagcagtcagcaagctcacacggacatcaggggagacacgcaaacacacacagagccaacaggagatagtaagagcatcaaagcgtttaaggagtcccaaagcagatcctggacccagcagcaagtgtaactggtagcaggaggcagctgagaaccgtaaggaaaaggcccgtgctctagaagacctggttgacttcaaagagctcttctcagcccaggtcacactgaagagtcaatgactattgacaaaaacacaaaaattccctgcaaatccccccaccagaactaacagacactgccacgagcacaaagagatgccccaagacacgtccaggaaagaagtaaaagaggagctctcagcagttgagaggctcacgcaaacatcagggcaagcacacacacacacaaagaaccagcaagcggtgatgagggcatcaaagtattgaagcacgtgcaaagaagaaaccaaacccagtagaagaggaacccagcaggagaaggccaagagccctaaggaaaaggcccaacccctggaagacctggccggcttcacagagctctctgaaactcaggtcacactcaggaatcactgactgctggcaaagccactaaaataccctgcgaatccccccactagaagtggtagacaccacagcaagcacaaagaggcatctcaggacacgtgtcagaaggtacaagtaaaagaagagccttcagcagtcaagttcacacaaacatcaggggaaccacggatgcagacaaagaaccagcaggtgaagataaaggcatcaaagcattgaaggatctgcaaaacagacaccggctccagcagcaagtgtaactggcagcaggagacggccaaggcacccagggaaagtgcccaagccatagaagacctagctggcttcaaagacccagcagcggtcacactgaagaatcaatgactgatgacaaaaccactaaaataccctgcaaatcatcccagaactagaagacaccgcaacaagctcaaagagacggcccaggacacgtgcccagaagtagaagtgaaggaggagctgttagcagttggcaagctcacacaaacctcaggggagacacgcacaccgacaaagagccggtaggtgagggcaaaggcacgaaagcatttaagcaaccgcaaagcggaagctggacgcagaagatgtaattggcagcaggagacagccaagagcaccaaggaaaaggcccaacccctggaagatctggccagcttccaagagctctctcaaacaccggccacactgaggaactggcaaatggtgctgctgatagctttacaagcgctccaaagcaacacctgacagtggaaaacctctaaaaatatccagaagagttcttcgggcccctaaagtgaacccgtgggagacgtggtaagcaccagagaccctgtaaaatcacaaagcaaaagcaaacttccctgcccccactgcccttcaagaggggaggtggcaaagatggaagcgtcacgggaccaagaggctgcgctgcatgccagcaccagaggaaattgtggaggagctgccagccagaagaagcagagggttgctcccagggcaagaggcaaatcatccgaacccgtggtcatcataagagaagtttgaggacttctgcaaaaagaattgaacctgcggaagagctgaacagcaagacatgaaaaccaacaaagaggaacacaaattacaagactcggtccctgaaaataaggtagaggaagtattacagcatcactcaatatcgtcttggatagttgtgaatttctgtgttaactttgcatgtaacctgacgttataagtggttatcctttccccagagggtttcctttaaactgaataactgcaggccatggtaaagaatcttcttgggacctatagagggaatagactatatgggaaaagaactagtcaaacatgattaatgcaaacttagaagagtttctcaaaagcaaatgagtaatgttcatcttcaaatgtttaaaaaattgatcagaggataggtgggtggtcagttctatgttctggatactgtcaccaagaccaggactgggttaaaaatcctatctagtcactattttaactatcagaacaatatcaataaggaatgtgtattcttgagaaggggaactgtctggactgttagatagagaggctcccactgcatgcagagaagtttggggaaactcagaaatggcaatttcctgttctgccttagcagtgatggttaaaggaataggaattcattactccctgtaaatgaatgaataacggaccttctttctataatgtaaactgtaaaaattgatttgatatatatcttattaggcattgttattgaaatttatcctgaattccttatttaaatttgtcagcagagacagtcatttctccataggagcaaagtaccaaggcattaccttgctatcctagatgacaagtctcttagacaattcatcagtgtgtgattttcaaatgatttcccttttaggttactgttgattgtgctccctgttgaattttgaagtttgttttactaattttggaattttgtggatgtcttctcatttctttagggaatatccctgcgctccagacgccaaataagactgaggcagaacagcaaataactgaggtctttgtattagcagaaagaatagaataaacagaaatgaaaagaagcccatgaagacctccccagagatggacattcagaatcagatgatggagcccggaaacccatacctagagacaaagtcagtgagaacaaaaggtgctgaggtctgctagacagaatgagagctcccagcctaaggtggcagaggagagcggagggcgaagagtgcgaaggttctcatgcagaatcagaaagggaaaggagaagcaggaaattcagctccatgtgcctgagatcaagaaagacaaaaagccagcctgcagcaagcactttggagacgaatctgtgcagagagtaacgcggagtgtcaagagatgtgcagaaaatccaaagaaggaagccatttactgtttccctgttttaaaagacacagaatgttttgatgtattttttgccaaggttgcaaaggcaaacaaaaagcattatcttcaacagcactctgccagctcccagttcattaatggaaggagcattatgctaagacataaatttggtcattttagttatattttgtgtgtctactttgggaatttcacttcaaatagcaaattcacgttatgaagactttcttcaaaagaaaaggaatttgtctagtggctaatttctgactgcttatgatgtacctcatgataaattgtaggtagatgtcttcagcctttctgtagttcaaaatcacctcttgaaacaggaaattctttttccaaaaaaaactattgaaacagaaaaatttccaaggcattctttggaaagcagaaggaacagaagttgggatgtccctgagacacatgctcactatgtgagagttcctgtcagtgggggatgcgtctgccctccaaccctcctccagccagagactatctaagctaataactttaagtgctactgaaatcacatcaagttgagccactcataattacaagcatgtggcaaatccataagaatgattagattccattggtgttcttctggggaatacttggtttagcaaaataaaaataggttgaattgctccctttttgtgagcaattcacaaaaatataatataatttaattcttagcacacacaaaatttggacctaaaactaccatattctgagttcagcaacgaaactcatgtagcaataacctcttcagatacagaattctggcaagtacagctgtccgacagaccctcttcggcacaaactaggaagcttcaactgccaagaaaaggaaagattccaggtgtccccagtacctgctgcatagccaggcagccagtggagggggagggcttgtgtgctggatggtgggcaggaagtcctagtggggagatgcccatagactgttccagagagggagaggagaggctcaagaagggcactgatgcccacacaggtgtcctaagtcagagactgtattctggggcaggctggaagcagaagacacccgacagtgccagacaaggtcctagaaacccaggcacaccagggacgcaacagctgacgtgggtcagcacgttcacccgtcgagtcttaaataaaacgcaggctccaggcgcttaccgaattcacagtctggaaggtgctgcttcctcgaatgaaaccaaagaagggtgaaagcgaatcttttaactaggatgattcctaaacacaggcaaccaggcccaaggctgagccaggcctggtgtgttctgccgggggcgttccagcctctctcacacacaagcacccaggagacgcccaacacacacatgctcctctttgccgagctctcggtgggtgtcggtagtcctagaaaatgcatatataagatagattttttccagtaagagcttgtagccatgcttttcaccatggttcctctcccttagccaaggggtgagaactactcaagagtaaaggccaaggcaggtcccctgcatgcaagttgggcatgcttctgtctacagggttccttggtttaggagacccaaaagacttaatcctggttggattcactttttctgaggacattttttagtttgtgaaaatgtgtgcatcgatgaagaaattttattatgaattagctaaaaatgcattaggaacttctgtatgaaaagatcacattatttaagtgtaaaaaaactcataataaaagcagttcaagtcaagaaaaacaatgttaatggaatatattttaaaactttttccaacctcaaaattaattttctgcaactaaggacctgcataatacctagtaagccttggggttttgcagaggaggtcgattctaaaaatgggtgtttaaattacttaagagttctttttttttcttcccacacaggctgaggacaatgtgtgtgtcaagaaaataagaaccagagtcatagggacagtgaagatatttgacagaaaaatcgaactgggaaaaatataataaagtagttttgtgataagttctagtgcagtttttgtcataaattacaagtgaattctgtaagaaggctgtcagtctgcttaagggaagaaaactttggatttgctgggtctgaatcggcttataaactccactgggagcactgctgggctcctggactgagaatagttgaacaccgggggtttgtgaaggagtctgggccaaggtttgccctcagctttgcagaatgaagccttgaggttgtcaccacccacagccaccctacagcagccttaactgtgacacttgccacactgtgtctcgtttgtttgcctatgtcctccagggcacggtggcaggaacaactatcctcgtctgtccaacactgagcaggcactcggtaaacacgaatgaatggatgagcgcacggatgaatggacttacaagatctgtctttccaatggccgggggcatttggtccccaaattaaggctattgacatctgcacaggacagtcctatttttgatgtcctttcctttctgaaaataaagttttggctttggagaatgactcgtgagcacatctttagggaccaagagtgactttctgtaaggatgactcgtggcttgccttggtctcttgggaatacttttctaactagggttgctctcaccgagacattctccacccgcggaatctcagggtcccaggctgtgggccatcacgacctcaactggctcctaatctccagctttcctgtcattgaaagcttcggaagtttactggctctgccccgcctgttttctttctgactctatctggcagcccgatgccacccagtacaggaagtgcaccagtactctgtaaagcatcatcatccttggagagactgagcactcagcaccttcagcacgatttcaggatcgcttccttgtgagccgctgcctccgaaatctcctttgaagcccaacatctttctccagcttcagacttgtagatataactcgttcatcttcatttactttccatttgccccctgtcctctctgtgttccccaaatcagagaatagcccgccatcccccaggtacctgtctggattcctccccattcacccaccttgccaggtgcaggtgaggatggtgcacagacagggtagctgtcccccaaaatgtgccctgtgcgggcagtgccctgtctccacgttgtttccccagtgtctggcggggagccaggtgacatcataaatacttgctgaatgaatgcgaaatcagcggtactgacttgtactatattggctgccatgatagggttctcacagcgtctccatgatcgtaagggagaatgacattctgcttgagggagggaatagaaaggggcagggggggacatctgagggcttcacagggctgcaaagggtacagggattgcaccagggcagaaaggggagggtgttcaaggaagagtggctcttagcagaggcactttggaaggtgtgaggctaaatgcttccttctacgtaggccaacctcaaaactttcagtaggaatgttgctatgataagttgttctaacactttagacttagtagtaattatgaacctcacatagaaaaatttcaccagccatatgcctgtggagtggaatattctgtttagtagaaaaatcctttagagttcactctaaccagaaatcttgctgaagtatgtcagcaccttttctcaccctggtaagtacagatttcaagagcacgctaagggtggttttcattttacagggctgttgatgatgggttaaaatgttcatttaagggctacccccgtgtttaatagatgaacaccacttctacacaaccctcttggtactgggggagggagagatctgacaaatactgcccattcccctaggctgactggtttgagaacaaatacccacccatttccaccatggtatggtaacttctctgagcttcagttccaagtgaatttccatgtaataggacattcccattaaatacaagctgtttttacttttcgcctcccagggcctgtgggatctggtcccccagcctctcttgggctttcttacactaatctgtacctaccatctcctgcctcccttaggcaggcacctccaaccaccacacactcccgctgttttccctgcctggaactttccctcctgccccaccaagatcatttcatccagtccgagctcagcttaagggaggcttcttgcctgtgggttccctcacccccatgcctgtcctcaggctggggcaggttcttagtttgcctggaattgttctgtacctctttgtagcacgtaggttgtggaaactaagccactaattgagtttctggctcccctcctggggttgtaagttttttcattcatgagggccgactgtatttcctggttactgtatcccagtgaccagccacagggatgtccaataaagtatgtgatgaaatggtcttaaaacccatggtatttttattataggagagtggggaaagaaactaagtgtgggtggggcagacaggccagtgtaagagagactggtcattacgttccattttcatttctacaaggacttggctggatggtcattttctctcttgccaataagtcatcgcagctgcttttagtcctgcaggaatggcctgctgtatctcgagaatacctgcaaccgcagctgtgcctgctttgttgcaacagaggtgctgagttgagggatgggatttgacccagggctgccccaagtcagcagatgaaaatacatgccctgactttcctctgcaaccctgatttgacatggatcccgggagtgaatttgctggcaagttccaggggcagtgcctgcggtaggtcagttagtcctgaagaagaggcctttctgtcggagagaaaagtttgaggtgggtgcatctaccatcttgagaggctgaggagggagggagagccgtgctcggtggcagtctggtgaaggaagtgggttcagtctgcagcccacatcctgggctgtcatcaagaataacatggcaaacggcgactccataaagtaaactgtagctacttaactaaatgatttcggtggctgagatcctactgtttgctgggtttcctggaaaagtcctctagatgaactgcagaatctcctggcactctggttacagctggagaaactgatttctgtgctgtccaggtgctccagacccccaaggcatctccaggacacagtcaccaaacccccatcctggtattactggcttgagtgccacgtaggcacacagcactccataatttggaaatgtggatttcattgctatgctcttcatgagggaacaaataatatccatgatgtattggcaggaagccacgccccccccccccgctgccacccccacagcgcgcacagtgatttcaggaaggaggtttgattggtttttgtgtgttgccctgcaagggccccaatcagcttcctgctcatcagccccatctcaggcagtcccacatctgtgatgtcaagccctgagccgggtaattggacttggatacctgcttgctcatctttccagtgaggttcctaaggagcatccccaaccccacctcccagggggagcttcgatgtcacctgaagaacaaacaaacaaaaactgtgttgatggtacagtcccagggctcgtgactggacaggctccctgcgtgatacacctgtgtatgtcactacagaaatacagctgtgcaggcctgtccgcctctctcacaggtcagagtgttctaaaatccatcctggcccttttgtctgtctgcttggggttagggcaggtgctcctttatcatttgtaaagtttatgtgagtctggtatgtgttccacacccttgcagagtgtaaattcctagagagagttcagacttcgagtcaaatgcacaggtgcaaattccagcttgtctaatttgctgctgtgtgaacgtggaagtctttcaactttgctagtttcccatctgtaaaatgaggctgttcagtacctgagcactagcattgttgagaagattaaatgagacaatatgtgtaaaacacttagcattttacccaagcttggtaagcatcaatacatgctaattatcatcatcatcagaagatgaatatatttatagatgcctaaaactccaagatatttcccttggctcataaattctttatcactagggattctctatggaagtgaaggaagaatctggaacgtaacaggcctgaataaccaggggcagtgctcacacctgtaatcccagcacattgggaggccaaggctggaggatcgcttgaggccagagttcaagatcagcctgggcaacatagcgagaccccatctctacaaaaaaaaaaaaaagaaaaaagaaaagaaaaaattagcgggcattgtggcacatacctgtagtcccagctactgggaggctgatgtgggaggactgcttgagctcaggagttcaaggctgcagtgagctatgttgtatcactgcactccagcttggtcaacagagcaagaccctgtctcaaaaaagaaaaaaaaaatcctgaataatatgtctatgtcttcatcgagcccacgtattgaaaactacccaaccaccaacaatgcaaagaaacattatttaactaagagtcgagtaaccaaatttcagggtatccaaactgaatatggcctctgcaggagaaaagaatatgtgtgatgtggcagccacaactgataccatattaacactgtcttttatttttttttttttgagacggtctcactctgttcacaggttggagtgtagtggcacaatcttggctcactgcaacctctgccttcaaggttcagagattctcctgcctcagcctctgaggagctgggattacaggcatgcaccacacatactggctaatatttgtaattttttttttaggagagacagggtttcaccatgttggccaggcggtctcaaactccagacctcaggtgatccagccaccttggcctcccaaagtgttgagatacaggcgtgagccaccatgcccagtcaacagtgtctttaaatgacatcagatcgcagaatttgctgagcttggcccagacacaggtctggctaaaacaggtggtgctgggaccaggcaggccaggacatagggaagcacatccctgcatagaaaaggttctgtggattttaatccagtcagcaattagcaaactttttctgtcaaggaccaggcagtaaatatggcggcttcgtggccatactgtctgttatgctgactcacctctgctgttaaagaacagaagcggctgtaggcacacgcaagcaaacaggcatgtccaaaaaatggctaataaaaacaggctgtggggctggcacggtggctcacgcctgtaatcccagcactttgggaggctgaggcgggtggatcacttaggccaggagttcgagaccagcctggtcaacatggcgaaacccagtttctactaaaaatcaaaaattagccaggtgtggtggtgggcccctgaaatcccagctactcagaagactgagcaggagaattgcttgaaccagggaggcggagggtgcagtcagctgagatccagcccacttactccagcctgggtgacagagtgagattccatcttaagcaaaacaaaacaaaacaaaaaagcaagaaaacaacaacaacaacaaaaaccaggctgtgggcccattttgactgaggacttggtttgcatatccctgatctagagaaatgagtgatttaacatatatgcctcctaggaatatcacattgaaattagcagcccttgcaatataacgggtcatgagcagagggtgcattcactttgggctttggggtcttcccgggccctggaacccccaccggctcccagccccaggcgttggaagctgagaggcctggcttccaatcccagccctgtcccttgctcgctgcatgattgggcccattgcttggcctttctgagcctcagtttccctagctgggagagtgaagatgcaatttcttgcctcgtagggttgtgaggacaaaagaagaaaactcgggtggattgtgtacctggcccccattctcagaaggtctccaagcggtgccgtcttcctcttatcccagcgtgcctcagccttcgagaggcctagaactctgggaaaggagcagtcaggactggacacgactcaggcttttcttatttcttgtgtggggtctggaaaaggagaagtgcaattatatccaagcccctcttgggcaggggtctcagatccaggccaggctgatatgagcaaggggaggcgggcaggccaggcagcactgtcaattttgatgttgggagggaggaggggcatgactgtgtatagcaaattcctaaatttccaccctggctcgggagatgcagcttgtgctgaagtgagtcattattcctgggcccctcatctgcctgcttgcttccatgtcccctagagccaaaaacaacataggagcaacttaggggaaaagttacctatatttatatataagcgtatgtatttatattaaatatgataactatagatataatctaatatattgtgtataatataaattaaatatattaatgtaatgtatataacttaagtatattatatattcataactatataaaatatataaaatactaaatattattcactaggttttcatcattggcaacctaagttctatataaatataaaatattatctatgaaaatttatacacaaatatgtatataaaatgttataaatatatactacatatttaagtaaaaataatatatacataaaatatattatatgtttatatagatttagttggcaatgataaaaacttaatgaagaatttttagtgtaataaaaactagtctcgtggagctctttgtgtttcagaatccagctatttggctctgggcccgccctctgttactccgaaaagcactgctttggaggtaacacaacgctaggtggcccctgaggctccctgagcaccgccgatacccctctcagaagcacctctgccccctcctctgtacagcccgctttgctcgccgcctcttcctttggattccaggttggtcggggaagcaatgggccatgtgtgtgcaccgttgtgcctgccttcacccacacgagcctgttggaagacgacagccatacggaagaccgctagctaccccggccccccagcccaggctagttggggttacccaactaccagccaatccccgacgtgaatgtgaataagcccagccagcatcacagagctgcctcgtcaatgtctagctgccccagatgccacctaaacaatttgggtttctcacggcagttctcttcccaacctctgtcccctgggttcctaagaactaagggttgtgcccaccaatcaaagcaagagggaaacgggcttggattttaaggcgttgcactgctgtgacttgaaaagggatatggtttaaaatcattatttaggccgggcatggtggctcacgcctgtaatcccagcactttgggaggccgaggcagtggatcatgaggtcaagagatcgagaccatcctggccaacatggtgaaaccctgtctcactaaaaatacgaaaattagctgggtgtggtggctggtgcctgtagtcccggctactcagaggctgaggcaggagaatcgcttgaacccgggaggcggaggttgcagtgagccgagatgtgccattgcactccagcctggcgactgagcgagactccatctcaataaataaataaacaacaaataagtaaatgattaaaaatcagtcacttaaagacgtattctaagatgagaccccttgctctataaaactgaaggtcgtgtccactaagaagagtggatctgacctcagccctcactgtgacgccacattccattagggcagaggaacagcatctggcaagagaggtcgtccagaattctaaagaggcaggatggccctagtattcaaacttggaccacacagatctgcactctctcatcccagaaaggagaacccaaagtatgtgtctcggttcatgattctgaggatggggaattatggaaggcaccaagtccattcataaaacacaccaccccctccctgtcccggtaatgacagtgggtggtggcttgagcatcaaagtggcccatgatgtcttggttttgctactggttatgccatctggctttcttggtcttcgtccattcatttccctggagtcctggcctgctttgcttcttactaaccttatgcagaagccaaggcaagcgaggacgaggcatacttgagtattcccactggagtaacttctgcaactagaag

SEQ ID NO: 5069 - DNA, 52635 bp, Homo sapiens
attacattcctcactattttcctaaaaccatcattttcgatgtctgcttctataaaaaagaaaccagtccaagaggtgaggagatacaacctataaacattgaaaaggaggttttaaaattcaaatacaaaactgctgggtacaaccataacaaagcatgtgcattcgagtttgaaagtaggtagggcagtattaacatatcctaagtactgtgaacaactagcctgatcattagttaattttcacatccctcagagtaggaggctgtcccccaactcccaccccctattgcttccactatttgtttcaaccttttaatagatacacttgcctcccaccaggacacacagtgtcggtttaaataggtttatctctctccttagcttgtcctggaattacgcctaaagctcaatctggcagcttttaggataagaaatctaattggagagagctcttagttttgcgactccaaacctcttttgaaaatttagtttgaccttccaactatctccaacagatcaaagttaaacatccagattccaaacctagtatagttcctttaaatctgcattgtaaacattgatactgattgctgccaaatctaaaaaagtttcttagctccttgagctaaaatgaaaaaccagtagtcaggaaaacgcaagggtctatcaaagaaatattcttattaatctaaaacacgggtctccaaaggatccctgtccctttcaacttcttgtggagggggaagtgggggaggtttgaagaagcccttccaacttttcacctgaccttttcattaagatcaggaagcccctcgctttcaagaatccacatcagactctaaggaacgaatgcgaagccagcgggccagtgagaagaggtcagccgcgcaggtctcttgatcattccaagatctttgtcctgcagccagccccaccagccccccagctcctccagcccatgcgtttcacttcggagatgtttcatgacataatccggctccgagtccccccggagtcccgggggctcacactccaccctcagggaggtcgctgatgccagccctgggagcacctccccgctccactcgtctgcgctgcagccggttcctatttgcccgagccgcgactgcgacccaggctccccgccgcagccgttcttgggggggctcccgcaactcgcgggcgcgaccccccgcccgctccctcgctgctcacgccgggcccccgctatgtgactggggcccgacccgcacccatggggcaccgctcctccctcggggtccgcgcctgcacccgcgctcaaagcccctctcggagtcccacgctcgcatgcgctgtcccgagccctctgggggcccctcctctcaccccgctgtcctggcccctctcggggtcaccctgctcccacccgctgcccggcctctctctaggtgtcctgctctcagccccgctgtctcagcccagcccccttccggacccctcctcttctcccactgtcttggcccttcctggggtcttctcacactctgttcaagccctctggggatcccctgtcttcacatcccctgaccggtcccctctctttactctgcctggattctctctgggtcccctcccctcacctcggggtctcctctccccgggtgctgtccagcccctctcggggtccccatctctcagactctcagtgccggcccctctcggggaccttcccctctccccgctgtccctgaccttttctgggacctggtccttcaggggaccccctccctcatccccctatcctagtgcctcatgaggcacccacccctcaccccactaccccagccctctccgggtcccttcctctcacgcgcactgtcccggcccctcttggagacccctccctcagactttcagtcttggaccctctcggagtcctctccactcagagccactgcctcggccctctcggagtcccctctcctcacccgctgtcccggtccctcccggggtctcctctcccagtctgcactgtcgagcccgctcccgcaactcccctcactctgcctggggtcccgccgctcggctcccactgtcatgccccgcgccccggtgctctcacctcagacctgctgtcacccccccgggcccggcgccgccgccgccgcttcctctcccacacttgttcctgagtcgctccctgtggcttgttccccggcggatccttgggtccggtcgctgagtgccggatccggctggcgcagcctctgctcgcggtctcggcgttgcgtcccactctccacgcaggaccccgccgccggcgccacaaggaccctcccgcggccgccgccgctgctgctgtccgaggtgcggctctgccaggggtggccaatcgcaccggactgcgccgagcacgccccgccccaccgtctcagccgcccgccccctgccccggaccacgccccaagctcggctccaataggctctctactgacttccctgatcgcggggcacagggccggggccgtatataggtatttgattgatggagccgggaagccgagcggtcgatggaacccgaggattggcggagttgtcgatgggcgggacaggcagggcggggtctcctcagacgcggaagaccttgcaactttagtaacctacgggcccgctggggtgcggtcagtcttgtttgtgctgctctccggtcaaagttcatggcgcttctcccacgcctttacttttcttgggagattcccagggaccaccatgttagagcctttggggagaccccagtctctcgctagaccttgcacagctttcttagtaattctgccatgaactaataagcattaatttgcccaggatttgtaaaaatttcctggatttaaaccatttctttttaaatctcttgcaagggagttgcctctccttgaattgagttcagcagccgtcagtttgataccttgggggaaaaaaaatctatatacagtactaggtgcatactttgcccaactaagcgttcatgcggggcacattttgataggtgcaaggacaaagctttagaaattttcagtttgtaggttttatgacagtaggaagactgtggtaggggaaccctattattagcttaacaaggtttcgcaaagctattcaatataacctttttccagggccacaggttttaatgattctatgtgaagtgtggccaaaggataacgagctttgacccaggtttaacatgtgataatcagagactcccttgatccacgctaaaggatagtgcctgccaggggtgaaagtgcatcatgctactaagaccatttgtgttatttttgtgaaactggatatgctgatcaaatcaacaccggaaacagaaactgctttccttactcttaacgccaaaagtaagtttatggactttagaatttagcatttatgaagaaattgtctcaggaacacattttgatcctaagttttgtcagatgtatacaggcttagttctcagagaaccctcgattgttaactttttaactccagctgacaaaatgtgttttgttctaaacagtatacatgtttcttctagtgttttaagaatcatacgccattcatcactgaggtcaagggttccagacctgcctggccaacatggtgaaatcccgtctgtacgaaaatacaaaaattagccgggcatggtggcacccacctgtaatcccagctactagaaaggctgggcaggagaatcacttgaacccggaggcggaggttgcagtgagtcgagatcgcatcactcactccagcctgggtgaaagagcaaaactccgtctcaaaaaaagaaaaaaagaaaaagaaaaaaagaatcatactccattccaattgtgatgtccccctttaaagtttcagtttgggtttagggtaggcagagaaggcctggaagcaaagaagttgtggaaatggggctggcagggctcgtttcaagtcaagtcgagttcctgagcggtgtggctgagtaccgttttgagaagggaatataaaaagatttcaaggtggtaaaacttgtttttgagggaacttgatttttacaggatatagcgactgtccaaaatcatattaaataaatctaaaggttaggtaagactaaagccaaagagaatttttttgagtaggtccaccttcactaaagagcattttttagttctgcagctgcaatctggacagaaaaaaatggggtaagttttcataacccaagtgctcagttgtgtctttcattacatataaaaaagaaatgcatgaccattaacagatgctgtttgcagtcaagaaacagcagtaaaacataagcaggataaaaatctcagcgtcttgaaaggaaaccatttagcacgaaataaacttaaaaattaattgtatcaatgaactcttgatttctaaaatctttgcttttctgcactatgattactgctactgacaggaacgcaagttactcaatatagttgattgaagtaatttagatgttctccaacagcacaaagaaagaaaatgacttcatcttttggacagagacagttctggaatcctagtttaaatatagatggcagacctacggtgcgatctgagatgattcttatttagaaggggcttcagaagatctcagaactcctggaaagacatcttagcttccattctggaaattctttagttttgttgggagaaaaaatcacttacaaatagagccagattttaattaaaacaaggtagtaaataaatgtcaaaataagtgggatgagaataacgttcattttcagaagagtccatagggaacaattcagagataaatttaatcacaaaaggtctagaatgggaatattcggttccaccctggttttcacatctgttcattttcactactggttcgtttcctacggagactcgggtggaacataaaagtggggctactttggacaaaccattaaaaccttacccttttttctcgctacacacaactagaccacattgctcttagctaaagggcaccttaaatctattcgttcagcaaaacttataacaccgtgttccttttctactcagaggaatcgcacaaattaattcttgcagatactcagctctcctgttttttaagcttccacgtggccttagccaaataacttctggtaggcaaattctccccttcttcagttgagagctcaggcaagctgttggattaagcaaaagcaccttttaaaaaattaatattcaaggcagctgtacgcggagggcctgggtctcggagtctaaaaaatcagactggacgttactatttttttttggcaaacgacagctcgtttctcatttgtaaaaccgggggaacatcttaccgaataaacctacacaaacagaaaggattcctaagggctgggaaaatactattttgctgtccccaggatgaatatcagcatccttgtcttttagctcttaataaagctctaactagtcacaggaggagcaggctgcatgatcacgcacactctggacgtctaggttttccgacctaataagggggcagtcgcgtcgttccctgcttaaattagagaccacctccacctgccaagggcccttcaaacctccgcccctaggtcgctaacgatcaccgctttagttctagctccaggcgccgcctggcgctgtctccggaagtcgcctgcgagcctcggggtcctgaccgctgctgggcctgcccgtgatttgcctgactctagcgaacctggctccgcccctcccccactatacgttgaggatttaagacggcgatgaaagggctgaggttgtggcgacgggggcgtccagcggcatctccactccccaaggatggcggaatcaggccgttgtcgggcagctctcgacccggaagtcgctcgcgcgcgaggcccccgttgccgagcgcgggcgcggggggcggagctcggcggagacggggaggggtcgccgtggctgccggtcctcgagttgggggctgccgcggacactgctaggcagaggcgagtaccgagcgcgggtggccgcggtgtccgtgggccacgctcagctgcggtcagagcgacatgagtgccgcggggctgctggccccggccccggcccaggctggagcgccgccgcccccgagtactaccccgaggaggatgaagagctggagagcgccgaggacgacgagcgcgctgtcggggccgcgagtcggacgaaggtgagtcctgccgctcgcccggccgcccggagggaggtgggaccgctgggggagggggtggggctgttcgggagaggggcggggcggcctcggggcctggggctgcgtggaggggccgccgggagttgcggggctcggggaagttaccccatccgtgctggagtagcggggaagccctgggtgcgttacactcgaccgtgatggggagagggacttagatgttgtcacgctgggggtccctttaagaccccgtcctccctcccagccgttctgattgaacctcactcactagtaggaattagaaactcatttactgaatacatcgaggtagttcgccccttttttgtgtgtgagagcatcagagtccaaagttgcccctccccaccccgaaatgcataagtcatctatactttaggtagtacactattgagaactcaggttggttaaggaaagggacctagaaccagccagatacaggtttaaatttggctttgtcacttaactagctttgtaaacttaagttttccagcctcgatttacccaactgtaatggagctgtttaatcccacacctgccctagaaggcacttcctagggtcggtatagggattaaatgacatgcgataaagtacttggcctggtactgtaaatactccgtaaatgttctccccacccgcccccccccggaaacaggtaagagagggagagatttgcttaatggtccccaggtgttgtgttttcgtcccacgctctttgcagtgtcatcacagagtctcagagccttgcttttcaaactgggcttataatttggcaagtgtgaggaacgctattttggagggatggaggaggaggaaggtgagaaatgtgagagatcaagggaggagaaataggaaacaaagagagaccgatatatgagcgaatattctgggacaaaatcgggccgtggagcaaaagctagaccagctgtttggaatgggcctacgttttattcatctgagtttcccgagtgccaagtaatgtggctgaccatgacaggactcagggaaggcctcttgactgaaggaggggagaagggtttgtggggaattggatctgaacagccttacaaaagacagctgcatatgcatgacatacaaagttgagggactgcattcatttaattccatcagaagacacggcttaaccagagattttgaatgtgaagcacttgcactcatctcatacccacgagggggcgctgtggagccaaaattgagtttttttttccttccatataggggctattaaaattttgtacacaccccagccattagcttgttctaagaacaatgttaagatgttctgaaacagttttcgtttgatcatctggcctcctccttgttccctttagtgtaacttggaaaatatttatttgtgtcagattccccttttttattgtatacagttggcctgcgtatctgtgggttctgcatctgtgaattcaaccaagcgcagctcaaaaatattcagaaaaaaattggatctgtactgaacatgtgcagactttttttttgttattcctaaacaggtagcgtaacaactacttacatagtatttacattttattggatattgtaagtaatcttttttttttttttttaagatggggtctcactcactcacccaggctggtgtgcagtgtcacgtctcagctcactgcaacttccatctcctgggttcaagcagttctcctgcctcagtctccgagtagttgggattactggcacctgccaccatgcctggctaatttttgtggttttatttttgttttgtttattttatttttttttgagatggagtttcactcttgttgcccagggtgggtgcaatggcgcgatctcggctcaccacaacctctgcctcccgagttcaagcaattctctgcctcagcctcctgagtagctgggattacaggcatgtgccgccacccccagctaatttgtatttttagtagagacgtggtttctccatgctggtcaggctggtctcgaactcccgactcaggtgatccacctgcctttgcctcccaaagtgctgggattacaggcgtgagccactgacctggccctaatttttgtgtttttagtagagatggggtttcaccacgttggccaggctgtctggaactcctgtcctcaggtgattctcctgctttggccttccaaagtgctgggattcagacatgagctgccatgcctggcctggatattctaagtaatctagagatgatttaaaggtactgttggcctggtgcagtggctcatgcctgtaatcccagcactttggaatgcgaaacaggtggttcacttgaggccaggagttcgagaccagcctggccaacgtggcgaaacctctctctactaaaaatacaaaaagtagccgggtgtggtggtgcacccctgtaatcccagcttttgggaagctgaggcaggagaatcgcttgaacccaggaggtggaggttgcagtgagccagattgtgccactgcactccagcctgggcgacagagtgagactgtgtctcattaaaaagaaagtatactggaagatgtgcgtaggttatatgcaaatactatgccattttgtcagagattgagcagctgaggattttggtatccacgggaggtgcagtaaccactcccccacggatatgagggacaaccgtgtatcctgatgtaaaatgtgcgaagggttccaactgggtatgtatagaagagaatgtacatactagtttttttctggagcagcgagtaaggcttgactgcctgcgtgtccagtcttacgcctgcatctcctttcttgagttgccagcattgttgtttctgcagagtagcagccttcaccataactgcctgtgcctgagacaccctattctgtggctgcatttaggtaaaggcaagctttttgcataaatctgactgtaagttggaaatggccttttctttttgaagtacggctgtccctcggtatctatgggggactggttccaggacttcatggatactcaacctgaggatactcaaattctttgcattggccttttgtgtccacaggtttcgtgtttcagatagggatggcctactaactgtatgtaatgtttttcattgatggctttgtgcaagctgccttgaatagaaattgattttacgggagtttattgagtgcatactctgtgtcaggtgcgccaactccgtgaattatgattttaactagcccctatttcctaactttattcagacacgaggatgctagtgaaactgacctggcaaagcatgatgaagaagactatgtagaaatgaagaacagtgagtatgatatgcctatgtctttttggaacatagaattgacaacatctttattagattgagcatcccaaatctgaaatctcagatgctccaaaatctaaaacttcctgagtccagcatgatgctcaaaggaaatgctcattgcactatttcagatttcagatttttggattgggatgctcagctggtaagtatattgcaaataatctaaaatttgaaaaaatccaaaaccttctgatcccaagcatttcagataagggatacttaatctgtagtaaccttgtgtgtatagtttgaccatagcgcttccaaagaccatgtatgtttacaatttctccactttaaattattacatttaatcagtcttcccgttataagactttgttgagtactctctagaaagaatctgagggcaatggacccaggggagggaatgaggccgtacaacaggagaggaccttttactattactcttttttttccttgagacagagccttgctctttcgtccagactggagtgcagtgcaggatctcctcactgcaaccaccgccttccggattcaaatgattctcctgcctcagcccctgagtagctgggattacaggtgcacgccaccacgctcagctaatttttgtatttttatagagacagggtttcaccatgttggccaggctggtctcgaactcctgagctcgtgatcccccaccttggccttccaaagtgctgggattacaggcgcgagccactgcgcccggaccttttttttcttttcttttttaatgggcaaaccaatgcacagagagggtaattgttgtcttgagcaattgggttctcaggtgagtgtaaactcactgcactaatgtgctagacaaggtgccgaggcctggagagctcagagaagccacgattgaaaagcaggctgctgactcttatttattatttatttatttttatttgtttaatttttttttttgagatggagtcttgctcggttgccaggctggagtgcagtggtgcaatcttggctcaccacaacctccacctcccaggttcaatgattctcctgcctcagcctcccaagtagctgggattatagacatgcaccaccatgcccgctaatttttgtatttatttattttttttgtgtggagatggagtgtcgctttgttgcccggctggagtgcagtggcctgatctcggctcactgcaacctctgcctcctgggctcaagcattctcctgcctcagcctcccgagtagcaaggactacaggcacatgccaccatgcccggtaataattttcgtatttttaatagagacggggtttctccatgttggccaggctggtgtcaaactcttgacctcaggtgatccacctgctttggtctcccaaagtgctgggattacagggtgagcgaccctgcctggccacatgctgactctcaggccagtgctctgtccacgtttgccctgctctcacccaaaccttctcattgtcttcagacagagccacagccgaacagattcaagaaacgaaaacctcactcacttttagcgtacacccagatggaaaacggtataaagtattttaatgtatatttgttgaatgtgttaggtttttaaagttctttaccttttaacaggatatccacattcatttccctttaggtcctttttgcaaatgttttgtggccatcctctggatctcacattgtttttgtgctttggaactcaaaggggtaattcagctaggtctaaccagtgtgaataaagatggattactttttttttttttgaaacagagtctcactctgtcacccaggtggagtgcaatggcatgatctcgtctcactgcaacctccacctcctgagttcgagtgatgtcatggctaagcctcctgagtagctgggactacaggcatgcgccactacgcctggctgtttttttgttgttgtatttttagtagagacggggtttcaccatgttggccaggctggtctgaactcctgacctcagatgatctgcttgcttcagcctcccatcgtgttgagattacagcctgagccatcgtgccaggccacttttttttgagacagtagccacttttttttgagacatatcttgttttgttgcctgggctggagtgcagtggcatgatagcagctcactgcagtctaacctctggggctcaatccattgatcctcccacctcagccttccaagtagctgggacaaaggcacgtgccaccacgcccagctgatttttaaaatttttagtagaaactaggtctcacgtgttgcccaggctggtcttgaatgcctgagctcaagcattcctcctgtttcggcctccggagtgctaggattacaagaataagccaatgtgcccagcctttttttttttttttttaaagacagggtcttgctctgtcgcccaggctggagtgcagtggcatgatctcggctcactgaacctccagcccctgggttcaagctattcttctgcctcagcctcacgagtagctgggatacaggcgcccaccaccacgtctggctaatttttttttttttaagtagagacagggtttcccatgttggccaggttggtctcgaactcctgacctcaagtgatccacccgcctcggcctctaaagtgctgggattacaggcgtgagccaccttgcctggcctcccttagtatttgatgtacagaaaaaatttcggttaaaatggaatgccttgtgtaattcaaggggaaatctaaaggcatcagaatttgccctgaaagagtgagatgtgtgtgagtctcaaattctgcctactctctccccttacagagggttgggttgtatttgcagcccttatttgagcgctaaaaaggttacacgcccatgtgctcacttcagcagcacatataccaaaaggttattgtgcttgttatatttggacagtgttctttcagatcacaaatcttgtttttatcactgttaaattgagggtgttttcaggtagaagcaaaaatacttgctgaaatgtgatttatatgtggaacccaccttcaaccaacttgctgaagttatgactgcctataatccattaggtgtgagaggaaaaaactaaatgccaaatgcttttgcttcgtgtgtgctgtgtattcccatccagctggggctgccagtaatgctgccttttaacttttctttctgaattactattatttctctgatcctaaaagagtgtgctttaaaaaatgacatgaaggtttattgacttagttcttacactgctaagcatatcgcatagaaaaacatgctgaaggcataatcttactctcctgtaacttacaatctaattgtgagttgatgtaagagttgtgtttaatgccatttctacattgtgtgtgtgcttgcctgttataattgtcatttattaaaatctgctatcgttgcaagttttagacggattctgtaaagagggataacatgggagaatctacaaaattagaataagattgaggaacacagggttctttctgttcctttctgatccctgtggctgctggtgcattttaagccagcaagcagactttacttcctctcttccctgaaggacattaatgaccttcccataacagcccagctaatttctgtggtaggttattttggaattgagtattgaatgtttttatctgttagtgtgactttttttttttataggatgtatcaggacaaactggcttctctcaagaggcagttgcaacaactgcaagaggttggtgtgtgattgaatcctgcatttctaaatatgcttcttaatattacaaaccctgaaatctgtgtatttcacttctctgtgggagttatttaaaacacggtctggctgatcttgctatccagtacattttgctatcttttgctgtcagtaaagtggtgattttccagctcctgattttgaaacatttatttccagtatgtgtgagattctttcttcaaatgaaatctcactgggactttcaatggagcacgaattgaacgccactgtgcctaaagctagagatttttagggagacattgttatcaaagaataaagtttttactgttttttctaaaccaaatgttaatgacttgtggattattcacactgtgttttctcctttttgcttgttacattaaaagtagattgattttgtcaaatgctgctagctgctaaaggcagtgcagcatcagagttaagagtgcaggtgtgaggccaggcgcggtggctcacacctgtaatcccagcactttgcgaggccgaggcggtggatcacgaggtcaggagatcgagacaatcttggctaacatggtgaaaccccgtctcactgaaaaatgcaaaaaattagctgggcgttgtagtgggcacctgtagtcccagctacttggaggctgaggcaggagaatagcgtgaacctggaggcggaacttgcagtgagccaagacgtgccactgcactccagcatgggcgacaaagcgagactcagtctcaaaaaaaaaaaaagagtgcaggctctggagttttgtgagggattggaatcccagtttccctgcttctagtaagtgaccttggacatgccagtttctcttgtttaatctgttttctgatctgcaaaatgaagaagtaagagtagatgtgattatgcatgaggagcgtctagcacagcagtgtgcacactgcaggtcctggggacagttagctgtggcagtgagctcttcggtttcatattgtggagtcccttgtcagtgaaactgtttttgcttttctttttttttttttcgaggctgagttccgctttgtcacccaggtggagggcagtggcgcgatctcagctcactgcaaccttcacctcctgggtcaagcgattctcctgcgtcagcctcccgagtagctgggattacagacgcctgccaccagcccggctaatttttgtatttttaatagaaacggggtttcaccacattggccaggctggcttgaactcctgaactcaggtgatccgcccacctcagcctctcaaagtgctgggatcacggcatgagccaccatgcccagcctgatactgctgtttctactatgtgcttttattgctgtgagtgatccacgcccttggactagcccatggtcaggcattataatcaggaaacacttcccccacaagatgggcccctcataattaactgttttgtgggaagagcaatgaaatgaatacgatttggttagaatctatacctgaattgtttaatgctgtcactagccacatgtggctgttaaatttaattaataatttagttcttcggttccactagctacatttcaagtgctaaaaagccacaaatggttagtgcctgccatgttggacattgcaaatataaaacacaccattgcgaaggttctactggagagcgttgacctagaccttactgaaggagaatgaaccttttccataaaggaaggcccgttgattcagactgttgcagcaactgatcagaatagtgtggagatatggcaattttccactccccctcactcactacagacccttgatccactgggttgggtagatttgaatgggcccctagtggtttctgctgtgtgccttggttaagaaccagagttaacttgctgaggtgtgtcttcctttggtgttactgaaacagtcagtgttgatgctagataataatttaggaagcaaaatgtagagcagatttatattcacaataattttatttttcaaatgttaaaatcaggtacattacaggaatatcagaagagaatgaaaaaactagatcagcagtacaagagaggatacggaatgcaggtaaggctcctttaaatggcaatgaatcatctttcaatgttgaccatttgccgatcgtcggtgtaatgcagccctaagagctattctccaaaacatatccagatactctgtcagggagagttttcagaaaagagacttccaagctgcagttatggaagtggtttcatcttctgcttctgttgctaaggaatggcccagaagtggagggtgtctgagaggctccttggagttaggttgttctccctggtaccccaagagtagtcttgcaccctcttctcatttctgcatggctggcctgatgtacagtcagaagtgcggatgaggaaaaggattgaggttgtttttgtcccattttaagtttttttttttggtattttgtgctaggattggggaggtcttcttgttattttccccaagtattgtttttataagaatttagagaaaacgcacactgattagttgtatacagtaaatgtattcattcaacaaaaatgaattgagcacctgctactctaagcactgcgagcaatataaagtcatgtaacacattgctttgactttaggacacttgtgtttcattgacaaaagataccacatgtataacgtgtaaagttaaggaacaccgagttaagagccatgcagaaagtaagatgtgacaactgtttaaagtgtgtaaacatggattcctaggttacaggaaatcgcgtgtatgtgttgaatttttaacgctcatcatcagccagcagttgggtgccagcagagtccttgttcctgcgatggtagaagtaatgatgggttttaaaatggggttgggtgccactcctcatgctgctgtcatctttcattctgggccagtgactctccacgcttcactgtgtctcctcagtgagaagctgcccagtgcacaccaacagagagaaaagggttgaagtgtgggtgggcgctgagaaagtggagccccagctattagctgtctgcctttcaccttctacctctccctgctgttaccccctttctactctgagttcctgaagcacctcctgagatgtcttgaaaatcctcaaccggttgctcttcctagacttcccttttagcagataaggaggtggcatttgtggaaggaggtcctgcctcctcactttagatctgatcctttaagcgaatatttgctcttgaaacctcaatttctccatctgtagaggggaatattaatacctcaggaactggcataagatggaagtaaggaaagaaaatggatgtgagtcatatttctgaagtagaacagcagagtgagtattgagttgtttttcttcattctgctcagactctcaatcatgcctcatgtgttcttttttttttttgagacagagtctcactctgtcacccaggctggagttggtggcgctatctcagctcactgcaacctccacctcctgggttcaagcgattctcatgctcagcctcctgagtagctggaattacaggcgcctgccaccacacctggctaattttgttttttagtagagataggttttcaccatgttggccaggctgctctcaaactcctgacctcggtgatccgcccggctcgccttggcctcccaaagtgctggggttacaggtgtgagccaagtgcccggccctcatgtgttctttcacatttctctctcctaggtaaaaatgcagaagagtcctaaatcagtcacgacttgagctttaaaaagcacattcttttcagagatgatccaccgctttagtggtgtctggctgctttaactgaaacaactgccacctctaagtgctaattgtattttgacttggtgcaaggcatgatttctcggaatggcacaggacttcagctgtctggccacttgtgcatggtacagatctgaagctgttataggaatgatcacattgggttgggtgtcctgggttcctatgcccagcaattcccagtgccaaagtgggtaggacttctgggggctaaaaataatgagtggcttgtccctttcctcagttaattttctctgtcaacaactgttaactctgggcttttaatctggggttcctagaactgtcagaattctgtggagtttgtatatgtctttgttctggggaaggggtccatagcatttgccaggtttgcaaaggggcccctggtagctgagaatagcacaccctggagaatctttgtggactgtacgcacagccccctgtcacccggaaagagtagaagccatggagcaattttgcttcaagttgcgggtttgtagacaggttttgctctattgtaaatctagtggtgaggggagctgctaggtaacagttactaatcatccgcacatggtaggtgctaactaagttgttgagtgctgttagatgggtgctttaaggcatctaagggcatgatgtgtgaagagtcagcaggaaaggcctcaggagggggctgcattcagtcggaacttgggaatgtgaataggaggtcagagggcattgcagggacagacagcgtgagcaagcttggtggcctgacagtgaagccccaggtgtccctggagcctctgtcctatggattactgtggaggtccttccttaccacatatagcccttcatatagtgctttaaaaaggaggtctggccgtaggcagtggctcacgcctgtaatcccagcactctgggaggctgaggctggcgatcacctgaggtcaaaatttcaagaccctcctggccaacatggtgaaaccccgtctctataaaaatacaaaaatcagccaggtgtggtggtttgcgcctttaatcctagctacttgggggctgaggcagtagaattgcttgaacccaggaggtggaagttgctgtgagtcgagatcagccactgcactccagtctgggtgacagagccagactctgtctcaaaaaaaccagaacccccagaaaaccaggggtctccatccttcaggctgcggaccactgggctgctttcccccactgccgcctgcccccctaccctgccccagcccgtgggagaattgtcttccaccgaactggccctggtgccaaaaaggttggagaccactgctttaaaacatcacatccactctgtttctgagtaattgcattatttcttcttgacccatcctgccactgtggagactgttggcgggtgactgagtgaaagatgggataagtttattttgccaggggagtttggttcctgctgcacgtttttgccctcaggcagaactgccacagctgatatgttcagggccacattttttttttttttttgagaccaggtttcgctctgtcacccaggctgtagtacagtggcacaatctcagctactgcaacctctgccgctcaggttcaagtgagtctcctacctgcctcagcctctcgagtgttgggattacaggcgcctgccaccatgcctggctaatttttatatttttagtagagatgggtttcgccatgttggcaggctggcagggtcacattttaactagacttgagtacttgtatgtcctttcccttcgtgtatatcaacatttcactgatgaaaacatttgctttgtaacagctttcagaaagcaattactgcttctaaatgaatgctaacatcactgtctagaaaggtgcacagcctagcaaatctaattgcactttttatctcttgcagaactcttcctccagctggagtaagtaccacggatcttctgggtttgcaggccctgtctgagactggaatcttgcagtctgatctggtggcttttccttctatcaccaagtagatagtttggaagccttcaccactgtctgtttgacttaaggacatttggtctcagctcagacatcctgtctggtcatttgttgtgcgcagcctctgcttatcacaggggaataaggaatactcatccctaactgcttattgactctatcccgtgttagagctgtttggaagtctctgagttataacggcctaatagtttgatttggtccttgaagcagttcaatctctgaattggctcagcagttctgttttacagctgcactctctgggccagtaaaaaaagacagatttctaatttttcctttcattccatggacaccgagtgctggttctgtgtcagactctgtgctgtgatacagagatgagggcctgaatcttgatgatgtactgctcccagagtggctagcatgtgtgtgggggttactttttgagaaagtctggtttttcagagccacattattggaacccagtttccttaaatcagtgtggtgcccatatcactcagccagaaggatcacgtgatcagcctgaaggtacactcaagtgaggtactcactccttagcccaccataggcccctatgtcagtcaccacaatggcgagatttgaaaagcggggcatatacaatttttgtcttagtataatatcaatatatgtatactttggggttcaggccttactaaatgttgttccattcttttgtcttgctgtatcaaaaataatagtaactttttaatatacacaatttatctagaatctattttcctttgaagctgtaactttatgagcgatttttactacctttgagaaatgtgttttagtataaaatataggatgtggaagcgaaaaaattctgggtagcaagtgaggtgtactcaaaaataagcaaaagtcacatgggtctgattttaaccctcgctggaaagcttgttctcagacacactgttactgcaagtgtgtgtgagggggaactctcacacactttgcagttgaggacagggctagactttgagttggagccctggctccagggctgtgtactcccagcccgtgtttctcttttgctcagactgaacaagtggaacgaattacattaaagaaaagaaggcagcagtgaaagaatttgaagacaagaaggttgagctgaagagaacctgattgctgagctagaagaaaagaagaaaatgattgaaaatgaaaagctgaaatggaactgactggaggtaggaaagccctatggggtgggatcttgggggccctgagcggggggtgtgaagggctgttccagttacttttgtcttacatttcaagagcagagcaaggtgagagtgggttttgacctcatagatcagagttcctcctccaccttctattggctgtgtgccttagtcaagctgcttaacttctcttttctcctctatgaaatggggctgatcatacccctcacaggattgtggttagacatatgagtgcctagtacagtgtcctgtgcataacagatttcaatagttgctagacctttaatagtaattgcaagctctggcttagactctacttaatcctgggtctgctgccatttgtatcttggttatgttcccaaattgcttacgcaagtcccttgtggtgatgggaatccctcgctttgtttttttccagtctgccttaattacagaaaaggattgtctccctttgacctagatgtaagaacaaaggcttttggctatatcctctatgctatagatctctcctgccaggtgttactgaacatttcagaaagatttgatatgattccaacagatagccaaactgaactagtttcccataaaggtaggaaagttacatgagactcagagccatgcctttctaaccttctagaatttagtaatccacatatgggaactcagcaggttgtagcaggtttcagggagaaacaatatgggccaactcttctgttgccatatgtagactgatgatcctagaaggatacagggaattggcttgaactagctattttggaacttggcaaatactgaaggcaagtcagtggtgagtttgtcacttggatatggaggtggcatgcctttctgtacaccccaaatttaactcttacaattcggaaagtgctggggctctggtgtgtctgattttagagggttctgtaggaaatgcatgcagtgtttttgtggacgttctcagggctgactttgaattaaaagtagccagttaagatctttgttcccctctatatattcctggtgctgtgaaccacttggccttctgactgacacagacttctggctccaatcctcatgatacacttaagagaagtggttgtgcctaaggtggggtctgacttttgaaaaatctctcttctgttagcttcctctagagagagttggcaaaagaaatgagctccttgaaggcctctgaaagcagctcagaaattttttttgtgagaatggatgccaaaacagcagctaacagcagcttcaggcagtatagtctgttcttgtgaaagtgcttatttaatgagaccagtagcaccgtggtaccttatctggtacagtctgcctgccggcttttggacctgcacaccattttctctgacagtggctgtgactgcattgatgcctcattgttctctgctagagccaccagatgtttgggagccttcattaggcagtgggaaatattatccgtttacagctgctccctttccgtctgtggggaacgggtatcacaccttacctgtgatttggcgtcctaattattgacaagcgatagacattgtttggccagcagttttacagccagaatcttaactgggacaggaggcatcctcagtgacttgaggctgacctgccagggtagaaaagacaaataaatgtagggaaatcatttgtaacgcaataaaataattacagaagtgtttaaagctagccatgggcattaaaggtatggatgtccttcctcaggcacctttgatacccttggtatggaaagcactgccaaggtaatgatggagtgttggaagaaaggtgctggagctagaagggtaattaacatttccacagatggcgctgctatggtgttgattaaaggcttgatttcattcctctaattgagtgacttagttcatctttgtggattgatcccaatatcattgttgcccagctctgccctgaaaaatactttttaaagtctccttttttgttcaacatgaacgtctcttgaaaagcaaagtaggataagacgctgatgagaagcttagctaaataacccactggaaacgggtgtatttggcgacctgctctttcccaccatgacttaagcgtttataaacctccataggaattggcaggatgtactgttcaccgcccaaacctctttggaaaactgggttgttcaggtagaaatgagtaactgtacatagagaagctaggaagaatataggtcagtgcatcccaacttcaatgtgttaggtcagtggggtcttgataaaatgcaattctgtttcaggggctttggagtggaggctgagatcctgcatttctttctttctttttttttttaaatttaatttttttttgagaccaagtcttgctctgtcgcccaggctggaatgagtggcgcagtctcggctcactgcaacctccacctcccatgttcaagtgattctcctgctcagcctcccaagtaggtgggattacaggcatgcaccaccacgcccggctaatttttgttttttagtagagacagggtttcatcatgtttgccaggctggtcttgaactcctgacctcggtgatccgcctgcctcagcctcccaaagtgctgggattgtaggtgtgagccaccgtgcccggctgagatcctgcatttctaaccaccttccccaggggtcgctgatcctgctggttgtagctgataccacaagtcattacaatgtcaaaatagaagtctgtttcccaagcacttacctgagccaagcattacataaatatattagagctaactttgcaggctgatggtccagggcgaatcctggcactgtcacagatttaaatctgaggtagggttttctcatttggcaaggggtgatagaacctactgcagagggtagatgtgacgtgagatgagataatgcctataagttgttcacaaagtagctggtttacagagtgaacactcagggattgggaactcactgagttccgcagctccctttgaccttgggggtatcgcttctgattttataaatggcagaggtggctcgagaagtggagccatttgctcacagtccctcagtgagatagatagtggttcagccagtgctgtctcactccaagcatattctcttcaccaccactactactgactctctgcagatacctagatacatgtggtggcactaagtgactcacaaaatcaggctaatggataaagtctgtgcttctaggaggctattttctggtagttagaaagctgacacagcttccttgacttccccaggtaatgtgttgagatggagggcccctaaataaaggtaacaatttgacaggcttgttttgactcattgatttatttaaagacagggtctcactccagttgccaagggtggagtgcaatgtgccatcggggctcactgcagctcgacttcccaggctcaggtgattctcccacctcagctcctgagtagctgggactacaggcatgtgccaccttacctggctcatttttgtacttttgtagagatagggttttgccatgttgcgtagctggtcttgaattccaaggctcaagcaactgcctgccttggtctcccaaagtgctgggattacaggagtgagctactacatctggctttttactcattttaaaaccctaagatatatgtggttgtactactataggagcagtaagttcacgcgtatgcaatagatgctaatgagtagctatttgggtgtcaagacaagaggaagagccccacacaaatatctggagagggagaatggaagaggtgacctggattttgggcagaggggcctttcctcaagatgttctttcctggtgctggcattgtggaatcagggtttttttttttttttttttttttttaagacggagtctcgctttgtcccccaggctggagtgcagtgggcgatctcggctcactgcaagctccgcctcccgggttcacgccattctcctgcctcaactcctgagtagctgggactacaggcacccaccaccacgcctagctaatgtttttgtattttagtagtgatggggtttcactgtgttagccaggatggtctcgatctcctgacctcgtgactgccctcctcagcctcccaaagtgctgggattacaggtgtgaaccaccacgcccggccgaatcaggtcttttaatgtgcttgagggtgcagagaggaaggctcgactggctcactgttattgctctcccttcataatggccaactttggctttaaagagattggtccctttattccactctgatttggcctccaaagacctaacattaattcttgtggattgattgattgattgatttgagacgtagtctagctctgtcacccaggctgaagtgcagtgccacggtcttggctcctgtaccctctgcctcctgggttcaagcgattctcctgcctcagcctcccgagtagctggactacaggtgcgtgccaccatgcctgactaatttttatactttttagtagagacggggttcaccttgttggccaggctggtctcgaactcctgacctcaggtgatctgcccaaagtgtgggattacagacatgaaccaccgtgcccagccctaacattcattcttattccccaccccacaaaccttaggcgctcttctgttaccaccgcagcattaatttgtgtcaacattgatgcgccctccatcctgctagagaagggcatgatgtctgctaggattgctctgggctgctagctagcctatgggtccctgccctggtttggaggtaattgccaatctgctataatgtttacctgcagtggattttctttctgccagttatatcccatttctttttaaagaaaatttccttttaaatttaaagtacatttaattttttgagacggggtcttgctctgccacccaggttgggtgcagtggcacgatctcagctcactgcaacctctgcctcctgtgctcaaatgatccactcagcctcccaagtagctgggactacaggcacctgccacctagcccagctagttttttgatttttctgtagagatggggttttgctctgttgcccaggctggtcttgaactcctgggccaagcaatccaccctccttggcccccccaaagtgctggcattacaggcgtcagccattgacccagccttatatcccattttttaaggatgaccctttgaatcactgcaattaatattttcccaatagataaatatgagcttgttttaatagttaaagtatgttgcattgaagcttttctgccgttgtacactataggcaggtatgctgttggaaatgaatgaatgggcctagagaatgcacagcaaaaggccagccagtaaactggtaattgtatgtaaattgcaggtaattaattatcaagaatatctctccagagggactgtgctataatgactctaccacctagcattgctcaacctgagctcccattttttagatgtcggaatctgtgctccctgtggtgaggggtgaggggttcctgtatccatcaggtttcctagtgagtagaacaggaggatttgcactattaaagtcatattgcagggtggtttggagaggagttatatgcctagtcttgttgcttgtttgatttttttctcacataacgctctctcaagtctgctttaagtgcttgatgtttaatgataaatagtatctccactgaagcaaacctatgaggagacctctggatcagagagggtttctaattcagccagttcgagtttttttatggttggtgcatgatgtcggagaggaagcctgactgatccctgctcaggtgtcttctctggggttgtcacaccccagggtctgagcttcagttctgaagtttgatttttgtcagtgtagccagattgagcgtcttgggactcttagagtcccagtataggagattgatggtaaaactcaggataccagctcgttgcttacagtgagaaatagaattccaggtgcactcagacctgggttgtcagactccatccttctatgaaaaatccaccgtaaagccaactagaccaacctggcgttggagcaaggtgacttaagtggataatcttactggtctgttggggctgtgatacatgttgatcatggcctcaaatcatgttttccacctgggcattggccaggactgctcccttctgtctcctctttcctagatggagatggagacatgctgtaagttttaggggcttctccagagtctcttccttctgcaaagcagtcttttggataaaataatcagattgttgctgtgaccaggctaataaaatagatttttttttttttaccatttctaagaatttgattgtattttttggtttgtaagtgatacagttatgattttcagagttcatggccgtgattggcctttacttggcttacatccatcatgcattgtccaccctccccactcccagtcttggcagcctgtggagcagagcacactcagccactctctttggcagacagaaattccataatgttcatgggctatgtgcttttcctttggtgctctcttgggttgggtgagtccctttacactttattttccaaattaggtgtcagtgttgcacagcctcacagttgacacagctgctttcgactatgtaactttttttcagctctttgtgccttgagttttaaaaaggtctttgtatagttttttcctgcctgaaaatataataataaaaactagcattgatagaaccccgttacgccaggcactgtgctaagatttcacacatatcatcacatgtaaccctcacgcgcactgtgggggaggcattattgatacttctattctctagatgaggacacgtgagacaacagcacttacaaacctgtgttaggtcacacagccgttgcagggattcaaacgcacgttgtgtgacactccagctcttaactgtggtgctgtgtcactggccagtaactaactggagagggtggcacctcagcataggataggagatttcttttagggagaagccttcaccacttgttctggtgtgtgtgtgtgtgtgtttatacttccaagtacacttttataaatattcattaggctttggttcttattttacctctattccattcataggaaaaaaatatttaatactgccctttctcttaagagcaacatgcagaagccttttttttttttttttttttcaaattttctgggcacatgtatgacatgctctaagatcctgcacactgcttggtagaattccctgaagctccctgcctgttctgctgattgtgtgcataatcacaaattaacttcctcccatgatcagattgacctcatctacccgttctgcacaaaacattatgcacccctactgtgccagactattctaggtgttggggtggaattcagacatccaaaggggtaggtaatgacctgtacaccgtgcacttggtctacttgaggtttgtatagatgctctggttacttggaggatggaatgagttctgcctttgaaacctgttacagaagggagagggtattaaactgactttcaacgggtatttgtaggagtttgctgggcagaaaagaggaagctagacagaggagagccatgcaaaggctgaaggcgtaaagtctggtgcccttgggtaacaggatagctaaaggcttgcacacggtgtagcgtgaatgaagaagaagggaggaagaccagaaatgaggcctggcttatatcctgtgggagtggtgagccattgaaatatttagtaagaagatggctgggtgtggtgactcagcctgaatcccagcactttgagaggctgaggagggcggatcacttgaggtcaggagtttgagacagcctggtcaatatggtgaaaccctgattctactaaaaatacaaaaaattagccgggtgggtggcgcatgctgtagtcccagctacttgggaggctgaggcatgagactcgtttgaacggggaggcagaggttgcagtgaatgaagatcgtgccactgcactccagcctgggtgagaagtgaggccctgtcttgaaaaaataagaaatatttagtaacaagagtgatacacaaaacatctgatttgtgtctcaggaagatcactttgagggaggggaggatggatgggacatgggaagaccactgaaggccgtggaggtagccagtgaaaggatgaagggatggagtggaggcagaccaacattagttggtgaacctcatgcctggatgaaggaagacaagtcacagatgcagtttgttctcgcatggaaggagggatagattggatgtccctgagatacaggaaaagaagcaccttgggagaggaaacgaggagaactgagtttttgtggggcatggagaatgtgtggtgcaggtatctattgccattcagagggatgtgtggagctggaagtggtgattgcagattggtgggatacagtctgaaaggaactgactggaccccaaagatgatcagtattcagggagcaacaagcgaaccccgaggaggcaggttcacctccttgtgcgccacctcttgggaggagcttttgaaggcgtggggagtcagcagcagtgtgagaccacagagaggagtgaagaagaaggaaagaggcttttattgtgagccctcattgtgtcatcttgatagtcaagtagctacaaaagttatagagaaaaaaaatccgagtctgtaaatgaaaacttcgtataaaaatgttggcacgaggccagtggcctctaaaagagcctttcataccaatgggcttcagcacacccaccctcttgggagctgcagaaattagtcagctgagatgaccttcaggttccttcctatcccgagacctgtgactctgggcttcttaatttgagggagaggaggaatatcccctaggttttgaggtgctggagagatgcccacagtggctgtaatgcttgacggtagggctgcatttctgagagggtgtgcacttagggcagctggtctgaatcttacaagtataaacgctttctaaaatctatggggtgtctggctacgaccatgtgtagaacaaacacccccagtaaaacagttctgattggtggctggggggcagatattcttatactatagaaattcttactgacttcaagtgggagtggatagatttacccattccattcttgccacagattctatggaggtgaaacctatcatgccagaaagttgcggaggcgaccaaatgatcccgtccccatcccagacaagaggaggaaactgctccagatatccatttacatcaagccttaaccgcctttcttttttaagactgtggatcctatgtttatccgtttgctagggtacacatggccgttgtcctacagaaaatagtaactttaactggaaagcgtgtgttaaatgtttgtccacaggtcaggggttgctcattttatctggtagtcctcatttgctactgcttttggtgggagagatgtatagagttgtgatttggaaggtgctttgcatgcaaagttcagcctggttttaatgctaacatcaagattcaggggcactgaaaacttgatgtgccttaattttttcacctgtaattttccaccttccaactgtaaatgaaggcagtaatatctacctttatgtacctctgttatctatgtccataatgtagtggatgcaacctgtttttaaattaaagcaaatgagatttcagtcagacataaagcagccctttatcataaaaatggtaacggaaacaggaaagatggagaagcgttgtttctgttcctttcgggagatggtgaatagctctctgcccaaaatggcttagtcatttgtgtaccatcaggaaaggcataacttcaggttgcttctccttcacaacaggagttaagttgctgagggaagattgccttaccttgggtgagtgtgtgtggaagtctttagatctttggaacaaaagcgctttatcattcatgatgaaattcttattttactgtttcctttgctgtgttattgtagatgcctaagaagctcattccaccttctcatcctagcagtgggggatgtgaattcttttatgtattgagtaccatgacatttagtaggagaatcataaatttctaagaagcaaactgttactgtagaacatcatttaacaaaatcatactttgtaaattctaaaatactggtaccattgtgttgatactctttgcctggaaactgtacttttcacatacagtcctttaactctcaacaccccagcaaactatttgttaacagatgaacagatcatggaggatctgagaacattaaataaggtacgtttgacttttttgatttatttgaaaactcaggcttttgtggttttctgattttgtttgtaacatgttacttgttaatcattatgatacctttgacacctgaagttgcacctgaaatgttttctctaagattttttgttgttgttcttcctacagcttaagtcacccaagagaccagtgagtgcatgatgtgttggcatttgtgcaacctttttatcatgttgttggaaaagggtggaatacctgtcaggaaatggttgcaattttcaaaaatgaaatgttcatcatttgcctaaagtagtcatcatgaaaactgaaggggaccttaactatacccctccctgatttcttttttttcataacccctgctttgttgtttttatttttttcttaggatttatcataaaagagacattgattgattgattgatttccttctgtgtaggcatcaggcataagatttaagtacacatcatttttgaaaatgaaaccagaaggatttttaagtattactggctttctaaagccaagtctaggcagttctgctcccgtggcttttcgtggcctgactctggtaaggcattccaaggcgctctgactcgcagttcatagaagagaccaaccagctcagtattcatagttgttccttcggaacagcacttgagatcatcagtgctagctgccaactagaattctgaattggtgacatttttttttgtttaaagcaccatgattactcgattactcgattactcacacatccctctattactgagtcttgtggaagaaaacaagagtcttctttttctaggtaatatcttcctggggccactgcggtccacagacatcctggccttctgaggcacgatggggaggggtgagggagtgtgtgagtgtaaagttagtagttctttaagtgattccttttttttttttttggattatgagtcttgctctgtcgccaggctggagtgcagtggcgtgaactcggctcagtgcaacctcgactcccaggttcaagtgattctcctgtctcagcttcccaagtagctaggacaacaggatgtgccaccacacccagctaacttttgtatttttactagagatggggtttcaccatgtggccaggatggtctcatctgttgacctcgtgattcacctgcctcagcctcccaaaatgcggaatcacaggtgtgcgccaccgcaccctgctgaaaacgattgcatttttaagagatttcataatacttgccctttgatcaccagggctttagtcctactctaagtgaccttatgtattgcacatttgaccttaatcttcctgaaacccaggtgtctcttccatttgagaggctaattgccttgcctacttcccagggttgctttgatgatcaagtttagatggaatatacaagagtttgctgaaatcccatgcattatcactgtaagggctcagtgatgattattaccacattcgatagtgtttcaattaaagcatgttaactggtagactcgcatgtgtttgttacattcttgtcacgtaagtattggtttcctccagcatctccatcctctcctgagcacttgcctgcaaacccgcggaatctccagcccagaggttcgaagctcggatagaagatggcaaactgtacttgacaaaagatggtatgttatgggaaaacctggactagtaagagtctcatatgaaccactggaaagagggctggggctattgtagttatttcagatcacggctgctgctaaacttacaagtactaaaagtagaaacccattaaaaaatgtattagcagtcatttaatcaatacttccgtggatctttgaaagcagcgtttcccaaaaccatgttctgctccccttccttctccatttggtgtctctgtactagaatttgcaggctggtatcttgtgtggtacccctgccaactgggctggggtgtatgtcccccctctgacccctcttacctctgctcctgtgtgctaaggttataggtgctcttcggattaaaggattttgtggtcaaatcagtttgggggatgatcatgttattaagataagtgggttgctcccttgtagtaccctttgggtcctgcgatatgctaatgtcactgtgaatttctaagatgttattagatgttttttgatgacacatacccttttttcttcatgatccagctgcaaaagtggtcaaggacacttgcttgggggaactgtatcctaaaacttcctagtttgttttttgttttttgagacggagtcttgctctgtcgccaggctggagtgagtggcgtaatctcggctcactgcaacctccgccttccaggttcaagcgattctcctgctcagcctcccgagtagctgggattgcaggcacccgccaccatgcccagctagtttttgttttttagtagacacgaggtttcgccatgttggccaggttggtctcgaactcctgacctccatgatattactgccttggcctcccaaagtgctgggattacaggcatgagccactgtgtctgcattcctggtttacattgaagactctttgaaacgttcagaccgcctagcatttttcttggaaaggtaatggcaaaacagtatgaaagaaccttaaaagctcatacttttgttcatcaacaaacatttcttctgttctgtattacgctttctgctagatatgaaatggatactgcatcatttctcaggtcttttcattctgatatatttctttttattctttatccatatgcagcatagtctattcattctaaggcatagtggacatacggtttgctttgcctttctgtttggtatattgagaatgtttttctgggttactgtaaggtgtctcattatcatttataatggcttataatgaccctttgagtttcagtatctaaccaaaagttccaaaattggggtaatgatttttattttgaattcttaaaaaaacccagcattgtgttaggttggttacccgataacatttacttgtcaaaaatgcttagggttctagtcatggccgaagtaaatcatttccacctattagttgcagtgagttaattgcccagtagatgctggaggctggctttatctctaaggctgacttgatgacttcttcccctctgagttggtgttctttggcattcttcagaaaggtcggttgtgttatatcttaacattatgtctcagaacacatcgccactaggtggcaggctctaacacttaacactgagaagggcaaaatgagatgaaaaatgtttctaataatgaaaaccaaatacctttaaagatcaagcccacacataagaaccatctttgaaaatgatgagatttatcactacatttttacaaatctatgagtcttaaagccatgtgatatttccagtgatgttcatttttaattgtgttgctttgaatcttcctctttctaagcttaatcctcagactttacgagacagtcttgagggtgaaaatgcagtaaaataaaattcttgtttttttaaagaagagatccacatgtctggtgtttcctaatgtaaacaaaatgatcagatttgatgtgttagaactcctaacattttgaaggaattttcaccatctttcttacattaacagcagaaatttagaaaataattcactggatgcattttactttttcagtgaaattgaaattgcttattctcttgttaaataactttgagaatgttgttttttttctctattctgtatacttttcatttttggccttggcatcagagatcataatgcagttgttgaaggtgggtctccctcttccccaatgacaattgaaagtgttcctgggaatactggctgaggtgttcactggtgcagtgccagcctctcccatctaccaggctcatgtttggcttttgtatcagtttggaggttttgtttttctttctttggcaacgtggcctgtggctgagaggtcagctacattgctttatgctctttccagagggtatgggtattttggtgcagccgtatttttggcagaagatgtcttcctgagttttaaatgacttcgcaaaacaaatgggattcaggcatcgcatcttggtgtgaatacttgccaagctccctttattttgaaagataaggatcttccctttgccttggtcttatactgcttttaaggcattcttatcatgctatgtaaatttgcctcacattttgatttggactaatgatctctcaaaaaatctgtgaaaaagtagctgatatttgaaaataactaattgatggtacgggtggacttctgttttctctccttgttttaaatctggggctgcctgtgagtcagaaacgaagccacccacttctcaagagcattttccccttcagccttcggtcgacacaaaagacttaaaacagtgaatattaccagtagaattgggactccttgaggttctgtagctataacgtggactcacttattgggaaataaagtgttaataccaggattctcagtaggatacaaaattaaattaattttcctcctcctcgccccacttttgtgtccaccttcttaagaaattgcttttcgaaaatagtacatagtggtaatttctagttttgttcggtttaatagtagaggttcaaagctttaagaacttattgtagagattcccaggtcagaatttccattagttacaaagtaatagagtcagtttgaatttggggcttagtctttgaggctatttaaatatcttttttcagcagctgagttgcagctgtaaaacaggttaattggcctaaaaaaaaaacgcacatttttactaccctgttgatgtgcttcgtagcacattttatatctaaacatatttttaaatttcttcccccccctttgattttctttagaaattaaaaagtaaattcttatgttaaggttgtcacatacttcttggtttctctttaaccgcccccgcccccccatatgaacacttcattttttatttttttgagacaggtctcactgtcccccaggctggcatgcagtggtgtgatcatagctcactggagccttgatcccctggctcaagcgatcttcccactttggcctcccgagtagctgggactacagtcctcattaccatgcctggctaatgtttttttgatttttagtagagatgaggtcttgctatgttcccaggctgtcctcaaactcctgagctgaagtgatcctcctgcctcagcctcccaaagtctgggattacaggtatgagccctgaacactttaatatctaaggacttatcttttcagagattcaaataatttaatagatttggtatctagggataatggttcccccaagacatcgtgtgtgcatgaggatcccttgaaggtctcagagactgcggttcaggagggacctggtgatcattggtttggaagttggctgctttgggaagcatgttggccacctctactttggagcaaatgggaccaatggtggacattcaggccaccaccattcagtgattccaaaggaggcggatctggaggtggccacattcccaagttccagaccacttcccagaggtaatagaccagcttgcatgtttactctgggtgttcgcttttaagtcagttgaatttcttgggtttgggttctaagtccactgaaggaaaatacaatgcatctcatgagaattgttggaatagccttccagagtcactgttttctttaaaagacctttgtgaggatatgatacatggatacacatgtaacatgtaatgtgttatttttggttttttttttttttttgagacagagtctcgctctgtcgcccaggtggagtgcagtggcgcaatcttggctcactgcagactccgcctcccaggttcaagcgatctcctacctcagcctcctgagtagctgggactacaggcacacgccaatatgcctggctattttttgtattttatttatttatttatattttttgagacagagtctcgcactgtcacccggctggagtgcagtggcgccatctcagctcactgcaacctccgcctcccgagttcaagcgttctctccctcagcctcccaagtagctgggactacaggcacccgccaccacgcccagcaatttttgtatttttagtacagacggggtttcaccatgttcgccaggatggcctctatccctgacctcgtgatatacccgcctcggcctcccaaagtgctgggattacaggcgtaagcactacgcctggccaattttttgtattttagtagagacggggtttcaccttgttgcccagctggtctcgaacccctgagctcaggcaatccacccaccttggcctcccaaagtgctaggttacaagcatgagccaccatacctggccagttttttttttttttttgagacagagtctcttcttccagccaggctggagtgcagtggcatgatctcagcccactgcagtccctgcctctgggttcaagcaattcttgtgcttcagcctcccgagtacctgggattacaagcgcacacaccatgctggctaatttttgtaattttagtagagatgggggtttcaccatgttggtcggctggtcttgaactcctgacctcaagtgatccacccacctcggcctcccgcagtgctgggttacaggcgtgagccactgcacccagctgtaacatgtgtatgttttatcataaacacagaacatagttgacatagttttttttggtttttttttttttacctaccagtatatggagcagtttccacactcgtaatattctacaccacatccatgacctttctttattaaagtgtttaaaagttgtatcagaatgacttgagggtagttgcattttgttttgtgtctttatctctttataacttacagtccctttagaacaactgtgagtattctccctctgtatttttattttaacattactcaagacatgactgtttacataggagagctggctcagatgtgagagagaaacaggggaagtgttagtgttagtatgaacttagccttttcttatgcattgtacagttcggccttgtgataatacatatttagcataatgaaggtcccctgccagtttaccaactaataaaggccaaaagcaactttaaaacttgcatttaaaccattctcgctgttctaattgaatttaaattcttttttttttttttttaagatagagtctcgctctgttgctcaggctggagtgcagggcatgatcttggcttgctgcaagctccgcctccggggtcaagcaattctcctgcctcacctcccgagtagctgggattacaggagcctgccaccactcccggctaatttttgtgttttagtagagatggggtttcaccatgttggccaggctggtctcgatctcctgaccttgtgactgcccaccttggcctcccaaagtgctgggattacaggcgtgagccaccacgcccggccaaaattctgtttcttttaacagtattttcagaaagtacattgacttggaaacctgagtttcagttcataagtagcaggttaaagagaattgagaccctagactggaaaaagctcattagggagtgaagtgcatcctttacttgccatgtcttggcaataggttatttccttataccacaaaacagaataagccatcatgctttgctgggagatgtgttttactaaatttacacgagttatgggtctggttagccagatctttgcagccaaaatgaaccaaagtttatgttattaacgacgtggggctggcccaggccagggttgctagctgcagctccgctgatacttccaactttgtaatccagcaggggctccttcatcctgtggcagctgcttttgtcccatttgggcttggcccccagcaacttcactttcatccttggccttgtctctgaacttgtagaaataagaatggccctacactacaggttgagagtagatgcaggagttgaaaggggagtgtctgtcttactactgtattcaaagcagctttcccaactgtccaggccaaattagataccctttggtatcgtcatggcacttggaactttgcctgattagctgttaccaggtgtggttatttaatgttcttatccccagtgtatttgaatctctgtgatagtggagaacttgtggcctttctcactgttgtccccagcctccagcatagtccgtggtacacagtaagtgcttaatgagtatttttgatgactgactaaagggttaaagtcagccttccttcttgttggtgactgacttggacaaaagaaaataaataacggtggcttatgcctgtatattttgtctgtccaaccttcttcagtgtctggtgtggggtcagaaaggggaaacagagtttttatttaacaatttttaatttacttttgaactgggtcatatagtccaaaaaaagggaaaaatacatagttttccaacactttcccagccttttcccttctgtagagggaccaaggaatataagctttagatcccaaagaagataggtggtcttctaacctaaggatggaagcctttatttatttatttatttatttattttattatttatttatttatttatttattttttgagatggagtcttgctctgtcgcccaggctgagtgcagtggcgccatctcggctcactgcaagctccgcctcccgggttcacaccattccctgcctcagcctcccaagtagctgggactataggcacctgccaccatgcccggctacttttttgtatttttagtagagacggggttttaccgtgttagccaggatggtcttgatctctgaccttgtgatccgcctgcctcggcctcccaaagtgctgggattacaggcttgagccacgcgcctggcctcaggatggaagcctttaaattaagctaaatgggaaatccaggctattctcaaatgtgaattattaagacttctttaattataatttttgttgtgatggtgtttttgtttgtttggtttttacttcctgtctctgtccctccctttttaaaaatgtgtgccttgttttgtcaggtaccacaagagccaggccatctatctggagtcaaaggacaaccagaaactggctgcgtgatcagttctgtaggagccaatgaggtgggaaccacactccctcacctttaggaagcaaaatgtgtactgcgaagtgttggtagggcaaacctgaaatgaaagtgccaccaggaagtacagtggagtactgtcttctatgtgggttagattctaaagtcaggcagaaattcacattgtcaaaatcatccttgaaaagtccttacattcgcttgactacaacatatgcggtttgtctattccatggggtatttgtgaactcccggtacagctactgatttgggaaccacgagctagattccaggaaagaacaaaaagcaagtctgtgtggtgtctgtacattcaactctgcttctttttttttatttttattttttttgagacagagtctcactctgttgcccaggcggagtacagttgtgctatcttggctcactgcaacttccacctcccaggttcaagtgatttcctgcctcagcctcctgagtagctgggattacaggcacccaccaccacgcccggctaattttgtatttttttttaagtagagatggggtttcaccacgttggtcaggctggtcttgactcctgaccccgtggtctacccagctcggcctcccaaagtgctgggattacaggcgtgaccaccacacctggccaactcctgcttctttttaaggtaaccatctactgagaatggagctgactgtggagcatactccatcttggttttgtttctctagaactttcacacataccagtgatttgtttcttgctgtgaggattgaatgaggcacctggcacagggtctagcacccagtagtgctcactaagtgagtgctggcctgaaacgacccacacgccacttgcctgccgtcttcctagctgagatgtcctattgtgcttcaaaacaagttgccagggttatgcccttggttttggtctcctcgagacactcctttaggatggatggggtctggttttaaagtcagctcagaggttatacctgaggatgatatgactgccctctgagttctccaagtggtctttcatgagggtatataagcaatgtgtaacttatgttgttagttaaagttaaaaactttaatagctggatggcttgatcttttatcagtccacaaatgtctgcaaagaaattgatttctatgtgtctgcctctgtaacttattcgtgccagtgcacagtaaatgtaatgaaactggattatgaagtacttaagcctcttctattcttccagcttcctgaattgaaaatgccctgaaatgtgactagttgcaaaatgattgtttacttagaagttagggagagccttctagataaatgaatgccatcttctctgggctgaggatccgtgtgagtcccctcaagccaagtcagaaccagaacagggagctaatagagagacctggtcctcagccaagaggtgtcacgatttcatggtaatcatttcacctggctgtctgggttgttccacaagcacatgtggccttctagtacctgaccctaactcagaaccagtgcattattctcctctatgatacctcaagatttttcagaaaaatataaagcaagttagattgtttttcccctctctctgccgaatattgtcgcgtcttgacataataggtgtcagtgagatctgacaaatggtgacactgaaacacgtcttctggaggggagaagctcagtgcactgaagacatgcaactctggcaatggggaaaccgttctcatttcttgaaagtttccagctcatttttcagatcaaattctaggtgacactggagctacttggctttagcatgcttgactccaagcaggtttggtgggtagctctgagtgtgtggatgactccctgacttacttttcttgggatcagtttttcatttaaaatgattctgcaaggtcccttggaggcttagttcatgtgaggtctttaactttttaaatttttaagccagtgtatttgactttaaagcagagagatactgctgaataatcacattaaagaaattgagatgaaacagaataagcttttttaaacctgaaaactgagtccaggaaggaggagataaatctgtaaacttgtatatttgggtagatgcagacctttcaaaaaactgtgcttttggctctatttaattgcatgttacagaaaacaggcaagaagaagccagagactgctttagtagagaagagccaggggctttgatgtcaacaccagaattcacgtcgtgataagtgactcagccttgctgagctttggtttcctcttcttaaaatggggccaatgatagtagttatttcatagggttgtcttgcgggtgaaaaagctagcctgatcagcatggtgtctggcacacagagctcagtaaccctggctcagggggtcagtgactggcagcagctccccttctcacccatggctttaggatgccccttattgagtgcacttgtcagccctggcagtcccctgttgcaagagttcattctcaattcaatggaagaatgctctgccctgtaaaatgcactgtaatctaatactgtctgtgagagggggatatggtgagggggaaggactctcggaagtgcttcaaccttctcatgatcctaattgggccttagctcatagtgggcatttttctattgttgatattttttccctgtttttctgcacaaccattagcctcattgccaggaaaccaaagtattgaaagtttgtataatatggaagtcccttggagcaagaaaatacttccaaatttgaaagtttgtgtttatgaatagatgtctcttgagtgttgatacacagtaatcaaaccaaatttaaaagcatctttaagatcaaggcagaaatggaacccaaattgctgtgctttccattttcgtaatcacaggtgtgagagagatggctgagaaacgagtcaaggctgatgcctgttcccagcggcatgcctttagatggcccgaggtcaggggtgctttgaagccctcacaagttgagacagtttattccagcaagaggctaccagccttctgcttgatctcactcgtgcagatattttgatggtgtaggagatttgctcttctgtatttaactttcatcttgttccctttcctctcccctgcagatctgggtgaggaagacaagtgacagcaccagatgaggatctacctgggccagcttcagcgcgggctcttcgtgatccgccggcgctcactgcttgactttctacagtgctcttctcttgaccctttttctggagtgggttttattttgttttgtttcgttttctccttaatagaaaaatgttaacttactgggaatagctactcagcttggaaatggagagcactgcagtgaattctttagggcacttttgtggccggatgcttcaactttgtcagtcttttctgcctcaacttcttccagacatcagtcaccatgagactgtttactttcaggcgtattggggggtttgatttactttccttttatttctttattttttgctatacttgtttttgaaaacctcctctgagtttgaagggacagctatttttattgattatcttaagtctctctaccatggagaagagcaggaagggatacactctccagtgcattttcatttttgaatctgattagtggatcacgtagctactttccctgtcgcgtccaattcactattgcccagaagcttggggcagaggtcctagcaggagatgatgaattctcgtggctctcggcttctcagagaaataaatgctttgtgtaacatctgtgcacaccatccattccgctcgctggcgatggaaaagcttgcctggaagactatgtgcactgaagtaaatggggttgggggagggacatttcatatttataatgtgctgaaggtaccatattttaaatgttatttaatgcagggatttattcaaacatttgttctagcttaagctggaataagcagtggtcatttcagaagtttcatttgtaattccttcctctcccttgttcccaagtaggtagtagtaagtatgtgccaaggctgattatctgggtaatcttttacgggtgggaggtgagattgatagtgcaataatcgtgatctatagaccctcatgcacgattcaagtttcactcttgtggctgatgccattattcacattggccattccaaacctgtggagaactttgttgtcaggccctgagcgctcacagctcatttggcccaggttgaagacaaggaaagctctgctgtggctgcctctggactgacacctccctaatgagtcctgatgaaacagcctttcctacatccttccctcactcccatgattgagaaatgattcattgggtgatgagtgttggggttttctatactcatgttgccatcttggatgttcaaaaaatttggggttagagcaactgttagcgtctctatgagcaatcagtagacttacacatcctaggaaatctttctttgtaagtaattcttttggtctcaagtgattctctcatgttgtctcttgatgtacatacccccaagcaagttggggggactgtgatgacaattaatcaccttctctgaagttctggctctgcagagaccaaaccttactgacttgtacagactgtacaagtaaagacttatacagatagatttttgttttaacttacaatccgttttttcccttttttttttttttttctggtgttggagtcttatttagaaaacaggataaatgacgctttatcaaaagttgcctggggttctgtatttcttctctgccctccaatccccgactgctagatgtttactacagtgaacccagcccatggtaaacacaggcttcacctgttcttgtttgtagccttgactgtgaggcaggacttccctcgcttgaactgttacacatacgatgtgtgttcacatcacatattgtgcagctgttggttttcatgtagtgccctgcgatggaaattagaatatttcatgtatttttccattgaaggtggagtttttcaatgatcatgtgttttgtcctctaaacagtataccaaagtttgtttttatagttgaggattgtattgataaccactggggtccgcattgaagcaggaacaaattgcctctttttctggccttctctgtgggacctctgctttgtgaagcaactatttatttgaagaccagggtatgggcacttttgccttctctcctcctgacttttgagggtattgagggcgcccttagtcatagtctcgactccgccattgcctttcctcggcgtcctcacaactcttaattgggcctagtgaaaatgggggcaggtgagaagtcattttgagaatcagcatagtaaattacatttctaatcccagaggacttaatattttctttgtcaccccagaggtgaaaaatcagcagttgaagcctgacaggcctcagtggtgaccagaacagaagcagccttcctgttagtagatgggggtacttctgtggtgggcagaagccttctaaaggggaagacagactttgaagtttctagacgagaaggaggctagcttctagcctggtggccattattccaaaaggtcattgtttctcactagaccccagggcaccagatgaattccaagtttaaactctttcctgcaggtgattactttgaaaaaggttggtccagaccatttgatcaagaacctgtatatgtgttgtgttagaggcatctgcctcaagtctatgtacagtgttgctgcgggtgtgttccaatattcattttacctctgcttgggggttttgtgtgttccctccccccatgccctgcctacccccttttccctgaaccacgtccttttgaataatttccaatggatttctgtagccataccaaagccagggtgttttcattcatgcggatactagtattatagatgtctgactacctaacttaatttttgtttttgaacttctaattggggccagtgtaggtcgatcccagaggctgatctgcaaatcaagctacatgtatttgtgtataagacccttgttcaggactgggtgacttttctaagaaatatggggtttagaatggggttgactgtatttttaacctaattctggagagaagattgtattttttacagttttttgggtttggcttcctctcacatttctttagctttgaatttttactaaataaatttcctcctgattaatttttttttctcatctgggaatttgaaatctcggtgcttactgttacaccaatttgtccaaagagtgaaatcactttaatgccagaacatggtaaatttgcagccatttcaagcaggtgatggttttttttataacatcgttaacgggtaccattaaatattctgagaggtgaatgtaaaataaaaaggtataggtttttttttttttttaaagaaaacaataaactttcaaagagaaaaccgcatgaagtctgtattgtatccattgacttgataagtgatagaaatttattttaggttttgatccattgcttatggggaaaggaagttagggcagaggaagggatattctagacatttattcttagtgaagactaagatacagaatgatgtcaggctaatactcagttttgtaaagacaatctggggtgttgacccttaaatgtttgtgcactcttcttgttgcagataaaagtcataaaaatcaagtgaatagaatggatcttgggtggaaaaacaatcttgaaataaacttgtattgaggatattgttcatttggtgcatgattaaggaggatattgttcctggcttttgagtagtgcctaccaatcttaaccaaacagtgatggtatttgtactgctcccggggtcagccacaagcctgcgtgctgccacaggtgaccgacctgtgacccagttatggcacccctttggaaagactgctttatgctttagatgatggagaggggtggtttctgtttttaaaatgtttgattagacagaaatgtgcacaagttttaattgtagaagttgttgaaatctctcaaagtgattcatccatgtaactattatagcatccagatcaagaaataacattcccagaacccacaaccccttagactttcagctactcctcccaactagttttctctattttaagtaccttaacctcaagctcttgagctgcttccttccatggttgttctagaagagccaggtacctggtatagctagggattgaccaggaatgcaaagagctagcagcaaaggatatgactaattggggagggaaaaacagattcaggtcaacctgctcaccctccccattgttcccaaggcaagtggggttgcccttgatgtcatagtctgccttttcctgagtactttgtatatatgccaggcactgactaaacccctcatgggaggcactttctcactaatcttcacaatctctgaaagagtactactcccaaatttaaggctggctcagtctaagccttgacttaattctagaaacccagagccagcactgtgcctcatacgtaaatactctgtaaatgttagcaaatgatattagggtatgtgtgccaaggcaaactggtgagtaatagtgcatgttctgggtgctggccccttcccttggttacctcatttaagcctcataataaattaaggagagtacactgctgctgtcaccagtatcaattattattttggtcacccatgaagcaagcatctcaccagtttttaaagaaggaaaagactccttgaattagaggaggtgattctccaaggtcacacagtacataacagtctggattaaagtttccaagccaggtttcccctaaccactacactttgcagtccttccccatgttatctgttaaaattacgttcaacatttctgcctttcttcaggatttccctgggaggtttttttgtttgttaaaatacataagctgctttcacctcctatacacacatgctcccagagcaaatgctagaagtacaaacactattatttgcaggaccctttcccctgcctgataactctggtttctctcttggcaatatagttgagagccatggtgaccagccaagagcttgctttctgtgatcctgcatgagtataaccatcctaaaaaggaatggaaacagctcattggtcgtgatagaactgctttatccaataagctacaagagagcctttgggcaaaaacatgtatcggtatttttcagatcacttcctccctccctgccttatcatctatggagttggagccattgaattgtttctaaaaatgtcggtatggagttgggccttcagcatcttgatgctctgatgtcactgacctttccatggcatgccctcctgtagaggcactgtaatggaagaataaataccttagtccatgtcacctgccccgaaactgctcagttctaattggcgacctgcttatcaaccaaacaggagtgtgcagtctttgggcagaggcaggagtagaaccaatttctggcctcttgcacatcatttgaggaactctaagccccatccttgggaaggctaagcacttttcctgcttttaaaagcaccagatggaatgaactagaaacatcatttcactccctttgaacataatatggtaggaatacatttgctttaggaactttggtgtttaccagaatagatgtttttgtgaataatgattattaagacaaaaaagtagatttaggaggatccttagaggagagaggtagataaggacagcataggtaccgagatgcttaatccctttgctcattttctctaatctgtgtttaccgattccctgaaagatacagatctataaaatattcactttactgatacgagaagaccaaaacccgaatcttaaagattcatatttttcagaagtcggagacttagcggtgtgttgtgttttccgtaggctgatgctcagatctgttggcatcacctctctctgccagtggtgtggacggcagggggtacagtaggtggcattcccagagccagtcaggaaaacaatgccccaggtctgggagtcagcaacaccggtacggagcaagcagatactcaacgcaggagtacagtacagttagcaagcccctgcaggtaaccaggaaccccctttatttcaccaccaattattttcatagtgtttgagtgtttactgagatgcagggtggcattatggctaagaacagaagctttggatcaggatttgaatctggctttactgttaagctggctaggtgtgaccttgggcaacttatttctttgaacctcagtttcctcatttgctaaatcatatctacttcagatatgtttttgggattctaataatattaacacagccccaatttccttctggtaggaatacaatttaaaaaatatttaaaacatagcacctactgtgctaagtattctgttaactcactgaatcctcgtacaaccctatgaggtagctacaattatagtccttgttttgtaattgaggaaatcgagaaaagagaggttaagtaacttgctcaaggtcacacagccagtaaatggcaagccgggattctagcccaagcagtctctccagagtccctgccctcattcaccctgctgtactgtgaggagtcataacacagggttggacatggttactgccagtctgtggagactgtccctaccattacaatgctgtggccatttgtatacttctctctttggatgctagtctgactactagatcctaacgatcagaaccatttcaggaaagctacttcagctaacagcagaccacgaaggtaaagctctggctttagagaccatgctcagcatcacctcctacaaatgggtggggactgccccagggcaggggtgagaaggactctgaggcccaagttccagtagagcaagaaacagttgcccaaccattttttctgctgtgagcaagggagtccatttagtgttcctgatttagtttgagccctcatttgaagatgaaaacagctgcagcccagagatgttaaatgactttcctgtggtcttgagctatagtcagtaccacagctgggctatagtcagtactacagctggaatatggttagacaatcatttgaggacctctttatgccgggctgggtgctggaaagcatagtggacagctctgggatatgagactttcaggactaaaaccagaaagtcccaggcacactgggatggaaaaccctaacactgccatcgttctatgggttcatttttgcctctgtctgtacctgcccagtgaggtgatgaaggccctgagttcataatcctggcctagccactcattaaccttgggacatttcttagtctctgtgtgcctcagtgttagggtattcccatcccagtgtgcctgggacttctggttttagtactgaaagtcttgtatcccaggagccctgtcagactggggcaagctggatggttggtcaccctacccagtttccactgtaaaatgggggtgacaactgctgtttttcacagatttgatttgagggttaagtaatttattattgataaagtacttagaaatagtgttgggacatagtcttttctctctccctttctgtgtatatagatatacacacacacacgtaatatgtgtgtgtgtaatataacacatatgcacatgtatatatacacacacatatacataacacattgttagagatgaggtctcactgtgttgcccaggctggagtgcagtggctattccaggcaccatcatggctcactgtagcctcaaactcctggcctcaggcgatcctcctgcccagcctcccaagtagccgggactaaaggcaatacatatttatttttccttgttattcttttttcattattattggaagaaagtgtttccaccacagaacgggtccctggagaccttcatcttatcccaaacaagacagggaactttgctatgataatcttttggtcacctgcagccattgtttggagtgtttcttcatctacttgaaatagtaaataatcataagcttgaggaacaatttgtcattgcattcaattcaaaaaccatttattgaattttactgcatgttaggtagtttctaggctcttttgggggattcagagaaagctaggcaggccttgagcagtgtctatgacaagaatgggaattccatacagaggaaatggcttgagcaaaaagacaagtggatatgagcatgtttaaagtcaaatagtagcgtgtgtttaacatacatcacaagccttgaacttttttcttttttctttttttttagacagagtcttgctctgtcgcccaggctggagtgcagtggacaatcttggctcactgcaaccgccgcgtctcacaggttcaagcgattctcctgcctcacctcctgagtagctgggattacaggtgcctgccaccatgcccggctaatttttgtattttagtagagacggggtttcaccatgttggacaggctggtcttgaattcctgacctcatgaccacccacctcagtctcccaaagtgctcggattacaggcgtgagccgccacgcctggcccaagccttgaactttaaaaccagtttgctccctgtttggttatctttttgccctttccctcgaggactcgccttcctttcctttctgcctctctcctttcttctccccactgtgcctgcctgcttgctcttcttcccctttctgtcaccagtgcagtggctcatggctgacctgcaggatgctttccaatttcacactaacatgctcctgaaagtattaataagctaactcatatgaaaaccaataaagggcaacagcacacattcctgttagacagtaattttacctgattcccttctcctactttgatcagtcctcttctctcaaacatggttctttgaccttcccagaagtaaagcttatgggaattcaagcttggtggagccctgcgggcatattaggaaggaataaggctcaaatttattgagcacttatgatgtgtttgggtgagggctaagtactttttatacatattgtatttaatatactaaactgccctgtgatgtgtgtcttcgtgatttccattttacaatgatgaaaatgaggcttgaggaggggaagtgttcacctctgcaccacgttcacacattcctttcccctttggcttctgtcttcctaatgtagatggccaaagcataaaggacccttattgtcatcttagccaaccccttccatttttcgcttctggaaacagacgccaagctagaatcagttcttgtaactctcaattcaacaatctaaatggagaaaagaaatccagttgtgagctcagaggcaggggcttgagacaggtttgaatctggattgaactctgctgcttacaagcgtgtgaacttaggcaaatcacataacctctcggggctccagtttcctcatctagaaagtggactaataatagcaaggtttattgtcaagattaaatgaagtcatgcaagcaaaacaattaataactattgtgcttcaaacaaactctgtaggtcacttgagtgctttagaaaatatacctggccaggtgtggtggctcacacctgtaaccccagcactttgagaggctgaggtgggggatcac

SEQ ID NO: 5070 - DNA, 47112 bp, Homo sapiens
aagaccagaaagctagaacagaactaaaataagatcatgcatgtcacaaaaaacagaagaaaagaccactgctcacaaaggaactgcaactttagcgatgtagtcctcctgctttgcccattttacacttgaggaaatggaagcttagaatggttagataactgctcaaggtcgcccgtttattagtggtcatcaggattagaatctaagcctcctgagtcatactttggtgctcttccataacagcatagttgtaccgattacattaatggtagtaaatgatactttaaaaaggttccataggcaagaatatttaaatagagtgttaaacaagctttctcactgtaggacttccaatcctgttaaaatgccaatgtatactatgaatctcagaggaaacttagatgtttcccgctcagtgtggtggctcacacctgtagtcctaactactcagaaggctgaggtgggaggatgcttgaacccagtgagaccagcctgggcaacacagcaagaccctgtctctgtttaaattattttaaaatttttaaagaaaaaaatgtttccccaactttggacaattcttcactgtatattctaagtaaaaacgaatataataaactgactttgagctttggggaagtaaaagataaatatgtaaaacatcaagttcatatgacatactcaataaacactggttctacttaaagaaatattgtgccacatttttctcagtgagcctgctgcaatgattttaaaatcagggaaaaaatagtttagtaaagaaatggaaggaatgatactccttctcaggactgtgaattttctggtgtatttcttctaaaaatctaaatgtattcccaattatctcactgattttcccataaagagaatgaaatacacacaaagaatggagaagcacttctttgttccctaagtggcaaagcggcatgtgacattaagccttctgactccacatccagtctctttgttccccaagtctaatccaaaactccaagaagaaaagcttcttaccacctgggcttctgaacacaacaggtgcagtgagttggggtcctggggggtcgcctctagatccatgtcatcactgtcagactcctgagcacagcctcttctgctccctcctcatgctgccagcccctctgccctggctcttcagtctagcatcgctgcctaccaggccagagtgagaggctgctgcttccaggccattactgggcaggcaatgacctgagcactcatcagggcttccatctcttcaaagaaggggcaggtctcagtgggtggccgctcttgactttccgatagctcttctggagacctttgaacttggtccgacctgttccagggtccggaggaagccatattccctgagccgctcagccacagccccatacattggctgttcctatggcagtttctgagagcctcataaaactcagtctggctgagaattggaggagcgttctggtctcttcatagccccagtgcacacctgccaccttctcatcttcaagctccagtgatcctgttccacccagcttcttctatctttcttggatggtaacagatcagatgcactcgtctgtctcctatgtggctgccacttggaagttctttctccttagagcccacagatctgggatccatggctctccttgctccaacctggagaccacaccggatttaggaatggcaatcctgcttgcagggaaacaaacaaaagttgtcatagtttggactgattatcacaaaatcttgaaattcagtcctgcctttttcatccaagaggattataaacaaagtgtctaggaaatgttttcagaaagttcagtgggctgaaaaaggtggggaaaatacaggaaacctcaaagatgagaaatgttttattttccagagcagggtgacaagagaggaaaggattctgtttgtgttcagagcagataattctattccaagctctcctatttgtaggcaggtcctagtacgctgggaataattgttcttcacttggggctacagaattaaactcggcgtgatttcaaggggaagcgagagaagattgtctttaccttatccgtttccttcacagtcagtcaccaggtttaaaggtgttcaccttagtagtccttcctctctattcctactgccaccatccaagtccaactacttatcctctcacacccagataattgcagcagtcactgttctacctaaccgcaggtcttgcttgccagtgcacatgctaccctggtgaaccttaaccttagtgcctaccataccattcctgtcagactcttcccttcagaacacagcacactgttgttcaccactctgtgccttacttttaattccctcctatccaattttagcccatccttcaagaggctgtatttgccaggccctcaagaagccttaccgtcagccctccctcatctcccactctgacaaacccatacgtactcacacaattgggcaagtcattgtctggcactgtttcagttcagttcagttcggcaatacttaagagttagctatagtgttctcaatcatgtttttaagttctttgaggataggccattttcttattgcagagtaccctgcaagatgttgagcaccttgacaggtgttcaaaaatgatgaactctgcaagtctgtgtgtgagattcagggatttcatctgggtgactaaacagccattaccaaactggctgagaaggctattgtcttggatgataagatcagaattcaaaacacctcaacaaattttaagtgaaatggtaacagaaaaaagcatacaacatggagatcaatgactacaaagaagaaaaacaagttctacaaaaatcaagtacaagaataatcaactaggttaaaggcattggggaaagctatcagagtcctggaagttaccaggtgaacaaaaaaatatacaggttgggctatactgatacaagacattgcaagattctgaagtaaaattcttacttacttctaacagactttcaggaaaataataaacataatttagttccccacaattaacatgaatttggagaacttaaaggttccaatagagagcaacagaaacttaggtttaaagaatggacttggccgggcgcggtggctcacgcctgtaatcccagcactttgggaggccgaggcgggggatcacgaggtcaagagatcgagaccatcccggctaaaacggtgaaaccccgtctctataaaaatacaaaaaaattagccgggcgtagtggcgggcgcctgtagtcccagctacttggaggctgaggcaggagaatggcgtgaacccgggaggcggagcttgcagtgagccgagatccgccactgcactccagcctgggcgacagagcgagactccgtctcaaaaaaaaaaaaaaaaaaaaaaaaaaaaaaaagaatggatcttctgggggaaagcttaaggtaacaaatatagttaatttgaagatggaaaacaaccaaaaggaagatgtgccttcaagtatagaaaagaattttatctagaaaataatgacctatactatcatcattaccaagaggaaataaaataattcaagttccgataaaaactagggagccattctcttgtggacttatcaagaggtaatatgaaaccagaggctaaactacatgtcaacaaccacatattctgcaatttccacttactcctgaatccctttcccactcactattcccaaccctacttcccaacttggaatggcagtctatctcccatatgaatctactcctcaccgctcctttgaaaaggtttgagcttctcctttgggttatctgctcctgtggtcccaggtctgggcttcttgccctctctttcttgggtacacccctggctggggttccactgactcctgccgaacacttaataactcttgtgatgatttcggggggtcatcttctccaagcgcacttcctgccccttcacagagactgtgacctagaaacaaccccgttaattgtcactgcaagatcataatgaggggcattcccagaggagagtatttaatacccaaaagagatcatctttcagagccatggccagggttgtaggggtgagggaggttaaccgaacaagggtcttattccattgccattagcttaaagcagttgaaactccagaaggaaagatcaaaatagtaaacccaccttcaggctgaaaaaaaaaaatcccctttcttccctattagaaactataggaaaaactcattatgacagggtaggtgaaggtacacccaggaagcatcccagacaagcactatctgaaaaagttacctataccagaccagaagtataagcctcaccagggagactgtgtccctctttaagcctgtctatatcttaatttagccctccacccagtatacacttttgaatttgaattccccctcccttctcaccgaagatctaggtcttccaggctcctttctaaatcttccacgagagtcactgcctcctctccattttctggacattgttcctgacccaattctggatctccccaggtaagacggtcaggaactgctctagcaccaacagttcacaatctgctccttggtgcgcacctccggccttagccaccgacagcaaagttcccagagtggctgaaagcctcccgcggcccagccacctcctggtaatggaatctcctgaaacgctgcggaaggtctcagagttagtgccattctctcttagagctgatttggccatcattaatagagaatgcagcttcccttcgcttaggagtctgggttccagggcttacatctatcttcccagtccttggagaatcccctgcagatgactgtaagaggtgtttcttcctagggcagagaaaatggcactatcagaaggaatacattcatatgtctaaagtcttgccagagctggcctgccttccatgtgctccgagtggccttctaaggtagcacaatcttcagtaaatagactttgcaaaactgcttttctggttgacttccagggcagccccaggaagcagcagagaataaaagtatgtctgcccctctcccacctcctccaaatccgatcccatttaacttccctggccaatgtgcacagtgagtccgaaccatataggagagctggagttcgagaggatctaaagacaagtcccatcctgcttgaaggcaacaaaaagcctctgtccagctggtcgcagctgatctcccccgtatctccgcagtccttcccgaggccttctgcgtccgccccgccccctcgggctgcacactcccaaagcccaccccaggcaaaaatcacgtccagaatctcgggtctttgttttcccccgtagtagtagccgctcagcaaggattagggagctacctgtcggaaaacctcgcgcaagagagaagctggttttggctccaaagcgaggaccatgggggcttggggagagtcacattggcaggagagacggaatccgaggagcagtagtaacgggcttcctgaggacgggctcgggttcggccagaggctccaggtgctgccggttcgcggacgcagagctctcagcccaaggagcgcggctgcgggattctggcctcttttgtctccgctccctccggccgggtaacccggagcgtcgtgcggtccctccagaggcctctgacccggctaaggcgccctgagggcgccctccacccacccctgggagcgtctccctctcgagctgcccctcaaccccctcgcatccttgcctcgggccagcctcacccactcggggtccgaccctgaccccggccccggccccggccccggcccggctctccagcctcccaagtacagctcccaaaccggaagtccgagcgggcggctcgggcaccgagggcgcatgcgcgagggcagcgaccgcgactcagtctccgcagagcccggggggagtagctggtggaccccgttgagctgccgaacttccgggactcccccgcgacccctcccagcttcccgtccgctccgccgcagcgattgtctcggtgggttgattcggcacaaacgcccgacccaggggccggtgcgcgtgtggaaggggaagcactcccctcgtggtcgcctgaggtgcgctggaggagggggtgacataaccagggactcgaggtccgccgtgggaatgatcacgaactgctcttggctctgagcgggtaccctgggtccattttcacctggaacaagcgagtggcctgcaggtactgtccggcgcagagcgcgggaaccagggagcgcaggaggggggcctgagccagcgcctgggggagtaggctgagggacctagcgagcggggcttccagggctggggcgtatccctggacaggtgactggagggcagccccttagggtcaaggctgatgcgaacctagagaggccgggcctaggctagaaaacggagggcagacctcgaagagccccaccttggcggggcgaggaaagggcctgaggtccaggtgtctgacagttgctggggaatgatatgaagtgtgggaggcactttctcctatttattttcacacgtgcattgtttgagttttgaatactgggccaaatacacagctcccaaacacatggtaagcgctcagtaaagtttgttgaagaaataaatgaaatcgagagcgtgtggtgtttccctcattactcctttaccagaaaattctgcactaggtaaagcacttggtagggggcctttgtgtaaccaggaatgtatgatgttcgtatgcattatcttatttaatcctcacaaccaccttatccattttacagattaagctagtttagaatagttaaataactatcggggtcatagctagtaattaacagagcttagttttgagccaggtctgtctggcttcagtatttgaactacttttacctgcttctgcttccagtaagttatctaatgctctcaataatttagtccacttaggtattgtttctaccagttaacaaagagcaaactgaagctcagaaaactttatgctggccagtcctagtagtggcaagactgaatctaggtccgtctgatcaccaagacatgccgattcttaggagactgtggaagagcagaaaagtacattcttagtctataaaacctataaatcaaacagtttcctttcgttattatttagaacatgtatttggagtttgggagtttaggtgaatttttgaaaaaaacaggtgaagattgtgtggtggagtttgaattgttatctttcacctgtaggtctttgaagactaattcgatgttcacttttctccatagatcttagtacaatgccaggcatataggaggacagtatttaggagtatgtgggtgcctgatggtccaaaataagaagagataacacagtacaggaaagatagtagggagggggtgggggagacaaccacaagtaattcatcttttcccttcctttctttctatgaaaaattctcaatcatgtattttctaccatttcatcctcaaggtctcagctttaaatcactttgtcagaaaaactttctctgagcacatctttaagcatcctcccctgatgccatattctccatcaacttgtttatttcccttgtaggatttgtcacaattcataatgtattgtgttacctgtttttagcctttctcccgcatagattgcccctgggagcgaagaccagtggtttcttcattcatctacccagagcacctagcacagtttctgccacatagcaggtgtttagtattgatggaagaaaagaagacaaagatggcaaatattacataatttctgcagagcagttcttttacatttgagtaaagggaaaagttgtcatgagtgccaagtgttaatgaaaattatttattatattgaatatgtatatacataagctaggtataaactcaagcataatactcttaacaactataaaatcaaatatttttataaattaaaagtaaacaaaactaccaaatcaatagttcaaatgaccattattctaatgcaggatttctcagcctgttcctataactgtgttaatagaatggtatcagtaacttcgagttattatttgctgtttcagaataattagatattgacttttcgaaaactctgccaacaagaaacgctcaaatgccaattttaatagtagtatcattgataactggtagagctgtcttgttaataatataaaattgcttatgtgtattgagcacagctatgtggttgggatatgtgctttacacatgtattaacttatttaatcctcacaattttttcttcagtttataggtatgaaaacaggcacagacaggtatagtaacttgcctaagcttcaagcaagtaagaggcaactcagggattcaaacccaggcagttgggctccagagaccggttctttttttttttttttttttccgagatggagtctcgctctgtcgcccaggctggatgcagtggtgcaatctcggctcactgcaagctccacctcctgggttcacgccattctccgcctcagcctcccgagcagctgggactacaggcgcctgccgccacacccggctaattttttgtagtttttttagtaaagatggggtttcaccgtgttagccaggatggtctcgatctctgacctcgtgatccgcccacctcggcctcccaaagtgctgggattacaggcgtgagccatgcgcccggcaagagaccaggttcttaagcaccgtgttgtgcaacctcttaagttactacttgaagatgtgattagcattgtgtcattaaaatctacattaattggattcctaatcaatttctatggacttggtaacagaaaaattcttcttcgcctatttgttaccacatttactgcatataaaatggcatccacatataatccatattatatatccatccatataatatgctaattcctttggagcagtaattgtatctgattttgttcactcttttatctcaaagtattagccagtacctgggatatagtaatggaaatgtaaaatggtacagccattgtggaaaatggtaggcagttcttcaaaaaattaaataaaggccaggcacagcggctgacacttgtgatctcacactttgggagggtgaggctggaggatcagttaatgccaggagtttgaggctagcctgccaacagagcaagactccatctctacaaaaaaaaaatttttaattagctgggcatggtgaacatgcctgtagtcctagctactctggtggctgaggtgggagaattggttgaacctagggttcaaggttacagtgagctatgaacccaccactgtattccagtctgggtgacagagtgaaccttgtctctaaaaaaaaaaattaaatataaaattcccatacaatctagcagttctattcagggtatatcccaaaagaagtgaaagcaggaacccaacagatatttgtacacccgtttcaccaagcattattcacaatcgctgagaggtggaagcaagtgtcagtgcagggacgataggtaattgagatgtggtatatacacacaagggaatattgttcagccttaaaaaggaagaaattctggcatgtgctacaacatggatgagctgaaataagccagtcacaaaaggacaataatgattccactttttttgagacagagtctcgctctgttgcccaggctggagggcagggtgcaatctcagctcgctgcaaccgccgcctcccgggtttaagcagttctcatgcctcgcctcccaagtagctggcattacaggcgcccaccaccacgcctggctaattttcgtattttagtagagacagggtttcatcatgttggccaggctggtcttgaactcctgacctcagggatccacctgcctcggcctcccgaaatgctgggattacaggcgtgagcaattgtacccgcctgagtgattccacttatatgaggtagctagagtagtcaaagtcagaggcagtagagtgtgtttggcaggggctggatacggagtttcatttggggcaaacaaaaaagttctggagaggatggtggtgctggttgcacaacagtgtgaatgttcttcataccactgaactatatactaaaatagctaaaatggtagattttattatacgtattttaccacagtatttttaaaaagtggttgaaggaatatattttcccactacttttttctacctgaactgctgtgaaaccttttatatagcatattaggctatcatttggctttcatttaaattaaaaatacaaatgtaaattggacactaaatatatatggccagttataaggtgcatttacagataataggtatgcttattttagatttttactggaatgaaaacaatgaaaacttctatagggaatttgtaaatcctagaatatgtctgagaaacccatggagtctgcagacccccatttgagcaatattgctaaaagactttgttgcaaccaggtcaaaacccccatatccttagagaccatccctagaagattcttaagaagcaggtaatagcggctgcttctggggtggttgacttatttttaatgtacacattttatattgtttaaattatttagcatgtgttacctattttaagaagcaaataattggtcagggatagggaacccctttgaagtgctttggaaatacattgttatccagaacttaaccctttaagtggacatcttgagaaagaaaacgataaatgtgtagtatgaagcgtttgaagacctgaaagttggggcagcgactggcggtgttttcggcagtgttcctcttcctgcaggttcgcaggacttccctttcctccaccccagtgagaccagtgtcctgaatcgactctgccgctcggcacagactatattcgcttcactgagttcattgaacagtacacgggccatgtgcacagcaggtgggtcctgttctctgtgggtgtacacctctagagggcaggagctatgtcaactttcacctctagagggcaggagctatgtcaagctttcagtgaatttatcggtaattcagtgaaataagttatggatttctcatcactagaaatattcaagtgaaggcaaggcctctattggtttgtttgtataacttttaaaagaaacaagcctgataatgtctttctcaggtttcgggcctgagctgagaagttggcttctgtttgtttgatttcaggatcaccatccatctcacagggccaaggtgggttacatggaatctacctgcgggccttctgcacagggctggattcgttttgcagccttatcgccaagcactgcttgatttggaacaagaggtaagaaggaggagtataggaaacacctctgggacagtagattagggcatgttcttgaatctgaaatgcccttgataagatcaggtagttaagagtgagcagttgcctgcatggctggaaggtacagtgttcctcagtgattgcccaacctgtgatcagagtggcttacagatcatggcaaagactctttatgagtttataagagccctggcttggtttctttatggcccgaaaatcaggattaataaccgattaaattatcagttctcgatagcctaaaattaacacttaagcccatcatgagattctttctcattttcatagatcaaatagatttgagatattttgtgtggagctctaatcacaaattttttattgcagttcctgggtgatccccatctctccatatcacatgtcaactacttccagaccaggtatgctgcccaaataaccaaatgccttgcaatctgttgatagtgttagaatatctaatttatggtactgtttttgagaactttttttcttctggattcagagcctaacatttatattttgtgcattttgtatgttttactagatcaaaactgtttaaagatttccaaattagttaaaacttaatgtctgatattaacgctaatgttactgctctatatggacatcagtttaacaagtatgccagcctcagaaatagaaactgcttcccgactgggcatggtggtacaacctctaatcccagcactttgggaggccgaggtggttggatcacttgaggtcaggtgttgagaccagcctggccaaaatggtgaaaccctgtctctactaaacatacaaaaattagtcgttgtggtggcgtgcacctgtagtcccagctacttgggaggctaacgttctgaatccagggtggaggttgcagtgagctgggatcctaccactatactccagcctgggtgacagagtggaccctgtctcaaaaaaaaaaaaaaaaagaaaaaagaaaaaaaagaaactgcctctctcgccatcctcttcctatctgcagcgaacctccacatcaaattgccttaggatgctggatctgactgttctgtggtattgccattttatcttaagttgaactatttagaaacaaaagcattcccaagttgattttttttcccttacatttgattacatacccttctaattattctctacttgcagttccagcttctttttccctctgtgatggttgtagtagaacaaattaaaagtcaaaggtgagaactttccttattccttttgctttgctaagcactgagggaatattactaataattttgctttacattatttttcgaagaccctagtttttagtagtttttatttattcatcatttaacaatatctgcttggttatcatgttaagtgtcaggaatgcaaaagtatgactcgcctttaaacacctcctggtccagaaggtagaggaaatgttcatagatgttcccaagaagttgttggggtaagaaaaaaagtgctgtggatgtttgcaggtgagaggaacctgcagtaggttttagaactgttgggtgtgaagcagaaagttaattcttaggaagaaggtaataggttatggttagtgtgctggcagttttctgagaattttgagatcagtgagtgaaagccagattttaataaatatgcctattcttatcacaagtttttatcaggtgtattgagaagttaggaaatgtctttctgggcagagttaataagtctgaggaataaatgctttgagatttcatattgaagaatctgctgtcctattgaattggtccacaattggaccaagtggacaaatggattaacatctttagctcaagtcgtcattttttttaagctctttatttgtgccttagcttattagggtgttcattttcattaatgtaactagtaaaccagttaatctgccacattgctgcatctttttaactgtgtaagtgtagaaacagtgctctgctatgttcatgctgtgccagcaaagcagtggtgggtgctcattggcccttcaaagctgattgtcctcatcaaataacaacatccgcttttactgtcactggctgtgtactaggcactgtgctaagtgctttaaatacattatccacacaatccactaaagggctaagttggttaaggggtgtgcccagtgtcacacagatagagtaaatgggtttatatcccagctctatctggctccaaagagtgtgctcttaaccactaattaaactatctcccaaaataaaaggagacattctaggcaaatagagttaatgaggacacataagggagccaggcctagctgcacgtctcagttggccttcaacttccgctggctatagaaggagagtggaaaatagggggattgcagatggctgaatcttcctccctgccagaatatggtagagaaactagtgtaccaaggctcttcagagtttttaaaatcaggtggtcaaaatctaggtttgggttgagaatggagattgattgcagacaggcacaaaggcgctttttggagagtggaaatgttataaaactggattgtggtaatggttgcccagtgtttgaaatttactaaaattgtttattagtatgcttaaaatgggtgaatttcattgtaaattatacctcaaagtgtaaaaataaaagtctggggaccgggcatggtggctcacgcctgtaatcccagcacttcggaggccgaggcgggcggaccacgaggtcaggagattgagtccatcctggctaacacaggaaaccctgtctctactaaaaatacaaaaaaaattagccaggcgtggtggcgggtgccttgtcgcactactcgggaggctgaggcaggagaatggtgtgaacccaggaggcagagctttagtgagccaagattgcaccactgcactccagcgtgggcgacagagcaagactccgtctaaaaaaaaaaaaaaaaaaaaaagtctgaagaacatagaggcagaggatttttgaaaaagatataccttagaagtagactgaattgggccttaacttgaaataaaaagctttccttggcttggtgttccaactctaaatgattctggttgctttaagtgcagtggttctcacactttatgtgcattagaatcacctggagggcttgtggaaacactgagtgctgggttctaaccaaggtttgcatgtctgatgagtctccaggtcatgctgctgatgggagagaggtccctctttggaaccactatgtgtaaatcttaggagaaagtttatccccagtctctcctagattgtgcctcttggttgaatatggaataagaatgtgtcttgcatggactcttagaatggaatccagttgacaaggccgtattttccacagattcatggttgtcaaatcctggaaacagtctacaaaacagctgtggggggttgcctcctgttcgaagtgcactggaaaagtaagtcatggcttaatgggaattggtggtggaggtgggtggtcaaattatttgacttctcacatgttttattttaggtcatttcaggtttccctcttgggaaggttataaccaggatagaaaaagctccatgacagaggagcccatgtaacctttattatggctcaggccttgcaaaaagggctatagagtgtgagtgacaaagccaggatttaggtgcctggatgaccttgaggcaatctttttaaatgttagatcctgttatccttgcaggaattccattacatgtgccagatgttgcttgctgtgtcaaacatgtgtatttgagtagctggtattttcaaattgaaggtccttaaaaatgtttatgtttataatcccataatgccactcttgggaattttatcctaacaaaactatttaatagaaaaaataactatatgcacaaacgtgttcattgcaatgttgtctactatatcaggaaattaaaaattaccaacagtagaaaaaaatttaaatgatgatatattcacttgatagactataagccactaaaagtgtaggtactataacatgtaaactattttatataaatatgtactgacaatgatacaaaattgtatttatcttgtgattacaacaatatgaaaacatgtagagtataacaaagactgcctgtttgagctttccatttatccattttccttattttaaaaaaactgtgcattcattgaaaaattataatagatgatccctgaggccactcacaactctgttttgttcttttttcttattttattttaattttttgtagagagaaggctttgctatgttgcccaggcggtctcgaactcctaggctcaaccgatattcacatcttggcctcccaaagtgttgagatacaggtgtgagccaccgcacccggccactcacaactcttaatctccactctaaccactgatgagtaaatcctccagaacattccttagggacttaattctctattatacttttgtgtaagaatataaaatctaatgtagatgatactatatatacatgtttgttctgtgtttgcaggaccaaactttacagaccacatactcagaaatgcataaatgtaaatagcttcacatttgactttttaaagagagattccattcagttaaataacacagtcaagttcttgtaatttcttttctcccaaccttttattttgaaaaattttaaacctacaaaaaagttgaaagaaacgtatataaaacacttgtaggctgggctcggtggctcacgcttgtaatcccagcactttggaagctgaggcagagggatcgcttgagcccaggagttcgagaccagcctgggcaacatagcgaaccctgtctgtaccaaaaataaaaaaattagccaggtgtggtgcctgcctgtagtcccactacgggaagctgaggcagaaggattgctttagcccaggaggttgatgctgcagtgagcgagatctcgccactgtaatccagcctggatgacagaatgagaccctgtctcaaaacaaaaacaaaaaaaaccaaccaaacgctagtgtatcctttagtttcaccatttgttaacatttccacgtttgatttctctttttctccttctatacgtatatgtgaaatgcacaaattttttgcagagtcatttgaaagtagtcacagataccctaacacttaaatacttcagcttgtatcctttagaaaaaaggcattcttggctgggcatggtggcacacacctgtattcctagcacttgagaggccaaggtgggtggatagcttgagcctaggagaccagcccaggcaacatagtggaccccgtctctacaaatacaaaaaaagtaggcatgctgtgtgcgcctgtgggcccagcacttaggaggctgaggtgggagggtggcttgagtccaggaggtcgaaactgcagtgagcatgatcgtgctacagcactccagcctgggcaacagagtgagaccctgtctcaaaaaaaaagaaaaaagaaaaaaagaaaaataaaagaaaaagggattctcttatagaacatcaattcatattacacccaagaaagttaacattaattcagtaatactatatccaaatttttctagtgtccctcagaattccttcatagctgttctttttttgcaatccaggatccgatcagtgttacatactacattttgttctcatgtctttttagtctcctttaatttagaaccgtccccctgccttttgttgttcttggtgttttggatgacgctgacattttaagagtcctgaccagcttcctgtataatgtttcacaatctggatttattgtttccctatgattagattcagattaacattttttggcaagaatactatgtaggtgatattatttcccattacatcatattagaagtacagaaagtaactttatcccatcacggatgttatgaagttggatcacttggcttaggtttttcatcacgtcctgctccattatagaggtacattttcccctttttaattaatatgcttctggtgggtgatcctttgagaccatctgaatatcctattccccaacaaccattctgcatttgttttagtttctgaattttgctagataatggtttttcatgtatacctggcactcactattgaatattctctccctaagtgattccaacaaaaataaaacaaatttaatactgtgtagccaaaaagagactccattaagtcgatttttaaaattttttattatttttattttttatgctataaaacagttgtacatatttaggacccatcagttttgaaaattacataaaagaaggaagaaaatgtcttccctaaaataatatcagcacatatactgaacattttagatttcatgtgtaggctgcaaatatggaaattcagtgagttagttcacccacatttaaattaaaatgcacaattatttttaacttaattggttatttctgttatgactcatcaaattctcaggccctgtttatcctgtaacagtttaaagcatgacttctgagcctcttactttctactctgccagaatcctggccgtttgtcatggggtcatgtataaacagctctcagcctggatgctccaggactcctcttggaccagcatgaagaattctttatcaaacaggggccatcttctggtaagtcagtgcccagccagaagaggacgaggaggatctgggcattgggggactgacaggaaacaactgagagaactgcaggacttggtgagagcccaaaaagtagcctagcactctcctgcaggagtcagaaaagcatgcacacaaatgatcttctggtgatcccttcttagctcatagcgagcaccttccatcaatcctttcgatgtaaacattcggctttatcttaactagtgtgagctataaaatagaaaatatgtttgtgatattctttttgtttcctctttcccaatatatgctttgagagattataagtcttacttatgtagctactctaatggagcagctagctacatttagattttaaatacagtttggagttttgtttttttttttaaagacagattctcacccatccccaggctggagtgcgatggcgcaatcttggctcactgcagccactgcctcccaggttcagcaattctcctgccttagcctcccaagtacctggaaccaggcatgtgccaccatgcctgctaattttcatattttttattttcatatttttagtagagacagggttttgtcatgttgccaggctggtctcgaacgcctgacctcaggtgatccacccgcctcggcctgtaagtgttggattacaggcatgagccaccgtgcctggccagtttggtgttttgattagactcctcaagttctacattgtccatattcatccattcatccatccatccattcattcatttatcctgtgcaatatttcattgaatgcctgttatgtgctaggcattgttctaggtgctacaaataaaagtagtagtgtctgtccctaaggagctcatagtttaggggaagagatatagaaaagtaacagttacattacagtgtgctaagggctctgaaaagactaaatatgggtattcttggaactggtcatgggatagggtcttggagtgactagggaaggcttttcagtggaaggtatgtctaattgcaaagagtttgggaggagccatcaagagacatccaggcagaaggaatgatatgttaaaggtacaggggccattaaggacatggttcatttggggaaacagtagtaattcaattaaatgatcaaataaaggctgaagtaaaatgttacaagagatggtgtgagggagaggtggacttgaaactgtgtaagttggtacttgatgaaacttgagttaagcagaggcaagatcacaaggtgcatgtaaacagtggaaatgagtttgtacttgaacctgaaaagagttgggggctttgaattttaagcaagtgggtaccacagtcagacttcatgataaatcactctggatgcttgtggggaatcattttttaaaaatcaagattagaggcaggtcgatcagttaagagagtgtggggagacttaggtgaaaataatagtcccctaaaccaaagatactaacattgaatatgaaaaagagcaaagaggtgtgagagatgtttagagggtggaatcagtaggcttagtgagtcttggaaatgagtcaagagggaagaatcattgatgatacccaggtttctgccttcagcactgggcaagtagtgacgataggggtgtatactgctggtatgcggggaagaagatgggtcaatggggggcatgttgagtttgaggaacttgtgggaaatgttcagtgggctgagcctgggctcatgagagcactccagcttactttaaatctacatatggaatcatcagcatggggctggaggtttttaatctggggcccttgggtggcttcaggaggttcatgaaatgttatatgttgtacatttgtctggaagatccatagcttttatgattgcagagaggtctgtgacctaaaattaaaactatctgttacactgatcagtcacagaagacgatgtgattgtataggaagtgaggctgagaggaaaagacagtctgggacagtgccctgaggagcaccagcagagaagacaagagagaagacctggaaaacaaaaaagaccacctctttcatcgtacaagtaaggaagctgtcgactgtgcaagtttttactcagtagtaaaggcagagtgagggcccaaatcccagtattaagccactcttatttccaccatgccactctgctgcctgaagatgaaatacatctctcaaaatgggtggtttgagaactgtgcaacaccagatttgaagtccctgcgtctttattttaatcatgggttgggagagttactaggtattttcttgttttccttttcttgcttcacactcatctcgatgtgtactctttccttgactagcgcctgattgaggaagagaacatgctggcccatctctgaagcagttttccctacgagtggagattttgccatcctacattccagtgaggttgctgaaaaaatcctatttgttggagaatctgtccagatgtttgagaatcaaaatgtaacctgactagaaaaggtagaaatctccttgtccaatgtaccacaccctcaaaatctctcttccttaatactatgtggccccacagcatgcctggtcagagcgagtggtcgataatatcctatcctgagattgtagcagaatcatgacgtttgtctgagaagcaggtgaagttgctgcccactgagattagccctccccagaaaaccctaactgtcctgggtattctccgtcctccttgacggtgtcttcctattttgcaggatccattttgaaaaaccaggaagacacttttgcgcagagctgcaccgtctcaagcagcagccactcttcagcttggtggactttgaacaggtgtggatcgcattcgcagcactgtggctgaggtttgtgtttcatcgtatatatatatataatatatatatatatatatttttttttttttttttttttttcttaggcaaaattggactatttcctagaaattgagttacttggtcgggcgcagtggctcacgcatgcagtctcaacacttgggaggccaaggcaagtggatcatctgaggtcaggagttcaagaccagcccggccaaatggtgaaaccccgtctctactgaaaatacaaaaattagtcgggtgtggtggcatgcactgtagtcccagctacttacgaggctgaggcaggagaatcgcttgaacccgggaggcggagttgcagtcagccgagatcacaccattgcactccaacctgggcaacagagcaagactcttctccaaaaaaaaaaaaaaaaaaaaaaaagacactgagttacttgacttttgtttttatttgatgtcttgatgagttaagaaccgagcttggaaagaaatgttgcagagagttgaaggagaaagtagaaaagaaaagcctctgttttcattaacagaggcagaactgccttcccatttcctatctaactaaaagacaggtggtttttagttggttagttagttgaataaaggggggtcttggtttaaattctgaaaatcagcattttggatctgtctctatcgtttgcaataactctaggaatcaactaattctgactaaattttgtgtcttgtagtttagtatggctcataactatactttcatttctatacacaatcatcttatgaggaaagcagaacaaatattattttccattcttataaatgaagcaaacactcagcaagctgacttgtctggcttgcctggtgtggacagtgagtagccatagtgaggtcagtgccaggcctccgactcctggtgcacagtcttctcattttgaattgtgctggtgccaccgacttaaattgtgaccagtaatttttcaaaggacatatatgttctgtggcttatattaacatttgtctcatggatatgtgataacacgaaatagacatttagtcagctgtgttgttaactatattcctggctttcaacattggctaagcatgaatcgcatgagaaaattttattttttattttttatctttttatggagtcttgctgtgtacccaggttggagtgcaatggtgtgatctcggctcactgcaacctctgcctcctgggttaagcgattctcccgcctcagcctcccaagtagctgggattacaggcacacatcaccatgccagctaatttttgtatttttagtagagatggggtttcaccatgttggccaggctggtccaaactcgtgagctcaagtgatcctcccacctcagcctcccaaagtcctgggattatagtgtgagccactgcgcctggcccgcatgaggaaattttaaaacctgcacttgcaccaagtcttacttccagagcttctgattcataggtcaggagagggtaggtacctttattttatttatttttgagacagggtcttgctttgtcacccaggctgaagtgcagtggagcagtcgcggtcactacaaactccgcctcccgggttgaagcaattcacgtgcctcagcctcctgagtagtgggactgcaggcctgcaccagcatgcctggcaaacttttttgtattttaatagagatggggtttcaccatgttggccaggctggtcttgaacgtttgggctcaagtgatcctcctgcttggcctcccaaagtgctaagattacaggtgtgagccaccacgcccggcaggtacttcttttaagcaagccagtccacccaccaaagacaaacctctacaggggtttttgaaacagacggactaaaaagcagtgcacttcgttcagtgtctggaactgctaagagcatcaaatctcctgggttagaagcacagtaatctattataaatatggtttccctttctagtcactgtctcaaaactcctggtcatcagaggtagagctgtgatatagacacagaatgttcgatcttaaaaggctgtgaagtatcatttgatttgaatctttctgggcaagtaaatatctaaatgacccagttcctgtcctttcaaaattttaagacattgcttcaaccccgtctataggccaaggcagttctagtctagaggggttggtatcagttcctttcatttttgaaaattgaatctagttctttgctttatcatttttattataaatctttggaaagtataattaatggaagaaagtaaaatgtactgactgaattataaacaatagaaaaattgttttttcttgtgaaagtttgctagaattatatttccaatttgtaaaaatgataagcaaactaaagcacagactctttgaagtttttagaattgtagttaatagactttggaagcattattgcaacaataacagcctacagcaagaaaagctgtgccctgaaggaaaaggggggagtgttttgtaaatatgtgttatatttatccttttgggattctttctctcctttaaaaatttttttctttaaagtgtgtatactatgtaatctatttctgtaaagttcaaaaacaggcaaagtgaatctggcgctagaggtcaggacatatttgcctttgagtcaatgggaggggcatgagtggggcttctagggtgctggcaacatcagttcgttccatttcttgatctgggtgctggtaatacaggtgttcaatttgtaaaaacttcaagctgtgaacttacgacttgtacttttctgtatgtattttggtacttcaacaaaggttttaaaaattctgaggtacttaatagttttcattttaattatgtctttagtttttatgcttacatagagaaatggtggtattactttttgtggttaatcttataacttgcaacgtttgaactctttttagttgtaatagtctgattctatcagttgttctaagtagatgatcatctatctgcaaatgagagaactttccttctatttttatttttattttttgagatggagtctgctgtgttgcccaggctggtcttgaactcctcggctcaggtggtccttctgtgagccacatacccagtccagagctttttatcataagtagatgttgaattttatcaactgctcttttgtgtcaattaaggttcagtttcttgctctgggttatttttctcctttagtctatttattgataaatttctggttagattttgagatactgattcttcctgagataaacactacttgatggatgttttacatctgtattcactagttgtattagtctgttctcatgctgctaataaaacatacccaagactgggtaatttataaaggaaagtggtttaatgaactcacagttccactggctggggaggcctcacagtcatggctgaaggcgaatgaggagcatagtcaggttttagtggcagcaggcaagagagcttctgtaggggcactcccctttataaaatactataaaaaatataaaatatataatttattataaagtaaatcacccctttataagagtgatttattcctctcagaagaacagcatgagaaagaccacccccatgattcaatcacctcccaccgggttctcccacaacacgtgggagttatggaagctacaattcaagatgaggtttgggtggggaccagccaaatcatgtcactatgaaataagactgtacccttcttttcctgtattttgcttagtggttttggaataaagattctacagtcctcataaaatgggctagttaggttttgttcttttctattttttagaacagtttatataagacaggaattcttactgaaagtttgaatttactgaaaaataatctaagctagatatttttaggagggaaaacttacctagttcagtgtattaaaacctattgacataaaacaggtatttcttgtattaattttggtattttctaggaattacctatttcatctagatttaatttaaaaaaatctagtcatttatgttttatttatttaaatttctttttattgtttagtcttattagtcttttcaaagaacaagcttttgtttttaacttttttcttttttcttttttttttttttgagacagagtctcactgtggcccaggctgggtgtattgatgcaatcttagctcactgcagcctccacctcccaggttcaagggattctccacctcagctcctgagtagctgggattacaggcgtgcaccacaacgcccagctaattttgtatttttagtacagatggggtttcaccatgttggccaggctggtctcgaactcctgactcaagtgatccacctgcctcggcttctcaaagtgctgggattataggcgtgagccactggcctggctttttctttaatttaaaaaaaatttgtagagacagcttctcgctctgtcaccaagctggagagcagtggtgcaatgatgagtcactgcagcgcgatctccaggctcaatcattttcccatctcagcctcccaagtagctgggactagaggtgcatgccaccatgcccagcaattcttttcttttttttttcttttcttttcttctttttttttttgagacacagtcttatcttcttactcttcttactgtgtcgcccgggctagagtgcagtggtataatcctagttcctgcagcctccaattcctgggctcaagcaatcttcccttctgcctcagccttccaaagtcagggattataggcatgagcctcagcacctggcctttcattttctttttttcccccagaacagggtcttgttctatctcccaggctggagtgcagtgatgtcatcatagctcaccatatcttgaactcttagggtaaagcaatcctcctccctcagcctcctgagtagctagtattaaggtgcaaatcaccatgccctgctatattttaaactcttttgtagagacggagtctcagatgttgcccaggctggtctagaactcttggcttcaagcagtcatcccatttcagcctccaaagtgctgggattacagatgtgagccacaacacctcagcactgcagttttgacctgctcatttctgacctgggccaattcacccattcttaggcaacctggtggtcccccactcccagtggtcaccgtattgatgccgaatttattgtggacacctgattggtgtagcacactacacccagaattcctagactcaagtgaaacttctgccccagcctcccaagtaactgggcctgaggcatgcaccactgcgcccaccaggctttttctttttttaattttattttttaaatattattttggggtcaggcacagtggctaatgcctgtaattccagcactttgggaggccaagcaggcagatcacttgatgtcaggagtttgagaccagcctggccaacatggcgaaacccttctctactaaaataaactacaaaaattagccaggtgcagtggtgcgtgcctatagtcccgctactcgggaggctgaagcaggggaattgcttgaacctcggaggcagaggttgcagcagctgagatggtgccactgcattccagcctggacaatagagtaagactccgtctcaaaataaataaaatagagatacacacacacacacacacacacacacacacacacacacacacactatttttttttgtttgaattctgtgtttcattgatatctgcctttttctttattagtttttccttcgtgtttttttttttactctttcccaggttgaaagcttgactcctttatttttacctgtgttttctgagaaatatatataaaactttacatattgttttgactgtgtctcacagtttttggcatgtagtgttttcattatattctatataattctaattaattttgtttatattttttaaccaaggaatttgttttaattttattgcattatagttggagaacatagtctaattatattgtttctttggaatctattgcaggtttctttatggactaatacaggtctggttttgtttgtttgtttgttttgttttgttttgttttgagacggagttttgctctgtcaccaggctggagtgcagtggcgtgatctcggctcactgcaacctctgcctcccgggttcaacgattctcctgcctcagcctcctgagtagctggggttacaggcatgtgccactacgcccgctaatttttgtatttttagttgagatggggtttcgccatgttgtgctggctgatcccgactgctgagctcaagtgatctgcccgcttcggccttccaaagtgctgggattacaggcagagccactacacctggcctaatatattctttacttagattctattttgttagttactaaatcactatccagcttcctttcaaatcatatttacctgatacactcttccatcctttatcgcaacctttctgtgtgctttcatcccactcttcctaccctgacagtccccaagcagccatgatctgatctactccctgtcactctaggttagtctgcactttctagagttgataaaaagaaatcatacagtatgcactcttttggaggaggagaccaggcttcttttactcagcatattattttgagatgaacccatgttgcatttatcaatggtttattcctttatattacttacagtattctattgtttataccagtgtgtttatccattcatccttgataaatatttgggtgcttcccaatgtcttttttttttttttttaagacggagtcttgctctgtctccaggttgggtgcagtggcgcggtctctgcttactgcaacctccgtctcccgggttcaagcgattccctgcctcagcctcccgagcagctgggattacaggcacccgccaccacgcccagccagtttttgtatttttagtagagatggggtttcaccatgttggccaggatggtttcgatctctttttttttaattttattattattatactttaagttttagggtacatgtgcacaatgtgcagtttgttacatatgtatacatgtgccatgttggtgtgctgcacccattaactcgttatttgcattaggtatatctcctaatgctatccctccccggtccccccaccctacaacagtcccggtgtgtgatgttccccttcctgtgtccgtgtgttctcattgttcaattcccacctatggtgagaacatgcggtgtttggttttttgtccttgtgagagtttgctgagaatgatggttccagtttcatccatgtccctacaaaggacatgaactcaccattttttatggctgcatagattccatggtgtatatgtgccacatttacgattaacaaaatgtggtttcgatctcttgacttgtgctctgcccaccttggcctcccaaaatgctgggattccccactgtctttttcattgcatgcctgtaatgactaatgaggttgaacattttttcatgtgcctctttgcctatttatactgggtttttgttttcttgttgtcgaattttgagagtcctttatgtattctgaattaagttctttaacagatatgtgacttacaaatattttctcactattttttttttttttttgagacagagtcttgccctgttgcccaggctggagtgcagtggtgcaatctcggctcactcaagctctgcctcctgggttcaagtgattcttctgtgtctgcctcccaagtagctgggatacaggcgcctgccaccatgcctggctaatttttgtacttttagtagaaatggggtttcgcgtgttagccaggatggtctcgaactcctaaccttgtgatccgcccacctcagcctcctaagtcctgggatttacaggcatgagccaccacgcctgggctattttctcacaatttatacttgtcccagaagttgttaattttgatgaaatccagtttaccttttgtttttcttttaggatcatgtttttggtgttatgtctaagaactctgcctaactcaaggatactaagatttctcttctcttttcttccagaaattttatagttttcagttttatacccaggtctatgattatatgcttggacctgtgtccccgccaaaatttcttgagttgtaggggcgtggtgggagagattggttcgtggagcagtttctcatgaatggtttagcgccattccccttggtactgtctcacgatagtaagttctcatgagatctggctgtttaaatgtgtgcagcacctcccccttctctctcttgctcctattcctgccatgtgagacgcctttgccttctgccatgattgtaatttcctgaggcctccctagaagccaagctgaagccaccgtgcttcctgtgcagcctgcaaactgtgagcaactcaacctcttttcttcattaattacccagtctaaggtattctttacgcagtgtgagaatggaataatacattgattgttttgagtaaatttttctatgtggggcaggtatagtcttcttttaatacattgctggatttgtatggaaccattctttgcaggagtttcactgtaatgaaatttgtccctgttttgttggttgttttcatagcatctctggaagttatggtagaagaatccgatttactgggtcagctgaaggtaatggcttagctgttgtaattttacggtgatgctggtaggcagtgacttgcattctctgatgtttcctgagagcactggtgcctatacccagacttccagagtcaactcatttgttcttatccaagtgagcaaactatactaatgccacaaatctacgataatacaaagatttgggagtgtacttttttctggcatattatataattatgttgctattgaataaataatgccaaatacacaccagtcatcctgctatcggaactaagtatgcctctttgaaatgccaaatgcctgtatcttttgtagcttgggctcaattgatgaaattagaaattactgtatacatgtaattcctcaggacagtgaggagctccgccttgctttactgaattgtaaattgaaattctttcctcagatcattaaagacttttacttctgggacgtggagaactgtttcaggccttcattgacacagctcaacacatgttgaaacaccacccactgcagtaactgagcatggtaattgtcagtggccctgagaatgatcaactattgacattgcagggtatttcttggctgctgctgacccttttaaggcctgctccacatagagcagcctgatgagttacagagcagtggcttccagagatggaaggctcttgcaggtagcttcatgctggggtcattgggaacagtgtcttggcctgtgacccttcctggaagagttgttcaggccttcaaaccaggtattttttctcattggattatagccatatatactttatggccatattgggacttagtgctgcttgtagttttgcagtagaattctttaggtgtgaatgaggaaactcacccgaactagcctagttaggaaagggaaatggatttgctattgtatctaaaccccagtgggaaaacttcgattcattctctctctctctcattcactcattcaccacatttgtttgtgtctcttgtgaacactttgatgaccttctggaaacatgatcacagcatctccaggaatatgcctcacagtgtcctctacggaaggaactgaacccagtccctcttgttgcagttagagaattctagggaattatctaggttttgattggcccagcccacatcacatcccatccctgtatcagtcaaagaggtcagacactaggctatgcctagttcagtgaagagtctccccttgacccactgatgtccattcccattcatactgcatgagtagagttgggtaaggaccaaaaaaagaaactgtgagaaagaaaatacatacacacaggctgatcatttttctaaccagtaaaaccatagatgtccactgtacttatatagtacaaatataagtacttgtggttgaaatatcagaaaatccaattcaaactcacttaagcaaagcaaaaggaaagaaataatgtttgattctcataactgaaaagctcagacgtatgatggttttcggctaagtttgatccaggacaggtgtggcacctttaggacttggtctctttccatcttctacctctttcttctcagcaggcctgctctgtatggtagcaagatagtctctagccaagtttacatcctactaagccctgtttatcttgaaaaaagagctggactcttttagagtctgaatagagcctctggattgcctggcttggtcatgttaatatccctaaacaatatagcataacaaagtagagtattacatccatttgatcatgcctacatcacccagctacccctagaatcaggtgttgtctagcactacccactggaaatatgtgaactgtactgaatagggatgattctccaaggaaaatcaagagcagtttgtcagcaagaagagaaggatggatgggtgttagacaaatgaaacagatgtccctgtgtcctgctgttagcattgagcatgttgggggagaagtggaaagctggaggagtctggtttgttatgtagccaagcgtccctgtcagcctgcgtgttctttcttgcagatgtgaagtggcctttcaacagtcagcacacaaggtattgctagatgatgacaaccttctccctctttgcacttgacaatcgagtatcacggaaaggagcacaaaggtttgccattcctccctgcaccttagagttcctgctggtcatcatccattttcccatctctgcttccatcccccgccaagaaaccatatgattttggatcttagaaatcagctagtacagtactataattctatagaaagaaaaggaaagtccagaagtccagagaggctaagtgagatgcccaggccatgttttggggagttggtttttttggtgtttttttttgtcatgctgctggaatggtgcctgtttattccagcccccagattttaaggctgaggaaagaatctctagaagacctcccaagagaacctacatagaagtttccttgcccccttcttagtgtcccctgtaagcttctgacatcgcagacccattgagctctgttgcttttcttttggagacagagtctcactctgttgaccaggctgggtgcagtggcacaatcttggctcactacaacctctgccttccaggttcaaacaattctctgcctcagcccccctgagtagctgggactacaagtgcgtgccaccatgcccagctaattatgtatttttagtagagatggggtttcactgtattgcccagactggtcttgaactcctggagctctagtttcattaatgttattcacttgttgagtctctggttctagattaaccaagtgttatcttttctttttttcttttcttttatcacagcagatgctactcaggcaagagaaggccttctcgggaaacttctccccgggaagcccctgcatctggctgggcagccctaggttttcctacaaagtacagtggccactacatattctcttcaccccagctgtcctggaaaaggagtatttctgagtttctcacaggtaaatatgacccaccttacttgtaagggaagaaacagcaggaacagaattagtgggaaagcaaggtgtggtggcacacacctgtaatcccagctgtccagagcctgagcaggaggatcccttaagcccaggatttcaaatccatcctgggcaaatagtaagacccccatctcataaaaaaaaaaaaaaaaattaatgggagcaagagagccaccaactagtttttaacaatctgtaaatcaaaaattgtaaacccttatgccttcaggggcagactgatcacattaataagtgaagccacagatatgagacacggagttggaatcagtggagggcatatctacttcaaaccatcatttttttaaattgccaaataataagcagtttgttgctgccagtttgtgagctctggaaaataaggtcttaggcaccatgtcgagataatggccttgatgattccatcacacctgacaaggtctctccctcacttttgtaatattttttgttgtttacttgggaaagtcctccagcctacatgtctgctatggatgttagccactggggagagacaaaatcctgtgtcctcattattcaccttcagtaaccagcaacattatactactttttctgtccctcccccacttttttgctagagctgtataaagcaaatcacagtcatttcatttgccaataaacaattgaaaaaggcatatttcaacagaactacaatgccattatcacatcagtaaaattaacagtagtcccttataatcccttataatatccagtctacattgaaattttccagttatctaaaaattatctttatgtttgggtttgttcaaatcagtttccaaacaagtctatcatttcattatgtttgttcctttagaaatagacaattttaaaaaccaaacagaagggactgtcttctgcaagcctacctacaaacaggtaaataaatcctattctaccaggaacagctgttcttcccgtgtgtcttttaagtatggagtctcagcattaagcagttagcaccgaacttgcagggaggcaggagcgggagtctgtctcagagggaagctattttactttcttcggctctcagcgacagagaatcagattcatcataatccttgattcataacacactatttttttgagacagggtcttgctctgttgcccaggcagcacactgcagccttgaaccctgggtcaagcaatcttcctgcctcaacctcccaagcagctgggactataggtgggcaccaccaacctggctaatttttttaatttttagtagagatggcatctcactatgttgctcaggctgtcttgaacccctgagcttaagtaattctcctgccttggcctcccaaagtgccgggattaaggcatgagccaacacacctggcctgctttaagaattatagaaaaggctatatgtaatctttgtgatttacctttttcattcaaaaatcatgtttttgaatatgagaagcaacacgagcaaccattcaaaaagattataagggtataatctaatatccagtccacactgaaatttccaagttatctaaaaaatgcagagatggggtctcatcttgttgtatagctggagttcattcactgctatataatattccattgtataaataaattataatttatttgtctacatctctagcactctttccttactgcctgtttgtgagaggagtgggtggcacaaagtcctagagtctgcgtgtgggggaagtgcaggggatgaaatttttgtcttgaatatcctgttatttctgtccaggtacaatgttgtttttaagtacttactgagtgtgcgccgggtgcaagctgagctgcacactgctgggccctacaaatgcagcgcaagcacctcaagtcgaaccagactgatgcaataagtggcgcctaagaaatcacatggcatttttggtggataatcttcagtactatctccagtctgtgctaagagatgagtagaaggaaggggtacggaaaaacgtctaggaggttggcaggagtattgaatagggactacaagtttctatttgataaaatggtggggtttgggaaaatcaggagttatatcaccaagcatgtttcttaaaataaaaaaagcattttattttattttatttattattttttagagacagggtctttctctgtttcccaggctggaatgcagtggtacgtcatagctcactgaagcctcaagctcctggactcaagtgatccccctgcctcagcctccaagtagctatgactacagatacatgccaccacacccagctggtttgtttttatttttttagagatggattctcactttgttgcccaggctggtctcaaactcctggcttcagcgagggtcatgggtcacgtctgtaatctcagcactttgggaggctgagatgggcggatcacttgggtcaggagtttgagaccagcctggccagcatggtgaaacaccatctctactaaaaataaaaaaaattagccaagcgtggtggcgcctgtttgtagtcccagctacctgggaggctgagcaggagaatcgcttgaacctgggaggtggaggttgcagtgagccaagatcatgccattcactccagcctgggcaacagagtgagactccgtctccaaaaaaaaaaaactccaggcttaaatgatcctcctgcctttgcctcccaaagtgctgggattataggcatgaaccaccgcccaccagcctcttaaaggcattttaaagaatcctcatcaacaatctattatttattgttgcttgccccttatttttattgtttgctataacttctggaatcctgtaggtgaccaagtcatcagtagacggaatgtggccatgagtggattaggatggggcaggggaggctgggcgcagggctcacacctgtaatcccagcactttgggaggctgagccaaacagatcacctgaggtcggagttcgagaccaacctggccaacatagtgaaaccccttctctactaaaaatacaaaattagccatgcgtggtagcgggcacctgtaatcttagctactcaggaggctgaggcaggaaattgcttgaaccctggtatgtggaagttgcagtgagccaggatcgcaccactgcactcagcctgggtggcagagcaagactccgtctcaaaaaaaaaaaaaggaaaaagagaaaaggtggggcaggggagagtggtcagccaggacgttggagggagggggttcagaattatgcaataacttcctacaaggctgggcaatataagggtgtctttggtcagccttaatgtgacttgttagaaggaagatgagtggaggcaaagcattttcatttcaatctgtcaggcatcttaattcttcgagtgcttagaatatgcaaagtgctaaaattttttgtaatgtctatcaggtagagtgttggagtctcagttctcccagctgcttcatcagatcaattctacccgagactttgaagcatccgattggctcatgaccacttcctgagcaatttgctggctcaatcctttatcctttgaaacctgtaagtaaggctcattggtttcctcagactgcttctaccactgaccattccttaggcagtttgagttgacaggatacgaaaccatcattaagcaattattcaagtccatttaaaacattttttaagaatgtgtaaagcggcggggcatggtggctcatgcctgtaatccagcactttgggaggccgaggtgggcggatcacaaggtcaggagttcaagaccagcctgccaacatggtgaaaacccgtctctactaaaaatacagaagaaaaaaaaaataataggtgggtggctcgcgcctgtaatcccagctacttgggaggcctgaggcaggagaattgcttggcccaggaggcagaggttgcagtgagccaagatcattccactgcactccagcctgggcaaagagcaagattctgtcttgggggagcagataaaaaaaaaaagaatgtgtaaagcaaaacaaaaaggcatgttaaacgggacctaagatgtctttgaatttctgaaatacagggtgtgggagcagctacagatgaaagaattatgtgcttaaaccctcaggagttaaagaaactcaaattcttgctgacaatacagaaaaaccaatgaaaagcatatagagttcaccttcttagaaacttttggaccaggatggatcagtcatttgaaagttcttttcatagacaactagagtagttttctctctcgatctatgtatgtgtttctgtaagtacatatatgtctccttcgtggcagtattttcaactttggctgcacattggaatcatcgggactctttaaaaaaatctaggtgaagagcacttaaattagaatccctgtaatagtgggacccaggtactaattttttttaaagtcacaagctagttccaattccaggataaagaacaggaagactgaaatgatctctggtagttctaatggaacggttatgcctcctctgacatgagctggttgttattcctcagtgtgctcagcacagctgttacagactttttaaaaatgttctggtgtttagggctatttctgctgtccaggaagagtaagatatatattaatagatgccactccagagggctggctgaaaacaacaagaactactgtgatgggtagatgctgtccttatgtggcatagatgtatccatagggaaagcagaataacagagcaggtcatcatcattaaatatttattgagtgcttactgtatgcaggcactggggatacaaagaggtataattcatggctctgcccttaaggagctcacaatctgttggaaaaacaagacatatatatatatatacatacaaaaatcagtaacaacacagaggctgaacaattgccaagtggacaacagtacagataataaagaagcaagaaacgagggttcctaaaggctatagtggggaagggagtgcttcactgagagagtgggacttgaactggtataaaaacaagagcatcccgggcaaagggaacaacactcacagctcagaggcaggaagacatctgcgggtctaagaaatgaagagttaaatgtggctagattggaggtttggtgcagggcaagagagtaatactcgcttagccaggaaaggatgcatttgttttacgcattttgtgcgttgaggggctggcaggccttgcacgtggcagtgtctatcctgtcagatttgggaggtcagtattaattagatcagctattaatcagactgttctcctaacactttaacttcatggatgtccttccttcctttcctaatgccaactctgtttcccgggtaggtgtttcactgcctgaataaatcctagatctctgtcacagtttttgttcgctggtcagtcagaacctaggcccactgatgagcgtggagccgcccagctgagcattctcgtgaaggtgcgtctgcctggaagtatgagccttgccgaaaggacagaggtggttttgccaatggagaattcatgatctttcctctggtcagtaaagcatttcctcaatacacacacgtacagagataagatacaaagataaaaatttggtatcagttgattttgaagcaggtaattactgtgccacctcacagtgctcaaaaatgttcagtcctgaatagtttattcagcccatcaaataagcattgggttgttctaacttcccacatcctcccccctccttacttccttgaactaacccccatctcactgagataattatcgcttgtaatcaaaacgggttctccccaaccccagtacttgacaaaatacattaactggaaccagctactaaattcctactgatgaaagagtactttcataggaagtcatgcatgtatgatttggtacaagtcattttaggaactaatagaaataggaatgtgggaaggccaggtggtctgtagaattttgaacaaggcttttccaagaaactcctccctccgcccccatcctccattggagagttggtgagctgaagtggaatgacagctgagtccttctctctgcagggctttaccgccagtcttcactcctgttcaagattctctccagtgttcggaatcatcagatcaactagatttggctcaactactgttacgactagattataacaaatactatacccaggctggtgaactctgggcaggtaggagcaacccttgggtaactcagtagactttttaaggtggcttttaatgagttgtagaattctagaactggaagaagactttagtccaaataccctcattttaaagtaaggcttagagatagaggtgtgaccatctttaataattttaatggaggttatttttagtagaagtcatcatcatcataaaatactaaaaaacctgacagtgagataggtgttaatcctttgctaggttatgtattgctatgctgggaggcagtgggccttccactcccaattcgatatgaactagctgtgcagccgtgggcaccccgccttgctggtccctagcttccgcattgtgaaaggaggcgaccaccccttctaactctaaactttaaaaaaaactgataccgagatcagtggtagctggcttcccagaggtctgtcattcccattcagaaaatcacttcattgtctttctctctaaaatgtctgcaagcagatttttttctaagctattgtagcagaagagtcaaagaaactcttcagttttaagatgacattatttagatcacaggttatcctgattcatattctttgaaggtagtcttgggaaagcatgacacttaataaggctctttttctcttttgtgtttcgggatgtgaaaatttctggctcataaattgaaataacagccacgttcccaaggtgtaacagaagattcaaaacatcccattctagccacacacaaataaatatctgcggcttatgataggactctaccttttctcctagaagcagttactgaacatccaggagtacaactcctcccatcattcccatgtggaagggtctctcccatcaaggagaacatgtggcatctctgacctttacattgagaacatttgttggatatgttcatttattcaatagtcatttattgagccctactacgtaccttggtactgttcaagctgtgggagatacagcggtaaacaaacaataagagcagaaagttaaatattttatggttcatatgtgaaaaagtaattatgtttataaatgactaactgctggatgttaccaccaagtaagaaagcaacaggtaagataggctttctcttccctataccaagtaatttatacctacacagattgggcaattctagctaatgaaaatatcttaaaagtatttcttaggccgggcatggtggctcacacctgtaatcccagcactttggaggccgaggcgggcggatcacctgaagtcaggagtttgagaccagcctgaccaacatgagaaacctcgattctactaaaaatacaaaaattagccaggtgtggtggcatgtgcctgtatcccagctactcaggaggctgagacaggagaattgcttgaacctgggaagcagacgctgagtgagctgagattgtgccattgcattccagcccgggcaacaagagcgaaattccgtctaaaaaaaaaaaaaaaaaaaaaaagtattattctccaagaaaaaggtccttaagaaaaaatgagatcaagttgttagatttttaaatactgaagattgcaggcccaattacccatcttaacaaaccataggggttgaagttatcttaatatggcccagccatcactggtaatcaatatcatatcagtgtaagtaaaaagaaatattcactgaacaacgccctccaaactgaaaaagatgcagtgttctggcatcaggttatagtcactgcatctggttttcatcactacatattctcacacactgggaagctctgacaacttattccctgctattatcaactaaagatcacccttccactgctgtctctggagcaggagctggcaaactatggcctgctgtctgtttttgtacattttactgaaacacagccgtgcccatttgtttactcattgtctatggttgctttcatgcctcacagcaaaggcgagtagttgtgatggatcaaatggcccacaaagcctgaaatatttctctttgaccctttacagaaaaaaaccttgttgacccctgctttagagaatgagaagcctgcagggatcagtgatgccagaggaagggaaggaactgcttccagctattgtgacaatataataataataatattgggtctttgactagaacgtgtaacatttccaggtgttctcactgtgcttcccatgtttatcttacggaaggtcattccatcaagcttatggtcactgtccctcatggcagttggtcctttcgttctccctttagctctaagagttggggagtacccacagggagctgtgatctcagctcagagagagagcatgaggtcttttttaactgtcaggaaacaggctgtgcccaattccactcaacttttggcacaactgttaatctgggccttcacctacctaaactgagtttctgcaagcatagcattttagacaccctggaataaccttttgggaatgagccacagaataaagttcactcttaacttttcaatttccttggccagctgtcctccgtaatgaataagcctgttgaaagactcagagaaagtactatgtcttgtcatttgttctgagataagctcaaaaaaacagatgaagaaatcccagttactacaaccaaagagattcaacatttttttatcataaaagttcagcaaataaaactatatacaagatccatgcaaggaatccagtacacacaagacacatttaaaacctggttaaaacacaatctccacgatagcagggaataaaccagtaagaccaagtatctttagtgagaaacataatcgtgtttatattttggatgctgttgaatccaattctctccccaacaatgaggcactggatcacccactcttgtgacaccacggcagctgcaatgcttcagcacacttcagcaccgaggctgggcatgaggggtccgtcacaccacatcaaatacccctaaagcaatatctgcaaggagcaagggaaagtgaagaaggaaggacactcaacttagccctccattagaaagagagatttgattctaaccaatacatcccatctgcacaaaccaaagccctattatgtcaaacacactgctactgatcatgaccaaaggcgagttataatcactatgtgctgaccttgtagaaatatttaacaaatatacgtccagtgctcacttatgttgactcacctcttgaaggtggtacttttcttctctaagaaacatggataggtcaacctattaggcctgagccttggaccacaaggcctaacacctacaggtctaaggaatccctggaacaaagacactacacacactctttcaggtacctttgttatgggcacttgatggtgctgcttcacagaggctgcaccaccagtcatgaggatctcagaccagagctccagaagttctgctgttggtctgataccaagagtaccttcagattctggaaaggattttcacgggttgcctatgaaggagacaggaaaggaccttagcatgacaagtaatatccaacaaactcctttctgcaaagggactcatgtacatctgaatgctttcaaaaataaatgccccatcagcatagtgtctcaagcctgtaatcccagcactttgggaggctgtcgtggttggatctcttggcctgggagttcgagaccagcctgggcaatgtggtgagaccccatctctacaaaagacacaaaaaaattagctgggtgtggtggcgagtgcctgtagtcccagcagcttgggaggctaggtagggggatcacttcagcctgggaggttgaggctgcagtaagtcgtcactgcgccatgtactccagcctaggtgacagagcaagacttcatcttaaaaaactaagccctatattaggtcccccttctcttccttctttctatgaatgatctgtattccttgcattcctggcttttaatttccatgtttgttctggggctgagaataatccaaatcatgctcctgagcctatattttttaatgcttgcttaaaacttagttctctgactttacaggttgagaatattgaaccttatacaaatcttcacacatttgcaaaaggttcctagccaatgtaacctagggaaataaatagataaactcctgaagtcatttcaaacccactcaaatttatcccacagacattccaattctagaaagctttactctctcacctagattctcttccctccaaagcttgctgtcctcctcctatacaattctggatgggcttcaaatacttaccagtccagaattctttgctcctcaagctgtacccagctggcaacagataattacggtagttctggagctggttggcatggcaacatcatggacccagacatgagacacacaaggaatcccactggcaaggcacaggaagtactccgggttcgacaatgctgatccgcaattagaagacactggtaagctgtgttacactgcagaaaagaagcagagccaatgggtttggtgacttctgtggaaagctcctaagcagcagcctaatgagccatgaagagcagatctgaagactcccaactactacccaaaatgtgatttagctatcctgcccaaggccactcttctcactggaaggcccaagtaatttccatagatgttcctctgcctcacctgcagcatactgaggacctaaatcctcaacggacaaccaaaacctataactcagcctttcaggctaaaaatcagcaaccctaataggggtttctactactaaacataacatcaatcttcttttgtcccagcaacagaaccatagccattaactaacccaaggtccaccttctcttccctatacacaacaaaaattctatttcatgcaaaaacattttggcagttctcagttcctgaaatctctggctactttatccaggttccccaacccctcccaggcctctctcaacacagcaagttggctcttatcattgccactatattaggttacacaaagaaactctcacctgggcttcattgaaatcttcaaggatatagccagctcctgctcgaagctgggatctgtatactgcttgttgaaaggaggaatttccaaaaattctatattaaaaaaaaaaaccagataataattactgagtggttttcttatttgctaccttatgcctccttcttactgccccttttccactccccagctatccacaacagtgtgtccccaaagacaggccaagggcttcccatgggtcagaaagagatcttgaggcctttaaaatgctgccaaaagaagggacaagagtggagggaatgggaagatgaggactggaggtaggtcctagacctaaaaacatcaaaggttctgcaccggaccgttgatagggatgggaacacaatcatttcccacagtgacatattccacttgaataacccttaccatcaggaagttccctttgtgtctatcctaaatctttcctgttaaaactaaaccccatttcctctagttctgccttctgtggagatgaatagctgatgaacatttataagttatatatgaagggtttattataaaccactgcatcagcctttttaccccctgtacaactaaaactttaataaaccagaatgctcaatgaaatatggttttaaaattttaatgattaagtgaaggttagaaaatcctgtttcaacctttttattgaaaactatctaccttgatgatcttgaagtacctcaggacactgaacaccaatgactgctctatagtcttgagaggaagtagaagatatgagagatgaggctgaagctgtaatgaccctaggcaattagaaattcttcttttgaccaaatatctaatttgagcttgttttcttgtcatctgctcctctcatattaaataacacattaaaaaaaaaaagaaaagaaaagcaagacattagagattttagttaataggagttttgggaaattaagttctaattaactgaaatttttatcacaaattttaaaaccaacccaatccagtgcataaggttcaatgccggtaccactccccttccccttcacacccgtagtaaaacttagagcagatcccttatgacggctcccccttcagtgccctcgttgtctctggaggagctcaggcaccgccgaggccccaggtcaggggtctccatctccacttagtttgactagccaacctattcacttttactgctcttttcttgattcagcattctccacattctctcaaattgaaatcccaaaacagaaactctaaatggttataagaaactcagaatacagagggctatttctcagctttgtcatagcacccttttgctatctcaatatagcatgtcacatcttcagcaccaagattctactgctgagtcactgccaacaccccttacagtcctgtattttctcaagacttctactttatgtctgcttaatccaggactggtctacttagattttaatcctaattatatttccttaatttgtctaatgaagtattaccctgtctaggcagtgtgttttctaatttttctcaaatagtctgggttccaatttcttcatttttgaggtataagtgcccgcccagccagatgctaaaatgaataggttgttaatcgtgccatctaaatcaagtatgaagtactaaataaacccaactccagggtcaatccctgtgtctgaaggatctctgatggtgtccacccaacaagattaggtaccaaacttattaataaatatatctcataagatgaatttaatattttactgagctcctgttgtaagctggtgtctaagaattcctatttatctgtaacactaccaaacagtttcttaaaaactataattctgtagaggattgttttagtattagatgtttccgccttcttgagattgagaaacccccaagcattctcatacactgaaaatatcaaggttctggtactgttgggctgcgcccaaggatgaaggcaccaacataaagacacattcacctaaccacactgtctatcagaaacctgaagatcccttcaaaaacactgtccaaatgcctcttttatttttatgagtacagttttattacatctcacgcaggcacacggattttaatgaactggacagcctgcatctcataccagtcagctttcttgactatgctgaaccaagcaacaacaaaacatctatacagctgccttgtgaagtcctggtttcaagtccagcaatattgtaaagggggaaaaaaaaacccatgaccatgaccactgttttaatgccatgacacacctctatgagaatcctcaaaagactcccaattttcctgtccaggaaactcttcaaataccttattccactgtgcctatctgattgtttgacaagctaggtgttgcaaacactggaccttgaaatccaccacaccacatctactcactcccacagcccaactctcccaaaccaaagcctgcccctgtcatcccttccatgtccttgtacatatctacacatggctgcagtcggtgagatatagtttggttaattaggaaagagtcatccacacacctgaaatgccaaccctcacagatgtccagggtgcaaattatgacaaccatgttgcctaattcaattccctcttgcaagacaacattagcagaactctaacttgtacaacatcattccatctggacctttagcctttacagacacattagatactgctgtcagtcacatttacagtgtatacatttatatctgctcattccctctccagatcactcatttttcagacctctacccactgcagccttccttcaaaaactaacagacacacagaaataaatgcaatgtacagatttaatttaaggttaaagagaggtataagagttgaaaggcctagaagctgtttctttgcaatcaccctgaggaaccaggcaccccacagtcccgtcttagacctcaggagaatgaaccttaccctccacatgggtttgctctagcagatgccatagaacgcaaatggggaagatggcagggcattcagacctgattgacttggatggttgcgtaggctaaaatgacagagctctagtcacaggtttgtcattattgtggacaaaaaaaaccaattatttaacctttaacctctccaaacttgtttcctcatccataaaatagataagattatctcccatctgcctcacaggattgttttcaggaaccactcactgagaggaattttgtaaaacagtctagaaactgttaaaaagcagg

SEQ ID NO: 5071 - DNA, 32038 bp, Homo sapiens
taaataaaattttaaaaataaaataaaaacaggatatttgcaggaggtaatgttggaaaggaagttagggcatattatgaaggatctttgagaaggaactgatgagaagaaagacaaatatttgtgattttgtgatattgtaaagggaataatatttcttcaacccaagcattccttaaaggaaataactccattctatgaatactttggggaaaaaaaagatgcaaaatataattacacacaggtatggcctgaaaactaagttatatagttaggtttgaatcctctttaccacatcatctctaccaccacaaagaaaatccttaagagatccctgcagtaagaggtagctttctcagattaaaagaaaagatggtatcagaggtcacagccaaacactaccttccatttcaaggctaatgaaatggataagggaagatggtattgataaattatttttttcgcttttgggatcactttcttaaataaaagaatgtgggaagtgagggaagaaaaaggggaaatttcttcttgtcctttgcaatgctctgcagggggaaggtaaacccagtcccattgctctgcccattacttaatgtgaacaaataataattagaaaaatatttattgtgggcctcctctgtggcccgacatagtaataaatgcagacttcttccccatctcaacctttttagatattattttactagtgcctttttaaaggttattttactccatgcctttgcagacaaaccagctgttcaggcgaggtgaccctatggctgctggtatgcattatgatcatagtatttcccccaaaagccaagataagcctctgacacagcacttctgtaatccaacacgcctctctctgggtaagaatgcttacaggcagaactgagtgcagggaaggaatctgagctgtatgcagctcccttggatatttggtggataaaaccatgcaatccagcagagcagggctggagttctgccaaatgagctcgacccccagaaaaactaatgacattcatcaggctagaagagaaggcccagcatcttttcttatgaattgccagagctgccttaaatcttatggagactttaagcattgaaagaattatatgttcttctctcctatgaacacctaattcaagatgagtgcaactaattgcaagtaaagtctgatttttcatggggacaactttaatactttaaatgccaaatatgaaattatttccaaaaaacttagagatgcccttcccactttgttaagagtgtgcttaatttacctattggatatttatcactatacattatgaaggcctgggggttgagaattccctaactggtttaaactagccgatacttttcaaaccatttgagatttatactatcttttgccttgtgctgactccatgcataaccaaggaaacagcctataatagtgccttcctcttgcacctcttctaacctccctttcagtggtggatccttagacaccttcgacaattcaagggtccttcatcacagttcaaagcattggtgtgccactatatctgccaattttgcttgacaagactgtggaagaagctaagaattggagagctcccaaaagatcatacttggtcattccagggggtcaatagttaaataaacaaaacaggaggctccatagccatcaaacactactacctgtgtctgacaatcatgctatcacaggtccctaataatccccttgaggcaggagaatagtgtctggagacagggagcttcacttcagcctctgattggtgggagccaagtcttcatttgcaaagggtgtaacttcattcagcctctaattggtcacaggccaagccaccacttcagcctccaataggtcgcaggcaagtcttcatttacataggatgtaattaataggaaacctctaaagggtacttaaacccagaagatttgtgcaactggggcccttgagccacttactcgagcccactcccactctgtggatgtactttcacttcaataaatctatgctttcatcttccattggtttgtttgtgcatttgtccaattctcttttttttttttgagatggagtctcactctgtcacccagcctggagtaagtggcacaatctccactcactgcaacctccacttcctgggttcaagcaattctcctgctcagcctcccgagtagctgggattacaggcacccaccaacacgcccagctaatttttgctttttagtagagatggggtttcaccatgttggccaggctggtctcgaactcctgacctcggtgatccacccacctcagcctcccaaagtgttgggattacaggcgtgagccactgcgccagctagtccaattctttgttcaatatgccaagaacctggacaactcgtagtcaagacctccactggtaacacccttggaagggcctttgaattgcatcgttttactaccaggcttctccatagcacacttcctaaattcaatatagatttttaaatactttataattcatatatgttttaattttttatttagctttctaagtcttatacatatgtatcagagcattttctgtcttgcttataaaattctgggacacagatgctaatgctccacagttttcttttttctttttttttttctgtttgagataagaggcttgctctgttgcccaagctagagcgcagtggcgagactcggctcactgcctcctgggctcaattgatcctcccatctcagcctcctgagtagctggactacaggcacacaccaccacacccggctaatttttgtattttttgtaaagatggggtccattatgtaccccaggctggtcttgaacttctgggctcaagcaatccacccgcctcagctcccaaacagctgggattacagatgtgagccaccactcctgtccagttttctttataggcactttggacaagtgctatgtgcaatttaacacttaaacatattttctgggccgggcaggtggcccatgcctgtaatttcagcactttgggaggccgaggtaggtggatcatgaggtaggagtttgagaccagtatggccaacatggtgaaaccccgtctctactaaaactacaaaattagctgggcatggtggcgcgcgcctgtagtcccagctactcaggaggctaaggcagagaatcgcttgaacccgggaggcagaggttgcagtgaaccaagatcacgccactgcactcaacctgggcaagagagcaagactccgtctcaaaaaaaaaatttctgggctgggaacagtgctcacgcttgtaatcccagtcctttgggaggccaaggcaagaggactgcttgaggccagagtttgggaccaacctgtgcaacacacaaagaccctgtctctgtgagaccctgtctcaataatcctagctactccagaggctgaggtgcaaggatcacttgagcccagagtttgaggtacagtgagctacaatcatgccactatataccagccttgctgacacagcaagactctgttctaaatatatatacgtatattttgacaatataatcatactggaatcatcacccagtggatggctggaatactgttaaccaaggaaagaggaggataattaacagacacctatagccatctttctgtgacattgtcagactttggcagtgagcctgcaaaatactcatccagcacactaagcaattttagtactatcataatctacatttgcactgtaattaataaaacccaatttagcagggcctgagatcacaaggctgagtttctgcccctaccatctaatcagtgtgtgatcttccctataccattcagatctattgtctagtctctttgtgagacttgatgaaagcagatctttggttaactactgctgacctttatactgagaccctgtgctagttagcggcctcattctgcagttgctatggaaactgtccctttctccccacaacctattctggctctctgcctcacatggtactcttactgattgcagaagaggaggcctgtaaatctctccaagctcttttcagattcagatccacaaacggggggggggggggcagaggtacagcggaacaccgtctcagtgtcatagtcatgagactagagggtgaggcatccccagcatctgacattctgccagtatcttattttcccctttctgtgcaaaaaggattttcagggccatgtccaaattggttgcaagtggactggctgttttcctgtaacacatgctccatggtagggaccaggattgctgtaagttttttgttttgttttgaaacagagtctcactctgtcactcaggctggagtgcagtgggcaatcctggcttactgcaaccttcgcctcccgggttcaagtggttctcctgcctcagctcccgagtagctgggattataggcgcccaacaccacgcccagctaatttttgtatttttatagaggcagggtttctccatgttggccaggctggtcttgaactcctgacctcaagtgaccacccactttggcctcccaaactgctgggattacaggcgtgggccactgtgcccggccctgtgaagtatttaacatgcagacactgcccaatcagaacgtggctcacaggcagccttctgaatctgatactgtgttcctttctttcctgtactatctccaaagcaaaggcaaacggacaaaaaaaaacccaaaaacccaaaaaacaaaacaaaacaaaaaaacaaaaaaacaagtctgctggagccctagggtgaaagataggcgctcccatacatacatgtacagaatgattcgtatcctgggtaaaagactactctggagtgtggagtaggtggagacacactgaggaatggggaggctagactaacagcacttttttacaaagatgttccagtcagtcataaaacagtgaaggcctcctcagtcctttcccaacctctggttttgatcttagaactgtcaaccccttcttggtgcaaacactgctccttctgttttaagaactcccggggggtgggagggggggaagaatacaacagtctcctgagggagacccatctcactgtcacatcacttgaagatgggaagtctttcctaggttttactcaaatcccccttgctgcagtctgagctcattgcactcgagtctgcactcagcagagatggaaactagccagccaactgctatcttcagaataacaactcacagggactcaaggccggaaggtcattctgtcccctccaatactgcgcagccttccagagactcccagggcccggggcaaggacagggaaaccgaggatggagacctcgggcaggacccggcaggcagtgacaaaaaacaaaaaaaaaaaaaaacacgccaaacaacgataatacagaacacagacacagatggaggcaacgatacaaactcggaggcagagagggacaagatggctccctcagttcgggcgaggctgcggaattgccagacagtacttatcagggatacatcttactagaagcttcttccggcgccgaggcaaccgcctcgccccaccaatgggtcccccagagccccacccccgctcaagtctaagtggaagctcccgctggtactggggagggcgtggtggaggaagggggcggccaccaccctctagcctggcgagaccgcagagcacgagcttccagcccggcccgcccctgcggcgcctgtgccacgccccctgacaggcagcagccaatgaactgacctgccgccggcctttaagagccgcgcgcactctgcctgcagcggaagctgccggactacactccgcgggtgtttccatggagaccgaggccgagcctgcgcggcctcacggcgttgcatggagacaactccggggctggggctccgaagtcccggcgcaccgctggctcagaacccgcggagctgctgtgcgaggccggagccgcggtggcggctgcacgctgggacctgcagagcactctttgctaattgtgatcggcgatatcggtacagagagtcagctgagggccgtgcggcccaccttgaacaaggtgagccactgttctggctgtgcttcaggcatctctaccctggcttctccgccttctgcattcaactaccaatgcatacgtctgcatctccatccctagtggcacttcctgagatctgcgcccttgtcacctgcatcttccatgccatgtgtccgtatccctcgctctactaacatctcgcttgcccatccttactgcacactccatggcgttccgcagctccctgaggcagcggagctctatgcagcccctggggcccctctggtcacaccctccacgcagtgttttggaccaggtgtcctgaaagtcctcaccatccctggagaatccacgtcccatcttgctgtatcttctttatggtccctgaaccagcacggggagctttctgaacgcccctacaaatctcaaatctctgaatgccagtagccaaccactaagtgaccttcgtggctaccgctcctaagtcctcacctccttccccagtgctgtgcctgtggctgtggtgcagtgctgcgagccacctgcgggtggaagcaagctgtggagggctggggacaaggaagggaacacagaggcgaacctagaatcctacttagctgtaaatgtggggaaggtagccctcagtatctgggataggcccttaggtgtcacttccaccacaactggggaaccttacaagaaaattcctaccatagactcattaatgaccgagtttagtctaaactctgtccttctccctctggctcaggcaagcctagaaaagctgtaaactgggagaaagacaccattactagccacctttctttgagcatcactgaggctgatcatggcaactatccatataccctccctctccttacctgttctggaacttgaaagtgttcctgcagtctcaccaccctacaacctgcaaccttatccagaacctctttgtttttctcccacagggattctctcctggaacattgacctgtcatcctttgactgaaccaacagttgagactcttcattacccggcacctagctcacttctcctcagaggtcaaggttaggactaatgttttatttcagtcctttgggtaagagctggtcacagaggtccagctccctgggagaagtggccttgcgggaggtttgagtggaggagaagggaggaactttatgaggaggaaaatcatggaattccatagctgtccccacataccaaatatactttgcagactggtttgatactggagggagactggagaacataacttctccttgagaagagggttgttttggatagctgttgacatgcactaaagaaatgagggactcctcttagtgatcaatcatcttcacgcaaaaattcactctcttcatttgtgttcccctttctgcataccccgggtctcccgcttccctttacagacaccccagaatcccccattcatcttccttgacccttgtttagcattttatttaggctgcacaggtttcagggtttctggttcctgcttcggcttagccaacagtctccagggcagagcagaatcttggtacttacatgatgatgggcaccatcaaatccagatggaaggaggggctcctgaatttactgctacaagatcaagttgtactctgagatttggccagatcaaagctcacataatgcagtttcccattctgctgggtgggaggaatgggtgggtagagatttgagaaaataagatgttaggcactaccattccatgacagatgtctgtgaggtactacggaaagctctacatgctattataaaagaactaaggccgggcacagtgctcacactgtaatcccaacactttgggaggctgaggcggggagatcacctgaggtcgggagttcgagccagcctgaccaacggagaaaccccgcctctactaaaaaatacaaaactagctgggcgggtggtgcatgcctgtaatcccagctactcaggaggctgaggcaggagaatcgcttgaaccgggaggcagaggttgcagtgagccaagatcgtgccattgcactccagcctgggcaacaaagtgaaactccatctcaggaaaaaaaaaaaaagaaaaaggagctaggcatctagtcagttactggaaaatgttgacacaccaatccatcagcttagtggaatataaaatccatccagtcaacagccactgcaactgaatgattgaattcatgtcttatacagataattctcaattctcagtatagtagtcacctttccttaattatctctcctccttttccactgctcctaactccaaatctttgatcacttcctgatcactgatacttatagatgctgctaggaagttggagaaataaggctaatatgactaaagctccattagcctaggaatatatacagcaattttatataatatatgtgaggctgacatcttcctgatgtgactggcttcctgtaaagcaggctactactcttttgagaatgtttctgtttagaattactcatgtcatggcttcctccatttatcctaatgatgaaaatcggcagttttaccacttagtactcctaggagctttggtgaaaggccgatacagggatgacagaggatgaaattaatgactgaacagaagtttggggattatctgcgatgttaataattcacactgaatgctctaaccttgtccttttggctacagagacttgaggtaggctgctttctggaataatgtaagaaatgaaaagaagttaaaccaaagtacttagcattcttcagattaagatgcagcgatacttgggaagacacttacagagagaacatagttatctcaggcacttcttagaaatgagcattgatatataaacacctactaggccctttccataaagagtttgtctgtggtgtcctcaaggagcttagggccatgtaccctagatcagagctactttggcatactgcatatttttaggtttggacatttttatcatggtctgtctatgtcaaggagaatagtagagaatttcctggaaaaacccacacagctcaagacagccacagcccccccctgctggctcctctttcagctgtccccacaaacaacagtcagcccagagcagctgcgacactgcccctccctccagccttctgttagtgaggacgcaaaggggaccaggcagctggatgagctcaaggggatatgctagtgccttatggcttgactaccccacaggctgggccacattcctatcacctatcctcaagccctgggccaaaatgctgagaaagcagacaaaaatgatcctacagtgacaaggagagtgcacttattcctaggcactgccccctccacattgacaacccacacacagaaaagaagggaccctctgataaagagtcagtggcccagctccttctatggtcaagtctggtaaaagctttcaaaggtgatttttgcaccaggtagtctctccagtgtgactttctaacccctacaaaaaatctggatcttccgagcattctaatacaaattcagaacaattaggacagtggaaaactgagtttcaataactctctgattcttttactattggatcctataggaaatagaagggggcttataattcataactaatattctaagactctaaaaaaacagggccgggcatggtggcttatgcctgtaatcccagcactttgggaggccgaggtggtggatcacttgaggttaggagtttgagaccagcctggacaacatgttgaaaccctcttcactaaaaatacaaaaattagccgagggtggtggtgcacacctgtaatcccagctactcggaggcaggagaattgcttgaacccaggagacagaggttgcagtgagctgagatcatgacttgcagtccagcctgggcgacagagctagactccatctcaataaataaataaataaaaaacaggctgagggaccagtctggaggccttcggtctgactctccatttccactgacggactaggaagtgatagctctattacttctaccaatacaacagttaccctgaattaatacagcgctcattaacccctggaaccggggtctgcattgctgtctgaaatgggaaagcaaggacagaataggacttcaaatctcatactgcaggcatctttagttctgggtttacctgggagctagagtactccagagttgatctggtctgagatcctgatttatgatttccttgatcacctaatgacctctcagaaatcttccacaaaagggagaaagacttccagtggcatttgtacattcagatttggaagtctaggaatgaagaagcttttttttcatcttttatacaattcaaacccacagcattatcggaggatggtactaatattatactcatttcatagtttatgaagtaggtctgagagaggttaagtctcttgtttagcagcatgattagtaaaatggtggatcaagtccaaatccagggtttcatatcttactttgtagctcagctcaagcctctctttcttctttgcatctcaccatttcattgcagcagagcctaggaatacagcaggtggagagttggttgtgtgggtagctgttcagagggtgaaggctgaaggaaaactccactgtgagttggcaccatgccagggtgtggcccttgggggtggcagctgagaatatgggtgggctctgtattggtctggaaatgttattttgttcgtaaactaaatgtctacttaagtttccctcctaacacactccgaaagccctagaaagcagggaggagatagaaggcttgaggtgggaggaaataagaacgagaagttgcagaagaggggtatttcccttttgtgatgctcagaactcagcctggttttcctgtgtatctctgcagatggccgcttctacccaaacggggttgttgccattgtcgcagattgcatccccggatctaagcaaggattgctccccttttgtcccctcaacccccaagagtatagtgactcagctcctcctctcctctggctgcaattaaggggggatgggggatgctgaggcacagactattttggcttctctgaccttcaaaagtaactcttggcagcctggggcaaggtggggctagtgtttgggtgtgagtgggtggctgtgattgtgaggaaggccttaggagcggccaaactggggagggtggatgggaagagggcagggaaggactatgtaagagcatgagatcctcgggttggaaggaagtgctaccactctccagattcttcctttgagtcctagagcctttactaaatctgagatggaggtagagactaagggaaacaggatcaacattagaaagaccaaataatataatatagaaacagcaaagagacaaggagagagcaagaacccaatcacctacaaagtcattatagggtttttttaatctaaagagtacttctgttacatttaataattgcctacaaccttgcttgggccggaggccctggtgatccttcttggtccttgttaactcctcactgtaaggcagaaagctccctgtcccttcagggacttgtctcttcatatccaatgatcaagaatcccaagaatcagtgcctgtgtggttactgtgttatgctgcattcccatgaacttcatgtagctctcagggtccctgtgccccaccccaacaggctagggaccatgtgtccctccggaatttcaaactaccctctaaccctaaaataagacttatttctgccctccttggttctgtagtgctgaggttcagaagaaggcagcacatctctgcatccccaacctttgtctaagcagttccccacacctaccccatgcttttgggcccccagcctttgtctcctgctcctcagggactgaaggtcactccctggatccatctgaggagagaggcagcagatggtttctagagaagggggagagcccacgcagcccatgcctcctatagcctcgctctgtgccctagcaggggctttggtcttttggctgatgccaaaagaatatttcctaactaagcagggttgggaagaaaggtcctatgggccataggacattgcagaggctccttgagctgctagacaatccccagccccacagagccaagcaaaagcactggagctcagacgtcgtgaaggcaaagaaacattaagtctccagtgcctcgtcacggaccagcccctcttccccgccctggcgccgccctctcatcaagcacccccctcccccccccaccgcccgccccactcccaccctaagtgctgcaactcttccctgaagctgccggctgaggccggagctgccgcctccatgagaggcttcctctacaccccagggtaagaaccgaaccaaagggcttggcatgtgggggtacactgtgataggaggtgggatgggggtcatggaaagggtgctggtacctaatctggcacatctagaactacccagtggcagtaggcaggatggggaaatggagagagaagatgaacgttactggctgtggcccagcctggacccagaaccagaggccaccaggggctgtgacagtccacctctccagcgggcggggatgggagaaatcagcctgggacagcagcagagggtggtgccactggctctgctgacagcccaggatgctggaggagtttgggggctatgtttctggtcagaggcagaagatctgagagaaagggggatgttatgggaatgtgcctaataggagggcccctgggtgtcagtgctggattgctcagctgctcctatgctgggggtgagcagggcagtgagtttttgccaataagggaaggtgggggacactatggaaaagaagggaggaaagggtcactaagacgtggccgcgcctccttacagaccaaccggtttgcagtgggctcccccaccctattccctgcggcagctttagaatgggactctaaacccccctttctggccctgccgaggccactctggagacgagaactccctccccagcggctgccctgcatttccagtcgtgtcaaccccacaggttccagtctcagccctacccccacctcatctctgcttctcttcccaagatgggggctcttgaaagaggagccagtttcttctctctctctgcatccccccatccccaccccccatgcagaagagccaagaaaatgacttgtcatgctggggtggggggtgggggcggagctggagccggagtcagcgcgcacactcacacactgcggcaaactgcagctgcccaaacggtccccctcccctctgcctcactgcggagacacctgccctcctgcctgctcagcctctgcaccgcagcccaccccccccgcaactccagcactggctgagcactgtgtgtccctgcctcacaagatggtctctctaaagaaaaaggaaaaaacgagtcagttcccttcagtgagagagccaggggagcaaagaaacggctttctcccaggcctgaaaaagagaggcacaggatataaaccatgtaattcaagtcagaaccactcccagggatagagtgaggaacaggaccttatgccaggacaggaatgggatcatagaagtcttgtggtgataaatggggaccgtgaggaatggttgggggcaggaggggtagatagaaagcaaatcagtgtgtgctatagatatttgtctttctgaccctcctcctcaaatttatgaccttatttgtgtggagggagctcttgtctttctaaatctgaacgattaaggctggcagcttcccgaaccttgatatccctcacctgccccaagccctgcccttgctacatctgaggtggctcttgtcctctgaatttatctcaaatgttccctcaattctcaataaatagaagggaacccttgaattcccctttggcccaacccacgctgtatggggtttggcttctgacaccatcgttcatttcccccacagctgcatctgcagccctgtgctgccagattgcctgatcctggcaccatggctctgcctcttaacaaaggccctggccccaggcttctctgtccaagcaccagaaagaagagagagctgggtcacagaagagggtctaagggacaaatatggaccctcccaccagtatcctccagacagcccactgccatctgttggatgctctgtgggttaatgccactatgtactgcaattggaaaggggatttggcaaggaagggcgggtgcagggatggcagcattcttcttcagcatcttctgtctcatttgccactttctttctttgctaattgtttggtgtttcatgtgaggctggagaagggaaataggggatttggggatgcctttctttctccatggcctggggaacaccctgaatctctccttccttattaatgtgtttcttttcaagaacctttcactccccatgcccgtggtagaggcccctaggagcggggcaaagatagagaagaaactgttcacaatgaataggttgtggggtagtgaatctggcctctctgaaatttgggacatgaagatcaggttggagagggtgttgtgaaaacttccgagcaggaacaattgattgtgtgcatgtgtattagtgcgggcttggcctctgaggaaccagaggacagaaaagaagttatagtcctatgtccattctttgaatcataaaaccccaaaaatttagatagcacggcttctccgggtcttctggaacaggaattctggccttggatggcaagaagggtggggatctgtaccacacagaagctcctatttccttatttctagacactctgcgggcaggaaagccagggcagaggcaagccaggaaggagaaagggaagtgagggtcatcatcccaggggcccctctccagctgagccccccatccccaggcagcaccaggagcttagtgctcgagaaggacaaagcttcttgtcaatagggcagtctgaggccatagttccaggcagagggatgggggcaaggcagcagagggtgtggtagatgaagggaaggagaggacagccagtgtgggagaggggggtggaaaccctctaagggaagggctggatgagccagttcctagaccttactcagcagttccaaggtggcagggcctaaggataccttctctttcgtctaagccccatttcctgatagacattctttcctctcctgcaccacaatttctatacctattctcaatataaattcctacactctccctcaggccagaggaccctttgccaccagagtgagatcctagagaccatcatccggtaaatcccagtgcagacagcatcagctctgaggtaaggccagggcctgtgccttgccaacaggcctggtgcaagtgctatacccacccttgccagtgctaccactattaggccaagattcctctctctgccatctaagctgacgtattgtctccagcccactctggaggtgttatagggacataagttgggagcatgttcttgaggtactgaggggccattcattgcctttcccggatttcctatatctgtgaccactccccttcttccattccaggttcatcatcttcttagagctcatcagcttataaactactaatcttgagtgggcaaagtttagagcctgggggagactcatcctacagagtggcacctactcatatgaaaactttgcccaggtccttcacaacccgaggtaagttccatgccagagtgtctgggagaaagggtagcactagagctgtgggagggtctaagggaaagtctcatattgcatgaccatggggggccctggcagaaaggtaagagtcaccttggaaagaggtgaagattagggtactgaatctaagtcagaccaaaacaactctaggacctgatcaggtttctatctcctattcttctagatttcccaattgctcagcaatagagccctgggatacaggccttccttaccgtgtcctgcttaggggaaggtgattggagccaccgggattatccagttcccaagagaccctgcacctccggctaaaccctgagcccactctgccaccatggacggcgtggctgagttctccgagtatgtctctgagactgtggacgtgccatcccatttgacctactagagccccccacctcagggggcttcctcaagctctccaagccttttgctacatcttcccaggtggtcgtggggactctgccctctttgctgtcaatggtttcacatcctggtggatggtggctctgatcgcaagtcctgtttttggaagctggtacggcactggaccgcattgactcggtgctactcacacacattggggcagacaacctgccaggcatcatggactactgcagcgcaaagtggcagagctagaggaggagcagtcccagggctctagcattacagcgactgggtgaagaaccttatctctcctgagcttggagttgtctttttcaacggcctgagaagctgcggcttcctgatgcctcccggaaagccaagcgtagcattgaggaggctgcctcactctgcagcacttaaaccgcctgggcatccaggctgagcctctatatcgtgggtcagcaataccattgagccactgaccctcttccacaaaatgggtgtgggccggctggcatgtatgtcctcaaccctgtcaaggacagcaaggagatgcagttcctcatgcaaaagtggcaggcaatagtaaagccaagacaggcatcgtgctgcccaatgggaaggaggctgagactccgtgccctaccttacctctatcactgctctggtggtctggctaccagccaatcccatgagaagattgtgcgtgtgctttttccaggaaatgctccccaaaacaagatcttggaggcctagaaaagcttcggcatctggacttcctgcgttaccctgtggccacgcagaaggaccggcttctggggctgtgcctaccaacctcaagcccagcaaaatcaaacagcgggctgatacaaggagagcctcaaagccactaccaagacggccgtgagcaagttggccaaacgggaggggtggtagaagagggagccaaggaggcacgttcagagctggccaaggagttagccaagaagagaagaaggcaaaagagtcatctgagaagcccccagagaagcctgccaagcctgagaggtgaagacagagtcaagtgaggcactgaaggcagagaagcgaaagctgatcaaagacaggtagggaaaaagcaccttaaagaaaagatatcaaagctggaagaaaaaaaagacaagggaaaaaagagatcaaaaaggagaggaaagagctcaagaaggatgaaggaaggaaggagggaagaaggatgccaagaaggaggagaagaggaaagataccaaacctgagctcaagaagattccaagccagacctaaagccctttactcctgaggtacgtaagaccctctataaagccaggtccctggaagagtcaaaatagacaggagccgtgctatccgtggggagaaggagctgtttctgagccccagacacccccagcccagaagggaactgtaccactcccaaccatcagtggcacagggagctggtcctatcctcaccagaggacctcacacaggactttgaggagatgagcgtgaggagagggctttgctggctgaacaaagggacacaggactaggagataagccatccctctagacactgcagaggagggacccccaagtacagctatccagggaacaccacccttgttccagggctgggacaagaagaacatgtgatgaaggagaaagagcttgtcccagaggccctgaggaacaaggcagcaaggacagaggcctagactctggggctgaaacagaggaaggaaagatacctgggaggaaaagaagcagagggaagcagagaggctcccagacagaacagagccagagaggaaagtgaacctgaagtaaaggaggatgtgatagaaaaggctgagttagagaaatggaggaggtacacccttcagatgaggaggaagaggacgcgacaaaagctgaggtttttaccaaaaacatatgcaggaacccttgaaggtaactccaaggagccgggaggctttgggggtcgggaattgggactccagggcaaggcccctgagaaggagacctcgttattccaagcagcctgaccacacctgcaggagccactgagcatgtctcttacatccaggatgagaaatccctggctactcagagactgagcagaccatctcagatgaggagatccatgatgagcggaggagcgcccagctccacccagatttcatacaagtacatatgacctgcccgggcctgaggtgctggcccattcgaagccagccaacctgccgatagtgctgttcctgctacctctgcaaagtctatggaacgccagagactgaactcacctaccccactaacatagtggctgccctttggctgaagaggaacatgtgtcctcggccacttcaatcactgagtgtgacaaactttttcctttgccacatcagtggctgaggaccaatctgtggcctcacttacagctccccagaagaggagacaggcaagagctccctgctgcttgacacagtcacaagcatcccttcctccctactgaagctacgcagggcttggactatgtgccatcagctggtaccatctcacccacctctcactggaagaagacaagggcttcaaatcaccaccctgtgaggacttctctgtgactgggagtcagagaagagaggagagatcatagggaaaggcttgtctggagagagagctgtggagaggaagaggaggagacagcaaacgtagagatgtctgagaaactttgcagtcaatatgaactccagtgtttagtgcccctgggcatgccctacatccaggagaaccagcccttggagagcagaggagcggtgccttagcccagatgacagcacagtgaagatggcttctcctccacatctggcccacccagtgccacccacacaccctttcatcagtccccagtggaagaaaagttgagccccaagactttcaggaggcagactcctggggagacactaagcgcacaccaggtggggcaaagaagatgctgctgaggagacagtcaagccagggcctgaagagggcacactaggaaggaagagaaagttcctcctcccaggagcccccaggcccaggaagcacctgtcaacatgatgaggggcttacaggctgtaccattcaactgttgccagcacaggataaagcaatagctttgagattatggaggcaggagagcccacaggcccaattctgggagcagaagcccttccggaggtttgaggactttaccccaagaacctggcaaacctcagaaagatgaggtgctcaatatcctgaccgaagcctctctcctgaagatgcagaatccctctctgtcctcagcgtgcctccccagacactgccaaccaagagcctacccccaagtctccctgtggcctgacagaacgtacctacacaaagaccgttggccagaggtatctccagaagacacccagtcactttctcgtcagaagagagtcccagcaaggagacctccctggatgtctcttctaagcagctctctcagaaagccttggcaccctccagtttggggaactaaaccttgggaaggaagaaatggggctctgatgcaggccgaggatacctctcaccacacagctcccatgtctgttccagagcccctgcagccacagcgtcacctcccacagatgggacaactcgatactctgcacagacagacacacagatgacagccttgacaggaagtcacctgccagctcattctctcactctacaccttaggaaatgggaagtacttacctggggcgatcacaagccctgatgaacacattctgacactgatagctccttctccaagagtcctgagtctttgccaggccctgccttggaggacattgcataaagtgggaagataaagttccagggttgaaagacagaacctcagaacagaagaaggacctgagccaaaggatgaagttttacagcagaaagacaaaactctggagcacaaggaggggtagagccgaaggatacagccatctatcagaaagatgaggctctgcatgtaaagaatgggctgtgaaacagcaggataaggctttagaacaaaagggcagagacttagagcaaaaagcacagccctagaacagaaggacaaggccctggaaccaaaagacaaagacttagaagaaaagacaaggccctggaacagaaggataagattccagaagagaaagacaaagccttagaacaaaggatacagccctggaacagaaggacaaggccctggaaccaaaagataaagacttggacaaaaggacagggtcctagaacagaaggagaagatcccagaagagaaagacaaagcctagatcaaaaagtcagaagtgttgaacataaggctccggaggacacggtcgctgaaatgaggacagagacctagaacagacagacaaagcccctgaacagaaacaccaggcccaggaacaaaggataaagtctcagaaaagaaggatcaggccttagaacaaaaatactgggctttggacagaaggatgaagccctggaacaaaacattcaggctctggaagagaaccaccaaactcggagcaggagagcctagtgcaggaggataaaaccaggaaaccaaagatgctagaggaaaatccccagaaaaggtcaaggccatggaagagaagttagaagctcttctggagaagaccaagctctgggcctggaagagagcctagtgcaggagggcagggccagagagcaggaagaaagtactggagggggcaggatgtggtccaggagtggcaagaaacatctcctaccagagagggccggctggagaacagaaagagcttgccccggcatgggaggacacatctcctgagcaggcaataggtattggaggggcagagaggatgtggccttggaacaggacacatactggaggggctaagctgtgagcggaaggtctggttccctcacgagctggatggccagggggcccgccacactacactgaggaacgggaaagcactttcctagatgagggcccagatgatgagcaagagtacccctgcgggaacacgcaacccggagcccctgggcctcagacttcaaggatttccggaatcctcaccacagaaggggctagaggtggagcgctggcttgctgaatcaccagttggttgccaccagaggaagaggacaaactgacccgctctccctttgagatcatctcccctcagcttccccacctgagatggttggacaaagggttccttcagccccaggacaagagagtctatcccagaccctaagctcatgccacacatgaagaatgaacccactactccctcatggcggctgacatcccaccctgggtgcccaaggacagacccctcccccctgcacccctctcccagctcctggtccccccacacctgccccggaatcccatactcctgcacccttctcttgggcacagccgagtatgacagtgtggtggctgcagtgcaggagggggcagctgagttggaagtgggccatactcccccctggggaaggactaccgcaaggctgaaggggaaagggaagaagaggtagggctgaggctcctgacaaaagctcacacagctcaaaggtaccagaggccagcaaagccatgccaccacggagcctgagcagactgagccggagcagagagagcccacacccttcctgatgagagaagctttcagtatgcagacatctatgagcagatgatgcttactgggctggccctgcatgccccactagagagcctccacttggagcagctggggattggcccccatcctctcaaccaaggaggcagctgccggccgaaacacatctgcagagaaggagctttcattcctatctcacccaagagcctccagtctgacactccaaccttcagctatgcagccctggaggacccactgtacccccaaggccagagccagggccaagtatggagcccagcctcacccacctgcagttcccccccgtgctcctatcctgagcaaaggcccaagcccccctcttaatgtaacatcctgagctgcagcccagataggaggtccccatcccccaaggaatcaggccggatcactgggatgacagcactagtgactcagaactggagaagggggctcgggaacagccagaaaagaggcccaatccccaagtcctcctcaccccattcctatggggtcccccacattatgccagaaactgaggcacatgttagccctcccttggactcacacctggggcctgcccgaccagtctggacttccctgcttcagcctttggcttctcctcattgcagccagctcccccacgctgccctctccagctgaaccccgctcggcaccctgtggctcccttgccttctctggggtcgagctctggctctggctccaggaccccccaccagaacccggcatgatgaatacctggagtgaccaaggcccccagcctggattcctcactgccccagctcccatcacccagttctctggggcccctctcctctccaatctgccacgacctgcctcaccagccctgtctgagggctctcctctgaggctaccacgcctgtgatttcaagtgtggcggagcgcttctctccaagcctgaggctgcagaacaggagtctggagagctggacccaggaatggaaccagctgcccacacctctgggacctcactcctctgagcccagcacccccagcttcactggacttggccctagtccagctccaagcctgcctggagacatgggtgatggcatcctgccgtgccacctggagtctcagaggcagccacggagaagccaagccccttccaggttccctctgaggattgtgcagcaatggcccaactgaaaccagccctaaccccccaggccctgccccagccaaggctgaaatgaagaggctgcggcttgccctgcctgggaacgtggggcctggcctgaaggagctgagagagctcccggcctgacacattgctctcccctgagcagccagtgtgtcctgcagggggctcgggggcccacccagcagtgcctctcctgaggtcgaagctgggccccagggatgtgccatgagcctcggccccatcgtggggagctctccccatccttcctgaacccacctctgccccatccatagatgatagggacctctcaactgaggaagttcggctagtaggaagaggggggcgcgccgggtaggggggccagggaccactgggggcccatgccctgtgactgatgagacacccctacatcagccagtgactcaggctcctcacagtcagattctgatgtcccgccagaaatgaggagtgtccgtccatcacagctgaggcagccctcgactcagatgaagatggagactcctacctgtggacaaagctgggggtgtcagtggtactcaccaccccaggcctggccatgcccacctcctctcccacagccagacccccgcccatcccctccccgccctgatgtgtgcaggctgaccccgaggggctcagctcagagtctgggagagtagagaggctacgggagaaggaaaggttcaggggcgagtagggcgcagggccccaggcaaggccaagccagcgtcccctgacggcgtctggatcttcggggaaaacgctcacccacccctggtaaagggcctgcagatcagcatcccgggccccacctcgaccacgcagcaccacaagccaggtcaccccagcagaggaaaggatggacacagccccatgtccaaaggcctagtcaatggactcaaggcaggaccaataagtatatcatgaaacttggcagagagtgtgggttagggctgggtgtgggctggtcagcttcaggagtgggacagaggggaaggttgccaaaagggttctacttttcctctacaatgatcctggcttgtctctacagtggccttgagttccaagggcagctctggtgcccctgtattgtggatctcgcctacatcccgaatcattgcagtggcaagactgctgaccttgacttctccgtcgagtgcgtgcatcctactatgtggtcagtgggaatgaccctgccaatggcgagcaagccgggctgtgctggatgccctgctggagggcaaggcccagtggggggagaatcttcggtgagtagcaaaggacaccaaggaagtagtctggtcaacgctcactcagaggcagtagggaacacagtccctatttattaaaggatgggccttttctaagggcagcagagctgcttcgagaccatgaggtgccccttccccctcacctaccttccctttatgttctcacatcagactatcttatctcccttctaggtgactctgatccctactcatgacacggaggtgactcgtggtggtaccaacaaactcatgagcagcagcaacaactgaatgtcctggtcctggctagcacagcaccgtggtgatgcaggatgagtccttccctgcctgcaagattgagttctgaaagaccgccctcccttccccaaggatccactcccccagctcctttagagaatggctactgctggtcctttggggttgagggagatgggagctagggggaggggagggagatgtcttgttgtgggacttgggctgggctaaatgggaggggttgtccctccccatcatccattcctgtgagggtctcaaaccaaagttaacagggagaggatgggggaggggacaaattagaataggatagatctgatgcctgagaaccctctcctagcactgtcaaatgctggtattgaatggggactgggatgggtctcagagagcaacctcctccctcgtagagggagattatatccccaactccaggacctctttatctcaatctatttatttggcatcctgggaaggatttccaatagtaattatgtgacctggggcaggataccgtcagtgaggtgcccagagctgcaccctttcctccattcccatcccccatctcctcaaccaccagggtctgagttctagcagggtcctgggggtatccactgctatactgttctactgcttccctcagtatctgaatgtctcaatttaaaacttgagctctttagaccaatagactggtgagaggagaaaggagcttatcccccagaccctgcttataccattcacatcccagggctgtgtccagacagcacaaaacggcaaggagagcccaaccccaatgccagaattcttccaaactccctgactctttgaagtttttactcaccccattcaattatcctgatcccttctcatcccctgcttggcttctctgcatgtggtcatctgctgggcttggtgtttaatgggttaaaaataagccactgcctgacatcccaacatttgacacccagcaatgtgtgactcccccaacattccactatgccatcctgcagctgaaatgggaacatggctgcctctccaaacccgctcttggacagaggatctgggaggtggaagccaggccagggacttggggaaaatgagatggaggaaggaaaaagggagaagctgagccacagcttaaccctacagagtgaaatgaaaacgggctgaaaataccaccccaggagaggacctcgccccagcaagccagtgagcagccctgccagactactgccagactgagaaacccagaagctggtatcatgtgggcttgccttctctgccaaacgactgggaaaccaaaatgagcccaccttgtgtcttcctagctccaccctccccgtgctgctgtgttctgctcctccccacgcttccctgcatagttcccagctgctgtaacggagccacctccaactctaacaataaaccaagttcattcagatagtgtagtgctgcttaggctttttctgactccatacatgcttagttactgggcctggcttctacctctctgcttcaaccagtattgaatttatcttggaagactccaatgctttgattactggaaacacttgtgcctgagtatgaagaataggagcctagggtggatacataatctggtctgggggagggaagaggggcagaaggcctcctgggaaggggatatgcattcctggggtcaagagttgaggaccaaataaccaggatcagctaccctggacagcctcttgggtaaaggggtaaaaagctgaaggaccctaagagatccagagcctaatgaggttggaaacactctccttgtgcagtcaggatttccatggagtaaaacggtcgactttcctcctccatggaaccctttatagtcctaagtatgtcagaagtggccaggttatgaatgtgtatatttgggaggggcatattctagccctcccactgttctgggctctctcatggtaaagatgtcaaagggcagagaaagggcatagcccctttatataaactcctcctgacactccatcagagtgaaaattaacaggatgattccaagaacttggtgagaaggcatgtaccctctggtgcttcacaggagggaacctctttccagtcccccatccaacactctacttactcaataaagaccttttgggaccgggcgtggtggctcacacctgtaatcccagcactttgggaggccgaggcgggcaatcacctgaggtcaggagttcgagaccagcctggccaacacggcgaaaccccgtctctataaaaatacaaaaaaaattagctgggtgtggtgacgggcatctgtaatcccagctactcggaggctaaggcaggagaatcgcttgaacccaggaggcggcagttgcagtgagctgagacgcaccactgcactgtagcctgggtgacagagcgagactctgtctctaaataaataaataataccttttgagatagtgggttaactgccataggctcctcttgggatgcctgatctctttttttttttttttttttggagacagagtctcattctgtcaccaggctggagtgcagtgcgcgatcttggctcactgcaacctccacctcctggattcaagcaattctcctgcttcagctcccgagtagctgggattacaggcatgtgccaccatgcccagctaatttttatattttagtagagatggggtttcaccatgttggccaggatagtctcaatctcttgacctcatgatcacccacctcggcctcccaaagtgctaggattacagacagatgtgagccaccacgcccactgatctctatatttttatagtctatttttggatgcctgatctctgtatttttacagccattcctgctcaactataatggcttttgaccgattcagattaatcagttacagacacaatgactcatagtcgtattcctttttttttttttttgagacagagtcttgcatttttgcccagctggagggcagtggcgtgattttggctcactgcaacctctgcctccagggttcaagtgttctcctgtctcagcctcccgaatagctgggattacaggtgtccaccaccatgcctggcaatttttgtgtttttagtagagacaaggtttcaccatgttggccaggttggtctccaaccctgacctcaaatgatctgcccgccttggcctcccaaagtgctgggattacaggtgtaaccaccgtgcccagcctatattcattcttgaattcacaaggacatcaccatcatccatcacaccattctcattagtttatatttattgagcactcataatgttccagcccccgactccatgaccgcattacccctcctacccactcccattcccatccctggatctttggaaaaagctcataatcatatctggccctcagacacaatgatataaggacaaatttcttggggaccctgagtgtttggtctttggccagtctgtccctggcacaactacagaaataaatatatatataatatttattaaacctttgcttgtatctgtacaatattgatctctgctgattgcttaaaaagaacctgattatctctactactacagcatctcctaagccaaacagccccaccacagagaggcccactttcacagactggctaagaatcctctagagcattttaagtagttgctctgattttgcacagcagtctaatacctacttttccctagagctattgcccagaggaacaggacgaggcagaaggggcacttggggatgatatggaaggatctataaggcaagtctaaagattagtggccatgtcagatgtttggggaagggactctattttccagacatttcagatagccacccgggctcacctgaggagtgctggcaaagacaagagtcccctgaatgcacatatggtcaagcgtaccttgagaagtcgtgaacatttccccagaaaagtgaagaccctagagtcccccttttgcatttgctgtcgccagatggtgtcttcagcagtgaagcggcatttcctttaacatctgtgatttcctaggatgctcagagaaggctgggtaatgacagaccaacccaccccaggaaatcctattcaagtctaatggctaagtgaggagccaatggcttcttcgaacctaaactggctcctcctcaaccacagctctggcacaggtatgcttcatacaaagagaactacttcccagacaccgctggtgagagctggccagtgagttagccaacagaaaaggttgctggctaaatggctggtatagtgtgataccactaatgagaaaattaatcacatgttgctggtggaggggtgagtgctggtcatgggctagagactggctctgagggtttggatcaccagatggagctgggcttgaggaataccctctccaggcagctgatcaatcacttcagggaccacccagacttctaatttatctcctcagggacctcctgggcctgcagatcaatctcctcagggaaccttgggatggtttatcaatctcagggatgccctgagataacagattgatcgcagaagtccctgggccagcctgccaacctccacagagaactcctggtatggctggatgacctcctcaggatctcttcagctgggctgccaacttctacaagggtttcctggaccaagctaccaaccctacatggaacttatggaccagcttgccaacctccacagagaccccctggcatggctggtgacctcctcggagttctccagacatagctggcaaacttcctcagagactttctggcacgttggctggacttctggcatggctggctgatgtgagggacctcctggcatgtgtggttacattgtcatggttctcctggcattgctggctgatgtcagggaccttctgacatggctggtgagcgcctcagaaatgtcctggcatggctggctgatgtcagggacctcctgacatggcggctgacctcctcgtatggctggctggtttccataggtggcacctgtggggactgatttgttcaaaaagctcttgctccccttctatggagagctcttgtgctccactcccaggggtccctggagcagcccaaggccttgatgttcttcagccacgtgtgaatttagggagggttgacactgaagccaaattgggagttaccatctactgtagtaggggaagaaggaccagcactgacacagtgctagaagggccactgctgtctgtaaagcaaagtcaagagatcaagttagagagctggaagagtaggctctaccctgtgcagatagttcaaatgctagaattgttggcctagctacttatgtcttgagggaagagtgtccaaattcttcctaagttaagcagagactcctagtttgcttacctcaggaactgtcaccctggcctaatgtatactttgagagtaacaataggtacatctaagacttcaggagagagtgctaagacccacttcatctggttctttcacaatacactcccatcccaattccaagttcccaaggcctctcattcctactttggaagcatataatactttagcccagtggttcataaacaaaatcatgaaaaaattttttaaaatactaattccagttttcaactccagagattctaattctataggtttagcgtaaaggtgtagtttggggagggaggaggaagaaggcaatataattttgttggaacactctcatttgaatctgatgacaccttctgttaagaatcattctttaaagcaatcaatgtatttctggggcagaggtaacattatttatagcccaaatgataagttggcagaagaatgtagaaaaaccatgtaaatcaaacaataggaaagaaaatggtttacctggctgggtgcggtggctcacgcctgtaatcccgcactttgggaggccgaggcaggcagatcacttgaggtcaggagctctaaaccagcctgccaacatggcaaaaccttgtctctactaaaaatacaaaaattagccaggcgtagtggcgctgtctgtaatcccagctactcaggaggctgaggcaggtgaatcacttgaaccccagagtggaggttgcagtgagccgaaattgtgccactatactccagcctgggcaacaaagcaagctctgtctcagaaaaaaaaaaaaaaagaaaatagtttacccaaaaatggaagatggccaggaatttctacatggcagttcttaacctttctaggggtcagtggcccctttgaggtactagtcagatatcttccaggaaaaatctatataagaatattcacactaatctttacatgtgttcctgaagctcacagaccctaccctgaaaccacatctatggatccagagttaagacgctgtaagtcttgggacatacaatgttacaggcttgtgcatattatatacacggaaaacattaaaaactgatttcctacatcctgacagtagtgtaataaagacctcagagtcttcaattcactgtgggatgattcctactccatcctctactgcttcatcgccctctagtacttgactacctacttttcccttggtaaacatcatttttgttgataatattataacgatatattaaacactatggtatcaataatgacagattctgggaaaagggaacatcagaacatattgccatgaagaaaaccttgaaaagttggtaaacctgagcctacaaaggctcaatccatcattgagtgaaggtatgctagttatctctcttctgtaaacaatcaaaggaggggctggacacggtgctcatacttgtaatcccagcactttgggaggccgaggtgggcagatcacaaggtcaggattcgagaccagcctgaccaacatagtgaaactcctcctctactaaaaatacaaaaaaaattagccaggcatggtggcgcatgcctgtaatcccagctacagctactcaggaggctgagcagaagaatcacttgaacccaggaggcggaggttgcagtgagccgagattgcaccattgactccagcctggatgacagagcaagactccacctcaaaaaaaaaaaaaaaaaaaaaaaaaaagaatcaaaggaggcatgcttcaagcagaaaaagaagccagacgcggtggctcatgctgtaatcccaacactttgggaggctgaggtgggtgcatcacttgagatcaggagttcgaaccagcctggccaacatggcaaaaccccgtctctactaaaaatacaaaaattagccaggatggtggcacgtgcctgtaatcccagttactcaggaggctgaggtaggagaatcacttgg

SEQ ID NO: 5072 - DNA, 100000 bp, Homo sapiens
ttgggaggctgagccaaacagatcacctgaggtcaggagttcgagaccaacctggccaaatagtgaaaccccttctctactaaaaatacaaaaattagccatgcgtggtagcgggcactgtaatcttagctactcaggaggctgaggcaggagaattgcttgaaccctggtatgtggagttgcagtgagccaggatcgcaccactgcactccagcctgggtggcagagcaagactcgtctcaaaaaaaaaaaaaggaaaaagagaaaaggatggggcaggggagagtggtcagccggacgttggagggagggggttcagaattatgcaaataacttcctacaaggctgggcaattaagggtgtctttggtcagccttaatgtgacttggttagaaggaagatgagtggaggcaagcattttcatttcaatctgtcaggcatcttaatgtcttcgagtgcttagaatatgcaagtgctaaaattttttgtaatgtctatcaggtagatgtgttggagtctcagttctcccagtgcttcatcagatcaattctacccgagactttgaaagcatccgattggctcatgaccactcctgagcaatttgctggctcaatcctttatcctattgaaacctgtaagtaaggctcatggtttcctcagactgcttctaccactgaccattcccttaggcagtttgagttgacaggaacgaaaccatcattaagcaattattcaagtccattttaaaacattttttaagaatgtgtaagcggcggggcatggtggctcatgcctgtaatcccagcactttgggaggccgaggtggcggatcacaaggtcaggagttcaagaccagcctggccaacatggtgaaaacccgtctctctaaaaatacagaagaaaaaaaaaataataggtgtggtggctcgcgcctgtaatcccagtacttgggaggcctgaggcaggagaattgcttggacccaggaggcagaggttgcagtgaccaagatcattccactgcactccagcctgggcaacagagcaagattctgtcttgggggacagataaaaaaaaaaagaatgtgtaaagcaaaactaaaaaggcatgttaaacgggacctagatgtctttgaatttctgaaatacagggtgtggtgagcagctacagatgaaagaattagtgcttaaaccctcaggagttaaagaaactcaaaattcttgctgacaatacagaaaaacaatgaaaagcatatagagttcaccttcttagaaatcttttggaccaggatggatcagtctttgaaagttcttttcatagacaactagagtagtgtttctctctcgatctatgtatgtgttctgtaagtacatatatgtctccttcgtggcagttattttcaactttggctgcacattgaatcatcgggactctttaaaaaaatctaggtgacagagcacttaaattagaatccctgaatagtgggacccaggtactaattttttttaaagctcacaagctagttccaattccaggtaaagaacaggaagactgaaatgatctctggtagtttctaatggaacggttatgcctccctgacatgagctggttgttattcctcagtgtgctacagcacagctgttacagactttttaaaatgttctggtgtttagggctatttctgctgtaccaggaagagtaagatatatattatagatgccactccagagggctggctgaaaacaaccaagaactactgtgatgggtagatgtgtccttatgtggcatagatgtatccatagggaaaagcagaataacagagcaggtcatctcattaaatatttattgagtgcttactgtatgcaaggcactggggatacaaagaggtatattcatggctctgcccttaaggagctcacaatctagttggaaaaacaagacatatatattatatacatacaaaaatcagtaacaacacagaggcctgaacaattgccaagtggacaacgtacagataataaagaagcaagaaacgagggttcactaaaggctatagtggggaagggatgcttcactgagagagtgggacttgaactggtattaaaaacaagagcatcccgggcaaaggaacaacactcacagctcagaggcaggaagacactctgcgggtctaagaaatgaagagtaaatgtggctagattggaggtttggtgcagggctaagagagtaatactcgcttagccagaaaggatgcatttgttttacgcattttgtgcgtctgaggggctggcaggccttgcacgggcagtgtctatcctgtcagatttgggaggtcagctattaattagatcagctattaatcgactgttctcctaacactttaacttcatggatgtaccttccttcctttcctaatgccaatctgtttcccgggtaggtgtttcactgcctgaatgaaatcctagatctctgtcacagttttgttcgctggtcagtcagaacctaggcccactggatgagcgtggagccgcccagctgacattctcgtgaaggtgcgtctgcctggaagtatgcagccttgccgaaaggacagaggtgttttgccaatggagaattcatgatctttcctctgagtcagtaaagcatttcctcaataccacacgtacagagataagatacaaagataaaaatgttggtatcagttgattttgaagcagtaattactgtgccacctcacagtgctcaaaaatagttcagtcctgaatagtttattcacccatcaaataagcattgggttgttctaacttcctcacatcctcccccctccttacttcttgaactaacccccatctcactgagataattatctgcttgtaatcaaaacgggttctcccaaccccagtacttgacaaaatacattaactggaaaccagctactaaattcctactgataaagagtactttcataggaagtcatgcatgtatggatttggtacaagtcattttaggaataatagaaataggaatgtgggaaggccaggtggttctgtagaattttgaacaaggctttccaagaaactcctccctccgcccccatcctccatatggagagttggtgagctgaagtggatgacagctgagtccttctctctgcagggctttagccgccagtcttcactcctgttcaaattctctccagtgttcggaatcatcagatcaactcagatttggctcaactactgttacgctagattataacaaatactatacccaggctggtggaactctgggcaggtaggagcaaccttgggtaactcagtagactttttaaggtggctttttaatgagttgtagaattctagaacggaagaagactttagtccaaataccctcattttataagtaaggcttagagatagaggtggaccatctttaataattttaatggaggttattttctagtagaagtcatcatcatcataaatactaaaaaacctgacagtgagataggtgttaagtcctttgctaggttatgtattgcttgctgggaggcagtgggccttccactcccaattctgatatgaactagctgtgcagccgtggcaccccgccttgctggtccctagcttccgcatctgtgaaaggaggcgaccacccctttaactctaaactttaaaaaaaactgataccgagattcagtggtagctggcttcccagagtctgtcattcccattcagaaaatcacttcattgtcctttctctctaaaatgtctgcaagagatttttttctaagctattgtagcagaagagtcaaaagaaactcttcagttttaagatacattatttagatcacaggttatcctgattcatatttctttgaaggtagtcttgggaaacatgacacttaataaggctctttttctcttttgtagtttcgggatgtgaaaatttctggtcataaattgaaataacagccacgttcccaaggttgtaacagaagattcaaaacatcccttctagccacacacaaataaatatctgcggcttagtgataggactctaccttttctcctgaagcagttactgaacatccaggagtacaactccttcccatcattcccatgtggaagggctctcccatcaaggagaacatgtggcatctctgatcctttacattgagaacatttgttgatatgttcatttattcaatagtcatttattgagcacctactacgtaccttggtactgttaagctgtgggagatacagcggtaaacaaacaatatagagcagaaagttaaatattttatgttcatatgtgaaaaagtaattatgtttataaatagactaactgctggatgttaccaccagtaagaaagcaacaggtaagataggctttctctctccctataccaagtaatttataccacacagattgggcaattctagctaatgaaaatatacttaaaagtatttcttaggccgggatggtggctcacacctgtaatcccagcactttgggaggccgaggcgggcggatcacctgagtcaggagtttgagaccagcctgaccaacatgatgaaacctcgattctactaaaaataaaaaattagccaggtgtggtggcatgtgcctgtaatcccagctactcaggaggctgagaaggagaattgcttgaacctgggaagcagacgctgcagtgagctgagattgtgccattgcttccagcccgggcaacaagagcgaaattccgtctcaaaaaaaaaaaaaaaaaaaaaaagattattctccaagaaaaaggtccttaagaaaaaattgagatcaagttgttagatttttaatactgaagattgcaggcccaattacccatcttacacaaaccataggggttgaagttatttaatatggcccagccatcactggtaatcaatattcatatcagtgtaagtaaaaagaaaattcactgaacaacgccctccaaactgaaaaagaatgcagtgttctggcatcaggttatgtcactgcatctggttttcatcactacatattctacacacactgggaagctctgacaactattccctgctattatcaactaaagatcaccctttccactgctgtctctggagcaggagtggcaaactatggcctgctgtctgtttttgtacagttttactgaaacacagccgtgccctttgtttactcattgtctatggttgctttcatgccctcacagcaaaggcgagtagttgtatggatcaaatggcccacaaagcctgaaatatttactctttgaccctttacagaaaaaaccttgttgacccctgctttagagaatgagaagccatgcagggatcagtgatgccagaggagggaaggaactgcttccagctattgtgacaataataataataataatattgggtctttactagaacgtgtaacatttccaggtgttctcacttgtgcttcccatgtttatcttacggaggtcattccatcaagcttatggtcactgtcccttcatggcagttggtcctttcgttctcctttagctctaagagttggggagtacccacaggtgagctgtgatctcagctcagagaggagcatgaggtcttttttaactgtcaggaaacagagctgtgcccaattccactcaactttggcacaactgttaatctgggccttcacctaccttaaactgagtttctgcaagcatagcttttagacaccctggaataaccttttgggaatgatgccacagaataaagttcactcttacttttcaatttccttggccagctgtcctccgtaagtgaataagcctgttgaaagactcaagaaagtactatgtcttgtcatttgttctgagattaagctcaaaaaaacagatgaagaatcccagttactacaaccaaagagattcaacatttattttatcataaaagttcagcaaataaactatatacaagatccatgcaaggaatccagttacacacaagacacatttaaaacctgttaaaacacaatctccacgatagcagggaataaaaccagtaagaccaagtatctttaggagaaacataatcgtgtttatattttggatgctgcttgaatccaattctctccccaacatgaggcactggatcacccactcttgtgacaccacaggcagctgcaatgcttcagcacactcagcaccgaggctgggcatgaggggtccgtcaccaccacatcaaatacccctaaagcatatctgcaaggagcaagggaaagtgaagaaggaaaggacactcaacttagccctccattgaaagagagatttgattctaaccaatacatcccactctgcacaaaccaaagccctattagtcaaacacactgctactgatcatgaccaaaggcagagttataatcactatgtgctgacttgtagaaatatttaacaaatatacgtccagtgcttcacttatgttgactcacctcttgaggtggtacttttcttctctaagaaacatggatacggtcaacctattaggcctgagcctggaccacaaggcctaacacctacaggtctaaggagatccctggaacaaagacactacaccactctttcaggtacctttgttatgggcacttgaatggtgctgcttcacagaggctgcacaccagtcatgaggatctcagaccagagctccaggaagttctgctgttggtctgataccagagtaccttcagattctggaaaggattttcacggggttgcctatgaaggagacaggaaggaccttagcatgacaagtaatatccaacaaactgcctttctgcaaagggactcatgtaatctgaatgctttcaaaaataaatgccccatcagacatagtgtctcaagcctgtaatccagcactttgggaggctgtcgtggttggatctcttgggcctgggagttcgagaccagcctggcaatgtggtgagaccccatctctacaaaagacaacaaaaaaattagctgggtgtggtgcgagtgcctgtagtcccagcagcttgggaggctgaggtagggggatcacttcagcctggaggttgaggctgcagtaagtcgtcactgcgccactgtactccagcctaggtgacagagaagacttcatcttaaaaaactaagccctatattagggtcccccttctcttccttctttcatgaatgatctgtattccttgcattcctggctttctaatttccatgtttgttctggggcgagaataatccaaatcatgctcctgagcctatatatttttaatgcttgcttaaaacttattctctgactttacaggttgagaatattgaacctatatacaaatcttcacacatttgcaaaggttcctagccaatgtaacctagggaaataaactagataaactcctgaagtcatttcaacccactcaaatttatcccacagacattccaatttctagaaagctttactctctcaccagattctcttccctccaaagcttgctgtcctcctgcctatacaattctggatgggcttcaatacttaccagtccagaattctttgctcctcaaggctgtacccagctggcaacagatattacggtagttctggagctggttggcatggcaactatcatggacccagacatgagacaccaaggaatcccactggcaaggcacaggaagtacttccgggttcgacaatgctgatccgcattagaagacactggtaagctgtgttacactgcaagaaaagaagcagagccaatgggttggtgacttctgtggaaagctcctaagcagcagccataatgagccatgaagagcagatctaagactcccaactactacccaaaatgtgatttagtctatcctgcccaaggccactcttccactggaaggcccaagtaatttccatagatgttctctctgcctcacctgcagcatactgggacctaaatcctcaacggacaaccaaaacctatgaactcagcctttcaggctaaaaatagcaaccctaataggggtttctactactaaacataaacatcaatcttcttttgtcccagaacagaaccatagccattaactaacccaaggtcctaccttctcttccctatacacaacaaaattctatttcatgcaaaaacattttggcagtttctcagttcctgaaatctctggctatttatccaggttccccaacccctcccaggcctcttctcaacacagcaagttggctcttacattgccactatattaggttacacaaagaaactcctcacctgggcttcattgaaatcttaaggatatagccagctcctgctcgaagctgggattctgtatactgcttgttgaaaggagaatttccaaaaattctatattaaaaaaaaaaaccaagataataattactgagtggttttttatttgctaccttatgcctccttcttactgcccccttttccactccccagctatccacacagtgtgtccccaaagacaggccaagggcttccccatgggtcagaaagagatcttgagcctttaaaatgctgccaaaagaagggacaagagtaggagggaatgggaagatgaggactgaggtaggtcctagacctaaaaacatcaaaggttcctgcaccggaccgttgatagggatggaacacaatcatttcccacagtgacatattccaacttgaataacccttaccatcaggagttccctttgtgtctatcctaaatctttcctgttgaaaactaaaccccatttcctctagtctgccttctgtggagatgaatagctgatgaacactttataagttatatatgaagggttattataaaccactgcatcagcctttttacccccttgtacaactaaaactttaataaaccgaatgctcaatgaaatatggttttaaaattttaactgattaagtgaaggttagaaaatctgtttcaacctttttattgaaaactatctacctttgatgatcttgaagtacctcaggacctgaacaccaatgactgctctatagtcttgagagtgaagtagaagatatgagagatgagctgaagctgtaatgaccctaggcaattagaaattgcttcttttgaccaaatatctaattgagcttgttttcttgtcatctgctcctctcatatataaataacacattaaaaaaaaaaaaaaagaaaagcaagacattagagattttagttaattaggagttttgggaaattaagttcaattaactgaaatttttatcacaaattttaaaacccaacccaatccagtgcataaggttaatgccggtaccactccccttccccttcacacccagtagtaaaacttagagcagatccctatgacggctcccccttcagtgccctcgttgtctgctggaggagctcaggcaccgccgagccccaggtcaggggtctccatctccacttagttctgactagccaacctattcacttttctgctcttttcttgattcagcattctccacattcttctcaaattgaaatcccaaaacagaactctaaatggttataagaaactcagaatacagcagggctatttctcagctttgtcatgcacccttttgctatctcaatatagcatgtcacaatcttcagcaccaagattctactgcgagtcactgccaacaccccttacagtcctgtatttttctcaagacttctactttatgtcgcttaatccaggactggtctacttagattttaatccctaattatatttccttaatttgttaatgaagtattaccctgtctaggcagtgtgtttctctaatttttctcaaatagtctggttccaatttcttcatttttgaggtataagtgccctgcccagccagatgctaaaatgaatggttgttaatcgtgccatctaaatcaagtatgaaggtactaaataaacccaactccaggtcaatccctgtgtctgaaggatctctgatggtgtgccacccaacaagattaggtaccaacttattaataaatatatctcataagatgaatttaaatattttactgagctcctgttgtagctggtgtctaagaattcctatttatctgtaacatctaccaaacagtttcttaaaaacttaattctgtagaggattgttttagtattagatgtcttccgccttcttgagattgagaaaccccaagcattctcatacactgaaaatatcaaggattctggtactgttgggctgcgcccaggatgaaggcaccaacataaagacacattcaccataaccacactgtctatcagaaaccgaagatcccttcaaaaacactgtccaaatgcctcattttatttttatgagtacagttttttacatctcacgcaggcacacggattttaatgaaactggacagcctgcatctcataccatcagctttcttgactatgctgaaccaagcaacaaacaaaacatctatacagctgccttggaagtcctggtttcaagtccagcaatattgtaaaagggggaaaaaaaaacccatgaccagaccactgttttaatgccatgacacacctctatgcagaatcctcaaaagactcccaatttcctgtccaggaaactcttcaaataccttattcccactgtgcctatctgattgtttgacagctaggtgttgcaaacactggaccttgaaatcccaccacaccacatctactcactccccagcccaactctcccaaaccaaagcctgcccctgatcatcccttccatgtccttgtacaatctacacatggctgcagtcggtgagatatagttttggttaattaggaaagagtcatcccacacctgaaatgccaaccctcacagatgtccagtggtgcaaattatgacaaccatgttcctaattcaattccctcttgcaagacaacattagtcagaactctaacttgtacaacatcttccatctggacctttagcctttacagacacattcagatactgctgtcagtcacatttaagtgtatacatttatatctgctcattccctctcctagatcactcatttttcagacctctcccactgcagccttccttcaaaaactaacagacaacacagaaataaatgcaatgtacagtttaatttaaggttaaagagaggtataagagttgaaaaggcctagaagctgtttctttgaatcaccctgaggaaccaggcaccccacagtcccagtcttagacctcaggagaatgaacttaccctccacatgggtttgctctagcagatgcccatagaacgcaaatggggaagatggagggcattcagacctgattgacttggatggttgcagtaggctaaaatgacagagctctatcacaggtttgtcattattgtggacaaaaaaaacacaattatttaacctttaacctctcaaacttgtttcctcatccataaaatagataagatctatctcccatctgcctcacaggatgttttcaggaaccactcactgagaggaattttgtgaaaacagtctagaaactgttaaaagcaggatacagagtaatttctgtgaccaagatcccagttgctacttgccttgcctcctcacatacaacagggggaccaccagctcataagtgactggaaaagaaagaagtgcctatgttcagagctcccagggcttcctaaggccttaccctcctcttcttcactgcttcctgtaggccatctggcagtttggagcggctggccaacttgtcactggttgtggccatggtaaggagaatgcgtagcccagaaacaaggtcttgttgagaggcaaaggccctctctgctcttccaggcagagggttcaccggtgttgtctccactctcacaggggctcacaaactctcctgccccactgcacctgggaaggacaggggcacagttactagagggatacacaccattgcctcagcaaagccttaacaccaaaaggccccagcaccaagcatgacctgatgggcaggcactgtccgatgaacttatctgagccagaaaccaaagaccattccaatggccaaccattctaaatggcgacagcctaggataaaatttacaacaaagagaaatttacatatttaaattttacacagcatgataatgtatacagtgttttcataaatgaaaattaaccaagtattgttttcatataccacaccaaatacttctgaggtcatctgaagaaagaggtggttctaatacaaagaaatataggtgagagtgaaaaatgtttggaaatcttcagcccactttctctgtcccgtgctctgtttcccccagggtatgagatattttgaagcagcctttggaaaaaaaaaaaaacccaacattttttattatcaagaaatgccccttgtagatagatcctcccaccccatcactgaccgtaccagaatggtgcagagaatacttggtaataaagtgtttttacacatagatggtgccactcaaaatagcctgcctcaactgaattagttttcaacacctgggtaagtaagtgaaccagcagccagaacacccatgccaagagtgcccccaataagtccttgagaaaaaaaacagatactgacctggagaagctgaatcgtaggttcattaggaggctaagatgacagacaggtcatcatgcctccctaaaataaaaccaggagcaagaaaacagtctcagaggcaatatgacgtttatgaacgaggctggaattagaagtgaagaccaccaaagtttgaatcctggcttacttttcatcttgggaaagttagccaacttttctgtgcctcaaagtcttcaactggaaaactcctctagcacctatacttcataaggattgtatgtgaggtattatgtgtgaagtactgagtgtatgcctcatacagtaaatattcaatgaactattgtttttaaataccctgaaacacagcgcagttgggtagataaggagatgacacaattcaaatacataggaaacaaaagaagctctgtgccaggacaatgtaacaatcaatggagtttcatcagtttgctagcctgagaaagttcaaaagggaatagactgattttacctctgtaatctcctgaacccatagcagctgggcctggtcacagtagggactcaatgaacaacagatggaatgaactcctttcttaattattgaatctagggactggaaaggggttgtttcggggataatggggagagggaagagcatactgaaaatgactttttttttttttgatggagtctcactctgtcacccaggatggagtgccgtggctgatctcggctcactgcaacctctgcctcccaggttcaaatgattctactgcctcagccccggagaagctgggactacaggcatgtgccaccactcatagctactttttttgtattttagtagagatggggttttgccaggttggccaggctggtcttgaactcctgacctcaagtgtcccccaacctcggcctcccaaagtgctgggactacaggtgtgagccaccatgcccagcatgtttcaataggaagtctgagaaagctagagggcctaagcacaagagagaggggagcaaatttccaggaagaagatggtgcaggcaaagagaaattacacctattttgaatctgcttcatttcaatacttctcctttccctcctagaacccacacagtagtcaaagaatggtgtgacaagtcctggccttctttttttttttttttttttctggagaccaagtttcactcttgttcccaggctggagtgcaatggtgcaatttcggctcactgcaacctccgccttcctgggttaagcgattctcccacctcagcctccccagtagctggtattacaggcgcccgccaccacatcagctaattctggccttgctatctacccgcactagagtctgtaggggatgggggaggaggatacagtgagctgtccctgaatatcacctgtgggcttgggcaggaccccgactttatgcaggacagaagggccactgccacatattaagctccatttttccagcagctgaccctgcttctgccatggtctgaaggaagaatgaggcaaaaaggagcacttaccaggttttactgtgcagacttgcgacctcgcttggcaggggaccgttcctcttcagaagtgataagttttctttgcctgagagaactcccatggaggcacgaggactttctgtgatctttcgggtaggggtgtgctgctgctactggaggcagtaggggtggctggggagctgacgttactgcgccgtttcgcttcccttccaccaaattgtctatggcaggataagccaaacaggttggtcaaactcttggtatgaggccctgaactccaagaaactgggcagaccctgattcagacaccacagtgtccttcccccacttcccatgaggccaagaagcttctttttaaggccatattttttatctatctttgccatgactgaaatgtgtttagtcccctatagaactgaggaggccagaaaaacctaaggactttctgtttggtactaagaaggaaacaggtaaggcagcagctctagaaaatgcagctcatccaccatctgagaagccacacataggaataataaaagttagggaaacattatgacaggtccagaatctcctcccactgtaagcagaacaggagcccaaaagcagctgttcggaagcaaaagtcttacctaagctgatatctgctgcctttgtaagaggtgttactgcttataggggccaagcccatactgctctctcagtctgtttccttgctccaaggacaggatgaagccattcgcttataccactttctttggccttctttttcaatgctgtagtacagttcccagactccttcctatgtcctttcaccactcctggggggtggaaagcataaaagaagcttgtgttgtcttaggctccttagcaccctctcacaagggctctgtaaagcaggcctgagttaggaatttagagatccaacagtggactgaagttaggacttaacaaaattccagttgtcaacccaaacagtaacacttaggatatatgtagctactacactgggattaggacaaggaaagttcttgacagaaggtagcctttagttataaaataaagcttcccaaagacagccattgtgattgctggtggttcaaatgatttccgtgaagtgaaatggcatgtggtttcctaacaattcattataacttctaaacatttccttcttggttccctgggaggctgagtagtaagtcttggttaagctgtaggtgaaaaatgacatcattctaagagagacagcatgtgtgtgttttcttctgtgtgtgtagcaaaattagagagcaaagaaaggaaaaaacagatcctgcctctcctcctaatcttcctctctattatctactttcctgctctgattcaaaacctgataaggccttatgttaaaaggaacaaaatgtgggatgtaaaaggaaactaagctataattcaggagaacgagcctaggcctaattctgctgccaccaagctgtgtgatcttgggcaggacccattactagcctgtgaaaaagaacacttcttcctatcaatgaataaacaatttacaacacacacactactatagctatagatacacacccccccacccccacacacatatacaatacaaaaacaagcattactatgaatattttttcattcctataaacagaagggtccaatttcttctcacccttagcctatgcttgaatgaagagctaaaagaaacccagagcctaccccacccaaggaaataacacagagaaagcaagccttggttctctatctatcctgtggaatcactcccttttccttacttgttcatctcctagcttaaatctctatccccaaactaagtcacaaagactccctaaaaacacaaagaagcccaaggccaacaatatacttcacactaatgaagagctactagactagaagtagtctagtgttgacatgagcaaacagcctcaagaaatgggacacagaatcccacaccttgatgccacagttcactcttgttacagaactccgtctttaaaaggccaaatagaacccctaagagtagctttacacctgaaagaagaacgaatgcatttgatacatacaaatatgagtcacaataaaagaccccaatccatgtgctactcccaactgatcccatatatagtaacaatgttatccagaactagaaggtgaagtggcccatttaataatgaacaaagggcaacaacaattactcagaggattccaaatacaagagaagcctggatggactccaacagaaaccatttttccagccgggagcagtggctcactactgtaatcccagcactttgggaggctgggcgggtggatggcttgaggtcaggaattcaagaccagcctgaccaagatggcaaagcctgtctctactaaaaatacaaagattaaccaggtgttgtggcatgcacctgtaatcccagtacttgggaggctgaggcaagagaatcacttgaacaccagaggcggaggttgcagtgagcaagatcgtgccattgcactccagcctgggcgacagagcaaggctctgtttttaaaaaaaaaaaaaaaaaaaaaaaatccattttttggctgggcatggtggctcacgtctgtaatccagcactttgggaggctgaggcaggcagataagttgaggttgggagttcgagaccagcctgccaatgtggcgaaaccccatctctacgaaaaacacaaaaaaaaattagccaggtgtggggtgcgtgcctgtaaacccagctactcgggaggctgaggcacgagaaacacttgaacccggaggcagaggttgcagtgagccaagatcacgccactcactgcactccagcctaggaggagagtgaaactgtgtctcaaaaaaaaaaaaaaagatagaaagaaagccattttcccccatatatgccaatccatgttcaaaaagtcctcagaaagatgtttttaaatgacaaactcaaacaaataggtatcttcaaattatttccatagaaaggagacaatatattcaaagaactagacatgaaacaataacaacaagcataaccacaagcataaacctctcactatcaccaatatacctacttcaaaaataaaaaggcactgttcttcaaaccagagaataagtggtagatgtgagtcatacagacacagcactaaaaacttctccctaagcaaaaatatctcaatatcacctctgggttccaatcaaagcaggtagctaagctttaaaaaagaagagagtatggaaagggaaaacactaactttagagaaggccacctgtccctctcttgcagtggctcacgcctgcaaaccagcattttgggaggccaaggcaggtagatcacctgagctcaggagtttgagaccagctggccaatatggcgaaatgccatccccactaaaaatacaaaaattagccgggtctggtgggcacacctgtaatcctagctactcaggagactgaggcaggagactcacttgtacccggagctagaggttgcagtgagcctagattgcgccactgcactctagcctgggaaacagagtagtgagactgtttcaaaaaaaagtgaagaaatctggcaaatacaaccttaaccagtgataagattaacatcctgcatcagtgatgtcatgtggatacatcacaaaccttcccaggtcctatatgataacatgagaagggcatttcacctctgtggcatatttttttttaagagacaggtctcactgtttcccaggctggagtgcagtgtcatgatcatagctcactgtggactcaactcctgagcttaagcaatccgcctgcctcatcctcctgagtagctacgacaacaagcattgcccccatgcccagctaatttatgttccttttttttttttttttttttttttttttgaagacagggtctcactatgtttcagcctggtctcaaactcctgacctcaagtgatcccccgctttggcctcccaaagtgctggaattacaggcatgagctaccacacccacccatctattggcattatttttaaaatatcccataactccagtctaatgagaaaatattagacaaatcaaatggagggacattccacaaaatacctgaccaggactccccaaaactgtcaaggtcataaaaacaaaagactgagaaattgccacaaatcagagcagaccaaagggtatgtgatgacaaatgcaatgttggatgctggaagagaaaaaggacatgatggaaaagctagtgaaatccaataaagtctaaagttttgtgaatagtaatacaccaaggttggatttttagttttgacaacgtcccatactaacaccagatgtcaacaatagggaaagctggatgaggggtatacaggactctctgtactagcagtactttgtacttcgcaaattttctgtaaatcatctaaaatatccaaaataagtttattcaaaaacaaatgaacaaacagaaaagtcagtggcaagagtaacaattttgtaggaatgaaatttctgactttagagacactggaaaagtaccaagtaatgtctggtaactactaacataacagagtattattgccccaaggcacaaaaaaatctctacaaatctgcttctttcattacctgcactgaaatactcatcctccgagagggccgtcacttcaggtccagcgggatggggtcacataacagaatgtctttgcccaacacatcacattcgtaccatcatcaaagagcaatttatacttcccagctccgacatctcgtgtgattttcccagagtaaagtagccattggatgaccacttggctacaacacggagccctacaaagctatttcctgagaggaggcatctaagccatcagaagggccagcagcagcctggaaaggaatttctggaggtcactacgacgcaaagcaccagcacccacatctgttcgtctggtggagtctggcactcgggcacgacacggctgaaggatttatcatctggtgacaagttaggtgaaatgtcctctagcccaaggggccaggcacagctgtttctctaaagagagataggggataggagaagccgggagaacaagaacacagaagtatatatctaccaatttttccactcctttgtccatgggtccctcagcccattctttaaaaaccccatcacaggcatgagcctggtctctctgtggcctcctctgatccctgcccactccccagtcagtatggcccctcttctccctcctgacaccccaaaactctctactcccctctcctccattcccttgttttctgaacaacagactaagtatatttacactacccaggtacctggttccagtggtccgagaaggtgggcggccccttcgcccagcccacgaggcgtgactggagccttccctccctgtctgatgccaaggcctgcatcaccacctcctcacacactggcgtccctgtctgactgaccccttttctaggactagagaatgaaacaagttagtctgatagcacctgctactgaatcttttcttcacaaagtctccccttggcctcagactacatgacaggcctacatgtgctgagcctttggggcagcaggaagctggttccacacccaccaccaaaatctcatgcagggagtggggagcgtgggataacaagtaaaggaattctccttcatgtaagtctattccctctgacaaagcttcctactgctgctgcaaaaacgcacacccaatttctgctatgccttctcctctactttaggctctggacacctgcaaagataacaaaaagctaggagatgcattaagtttgggctactatcccaaacttcctgtactccaactaaatcatataaaggctgtggtagaagcagtgcccaccagatgataaattcccgaagtcccctcccctgttacctacattttctcaggggctgctttgccaatgaagtctacctgcacagggctccaccctacttcccacacaaacccaaaacaggaagagagcaaatagtgaaaggggtagttgatttatctttaatggaggatgggggatttcccattactccccttttccgtgatattaaaatgtcagcaaccctgcccctgctgtggctctctctctctggagacccttctgcacctcagttttcctgggcctcctcgggagctgggtaaggcaaaatctgcgggtttgtcccgctggttttccctctgagtggtccggctcctttccctgagcttccactgctgtcatagctgagagacttgtcccacttgatgtgcggtgtaagctggatgccttggaggagaggagctgatatcccccaggtcacctgaggagcccccagtctgtgaaggggaaacttcagttcacactcctgacactctacaattggctcttcagtctcctgcaaggaaaaaatagataagaagataaaagatgccataataacacaatgctaatatgatggttggaaaatcctacagtggcacaaaattataattcaaaaaggtgagaatcaggagactttctggaataatgggaagttctgtatctgttttgagtagtggttagataaaattttcaaaagccactgaactgaactttaggatctgttcttttttttttctcccccaggtgattctgagaagaattgttcattcaatgggactatactgtatctcaataaaatataaaataaacatggtactatattggtaagaagagtttatctttttattggataagttcacaacctctggctaccagcaaagattctaactagacgacagaagtaaattcttatctgagagaagacagggaaggaggtaggcaggtgaaggagaaaatgagtggtcaggagcccttctaggtacttcattaacagtggacagcattaatgttttgacattggttattttacattacctttcaataactgatcaaggcaatagaaaatatatgcaaaaataggctaaaaggggtcaggtgtggtggctcacgcctgtaatcccagcctttgggaggccaaggcagaaggactgcttgagtccaggagcttgagaccaccttaggcacatagtgagaacaggtctccatatgaaaataaaactattagccaggcgtgggagtgcaacctgtagtcccagctacttgggaggctgaggtgggaggatcacttgagcttggaagtcaggctgcagtgagccgggatcatgccactgtactccagcctaggtgatagcatgagacctgtctcaacaacaacaacaacaaaaaaggctaaaatagtattaccatttggaaaaatgaggacaaaaaggttataagtatctatagactacaagaaagtcaaactggctttatctcggtgcctactttgataaattggtagtagctgcctggtgctcagttttaagaagccttctggggctaaatcccagacttagtgggaaaagattctaagaccaatcagcaatgttcgctatggcacagcatagagaaattatagcatgagtatgacacatctgccttcctagtctagaatgtcacgcaatattatgttaattgccagagaggatatggagatgtataagatagatccttcctcaaagagtttagaattccttttgggaggccaggcatggtggctcacgcctgtaatccagcactttgggaggcagaggcaggtggatcacttgaggtcaggagttcaagaccagtctgccatcatggtgaaaccccgtctctactaacacaaaaaaaatagccgggcatggtggtgactcctgtactcccaggtactcgaaaagctgaggcagaagaatcacatgtgaacctggggatggagctgcagtgagctaagattgtgccactgcactccagcctggacaacagagtgaactccacctcaaaaaaaaaaaaaaatccccatggggagactgtatataatgacacacatcatatacatttagataatactataaaatgatgaaataattatctctgatccctcccttctgaaaatctctcctcctttaaaatccataaaagtacttttctctttctttcagtctaccttttggctacttctatttatgcttctttgggttcctctttctctgtgtgttcctttaaatcggtatttcccaggactctgtttttattccttttctcactctcacatgctttccctggcagtctcaccacactcatccttacctcgctaccaagaatacaatgatgactcagcttatcaaatttctactagtcttccccttggatttaccacaaacacctgaaattcaacagatccaaacaatctgtgatcttccctccatttctctgccttcaatgaataaatcctagatatcccagtgcatctcacatctcctacagctctttctagcagagactggtttctttcagccgaactccattcaagaattttgagatgagatacctccttgctccccactgccatttacagacctttctatttccccacctcctctccttcaaaaccactatttgccactttcttaaaactatttcaccccttccctagttgttatccactaacattctccaaatcaccctctctcatgcataagaccttagcttcataacctctctaccttccccattcctacttctgtcatcattctcatggcctattttaactagatacacttgtgttttcacatctgcaaaatgagaataataactgatctatcacagaatagttgttaagaattaaataattcactaaagtgcttagaataatgctggcacatagtatgtgctcaataaacgctagtcactatcattatttaagtttagtagtcttcccaaactatcttccatagggaaaaaacaggtattactttaaaaaatgctaatggtatgtaagtttgggaagtgctgggttaaacagaataaaataggtatccttactagaggactcttagaacttttaatatggtaatatgtgaattttcatgttagtggggacagggattaaggcgtgctatggtttgaacgtctgcccctccaaaacacatgttgaaatttaatacccaagtaacagtaccaagaagtaagacctttaagaggtgattgagtcataagggctctgccctatgaatggattagttcattcatggattaacggaattacgagctaacagattaatgagtttcacaggagtgggttagttatcaccagagtgggtctgttataaaaactaatttggttctttttgtaaggcccctggcaatgtgataccctgtgttgcctcgggactcttcagagtccctccagcaagaaggccctcaccagatgtagccccttgaccttggacttcccagcctcctaactaagaaataaatttcttttatttataaattatccagtctcaggtgtttaaatatagcacagaaaacagactaagagagcgtttcatgtttctcaggaccatggaaccttttccctcatcaaactgtctaagaggcctgctgtttccagaaatatactttagaaagcaccatataaatactaaatgggcctagcagcacagtagctcatgcctgtaatcccattgccttgggaggcaaggcaggaagatcacttgagaacagagttcaagaccagtctgggcaacacagtgaaacccatctctacaaaagatacaaaaattagcagatgtggtagcgtgtgcctatggtcccactactcagaaggctgaggtgggaggctcccttgagccaggaggtcaaggctgcagtgagtgtgatcataccactgcactccagcctgggcaaaagagcgagaccctgtctccaaacataaaataaaaaatatattttaagaaatgaagtaatgtgtttaacacttaatgtagtgtacaggcacagagtttaatgtggactacaacagttacaaaaattttcatgaaggcaaactgctttcataatttctccaaaatagtaataacatgaaaaaagttccacgaacaaaaatcttttaaaacatttttaatcgggaggctgaggcaggcggatcacgaggtcaggagatcgagacatcctggctaacacggtgaaaccctgtctctactaaaaatacaaaaaattagccgggcgggtggcgggcacctgtagtcccagctacttgggaggctgaggcaggagaatggcgtgaaccaggaggcggagcttgcagtgagccgaggtagcgccactgcaccccagcctgggccaagagcgagactccgtctcaaaaaaaaaaaaacaaaaaatatttttaaaatgaagataaagagtattttaaaagaattatttctggtatttggtatacacaaagaataaaaaacaggccggcgcagtggctcacgcctgtaatcccagcactttgggaggccaaggcagatcacttgagtcaggagtttgagaccagcctggccaacatggtgaaatcccatctctactacaaacacaaaattagctgggcatggtggcacacacctataatcccagctactcaggaggctgaggcagagaatcgcttgaacccaggagacagaggctccagaaggccaagatcaggccactgcacccaacctgggcaacagagtgagactctgtgtcaaaaaaaaaaaaaaaaaaaaaggaataaaaacaattactcaatgagtgtctgtaaaaccaatgaaatctgaataatctgtggatagaaaacaaacaacaattcctcaaactaacatcaaatgttatctgacatgagggccacaatgcccactgaaaaatagtaataatatgttctatttaataaaactatacactagagtttaatctccctgagtacaacctcctacacggccagcagatagaattaaaggaaagtatctgggaaaggaagaaaacagttgtgccttgccgggcgcggtggctcacacctccaatcccagcatttgggaggccgaggcctgagcacaaggtcaggagttcaagaccagcctggccaagatgtgaaaccccgtctctactagaaatacaaaaaaaaaaaaaaattagccaggcacggtggcggtgcctgcaatcccagcgacttgggaggccgagccaggaaaatcacttgaaccaggaagcggaggttgcagtgagctgagattgcaccactgcactctagcctgggcaacagagcaaactctgcctcaaaaaaaaaaaaaaaaaaagaaaatagctgtgcctcttaccaaccaataaatggttcccagatcttaacatataccaacaaaggtcccagatctttaattctagaaaactgtctaatctctctcattattagatgtaaacaaagtcagcatagtatgccattcaagaaacaaacagtcactaaatgccaatactgagctgacatttgtaatgagtctataatgaatccactaaaaaataaaggtgcatttcttaccaacaggtctatgaccacacacagatagtgcaaataaagaacagaatgagtagacatgaaaatatgtgagaaaacacaggtagtttgaacggagtgttctaaactccatttgagtttctaaggatttaaaataatacatacaatcttttacatgagagagatttatcagtctgttctttacagaaaaggaaagcatgatgggatgcataaataactaaccaatggtcaaacagcaaacctatggctggggaaagctttagaaagcagaagtctaacttctaaccctgttcttctatctctggtaataaaaagatgaagaaaaacaagtgttgcacaggaaagcgggatggggtagaaagtcaagagaatttttctatagaaagaatgtggggtcagggacaatagctcatgcctgtaatcccagcactttgggaggccaaagcgaaggatcacttaagcctaggagttcaagatcagcctgggcaacacagtgggaccttgtcatccaaaaaataaacaaaattagccaggcttggtggttcatgcctgtagaaccaactgaagggaggctgaggcagaaggatcacttgagcctgggaggcagaggctgcagtgaaacaaatcacgcaactgcattccagcctaggtaacaaagtaagaccctgtctccaaaaaaaaaaaaaaagaaagaaagaaatttgccacacagactcagagtatgtattacctcagttactttctttctacttctgttccatccacataatacacatctgtaatgacacgagtgacaagtggcgtacttcccggattgttctcatgtgacgatgtaagacatggccatgtggaggctgagcatatcaaactcttcttctccctgtgacagaaaatacagaacataagcacaggtctcacgcaagctgtcaaaatcacaaatcttatgcttcatgatgagaactgtttagaggctccataatctagtgtgacagaatcttcctactgttttgttttatccacctataggtaagaccaggatggatgagttatatagccagaggctaagagaagtttatatgagcatgacctaataaatgacctattcttgtctaaatcaaaatcattacatctagtacttgtatttacggacatttggtgaacctttgacccctaaaagttcattatttttaaaccgtatttcttctaattctgagctatcttgcaaattagtaaacgagtttacatttgcaatagctctttagataaaaggaagcactctttagtcctttatataaaaccagaatgatgtatctgttaatctcagtttatcttttttcctgtattaaagtgaaaaccacagtttattacctaaaacaatatacactgatcttcctagaattaaatataaaatatttcatctattccaaagaacagattatgactaaagagtgagctagtgtccagaaatggaaaaattagcaaattaagattttatatctagttctactcaagaataatgtagggctaaataagaccctactttttatgataactattaaataatattcttaggaggattgagcttctttcattcaaaaaacattaagcaaatatttatcgaataactaagggtgccaggtactatactagacaaataactgctggaaaattcaggacaggtaaaatcattcaacactgaaaaaattcaaatgcactatttcttatttacaaaaatacaacaaacaataacaactactgctattcaaaagaataactgagttaactaacatagcatccagcttcttatttcttgttcataattttctatttacagacagcccgagttcatattttagtcagattgaataatttttaaaagataacttcttagcaaattaggtcttaaagccctatttaccactcgaatcattagttagtttgagactttcggcctttattacctaggacctgcctgtggctaaaaaaagtgctagaatttcagtcctgcatttctgaaaaaatacatgttttctaataacactatatcacattttttcacatctttatcctccctcctacaccccactaactccgtaatctgaagagaaaatgcacacttttgtctctcaccttatctcccctatggtaggctgatttactttcagcattcagtatcaaagtagccaagtctttaaaaagaattacatatacaaatgaataatggtaattctgcatttttttcctgacatgtggtagtaatttaccaaaagctttcgtaatttctccgaataatccccactccaattccaacttggaaactggcagaggtgaaattttactaaaatggagatatgtaaattatgtgactagttataaataatatcaaaggcatgaacgctactcatccaattatttaaaatacttctacatacttctacacagacacaactcttctaatgaatggttaaagcacaggtctgtcctacctcaatcatcagggtacccatgcatagaactatgacagcctgtacttcctgcctgcacacacaatcagactattccccactaaaagaaagtcagtctaaaaggtttcagtgctttacatattcctgaaatgcagccaagaagctccctgtattcttccagttacaacagccatatgaatgatcacttcaagacagacacttagcgtgtctgagagaataaggagaaaaggtaaagagggcagacagaaaactatgtttactacttcaaatactcttctgaaaagaggtgtctgtaaaataaataaattgatgatcttaccccattaagggaaggaaacaaaatgaaaataaaaccacactttcccttccacctggttcccgtcctttttgacatataaatgaaaatttcaggagtgtcaaagtaggctgcctatgctttccactagcactagcctatgtcctatctacactgaaggggatttttaaaaagcaccgaccctggaaaacttgcatacagcctttctcatttgctaacctctcttcaaaagatggcacacaatttcaatttctgttattctatacaccatctatatatttttactatggtaaaatctgataacataaaatatatcattgtcttgaacacaatgctcatatcccatatgtgccacagggttcaataaataagaactgtattttatttttacaaaacaaacaacttggacaatcaaaagagaggtatatcaataatgaagatttcctaagtagatcccaaatgaagataatctaccaagcaactgaaaaagcaatttgaccactacaatatctcctttatctgagggagatatgtgcaagacccccagtggatgcctgaaactgcagataatatcaaaccctatacactatgtttttcctatacatacagacctataatgtttataaatcaggcacagaaagattaataactaaaataagataaactataacaatatactgttcacaatttcatggatagatttgttcttacccagattttagtaacttcagcatatgattttttttctttccttattaagaccttttacctttcacttagaggaagcactttatgacttacttctctggcatattcagattgccggcatcctactctcaaactttggggtgagagtaaaacaagggttacttgaatgcaagcaatgcaaaccatgagagttgatctgataaccaagacagctactaagtcattaacaggcagggagcaatatagcatatggatatgctagaaaaagggaggattcatatcctagccaggactaagaggacagcactttatcacattactcagaacagcacagtatttaaaccttagtatttctagattttccatttagtatttctggactgcagctgaccatgggcaactaaaaccaccaagaaaagaaaccactgataagcagagactactgtttactagtaacttccaaattttctctgccaagatcccactctgccactcaatgaaatgttgtgaacttctacgtatttgttaacacataatttctacgacttcttttcatctactcaattttttttttaagagacaaggtctcactatttgcccagtctagtctcaaactcctgggctcaagtaatcctcccacctgagcctccaaagcgctgggatttcaggcatgtgccaccaggcacagccacctacttaatttttactagtacgacacttccctactctattccctggaacctgatactcctccagcctcgttttcatcagcccaatccttttcttcacattagcttctagtctagcctctcttctgcagttcttggtcactggggacttttccccatctctctctctattcctgttaccattctttctgtttcatatatgaaatacactattcttcgtgctgcttctttcccccttaccttctactctctgaattccgagaaccatgatgaaatagacttaagggagagaaaattagatctgatggttagaaggcagataaaaagtatggagaaggaaaagagtgaatgtagaagagtattacaggacccaggcaaatctctggctttcttctccagtaaagacctacctaaaaaactgtagcaatactacatttccctaaaagactatctaatggctatagctacccacaatttcactaccatatctgtatctagaaaagttgtttttgtcttttaaccactgttctgtacaaaactgtcaagaattgtcataggcagacatgccacaacttaaattctctgagaatcctgaaagttaaaaacaaggccttgatgcaccctagtatgttctctcacctggctatggagcgactctgtatcatccccagggcactgactggtttctcaccactccccctctcagtctgaactgtggcatcttgctttccaagttctggtccactgtactggtcccctgctcacacacattctttatagtctgggttgcgctgaaacagtttctgggaccctcaaggaacactccatggtttggattcctatgttatttggctgggcctttcaatcaaggccttactaggattttccttattagtactccgtccttcttctggtcttctagcacatctgtcaccattgcctctccttgaggactggatggcccttgatgaccatcttctgggaagcaggagaaacagggtccttgacaggactaatgggcttcatggctgttgactctgcctgattgtatggtcaccctccaatttttctttctcctcttctcctgagaacttggaaagtggagcaagttccccctgaaaatgcaacatataaagaagccatgcaattaagcaagtgtatgtgtgaacgtgtgtgtgtgcgtgtgcatgtgtgtgtgtagtgcaaggggggagccatattttgacaatttgagaaatgtaaggaagggagaaagtcaggtatcaagcattatcaccttgggaggcctctcattataatttcactcctgtaaaaaaaataaggtagatagaacaattccaccatgatgataaaagagtcataaaatttcttcccatcactgctatgaactctgaaacttgatgcaggaaaatgaagtaaacaaaaagatgtaaacccatactgaagtcatagacaatgaagggcaacttagggatctattttgaaaaaagatcaattagtcaagatgtcttatctggccttatgatggttctaacattccttaactgattcctagcatctagatactgtttatccccacctgagcaatatttttaggaaagaaaatctgacttacaaggataaagctgtaggtagattctagttttgtcagctatactgatatatctacaactaacatttcagaatgaattggtttctcaaagacagttcttaagatacagcccattttttttctaagtcatcccatttgggtatcagtgattcgttcctttattccacaagcatttgctgaagtctcctacaaaccacataccacgatttccgaagtgactaggagctttcttaaatatcctaacaattctccagaataaaaacgtccaggctaactccaagtcaacagaaatttgacatcatgtcttatctatctttatatttaaaacacctaactcacagcttaatataaaatagatcttaatacatgtactttgaacagaagactgaatgttctctgaatcaattaattgcaaaactactcagattaaatcaacataatgcagttttaggctccattacacgcacaatagccagataaaaataaaaggaatccattctgaactgaccatgctaagaccacatctggaatatcttttcagttctcggcatgacagtttacaaggcataaactgtagataaactcagaaggtaaatgaaggacgataaggggcctagaaactatgtcatatgttgatttaagtatgtggccagaaaagagttagggctgtctcctatttgacagaagctcttatccttaggatctcagctttctacgtagacagggtaaaggaagcaggaagtgctcttcagggattgctctgctctagatttgaaggaaaaggaaaaaagaagtttctgaggtttctatattgtttagctcagcctaccgaacaggagctcaaagagggatttcaaatagagttctagccaagaagagcttagtataatttggttgttatagtgtgtgtcctatctctcaggaacctcaactgaatgagaatatatgtccaatgaagaagaagtaagaacaagaccaccaggagacacctaccatgagtagcacttcctcttatgaggtttataaatgttcatatatgtaaaatattgagcatagcagatgctcatcaatattagatgcataagacaatgcaattaaacagactcagttcaccttcaatatcaataaatattcatatttaaatctttaagacatctaacataccaatggctgagcaagaaggaaggattcaaaagccagaagagccaggactcgattttaggaattcaattattgttgtttctatcctaaacaagcttataaattttatctcatgctacagactaaatgtctatgtcccctcaccccaagacttacattaaatcctaaccaccaaggtgatggtattaagaggcagagcctcatgaatagggttagtgcccttataaaagagacctcagagagctctcttgcccccaacgccatgtgagaacagctgtctacaaaccaggaagcaggccctcaccagacaccaaatctccagtgctttgatctagaacttctcagcctccagaaatgagagaaataaattcttttgttataagctatctagcctatggcagtttgttgcagcagcccaaagagactaagacacctcgaagctgtttattcaggttagaatacctgaattgaattttacttctacagcaatccaataattgtaagaagtgccatacctctctccctctccattagttccagctatgcaattctacctggtcactatatgccagacttagaaactgatgctaagaaagtaaattttaggctgggccagtggctcacaccagtaatcccagcactttgggaagccaagacgggtggatcacctgagtgaggagttcgagacctgcctggccaacacggcaaaaccccgtctctactaaaaatacaaaaaaatagccatgtgtggtggcatacacctgtagtcccagctacttgggaggctgagcaggagaatccctcgaacctgggaggtggaggttgcagtgagccaagatcgccctactgacttccagcctgggtgacacacagaccaagaccccatctcaaaaaaaaaaaaaaaaaaaaaaaatccaaattgaaatagggaagaatacatctccatatttaacaaatgtctaactatctattctgagtgtagctctgtttatgaggcatctagaatcaaatccagctagattcccaatctttgctccaccaaggttaaacaatataaccaacatcttggcacctctattttaaaagctttaataaaaaagcaaggcaatacaatgacatcaataaatttagtaatagctgggtcttactacaccactgttaaaatcacatgatttcaggatcatctgattcccaagaatatcacaagctcacacttattcagaatgcccatttaatgcactgacatatttattttaaatattctttcaataatgagcatagaaatttagaaattatgctacctattaatttttttttttttatggataagacataactctcactctctcgccaggctgtagtgcagtggcaccatcttggtcactgcaacctcctcctccagggttcaagtgattctcatgccttagcctccagagtagtgagactacaagcgtggacgaccctgcctggctaatttttgtatttttagtagagacaggttttaccatgttggccaggctggtcactaactcctggcctcaagtggtcacccctcctagcctctcaaagtgctgggattacaggtgtgagccaccccatccagtcttttttttttttttagacagagtctggctttgtcgcccaggctggagtacagtggcacaatctcggctcatataacctccacctcctgggctcgagccattctcccacctcagcatcccaagtagctggactacagggatgcaccaccacacctggctaattttgtactttttgtagagacgaagtttaccatgatgcccaggctggtctccaactccagagctcaggccatccacccacctcggtcaccaaagtgccaccgcgcctggctaaatcatgctacttatatcactgttactgatatactactgacaaaacattatcacattgtctaattacgaaatcactgaattttagaggtgaaaatactcacttcataatgaaaatacaggtccttttccactgccattacttatttctctacctaaatataagtatcatatattccatataagatactatttatttatttatttattattatttttaagacatggtctcactctgttccccaggctaaagtgcagtggcgagaccacagcccctgcagcctcgaccacccaggttcaaccaatcatcccacttcagtcttccaagtagcgggaccacaagcgcatgccaccacatccggcttttttttttttcttttttttcttggtaaaatagggtctcactatgtcacccaggctcatctcaaactcctggcctcaagtaatcctatgctttggcctccaagtgctgggattacaggcgtgagccaccgtggccagccgcttcctaattatttaaatagagataaaggcctgtaactcaaaacttttttcctgcctcacgactttctaagagattatggagtaaagaaattatggggctaagcacagttgctcatatctgtattctagcacgttgggaagatgaggcaggaggatcacttgagcccaggcgtctgagaccacctgggcaacacagttgaaaaaaaagttgaaaaaaaaaaaaattagccagacacggcagacatgcctgtagtcctagccactcagggggttcaggcaggaggattgcttgagcctaggatttggggctgccgtgagctattactgcaccactgcacctcagcctgggtgacagagtggaccctgtctctaaaaagaaaaagaaattatggaaaaattaattccattaagtctgaaaactttaaatttgggatgttaaacatctcatattttgctctgtgggaaactaaggagaaaaaaaagtctgttaaaagtaaacatgattcccaaaataagaaaaactaatctaagaaatgggaattatataaattattttcaccgtagggcacggtggctcacacttgtattcctaacattctggacgccaaggtgggaggactgcttgatcccaagagtttgaaaccagactggacacacagtgagaagccatctctacaaagaatagaaaaattagccggtatggtggcgcatgctgtggtcctagctacttgggaggctgaagcccaagaggtaaaggcttcagtgagccatgtcacgccacttcactccagcctgggtgacagagtgagaccctatctcaaaataaattaaaaatacatttatgaagtcagtcatttcaaattgatacaactggcagataaagacaaaaagtgtatctataaaatatttaacaaaatttctcatgacagctcatcaatctatccagaatcactatagtccctcaaggtataaaaaaataaggtaagctcaagctcacaaaacagtagcgtacatcttagtctgttttctgctgctataacagaattcccaccagactgggaaattgaaaagaaaaagatttacaggatttggctcatggttctgaatgctgaaatgtccaaggacaggcactagcatctagacggccagctggtaagggccttctagctgcatcgtaacacggtgaaagacatcacatggtgagggtgcattcaagaaggtggaaagggggccaaactgcccctcagccttttataattaacccatgctcacggcaacagccttaatgcatacatatgggcaggcccccacgacctaattacctcttttttgtgtatgtgtggtcaacttctgtagctttatccaataccactaattacctctcaacactgttgcactgggggttaagtttccaacacatgcacattcaaaccacagcacagtacatattaggatttgggcactaaccattttgtgaaccatggagcccaaaagattctataaaaataatgcttacctgatgggtgtggtggggggatctcacttcgagcctcattctcttgcctggcttcacagatacagctcaacacagacatggtttctggggactaagacaatatattaaagcaatatattgttaactttgaaaagaaaagtattttggagattatccttttatgcacagaggaaataaaatgctttctctgcatatcaaacccaaaccaccttacaccaaaatgcaaattctccatacttgttttgaattagcataatttaaattctcaaggaagattcactggaaataaggtggacagaggactgtattaaataccataagatgcgatcagcaaaatccagaatgtagaaaaccatacaacaatctgtaccttcaacaataatttgcaagcaagaggcaaaaaaaaaaaaaaaaaaaaaaaaaaaagactggagggtactctgtattttaaaagacttaaagagatataatcaaatgcaatatgcagaccttattagatcttgagtcaaactgtaaaacaccatttatgagacaatcagagaaatctgaacattaatatttcatgatattaaggaaccattgtcaattttttaaagtatgataatagtaatacgttaagtttaaaataagaatccttatcttttggagacagcactgaagtatttcagataaattatataatgctgaaattatcttcaaaataattcagtagggaggggggtgctggaaattaaatgaatcaagactggccataagaaatttttggaactgggtgatgaatacatggcagccattatactactctctctactttcgtatatgcttgaaaccttctgtagtaaaatgattagaaataaggtgacagcaagtaatttgaacagagtacagttacaaacaacacttaaaagttcatgtacgctgggcacggtggcttatacctgtaatcctaccactttgggaggccaagcaggtggatcacttgagcttcaggagttagagactagcctgggcaacatgacgaaacccatctctactaaaaacacaaaaattagcccctggtggcaggtgcctgtagtcccagcacctgtggggttgaggcaggaggatcgcttgagcctgggaggtcaaggctgcagtgaactgtattgcaccactgcactgcagcctggttgacaaagtgagaccctgtctcaaacaaacaaaaaaaaatctccacctaaatgcagatgaaccaaggaccacttccaatattgtgacagagctactttagatgatttgttagagtgaacacaatagcaaacaagtcgaatttttttaaattagattcttatatagaaaaatttattcacaacaatatcaaaaatttcatctcattctaggtccaccattccaaccctctgctcaaagtttttccttattttctcctctctactttctacctaagagttctagaagcttcagcaacatactctgttccctctgaatatgcacaagtacaactaataacaacttattcctggccaaaaattctgttaaagccaaatggaccagatacacctccactttcttcagcttctaagactatatatcattaagggatcttcaaatgaaaaaggctctacggtacttatgtttcagattaaatatactaatagcccaatgaggaactaatctcctaagacatagctaagaacagatcaaaagactttgaaaaaggtcagaaactcacaagtgggtcacatttagtccacaggcctcttttatttgatattttatttttaaaaatccagattctttctaaaaacaaagatgtggcaacaagaagtttgcagtttcacatgacaactactggtggagttgagtggggcacaccctttcacatggaccatacattcagtttgccattgtcctaacactctgtcttgcgggcggatcacgaggtcaggagatcgagaccatcctggctaacaggtgaaaccccgtctccactaaaaatacaaaaaaaaaattagccaggcgtggtggctggacctgtagtcccagctacttgggaggctgaggcaggagaatggtgtggacccgggaggcgagcttgcagtgagcggagatcgtgccactgcactccagcctggatgacagagtgagacccgtctcaaaaaaaaaaacaaaaaaaaaacactctgtcttgtacctagccactttagttttaacagtacccgcctagcctctaatttaagaattcttggtggggcatggtagctcacactgtaatcctagcactttgggaagtcaaggcaggtggatcacttgagcccaggagttcaggccagcctgggcaacatagtaaaatcctcatctctacaaaaaatacaaaaattagccaatgaggtggtacatgcctgtagccccagctactcaggtggctgaggcaggaggatagctgaggtcaggatgttgaggtcacagtgagccatgatctcaccaccgcactccagcctgggaacagagcaagattctgtctcaaaaaataaaaaagaaaataaaagaagaattcttgccttgtttcaccaactgctattagcgttttcaggctggatgactcatgcctgaaacaattgtttctcacagccaccagatggcaaagcttaccaaccaaaacctcagtatggggtcatactgtcctcaaagcattacaacatccatgacaaagcaaaaataacagctcaacatagtagttatttggcaggcagaagagaaaatgacctgaggctgcagctgagtatgcgattgcagaagaacaaggtctgtagctatctcttgttaatccttctttttctcatcaattggatcaacaacctgagattgtggagactcttgtatcagcaacagaaaaaaggggggaaaggaactctcaatgaacaaaagtaaagacatttcaattatcttagttctaggtgtagaaaaaagcttcacgaacttaaaaaagtattaactaaaaagtctatgatccattcaaaacattgctaaatccttatgaaagagtctcattttaactttctcattttaacttttttcctttgttgataaaccactaccctcatcaccagtagctgtgtattaaactctaaatagcatccagctttggttaccggcaacagactcagcaacagcagtagatccattttttctttcaccagttgcaggctctgataaaaacaaaaccaaggagagaaaggaaagagaaacagaatttagttagtatcacaccaaaccttcactctgctctactagtatttgcaaaaaataacaaaaagaaataaaaataagaaaactagtaagtataaacatacaaacatttcttgtaattttatttatttatttctttatttgagacagtctcactctatcacccaagctggagggcagtagcgtgatctcagctcacgcaacctccgcctcctgggttcaagcgatctcctgcctcaacctcccgagtagctgggatacaggcatgcgccaccacgtccagctaattttttgtattttttaggaaagacagggtttgccaagtttcccaagctggtctcaaactcctgaaatcaagtgatctgccagatttcttttttttgtttgtttgttttgagacaacagtctcgctctgtcacccaggctgcagtgcagccagatttgttttaatttttttttttttttttttttgagacagagtctcactctgtcgccaggctggagtgcagtggcgcaatctcggctcactgcaagctctgcctcccgggttcacccattctcctgcctcagcctccccagcagctgaaactacaggtgcccgccaccacgcccgctaatttttttgtatttttagtcgagacggggtttcaccgtgttagccaggatggtctaatctcctgacctcgtgatccgcccgcctcggtctcccaaagtgctgggattacaggcagagccactgtgcccggctggctatttcttgtaatttaatggtacaagtttttctcacttcaccaatcaattttctttcaaacttcctataaaagactaataagattggcaagaaatacatacaatgagtaactttttttttttttggagacagagtcttactccgttgcccaggctaagtgcagcggcgtaatctcgacttgctgcaacctgtgtctcctgggttcaagcgattctatgcctcaccctcctgagtagctgggattacaggtgtgcaccaccacacccagctaattttgtatttttagtagagatggggtttcaccatgttgaccaggctggtctcaaacttccgcctcaggtgattcacccgcctcaggttcccaaagtgtgctgggattacacatacgagctcgacacctagcccttagcagtaatattctttttttttttttttttttttttttttggagcagaatctcactctgttgctcaggctggagtgcagtggcatgatctcagctcactgcaactccgcctctcgggttcaagagattctgctgccttagcctcccgagtagctgggattacggtacctgccaccatgtccggctaatttttatatttttagtagagatggggtttcaccacttggccaggctggtctcgaactcctgacctcaggtgatccacccacctcagcctcccaagtgctgggattacaggcatgagccaccacacccggccagcagtaacattcttaaatgaaattaaacttctgaatccaaattcatctctgcccatataagaagttaaaaaagtatgtataatacaaaattaaaaaccaaaaactttttaaaatttatatcatattaaaaacaaattaaaataaaagaacttaataaaataagtagaaaatattttaggttgatgaactaattttaatagtttttagagcacccacaaatagaaggtacccaagttcttcccaaagtgctttaggaagacacttcaaaaacaaagggtggccaggcacggtggctcactcatgtaatcccaatacttgagaggccaaggcaggaggatcgcttgagcccaggagttcaacaccagcctggctaaatggcgaagccccatctctataataaatacaaaaattaaccaggcatgggtggtgggcggcctgtagtcccacctactcagggggctaagatgggaggatcgcttgagcctgggagatgaggctgcagtgagctgagatcaccccattgcactccagcctgggtgacagggagaagcctgtctcaacaacaataacaacaaaaagaaacaaaaaggacattttcaagaacatgcagaacagattaaaggtcgtactgaaaaaaatcccatattctcacaacaatgtcactaatttaagggattaaaatttgttcatttacaatttataccagccttagagaaaacaacccttaatggtttttaattatttctaaaatattcatgacccaacataatctaaacagtccatcaggaggcagctgaaattcagttggagccctggctctgaaatagaaacctggctcacaccctgctattgcacttaatagtccaacctaggagtaaactactttgtcattttgagtctcagtgcctcctctataagataaaaacacaacaaacctaaaaagtttgttgtaaggatgaaatgagtaagtaacactgaatacagtccttgatactatgctcctggtattaggaaaggtagtaaatttactgatataaccatccttaacacttcgctagttgtaatttcagatccaaaggtaagtaagatttaaggctatcacatactctctctcttgacaaaccctttttaaaatttttattttgagatgagatgtcactatgttgcccaggctggtcttgtacttctgggtttaagcaccctcccacctcagcctctggcattgctgggattatagaagcgcaccaaccaccatgcctgcaataagcccttatttattccggaaaagatgatagtaaggatggaaccatgtaatacttaactcagtctactgagttgctaagattcaaatcagtaagtaccacagcatcaaagattggaaccagacttcctggatttgtatcccggctactccatttactagctatgtttagggaggcgctcaaccttcctgtgcctcagtttcctcatctgtaaaaggaggataataataggactagttcatcggcttcttatgagatttaatgagctatacatgtgaagtacctggtatacgtaagagctaaaaatgtattagctaaaattacttttctctggtctcagggaagaagaagcctgcttatccaacctattctgtgtagtcttcaatagcttcccctcccaacttcttcaggccttaattcatcaactgtttcccccaattccctcgtctttaatctatgcctccctctttggatccttccttaacccatttatgctggaggttgcaaatttttttttgtgaaaaatcaaccttggtgatgaccttgagcagcaggatataaataactcccgcaagcttagtgttccatagtggaacactaggcataaatgggttaaaatctgtaaacttgctcaggcctctcccagctaaaataacaaatcctctctcaaccctgcatttccctctaactcaccatattttctctcttctctcacataaacttctcaaaagtagagagtacatttgcagcctcatctcctcttctcatccttcctcaattactttcagtatagctcccaccccaactgctgcactgaaatggccttgctagagtcaccaaatggatcctaattgcctcgccgaagtcaaagtatatttccagcacatcttactaaacttgctcctgtgcctgacatgatcttcttgtaactcccctccccaaggcttccatggcttcatataccctcctagttctccttctctctgaacgttcctttatatctcctttatgagatttcttcctcttctaatcccccttaaacagcttttacaaattaccgaaatgaaaaaattataagcttcagagttaggtctgactcaaattccaactccacctagaccaattattgtgaccttagacatgtaacttaaaaacctctcttactctgttttctcataataaaatgaaaatgcagatacctacttgggagtactattatggaaatgagatcatacatatatgtgaagagtcattctctctttttttcctcccccttacttccatattcacctggcccatcgttctgcctactcgctcctcaaattcatccctcatctccagccccactaccaatacctcactttctggttaaagactgggtagaatttaccaggcaggagaacagaatatgggaatgcaaggaaaggaatcatcatgcacaaaagcacaaggttttgaaagactcagctgatcttttttttaaaggcaaatctgatcatattactcccttgcctaaaattcttcggcttctagcatgatgtaaaaagcctttcagcatctggtccctactttgcatccctcccttgtatctctctttattctagccctaccaaacaacttctaattcatgtgggaaagaatcaacattatctgcaatgtgaatccacagtcctaaagttttctaccctattctgaagtctttctgaatgggaaaccaattacataggaacagacttaacagaaacaagctataatatggagattataaacagagtatctttagtaacatgacaggctggccaaaagcaaagaattaaatctatgaggtaagactttacaaatacatttataaatatagaagtatcaattattataactagattatatcaatactccccagataatctgcagctactaattacccaagattaacataaaacttacttccaggttgaactgcaaagactcttcactcgcctcagtctcaggactaaccagtttcatcttagacataatttatcatccacgtctggggcagccccagaatccccttttccactccaagtatgggatcatgggtctccaccatgctttcagacatgacatcactggttgctatgggctttctggatagttgctaatacctgaaagaagtgaggcagggaggaagaaaaaaagaaactaaaatacaaacacaaaaaacagcaattcaaggtcatcaatttgcctgtttggctcccagctctgcaggattgaaggaggttcctaggatagatccctgtcataagtatcaacaacacgaactagtattgacacctggtcttaagaggagcaacaggattcagttccacttctgctctggacaaaggatgctgcatgagccctcagccaacccacatctgccagcatcaggcatggtagcaggagactccagacggcatgattgttacctcccagcactgactagagaaaacaataggttaatgtagaagactactggctgcttcagggaaggaggatctaagttttcttgcctgtcaagcagcagactgactaattagccaaggtactgaataaatagtacttctaccttcttcctgttccatccttataaaacatctctacatcactacttagcactcagattctactccttgcaagtaataagataaaattcttttaagtattctctttctttcttacttccctccccctttctttccttcctctctttacccctcatctcctagtagtaaaatcacagaaccagcttcataaccctattttccctaaaacaaaaatcaaccttaccagccagacccaactcctagatctaaaatatcacttgtgtagagaatgatatctcagaaattctgccttaaatatcatactttttattcactcaccaataggagtactgtgtctcttgggctccaattttaggtgccaataagaggtggggttgcaccagtcaatggtgggatgatatcaccttctttaggcaaatgaaatgaaatggggtttctgaaaaaaaaaaaaaaaagaaaaaagaaagaaagaaaaaagatttaaaaaaaacagaagtataaaataagcaaaaataataagaactgcaagaaatattcaatcactcttttcctttgctcccaaattctgtctcattgccaccaccctcaccaggcccctgactaactcccttctatcgtctctgctctcttcacagccaacaactatagtactgaacaaagtagacaaccagaggacaggcaaatagagaaagcccgaagtctgcaagacctgagaacctggagtcaaatggaacacaaacatttgatctccaagacagtacatcaggggatattagcaatacaaatttggacagtttcaaatcagaacaacataattttgtgcaatgctaactaaggagtttgtttataagccttaatagtctgtaggattctccaaagcaaagtttgaattaatacttataatgtacaatctaatcaaagagatgacagaggatctcacgggttaaagacttcaagatactgactggttctagcatagaaatccaagggtttcatggttcagcagtaggaccagcattcactctaggcctaagtgtaatgttcatacctaaatctctgcacaacagaaatccctcatatataagcatcaccagtgtacacattttagttattaaattattataaaagaaaatatttgtcaagacataaagctactttctacctaggtctcagttccaaatttttctaatcagaactagaaaaccgtcaaaaaatcacattttctaatttcctaatttatctcttttataaaatgatacatttgggagaaaataagaattgcgccagactgccctcttaaaacaatatatgaaaatttcttcttactttcctgggatggctcaaaataactataatctggcaacttggacactactacttatgaaagtagtttgcttctttcatctttttccactcctatcttaatagcaagcaccgtgataattttttcctttaaaacaaaacaaaacaaaaaaattttttttttttttgagacggagtctggctctgtcgcccaggctggagtgcagtagctcgatccggctcactgccagctccgcctcccgggttcatgccattctcctgcctcagcctcccaatagctgggactacaggcgccctccatcacgcccagctaattttttgtatttttagtagaatggggtttcaagagaaaatgaattagtaatctgaggagataaagagagaaaaagaaatgtctttagaaataaaggattaaagtacatatgctcagctaaagaaactgtaaagaggggcaggtaccatggctcatgcctgtaatcccaacactttgggagacgaaggcggatggatccttgaggtcagaagttcgagaccagcctggccaaaataatgaaaccctgtctccactaaaatacaaaaattagctgggtgtagtggcaggtgcctgtaatcccagctactcaggaggcgaggcaggagaactgcttgaacctgggaggcagaggttgcagtaagccaagatggtgccccgcactacagcctggatgacagagcgagaccgtgcctcaaaaaaacaaaacaaaacaaacaaaaacaaacctgtaaacagtatggatgaagaatctcaacattacatctaactgacaacatccaccatagttacagaaaagagaaatgggtcaggtagataagcattcattctgtgtagccccttataaagcaagttgttctaataaagaacttagaagagatacagaaacttaaaaacaccttgcaaagcctcatatattccagacttctgaaaatgtgcatgaaatctttaacagacctttctatgtgacatactatattacgcaaatgcaatatgcaagcattaatcgctaaaatatatccctgtaacaaggtttcctttgcacagtattacataaaacttatggaaagaattttagcaccatttatctaactgcattactataacctaatggaaaattgagacttttcaggccctagggacagcactgccactactctcctcaggtctccaatgcctcattcctggttattaccatagcctatcaatcacttcctctgcctaaagtctcccactctccctaaccccattctttctgcacactttctgcagccttcctagaaaacatggctttgttagctcctggcaaaaaacttcaaggttttcactagaagacaaattcccaactctatagtcagcattcaataactagtagcagcctatatctccagtttttctttaattattcacgttcataaagcttcattcaatgtcctccaaaggtttcccatttctatgcttttgttccctcatctggaaaacacacacatctactcaaactattgccaaatccttaaaaatacatttgctggtatattttatcttttaaacttacggaattttccacatattccattatttctctaacatttagcaatcctcattctttaaattatcaaatcccttcttgtttttccagataatcatgggctatcatgtttaggtcagcataccaaacaataatgaaggatatgaatgaggaaacaaaaggaaactcaaactaattttgaaaccacctgagtgggagtatgtgtcctttaaggactttagagaataacccaaagcaatatttaaaactctaaatgttaagaaggtctctcctaactttctgttatagtttaaacccatttttcttctttgttcttaaaagaactggttacccctaagaatttattaaagccatctagttaaaaatgtaagaatttatatatccggcgatatcatgcatgaagtctccccaaaagtctgcctctgatattaatagccaattaagatggcattctatcaagtaagcaataaaggttatagctagagcctaaaacacatctagatcccctgatcattattaactatacagactattacttatggatttaaagacttactgaactccttacagtttttcacatcataacccaccaaatatttgttctgtgttgaacaagattgggcttccaagtaccatcttgctttttacaggtttaacaggagctctccatagacagatacttgaagaggtctccaaactgtaacagtgacaagttatctataaatggagacatttaaagtaattctctctctccctctcttactcactctctcttttccttccaactccctctctccccacaccctccccactcagaattctactttgtattgtttgaatgtttttcaaaattaagcatgcattatttatttacttattatttgagacagggtctcgccctgttgcgcaggctaaagtgcagtggtgcaatctcagctactacaacctccgcctcccgagttcaagtgattctcaagcctcagcctcctaagtaacggaattacgcgtgcacgccaccatgcctggccaagcatgtatctttttttaaaatcaataatctattaacaacaaaaaagtgctcttctaatagtagatgaacaaatgcaaaactcaccaattcacacctttcattctgtcttttcagactgaagaaccattactttttttcttttttttttaattattatactttaagttttagggtacatgtgcacaatgtgcaggttagtcaccacgtatacatgtgccatgctggtgtgctgcacccatcaactcgtcatttagcattaggatatctctcaatgttatccctcccccgtccccccaccccacaacagtccccagagtgtgtgttccccttcctgtgtccatgtgttctcattgttctattcccatctatgagtgagaactgcagtgtttggttttttgtccttgcgatagtttactgagaatgatgatttccaatttctccatgtccctacaaaggacacgaactcatcattttttatggctgcatagtattccatgtgtatatgtgccacattttcttaatccagtctatcattgttggacatttgggatggttcaagtctttgctattgtgaatagtgccgcaataaacatacgtctgcatgtgtttttatagagcatgatttatagtcctttgggtatatacccagtaatgggatggctgggtcaaatggttttctagttctagatccctgaggaatcgccacagtgacttccacaatggttgaactagttacagtcccaccaacagtgtaaaagtgaagaaccattactttttagattactatcatttaatttggccaggcccagtggctcatacctgtaatcccggcactttgagaggccaaggcagtggattacttgaggccaggacttcgagaccagcctggccaacatggcaaaaccctgtcctactaaaaatacaaaaattagccaggcatggtgacatgtgcctataattccagctactaggaggctgaggcacaagaatcacttgaacctgggaggcggaggttgcagtgagccgagtcatgtcactgcactccagcctgggcgacagagcaagactctgttccaaaaaaataaaataaaattagtctctcaacatttagcaactaaacaactatatttttaagtacaaaataattttttctgttctttttgcaacgctcttctgaatgatttattttatacaattttctaagtaaaaactattgttctcggctgagcacggtggctcatacctgtaatcctggcactctgggggccaaggtgggtggattgcctgaatccaagagttcgagatcagcctgggcaacatggcaaaccctgtctctacaaaaaatcagccaagcatgctggtacacgcctgtagtcccggctctcggggcggggggctgaagtgggaggatcacctgagcccgggaggtcaaggctgcagtaacattgatggtgccactgcactccagcctgggcgacagagtgagaccctggctcaaaacaaacaaaaaaaaagacaaaaagctattattctcccttcatgttctaatttgtagttaaattatttttatttaacttctcctcataaatactattttccaaccactgtcttcattacttttgttgtttgcccaagaactaaaatcatgaaataaacacgaaatcactagcattttcataatctggatattaatgttaataaaataataagttttactacggcaaaaaaagctgacttgccaattaacaatgtaaacaagaattcatgaagaatactattaaaataatagaatatccactgttttagaagcttcttttgcatttaatttaaaagtactccaggccgggcgcggtgctcacgcctgtaatcccagcactttgggaggccgaggcgggcggatcacgaggtcaggaatcgagaccatcctggctaacacggtgaaaccccgtctctactaaaaatacaaaaaattgccggacgtggtggtgggcgcctgtaatcccagctactcgggaggctgacgcaggagaaggcatgaacccaagaggcggagcttgcagtgagccgggatagcgccactgcagtccagctgggcgaaaaagtgagactccgtctcaaaaaaaaaaaaaaaaaaaaaaaaagtactccaaataactatattaaaacaatcaaagagacctgatattttgttggcacaggtcattagcatatttaaacataatacaattagaaaaatactctactacagaattttaggttattcacatgttcttcactacagctcttcagaatcaaataatctgtattaagcagttttacaggaagaaaagcacagctgggatcaggagacctaggttctagtctcacctctatcattaactagccaaagacgttaagaagagactaaatccaataacccctcacttcctttttagctctaacattcttattcttaagataaaaaaaaagtgctaaatataaaagctaataaatagggacttttttttttttgaggcggagtctcattctgtcacctaagctggagtgcagtgatacaatctcgcttctcgtgcctcagcctccagagtagctgggactacaggcacccgtcatcattccagctaatttttgtatttttagtagagatgaggtttcatcatgttggcaaggctggtctcgactcctgatctcaggtgacccgcccgccttggcttctcaaagtgctgggattacaggcgtagccaccgcacccggccaatagggacaatttaaaaactaaaaaaaaagtactattaatatcacacttagacaatgggtataaaatgggactgttctaggctgggtgcagcggctcacgctgtaatcccagcactttggaggccgaggaaggcagatgacgaggtcaggagattgaaacatcctggccagcatggtgaaaccccgtctctactaaaaatacaaaaattagctgggcaggtggcatgcacctgtagtcccagctactcgagaggctgaggcaggagaattgcttgaaccgggaggcagaggttgcagtgagctgagattgcgccactgcactccagcccagcaacaagcaagactccacatctcaaaaaaaagggactgttctacgcaaaccaaaaaatatggtcctcatactatcatatgtaaacctgccaaatactgttttttcatttcatcctaaaaacttttttcttaagtttgtgtcttgttattttgtttttggagcttgattttacattataataatctttttttttttgagacagagtttcactcttgttgcccaggctgtagtgcaatggcgcatctcagctcatcgcaacctccatctcccgggttcaagtgattctcctgtctcagcctccgagtagctgggattataggcgcctgccagcactcctggctaattttgtgtttttggtaagacagggtttctccatgttggtcaggctagtctcaaacttccgacctcaggcgatctgtggcctcagcctcccaaagtgctgggattacaggcgtgagccaccacgcctgacctacatatactaactctaaggattcagaaagattgaattattttcagctaatgtcatactctacaattattttattttatttttgggaaacagagtctcactctgttgcccaggctgcaatgcgtggcgtgatcttggctcactgcaacctctgcctctcaggttcaagcgattctcatgcccagcctcccgagtagctggaactactggtacacacgacacacctggctaattttttgtatttagtggagatgggtttcaccatgttagccaggctggtctcaaactcctgagctcaggaatccgcccaccttggcctcccaaagtgttaggattacaggcgtgagccactgcacccacctgtacaaatactttagaaagtaatctacgttttcatgctgaatttcataaaataaagacaagaactaatacattttccagtttcaggtttaagagatatgtattttttgaactaagttagaaactttacctaatgcccataaaaaggaaataactaattaataggatactcatcacagttctgaatgtgattttaccacacagagttaatcaaaaaagatccttctacttcaagcaactgtcaaaatctatacacagagagcaaggatacaatctaagtaaaaaaaaaacagatggtacaatttctaaatattttttaccaactagtcccgagttacaaagctgataaacctaaatatctttaattgcacaaataattatagctattaaaaaaatacaatccaggttgggctggtgactcatccctgtaatcccagcactttggaaggccaaggcaggtagatcacttgatcaggagttcgagactagcctggctaacatggtgaaaccccatctctactaaaaatacaaaaaattagccagatagtggcatgagcctatagtcccagctacttgggaggctgaggcagagaaatcacttgaacccgggaggtggaggttgcagggagctgagactgcaccactgtatccagcctgggcaacagagcgggactctgtctcaaaaaaaaaaaaaggcaatccaaaaatttaatttcccaattattattggttgttcataaacataaaccaaagatagtgttcactctgacataagcatgcagttctcgccaactttccattccagattataatttaggtggagacagaataatctacaatcacactcaccactagaactttcacagaagctttgtgaggcatggcagagggcttccccagcttctgggcctctgcatctgagcttagctgctttgcattagcctttttgagtcttctgttaatgaattacttgttttctcctgagtttggggctgctgcaaccctggtcaagtcttaaaggatcatctgctctcactaaaggtaaggaaggctgtgaagaacttgctctacaggttctgtttctgcagtccctgatttcagatctccttcatattctacatcttttcttccttggtgtctaatctattctcagcacatggttctatttctggagcaatacctcccatgactgggaatctgagcacttctccactccctccaaaggttcacaagaaacacaactctgggagatggctctttcacatctacaatgacaacactggagtcctctgaagtacttcttcccaagcttcctgttccttatgttccaattcttggtcaagtattgccaactttgaggggaatcaatactaatcacactggtttcaacttccatagcttctgagcattcttttttggcatttccttttgaagacacaacccttgggactgagtttcagtcagagaaaggtgcacggaacactctccatattttcttctttgagttcctctccttgactttcacaaggtgtccagggatttcttccacctcagaccctgaagacccctcctctggatggtgttctttaattccatagcttcctcctgatctaacacactagaaagtgcctcagatcgagtagctggtgacgaactgcctgactccccgaatcacaagtgagatcaatacaaacatcttctgctaccgttcttctctgcccttgcaaccagtggctaaaatactaatgtcatccctggtgtctgtatcactccctttgttttgtcatcattctgactcagttgtacttcaccatcctgtgctggattctcaggatactatcattttcagcaggaacaaatttagaattgagaactggagacatgggtccgtatcctcaatctgtgtgttttctccatcttcatcaattctgtgagaactcaagctcccatctttggggactgactatattcacttgtagaaagcatcaacttgcaagaatccccttcaaagatagcccaagatcctcaggggaattctttggttcaatctctgaagttttagaaactcaactgtcaaagatgaactatgcatatctccatctttcttcccatcatttgattgtcttccagacttggggaaggaataaaaatgtcctaaggaagaacagaaagagacaaattgaatttgtacatgatcatatatcttttatatcgaatccttggattcatataaaatttctaaatcaaatttctaaatcaaatttttaaattcatataaaatttctaaatcaaatttaagattaaagaactctagtatagccaggagcagtggcacatgctccagcccatttcagttctccaaagtggggatacgtactcattttacttcacgatttcaaaatgtgctagcattcaacaggtgaaaccctgtctctactaaaaatacaaaaaaatcagccaggcgtggtggtgggcactgtaatcccagctacttgggaggctgaggcaggagaatcacttgaaccttggaggcggagttgcagtaagccgagattgcaccactgcactccagcctgggtgacggagtgagactcctctcaaaaaaaaaaaaaaaaaaaaaaaaaaaaaaagctagcattcataaagcaggtattaaatccagtggccaggtgtggtagctcatgcctattatcccagcattttgggaggctgagcaggtatatcacctgaggtcaggagttcaagaccagcctggccaacatggcgaaacccgtctctaccaaaaatacaagaattagccgggtggggtggtgcatggctgtaatcccagcactcaagaaactgaggcagaagaatggcttgaaccgcggaggcagaggttgcagtgagcaagatcgtgtcattgcactccagtctggattacagagcaagactccatctcaaaaaatataataataatactaataataataaataaaatccaaagcttacaaaatatcaatagtcaaagagaaatacaaattaaaatcacaatgaaataccactacacgcaacaaaagcaactaactaggccaggcacggtggctcacacctgtaatcccagcactttagtaggccaaggcaggcgatcacctgacgtcagaagttcgagaccaacctggccaacatggtgaaaccccatctctctaaaaatacaaaaattagccgggcatggtggcgtgcacctgtagtcccagctactcacaggctgaggcaggagaatcacttgaacccaggaggcagaaggcagaggttgcagtgagcgagatcgtgacattgtactccagcctgggcaacaagtgagactatatctcaaaaaaaaaagcaaactaatgttaaaatagttcacaaaacagtcaggcatcgtggctcagccagggatgtggctcacacctgtaatcccagcactttggggaggctgaggtgggaaaactgcttaagccaggagttcaagaccagcctggacaacatggctacaccccatgtctacagaaactttaaaattagccaggcatggtattgtgtccctacagtcccagctactcgggaggctgaggcacaggatccttgagccacaggagttcaaggctgcagtgagctattattgtaccactcacttacactagcctgggtgacagagaaagactctgtcccaaaaaaagacaaaaaaaaaaaggtcacaaaacccaggattagcaacgatgttgaacaactgcaactctcgtacattgctgctggaatgcaaaatgttacacccactttggaaaaacagtatggcagtatcttataaagttgacattcattactatataacctaggcattctgcttgtaggcatttacccaagaaaaataaaatatgtgcccacagaaagatgtgcatccaaatgatcacagaattattattcgtaagattgcatgctggccaggcacagtggctcacatttgtattctcagcactttgggaggccaagcaggcagatctcttgaggccaggagttcgaggtcagcctggccaacatggtgaaatccccccctactaaaaatacaaaaattagctgggcatggtggtgcacacctgtgatcccagctcccagaggctgaggcacgagaattgcttgaacccaggaggcagaggttgcagtgaggcaaatcacgccactgcactccagcctcagcgacagagcgagagtctgtctccaaaaaaaagtgtgcaaatgatcataggattattattcataaattcatgggaaattattcatatattcatcatataatggtcatatattaattataattgaatagattattcaaaataaccaaaaactgaaccaaatgtcctatcaattggtgaatgaataaacaaattgtggatacacatattatgaacactatccaacaatataaatggaataaaatatgaatatgtataatacaagcaaatctaaaaatatgctaagtaaaagagctcaaaaataaaagaccacacacacttcctgattccattgcatgaaattcttttttttcttttttttttttaaagacaaggcttcactctgttgccaggctctggagtgcagtggtgagatcacagctcactgcagcctcaatttcctgggctcagcaatctctcacctcagcctcccaagtagctgggaatacaggtgggcgccacaacacccggtaatttttaaaatgtcttttagaaatgggatcctgctatattgcccagacttgaaacactgaaataccaaaactatactgacagaaagctgatgtgtgattgcctagggcgggagagggagtatactgggcagcagggagatcaaccacaaaaggttataaggaaactttttaggtgagggaactgctctctactttgatggtggtgatggttacacagctgtatacatttgccaaattcatcaaaacatacacgtaaaataattttattttatgtaaccaatacttcaatattttaaaaagagaaattaatacaaaacttagctgtttttataagagattttacatttagttgttattttgcctaatgtaaatgatgtaaaactcccaacatagatggttaggcattcattcctatgttttgttttgttttgttttgttttgagacaaggtctcgctctgccagccaggtggagtgcagtggcttaatcacggctcattgcagccttaatgtcttggactcaactgatctcccacctcagtctcccgagtagctggaactacaggtgcgcaccaccagagccaggtatttttgtattttttgtagagagggtctcattttgttgcccaggcttgtttcaaaatcctggcttgagcaatctgcccagcttagcctcccaaactgctaggattacaggcatgagccacacgctcaggctttttttcctatgatttttaagggaatgaggaatcaaatgggtagtaagcattctgtatattccataacttctgatatttcaatgtctggtattattgtttatcctacagattgtaacaatgatcctaagtttgaatctgttcatatactctcagacatgactgagataaactggttcaagccagatgcagtggctctaacttataatcccaacactttggaaggcgaggcagaaggattacttgagcccaggagtttgagataagcctgcgcaacaaagtgagccctgtctctaccaaaaaaaaaaaaaacattagctgagtgtggtggcacacgtctgtggcacagctacttgggagcctggatggttaaggctgcagtgagcagtgtgattgtgccactcactccagcctgtacaacagagtaagaccctgcctcaaaaggaaaaaaaaaaaaaaggtcaacatttctaaatggcaatttagcaaaacacaacagccctgaaattctataccccatatccaataattccatttctgggaaattaatcaatgaaagcacactaatacttagctacaaatggttcactgctatattattatttagaataggaaacaatatgaaataccttaaatggtacaaataggaattttattttattttttttttgagacaggtcttgctctgttgcccaggcggagtgcagtaatgcgatcatggctcactgcagtcttgacctcctaggctcaagtgatttcttacctcagcctcccgagtagctgggaatacaggcacacaccaccacacctaatttttagtattttttgtagagacgagattttgccatgttgcccaggctgatcctgaactcctagttcaagcaatctgcccacctcgaactcccagagtgctgggattacgggcatgagctactcgtccggccaagataataatttttaaattgtgatctatcacatgatagaatgttttgtgtctacataaaagtatacagtagaagaatactaaaagatcaaaaaacatttgggctataaaagaagtttctattttagtaaaaaattatgtggatatacattatatttttttttttttagacacagtcttgttctgtcacccaggctgaagtgcagtggcaccatctccgctcactgaacctccacctcccaggttcaagtgattttcctgcctcagcctccagagtaactgggatacaggtgcccgccaccacacccggctaatttttgtactttttagtagagatggggtttcccgtgttggccaggccggtctcaaactcctgacctcaagtgattggtctgcctcggcctccaaagctgggattacaagcgtgagccacagaacctggccattctactctttttacacatttataatatataatcttcatgtaattttagttaataaacatatatcaaaaaaagctaaagggccaggtgtgatggcttacacctgtaatcccagcacattgggaggctgaggcaggtgatcacctgaggtcaggagttcgagaccagcctgaccaacaaggtgaaaccccatctctctaaaaacacaaaaatttgccagacacgtggagagcgagacttcatctcaaaaaaaaaaaaaaaaaaaaaaaaaaaaaaaaaaaagctaagagttgttatttctgaggtagaataactatgatcttatcttctcttttttcttttcttcaagatggggtcttgctttgtcacccaggcagagggcagtggcacaatcatagttcactgcagcttcaaacacctgaactcaagcaatttccccgctcatactgctccccagcaccaggagctgggactacaggcacacgtcaccactccggctaattttttttttcttttggtgggtagagacgggggcctcactatgttgcccagctgctgtcacactcctagctcaagctatcctcccaccttggcctcccaaagcactggtttacaggtgtaagccaccaagcatgaccacatcttctgcaagacatatgtattttttccttgttgcaaaaaataagtcattttacaaagtctcatagataaaacatcactaacgtaaactataaatacctttttttaaatgaaactcacaatataaaattaacccattttaaactaacaattcaggccaggcgtggtggctcatgcctgtaattccagcactttgggaggccaaggaggcagatcacttaaggtcagaagtttgagaacagcctggccaacatggtgaaaccccactctactaaaaatacaaacattagctgggcatggtggtgtgcactttttgtcccagttattggggtgctgaggcaggagaatcacttgaactcaggaggaggaggttgcagtgagctggatcatgccactgcactccagcctgggcgacagagtgagactccatctcaaaaaaaacaaaaaacaaaaataaaataattcaatggcatttggtgcatttacaatgttatgccaccacaccactattctagtttgaaaacatttaattgtctaatttgtcctcaccaaaattaatactatatcaagaatgagaaaatgttaactatcaaactgtgttctactaatcctctccccatcctcatatcttggtaaagggtcaaagaggctatgcaattgacaagtttattaggaaagaagaaaaaaatagacaaaattacctttatcccaattttctcttgaatagtactaatctcttacacatatttaaatcttacaacatcaaaattaggttgacttggactccagtaaccaagtacaaaagaaataacagatgaacaagggttacccattaagaataacaagaataagtttgcatataatgaaaaaagtagggaacttaatagaaatggagaactaaatatacacatattcgagttttctgaaatcccattaagtaatggtaaagggatttttcttaagcacaaaacttcagaaaaagagaacagaagaaaagagaactgcaaaaaaaatctggaaaaggtaatctattagcagaagagtgaaagctgaattcctaagccagcagtggagaaagccaacaaaccaccaagttacaccacagttccaacacccataatctcaccctgcccctcctctgccctggagaggtaaaacagagtgtcccaggactggcagacaagaggcacagttatcaggaagtacaatatgaaaatacggagattaaatgaaaatctacatattgaatgaaacctgcacctgcctcccaccccccttcccacccaaagcccgcttccattaatagacctctagtacagccaggccaaaccctgcaaataggagatcagacattttcctaagggatctgaccgggccaagatgaatcagatactgacattatgggactcccaataaaatgtctcagcggatcacattacagcaaatccaaaaacaataagacccaaccacccactcagaactactaatcatctgtctgatatttcctcttgaacatcagcaaataatcaaagattaccagacatctgaggaaagcctctaatttaaagagatcaaaacaaacaaaactaaagtccacctggaagaaataggactattccagacgaagaaaactgttattaatactgttacagagataagatagtatatcaataaaacaagagaatggtatttaaaaatatattctgaaaaaagaatttagaaattaaaaacccaagagtagaattaataactaagagaagaattaaaagatggttgaactgggcaatggcacctgtaggttacataagagaaataaaaccatgttcacacacaaacttgtccataaatgtacatagcagattattcacaatagccaaaaggggaaacaacccaaacgtccatcaactgacgaatccatagtaactgtggtatatccacacaattgtattattcagcaataaaaaggaatgaaggccagcgtggtggctcatgcctgtaatcccagcactttgggaggccgagacaggcggatcaccgaggtcgggagttcaagaccagcctgaccaacatggagaaaccccgtctctactaaaaaaaaatacaaaatttgccaggcatggtggtgcatgcctgtaatcccagctactcaggaggtaaggcaggagaatcgcttgaacctgggaggcgaaggttgcagtgagccaagatcatgcattgcactccagcatgggcaacaagtacgaaactccatctcaaaaagaaaaataaataataaataaataaaaaaggaatgaaattcttttttcctttatattttttatagacaaggatgatcaatacaaaaaaaggaatgaaaatctgatacatgctacaacacaggtgaatcctgaaacattatgctaaatgaaagaagccattcacaaaggctatatattttataattccattttatgaaatgtccagaataggcaaatctatagagacagaaagtagactggtgtctactttcatttgtagactggtgtctacaaatctatagagacagaaagtagactaccctcgaagggcgagggtagaagaaatgttgagtgagtgctaaagggcatgggttttgaggaggtgatgaactattctgaaattagatcatggtgatggttgcacaactctatgaatatactaaaaaccctggattgtgcactttaaatgggtaaactgaatggtatgtgaattacatctcaatatagcactgtttttttaatgattgaagaaatcacccagcaagttgaactaaaagagacagagagatcaaaagtaggaggcaaaataaaattagaagactattctaggagtttcaacatccaacaacagatagtccattaaaaaaagaagaagaacagagaaaacaaaggggaagaaattaagaaataaatttctttgaactgaaggacctgagtttctaaattgagagggcctgccaagtcccaatacaatgaatgaaaatagacgtatcccaaaggtctggaaatttcagaacactggaacgaagagaaaatcctacaggattccagtaaagaaaaaccagatcacctattaaaagtaagatcagactgccttcacactgttttgttttttgttgttgttgttgttgttgttttgtttgttttggtacagacagggtctggccatgttgcccaggctggtctcaaactcctggctcaagtgatcctcccaccttagcctcccaaagtgctaagattacaggcatgagccaccatgctgacctgaccctcacacttaacagcagcactggaagttggaagacaaaagagcaatgcttcaaaatctttaaaggaaaattatttccaatctagaattctatactcctgcaaactaaaatcaagtgtgatagcagaataaaggctactaaacaatgtcccccaccaaaatgaggggtaaaccaagcaagaagatatgaaacccaagaggtatccaacacagacaggtaaggagatctccacggatgacagtgaacggaggttaacagttatgcaccaggcatagagggcaacatacagattagaaatcaggagggtccaaaagaggtttctccaaaaagatgaaacagaaagctaaggctcctcaacatcctgaaaggagtttctgacaattggtggagaatctagggttgtttaatgagagtcaaagaaaactaaacaaataaaaaaagacaattacaatttcagagaaagaaacatgaaaaactattaataatatgtcataggctctgctgtgaattgtttacatagtataatgtaaactcagtaataatctaaacaaaattacgatgtaactatacttggaaaatgctaaaatttttttatgaaaataggctgggcacggtagctcacatctgtatgtaatcccgcattttgggaggccaaggcaggaggtctgcttgagcccagtagttcaagaccagcctggcaacatagtgaggtcccatctctacaaaaaaatttttaattagccaggtgtgatagtggtgccactagtcctagctactcaggaggccgaggtgggaggatggcctgagtacagaagtcgaggttacagtgagctatgattgctccactgcattccagcctgagcaacaggtcaagccctgtgcctaagaaaaagaaaatataatcatgctatgtagaattatggaggtaaatacaaaagaaaaagcataaagaacgaaaagtggttatctttgggtaggaagaggaagaggcctgttttaactatctgacttatttttggggttttacacatgcttattaagtaaaatcaaactttaacttaaaagctatgttgtaaaggtattcttttttttttttgagacaaggtctcatctgttgctcaagctgagtgctgtggcatgatcatggctcactgcagcctcaacttcccgattcaagcaattctccaggcaattctcctgcctcagcctcctgagcagctgggactacggcacacaccaccactcctggctatttttgaccatttgtagaaatggggtctcgctatgtgcccaggctgttctcaaactcctgggctcacgtgatcctcccacctcggcctcccaaatgctgcaattataggtgtgggctactgcgcccggcctactaaaggtattcttgagagactttcaggaggcatggactgcactggctaaggcatcttataaaatatgagttcaaagaaactgattagagtcatcttaggttccaagaatctctgaactatgttcagaatcactcattttctcaaattttcattgctgattttttagctaattctgaaggtctttggtaaatgttgaaatagagcaattccttcaacagtgccttgtttttcaaaacgtccattctccctttgtggcaggcattatctccacccccccaaccagcaggaatacctttccaaagaccataaaagtctgtttggtcactgataaacatctgtaaccattttctttaaatcagtgttggaagaatctttcagtgctctgtgtcagtgtttatagctcattcttaaactctttttttttttttttaagcagggcctcactgttgcccaggctgcagtgcagtggcgcgatctcagctcactgtaaccctgcctcctaggttcaagcgattctcctgcctcagccttccaaatagctgggactacagtgcgtgccagcatgcctggctaatttttgtattttttggtagagactgggtttcactgtctggccatgctggtcttgaactcctggtctcaagtgatccgcctgcctcggcctcccaagtgctgggattacaggcatgagccaccacacctggtcagatttataacttttttttttttgagacagggtcttgctattttgcccaagctgttctcaaactcctaggttcaaatgctctcccacctcaatctcctgagcagctgagattacaggcatgccccaccatgcccagctatttcacatataacttagaaaaataaaagctaaagaaggccaggtacggtggcccacaccttaatctcaacacactgggaggctgagagaggaggattgcttgagcccaagagtttaagacagccctggcaacatagtgataccccgtctctataagaaaaattaagaaattagttgggatggtgccatgtgcctgtagttccagctacttgggatgctgaggtgggaggatcacttggactgggaagtcaaggctgcagtgagccatggtcgcaccactgcactccagcctgggcacagaccaagatcctgtctcaaaaaaaaaaaaaaaaagctaaagaaaatgatgtatggttgaacatccatttcacctctaggtaaccttgtttttaaccctttcactgccaacaacagcacccttatatgcagtaccaagtgcaaggcactagtctaagcattttatatatattaactaacctttcataaacatcctacgaggtagacagtatcaatatccccatcatttgactgatagcaaactaagattcaatttcaattggtcacaaaggtagtaatgacagagccaggagcggtccaggaagttctgactctagagtcctcatttttaataacgctaccaaattctaatgactgcataaaatgaaatcctttaacaaaacaagttttaaaactccagaaaacaaatcaattcttcctactgtcccctcctcactaaatttacagttcattactattcattttcaaatttacttttaaatacaaactcttgttataacacctgcaaactgaaaggggtaaaataagttgcccaataaaactacaataattcccccacttaaggtcttataagaataggtatttagattaatatataatagtcatttagatttaaggattttcaactcagtatgaaacctgaatttcattctttaaatatttaaatttaaaattatacaaattaatagttttccctcgcttttagaaaaaatacacattggaaaactaaaaaccatcttgataccctaagtataggatgatcctgtctgagatcacatctacttagagaaataatacatgacttttgaaaggataagtgaagacatataacactgagaattattacgacacaacattaactggaaaaagaaaattaaagttgtgtatataaacaccttttttaaaaaacataagcatgtgggggcacatatcgtcaggacctctgaggctgtgtcataggcaaaaaaatttattaaaaaaaaccataagcatgtagaaagacaaaattacagtaacagttgtgttaaagtagaataatgatttatgtcacttcgcaattttcagtaacattttcaaaaagtttaaagacattgtaaaaagtttaaacataaaaaaaaatcagatgttaggtgactttggaactgttctaaaactgctttgtgacgacagcttcacaacttgtaaatttactaaaatatcacaaaattatacatttaaaacgtgtgaattttatggtattaaattataccccaataatgctgctttaaaaaaatatgttaggagaaacaactctttttcaatactcacatgagaaaactgaggctgggatgggataggaagtgacccaggagggaagctggtgtgctctgagatattggtgttgaggcttgtggtgatacagtggactcaggcagggaggggggttttctaactccactggttcaccactttgaagtttcttctgaaaaggctctctccttcttcagataacactgacgtgtccattggcttatctggtttaaaacaggagaaaaaattgagaaatatcactcatcaatattactcatgttccaaaaccactaagaacaattaactacagacattttcactctaaaaaaatagtgacgtaatttttcagaaaagctgacagataatagtagactgggtcctagcaatctaccaatacttcctttggttggcggagcagtccagctcctatttttaggtatagatcaaaactggatgcatctggggctacccacccattcaaaaaaatgttaaattaacttggctcctttcctgattttatagctcagtttttcacatttctgtagaaaagcccaaactactggtacctaatttaaccatcatatattctaccacaggcttgaaagacagtgaatttgtcaccactttaggtaaatacagtatctataattcatatttcgaactgattatatttgcattaacaattgctaactgcagagagatggatgcctgtacaatacagatgaagaaaaaaaatctatcaatgccaatcagcactgatttatcaaagaactaaaaagagaagacactaatcctgacacacattaggagggaacacacacacacaaaacacaaacactgctttcccatagtatactacccacctgtaggctatcaggaacttgcttggagtcgcccagctagctaagtatttgattcatcatttgtatcccctatcttacaacttgaccccaccaggcttcctctagaccactcacaaactactaacaacatttaccttttccccataatcacattcatgctaccagctacccaaactgcaacctcaatacccagctttgctgcttagctagtctcaaccttaccagtctacacctaatttgggatccagtgctacaggcctttaataactaccatagctgtgctaagtatttttgttgcaccttttgaactttcttgccatgacaagcacattaaaaacctgctgttataggcactacatacaaaaaaggctttaggttaagagaaagcaaaaaaacaaataaatacaaaaagcacatatagtttcacaaacactgatgtacatcatattaagcaaatgcattaaatctaaaatataactgacaagggaaaatacactgttactaaaaaaaaaaaactgagtcatatacacaacatgccaattatgtaaaactactttatgcttgaaaactgaaatatatccaaatatactagttgtagctatatctggagtgtagtatcaaggtgatttttattttcattaatttcctatatacttaacaaactttctacaataaatatgactgtttacaatcagggagaaagcttttttttttttgagacagggtctcgctctgttgccaggctgcgacgcagtggtgccaccttggctcactgcaacctccgcctcccaggttcagtgattctcctgcctcagcctcctgagtagctgggattacaggcacccgccaccacaccagttaattttttatatttttagtagagatggggtttcaccatggtggccaggctggtctaaactcctgacctcaggtgatctgcccaccttggcctcccaaagtattgggattacagggtgagacaccgtgcccagcctgagaaagtatatttaatataattatttttatattttttaatgttcacactacagataaaagataaaagaaactgttttaagaattaaccaaacttcattgtattacctgggtttttgtagaattaattcacctaatcatgttatacttagattgattcagtcactaatcatgttatgcttagattgatattagtcaatttggatacctacaactgttttaagagaaacagccagagacaaactttgtagcagaagaaagcctaagatcaaattcatcactgataaattacatttgaaaaactgttaaatgtctatgttttatgttactcaagacagagaaaggatataataggaggcatatacatgacagatgaaggcacaggctctggaggagctgcctgagttcaaattctgcttctacatctcattagttgaaaaatctctctatgccccatttcctcatctgtaaaatggggataaaaataacacctccttcttaggatgtttgtgggattcaatgagaaaaaccacagaaatgcccttagaacaatgccttgcctatactaagtctcaataaataaaactattataccattacttgtatatgaaagagtgaaaagatgaaaatatagaatttattagaaaaagctttgtagaaatcgtaagaacttagaaacatcttgaatgctggataggagactaggtcagagcaaaagaagcttaaataatgagataaattaggtaaggaaaaggaaagctttcttgtgaataaagtaatataaaatctctaagtcgtcaaaggagtaatgaatgaagttaaaatttttaccacctactcttaaccattcttatgctaaaactatttaatagcaaaaataacctataaggaccacaagaaacaattgctggttccttctcaccagaatgtgttcacgtgttgctagaaacaagtaggccattattaataagtccagttcttcccatactaattcatttcagttcaactttaaaaacaaaaatttttccttcagagcctttttaaaattgagccaatacagaaatctcaatagaattagtgctagaaaagcaaagaatgggggtggtgtgtccagaattggtgggttcttggtctcactgacgtcaagaatgaagccgcggacctcacggtgagagttacagctcttaaggtggcgcgtctcgagtctgtcccttctgatgtcagatgtgttcggagtttcttccttctggtgggttcgtggtctcgctggttcaggagtaagctgcagaccttcgcggtgagtattacagctcttaaggcagcgcgtctagagttgttgttcctcccagtgggctcgtggtctcgctggctttaggagtgaagctacagacctcgcatgagtgttacagctcataaaagcagcgtggacccaaagagtgagcagtagcaagatttatgcaaagagtgaaagaacaaagcttccacactgtggaaggggacccgagcgggttgccatgctggctcgggcagcctgcttttattctcttatctagccccacccacatcctgctgatggtagagccagtggtctgtgctgacagggggctgattggtgcatttacaatccctgagcagacacaaaggttctccacgtccccaccagattagctagatacagagtgtccacacaaagttctccaaggccccaccagagtagctagatacagagtgtccattggtacattcacaaacctgagctagacacagggtgctgattggtgtgtttacaaaccttgagctagaaacagaggccgattggtgtatttacaatccctgagctagacataaaggttctccacgtcccaccaggcagccagatacagagtgtggattggtgcattcacaaactcagagctagacacagggtgtgactggtgtgtttacaaaccctgagctagatacagagtgccgattggtgtatttacaaccctgagctagacataaaggttctccacgtcctcaccagactcagcagcccagctggctcacccagtggatctcgcacgggggctgcaggtggagctgcctaccagtcctgtgccgtgtcctgcactcctcagccctttgggtggtcgatgggactaggtgccgtggagcagggggcgtgctcatcagggaggctcagccacacaggagcccacggagggggtggaaggctcaggctggcgggctgcaggtcccgagtcctgccccactggaaggcagctaagtaaggcccggcggaaatcaagcgcagcgccggtgggctagcactgctgggggacccagtacaccctccataccgctggcccgggtgctaagcccctcattgcccggggggccggcagggccggccggctgtccgagtgcaggacccgccaagcccacacccaccaggaactccagctggcccgcaagcgcgcgcacagccccggttgctgctcgcacctctccctgcacgcctccctgcaagctgaggagcgggctccagccttggccagcccagaaaggggatcccacagtgcagcggtgggctgagggctcctcaagtgccgccaaagtgggagcccaggcagaggaggcgccgagagcgagcggggctgtgaggactgccagcacgctgtcacctctcaatggggttagacaaaaaaaaaaaaaaaaaaggaaggaaggaaaagcaaagaactgaggacagcactttacagtaggtcacatcctaaaggttagacaaacatgagtcctaccgaattgtgtaggtcacaagcattctaaagacaaagaagtagtacattttgcaaggcagaaaaagtgttgctcctcttctaatctgagacaacagacagatcaagagagctcaccttgtctcccttcttgctctgtgggactgctaggacgataaaaggagtagatcggaaagcatcaggagaaggagcaacaagatctgaagaattctttatataaagagagaatcacaggttattttaccatagccacagttttgcatttctgttttgcttttactttttaacaggaaaaaatatctaaggcattcagataaatacttatcagacttttccccaacagcaacctgaggctggtggaagaaccaaaaatacttcaataactattcccacaccagacatttctgttgtaaaataagaactttttcaaaaagagagtaagggcaagtgaatgatcagacacaaggacatcatgatttaaaagcaaaatgagcagtgctaggaataaattcatttgcagatttgagacataaaaaaaattattccatttttttgcctaataatgtcagaccatgaacattttcatcagaaaactaaaactaaacaaaaaaaaccaacaagcgacctctttgccctaacataaagaaatccaactactgtcaacttaacaacctattctccacctctgctattaaatgagaagaattgcaagtaaaacagaggagcagaatgcttgttttgatgtgtaacattttctaaataactgcgccttttctttcttagtgaaacgtttgggctacattataaaattttcaaatgggacaacagatttatctgccttcaacagttcttcatccccaagctctaatgcataggttctaccatttggtttcaaaaagaattctagactagcagatagtttagcctctttcagccttagcctaagactctcaggcacatactgccttggcataagcattttaggcttacttacgtggaaagactgtcctgaacaagggacctctgaccagagagcgcaggagatgcagagtggtggcaggagtggaagccaaagaacacccaccttcctcccttaaggagtagagcaaccatcagaagatactgaaaaaaagaaattccagttgcacttctcaattgacactactgagctgccaaaaaccattcagtactgcaaagagtaatatccatatttcaacatatttccatatttccaaaagggcagaaattgttttctaattatagtacaacgaaggactactacaatagcacaaatcttgagtgaacattaaccacccccgcaatgggcttctgaataaagaactgatgaagagttccttagtcctttctgtcatgatctaagcttggagataaaagccagaatcctggatgggcgcagtggctcacacctgtaatcctagcactttgggagctgaggcgggtggatcatctgaggtcaggagttcaagactagccagaccaacatggtgaacctcatctctactaaaaatacaaaaattagctgggcgtggtggtatgcgcctgtaatccagctacttggaaggctaaggcaggagcatcacttgaacctgctaggcagaggttgcatgagctgagattgcaccactgcactccagcctgggcaacagagggagactccgtctcaaaaaataaataaataaataaaataaaagccagaatccttatacttctgcttagctgctctctttcttgtgatgcttctattaaaaaacagcaaatgagccttttattccaacgtctacctaggtgaagtcaagctcatgccatgatacagatgggagaagtcaaaaaaatgcacatgaacttgatgttataaatgcagcagttttcaagatttgggcctgctcaaaggagtaaaaggtttatgagcagccattactgttttatactatgaagagtctcttgttggtcccttcccctagcaatagatggagtatcaactatattaatcccagtgtaaaagaatttcttaaataaaacttacaactttagtaagagaccaacaaaggttcctcggtgaccctctgaatgtcttgcaagcaacctgtatcacagcatagcaaaggaagatagccttcttcccttcccgccttacaacaacataatatgttttgctggtaattaactcaagctttctagctctctgaggctgtggatgaaagattggtggaggttaaagaggtgtgaaacaaattatatccttttaagttttatgcctttccgctagattttaaattcctatctgtgtcagattaactaataaacagattaagtagtaaactgttacccagatgaatatgaaaaacctaggcttaatatcatattgaagatttaagacatagtagccatgtaacagaaaatggcagccaggtgtggtgactcatgcctgtaacccagcactgtgggaggccaaggcaggcggatcacaaggtcaggagatcaagaccatcaggctaacacagtgaaaccccatctctactaaaaatacaaaaaattagccaagcatggtgcgggtgcctgtagtcccagctactagggaggctgaggcaggagaatggcatgatcccggaggcggagcttgcagtgagccgagattgcgccactgcactccagcctgggtgacagagtagactccatctcaaaaaaaaaaaaaagaaaaaaagaaaatggctagtatccataatactaatttactgtattagctattcttcaccatctcatttccaaaagagagaaaattatgtcaaatattaaatggaaattattcccaaaaagcccttctcactaattactagaaacacgtttccttccatatcacaaacaagtctgcaaacctataaaatgctttgtaacttaaccagtagctcagaactaaagtaaaagtttagatctttggagaagagctgtaacgacaaatcactctggtacctgttttattgctctggtcaaacaagtcttcctgagttgacaaaacctcaggcttggtgacttctgaatctgcagtccactttccataagttcttgtgcagacaactgttctttgcttccatagcagcaacagatgctttggggctaaaaggcatgtcctctgacctaggaattcatatcaccaggagaaaaagttcctaagttcaaatgtttttaaataaaaagcttttctgttttgtgtgtttttctttaataatttcaaaaattccagtggctctaatttacataatatatattaaaaaggaaataaactactctttatagtgataaaagtcctcagcccattttaaacctgtctcactctctctcacagccaatacctgtcttcaactctgctcaatactgtgctcatgctttctaagatttctgatgagtaacttggggaatttttgttacatataatgttactagacctgtataaagaattctgatccagaccccaatgatgccagtaaggagaacagtcaaaccatgacattccatggaaagcatttgatgtcaattatcctccttactagtgccacaacatcttctgctgaccttttccatttgatgtacccaaaccccaaaccaattctccttcaatcaatactaacatgtataagacattcatccctggcccctttccagagacttatgaggtcacctgttctaccactccccagggtaaacagaatagcataactagatggaaggcagcattaaaagaaaagcctaaaaagtcactgttatgctgagtgttttacattagaaagacaattctcttgatattcaactttgcttaggacactctctccccactctttccattgaaggaaatacaaaacaatactgtttatttatcccctatcccaaactggaagcatcccagttttcttcgccatattcaaacttcacttactggccagaggtaatgaagctttggttataaaaatcacagagatgaagcagaggcacattccccaattcctaccaagttaagagcctaaagaacctggaaaatccctacatctatcgataccataaaataccagatgcaggatacctaagaacccaagcaatctgggtgctcctcaagtatagaaacagtaggctttcaaataaaatagtcatgtactcttcataacaccagagaggctaagaagacctcccacagacaagcagtgtctctgtaacaaagatcacaaaggaggagtggcaaccaaagattacggagtcatgcttatagttagacagccttaaaacatcattgcaggctaggcagagtggctcacgcctataatcccagcacttgggaagctgaggcaggaggattacttgagcccaggagttcgagaccagcttgagcaactagcgagactccatttctacaacaaaaaaatttttttaatcaacaaaaaaaggtctttgagaatgcctaaagataagattagtagtcaagtgtggccccagtacttgggaggctggggagagaatcacatgagcccagggcaacatagtgagactttgtttcaaacagacagacagaagacagacaaaaaacaattcttgagacttcataaataatcaacgtttccaatggaccacagtatgcccagtacaaggggaaaataatttaaaaatcaacaatttctaaaaatgttttctctggtaaaatgacattagtataaccctacagcaaaactcgtaaatcctttttagaaagtcggcttaccttgcaggtggtggattttgctcttttacaacatgtacatccttactgggtgtgctgtcacagggatgtccttgctggactgttctgctatggggatatcttcgttggatgttcttcatgcttaattgctgagagttttataaaatgacaggaaggagataattaagtttcaaaatactagatacagtcccagatgttttttaaaaagcaaagattttaacagaagtcaatttaaaatatatacaggcatcagtctataaaggaaagtaaccaataacttaaaacccagcccacaaaccaacaattgacaagtatttaccagaaaactcttcaaccttactaaatacttagattatattaatttggatagctgcaaaacttatcaaagaaaaaataactacctcaatatgggagaaaacacaacaactccaaatgccagaaaacatgtttcataccagtattacatccacatcagacagcctggtataaccagagttggtggttactgattgtagctgctcttgtccacttcatatggcacagtattttcctcaacatcctggctctgggagagttccagaccccaaaacccaactgtgatgaggcagtatctaggaacaaaatgccaagaaattaggtacatcccacaacattatgcaatgtacaagctgctgtcctcagcaaaggagggtcccgttagtccttcacatcaaagccctgtgcaccccccaaatttttcaaaaataaaaaataaatgtgccgagcacggtggctcacacctataatcccggcatttgggaggccaaggtaggtgaatacttgaggtcaggcggtcaagaccagcctggccaacatggtgaaaccccatctctactaaaatacaaaaattagccaggtgtggtggcgcacacatgtaatcctggctactcgggaggtgaagcacaagaatggcttgaacccaggaggcggagcttgcagtgagccaagattgcgcactgcactctaacctgggcaacagagcaagactccgtcgcaaaaaaataaaaaataaattaaaaaaaataagtgcattaaagatgaagggggaaaatgtgtaataaagtaaaaatactcatactataaaatcttataaggagactacgtctgctttctaaaggtacatcataaactaacccacagtcacagcaattcagactgtacttacaccccacaaagtacacattacaaaaaatttgaaaaacaaatgaatacaagaggaagaaaactcaatatgcagaaaggggctaaccatgaactacaaattcctgaataccaaatcaggtggaacattttaaattactagcaaattcttaatgactctcaatttaattatgagaaatctgcaacctaataaagaggagaaatttaacatctgcacaatcatgttaaagggaagttagaacagtctattattctgaaaaaagcacaggctaccttcagcaccaagggaatgtgtagtattgcctgaagtatcttcttccttctcttctccttctgttccaactcttctcccttctcttcctccacagcaggagcagattccacgacattcccagaacactacacagcagaaggatataatcatgtgttcccagatagtttggacactttaatcagagcactctgacccccaacacataccaaccatctcttagccaaacttaaaaagtaaaatacctcacctttatagtgcttctttctacaaaaagcacctaaaagattacaattcaacatcctacacagaattaagtaaagaaaaaataaggcaccaacatactcgattttatatttttgagaagaggcagaaaaatcttgcattcaggagaattactgacaagtgcaagagaagatatgcattggatgagcacagaaagggctcaaaaaactttttaaaagttccagaagtattttagtaaaaaatcttaaaatacatatatagaaccacagagtccaaacaaattcaggtaaggagcttatatatgtatataaatacacacacacacacacacacacacaccacacactttttattttttacttattttttttttaagagacagagtctgggccgggcacgtggctcacacctgtaatcccagcactttgggaggcagaggcaggcaggtcacgaggtcagagatcgagaccatcctggctaacatggtgaaaccccgtctctactaaaaatataaaattagctgggtgtggtggcatgcgcctgtagtcccatctactcaggaggctgaggcaggaaattgctcgaacccaggaggcggaggttgcagtgagccgagatcgcgccactgcactgcgcctggtgacagagcgagactctgtctcaaaaaaaaaaaaaaaagagagagacagagtcgtctcccaggctaaagtgcagtagcacgatcacagcttactgcagccttgaactactggcacaagcaaactccatatatttttaaaataagttaacaccgaccaggcacggtggctcagcctgtaatcccagcactttgggaggccaaggagggcgcatcacgagatcaggagatcggaccatcctggctaacatggtgaaaccccatctctactaaaaaatacaaaaaaattagcgggcgtggtggcaggtgcctgtagtcccagctactcaggaggctgaggcagtagaatgggtgaacccgggaggcagagcttgcagtgagccgagatcgcgccactgcactccagcctggcgacagagcgagactccacctcaaaaaacaacaacaacaacaacaacaacaacaagaacaacctataaattcagcattaaggaaatgattacataatttcacaatctattaataacaatatcaccgttaaaaatgtttgaaacaaggccaggcgcaggggcttatccctgtaatccagcacttcgggaggccgaagtgggcggatcatttaaggttagttcaaaaccagcacggcaacatggtgcaaccccgtctctactaaaaatacaaaaattaggctgggcgcggtggctctgcctgtaatcccagcactttgggaggccgaaacaggcggatcacaaggtcaggagatcagaccatcccggcgaacaaggtgaaaccctgtctctactaaaaatacaaaaaattagccggcgtggtggcacgcacctgtagtcccagctactggggaggctgaggcaggagaattgctgaacctgggaatcggaggttgcagtgagccaagatcacgctactgcactccagcctggagacatggcgagactccgtctcaaaaaaaaaaaaatttaaccagtgtggtgtcatgtgctgtagtcccagctacttgggaggctgaagcaggagaatcgcttgaacccaggaggtggagttgcagtaagccgagactgccccactgcactccagcctgggcaacagaaaaagagtcttctccaaaaaaagaaaagtgtgaaacaatcaaatacaaaatgtgaacctgaattggatctagatgctatcaaccaaccaatcaataaaacaagacaaaagacatctttgagacaactggaaaatctgaactgtatacttaaatattatggaattattactttaagtgtgataacggtctatgattatatagaataatgtacttattcttaggggatgaatgctgaagtatttaagggacattatattaaggaaaaatctgatgtctgcaacttaaacaattaatcctccccaaaaagtacagaacacacacacacacacacacacacacacacacacacacacacacacacacaagaacaaatgtatactctttcatttcttctgtgggcttaaacttttaaaataaaaaactggggaatatgttaagttttaattgtcatgagaaaaattttcatgtttttaagcaaaacacagcaaacatacacttttactttccacatgatgtcaaccatataaatcaaatgaacaaaaaagagagaaaagatgccaaaatgtttacagcaattagcctctgggtggcaggattacaatgacatctttgcttccttgcaactttctacacaactaatatttcataaaaagagcattagcgtaactgtaataaacacaaaagaggtgaaaatataaatttgcaaagttgggaaccggacccaagcaagtgaaagaagactaagtaaagatttttacaaaagcaaaatagaacatttctatataactggaaggaccagataaatgactttgggaaacagagggaaagaaagttcagagcaaatattgcaaatggtagaaaagaagcaatgaaggacgacagcacaaaacaacacctttgagctcttcttagtttcttttggtgtttttacctcatgtccctgatctctaaatgtggtaggctccgtgagtccttggacctcttttctagctacattcacccacttaatgacccatccagactcatggtttagaatactacctatctgcttatgagtctgcaatttaaatcttggcctagacttttccctctgagctccaggcctccttgtccaattacctcctcaacacaccagctggttgttgaaaagatagcacaatgtttcatatgtttaaaactgaacttcccctctgcagtcttctctatcttaactgtcattccattactctagttgctcaaatcaaaaactggaatctgccaggcacggtggcatacatctgtagtcccagctacttgaagcaaaacaaactggaataattattacttccttcttgtctctcacactccacatctgatctgtctttgaaccccttttcaaatactcagaatctcaccattcttcatctgcttcaatcctggtccagccctatcaccttttgctaaattatgtcaatagtttccttgttggtcttcctgcctctagcctgtcctgctttcagtctattcttaatcaagcagccagagtgactctgttaaaaatctaatcagatcatgtccttcccctgctcaaaacccttaaatgtcttcctatctcactaaaaatagagccaaattcctcacaatgccttacataatctggttcccttctgacttctctgacctttctctcacttctcttagtcactccactacagccacactaacctccctgctatttctcaatattccagggacgctcatgcctcagggtctttgaacttgccattctccatgcatggatacacttatcccagataacagcaaatacacacttacttgttttttgttttttttttttaaatatggtctcactctgttacacaagctagagtgcagtgaagcaatcatggctcactgcatctcaacctcccaggctcaagcgatcctcccacctcagcctcccatgtagctgggatcaaggcgcacactaccatgcctggcttactgtgtattttttgtagagacagggtctcactagttgtccaggctgctctcaaactcctgggctcaagagatcctcctgcctcggcctcactagatttttaatcaaatgtcctatcaatgaagcactccctagacaccctatgtaaacttgaaccactttgttgcttcctctccccttccctgctatatttatctcttcagcccttatcacatctaacatactacatattttacttatttatcatatattgctataccctacacaagaagtaagctacattaaggtctaggatttttatttcttctgatcactttgtatccccaaaatcaagaacacctggcacacagaaaatactcaatagaaggtactttggccgggcacggtgggcatgcctgtaatcccagcactttgggaggctgaggcgggcggatcacgaggtcaggagtcaagaccatcctggctaacatggtgaaaccccatctccactaaaaatacaaaaaattaccgggcgtggtagcaggtgcctgtagtcccagctacttgggaggctgaggcaggagaatacgtgaacccaggaggcggagcttgcagtgagccgagatcgtgccactgcactccagccgggcaacagagcgagacgccgtctcaaaaaaaaaaaaaaaaaaaaaagaaagtactttggaggccgagatgggcagatcacttgaggtcaggagttcaagaccagcctggccaacaagtgaaaccctgtctctactaaaaatacaaaaattagccaggcatggtggcacttgcctgtatcccagctactcaggaggctgagggacaaggatcgcttgaactcaggaggtggaagttcagtgagccaagatggtggtgccactgcgctccagcctgggcaacaaagcaagactccgttcaaaaaagaaaaaagaaaatactcaaaaaaatttgtagaatgattagacaaatcagaaaagcatgaaataattcagattacagacaaaaaacagtactttagttaaacttttctccctgtctaaagttgatggaaagagaaaacaaaggtttaaatatattatttagaagtgtaacggagccagaagaattaaaataattaccatcaaaaattgagagggtgaaaacaaacaaaaaaaaattgggagggccgcggaggtgcctcacgcccgtaatcccagcagtttgggaggcgaggggggtggatcacctgaggtcgggagttcaagaccagcctgacgaacatggagaaacctatctccactaaaaatacaaaattagccgggcatggtggcacatgcctgtaatcccactacttgggaggctgaggcaggagaatcgcttgaacccaggaggcggaggttgccgtgaccaagatcatgccattgcactctgcctgggcaacaagagcgaaactcggtctcaaaataaacaaacaaataaacaaaaattgggagggtgttgctgagttaccccatctttcattatcgaactcaattgtattactttacatataaaacacatttatagttttacaatagtattagagtaggaagataacctcccaaagaagtaaaaccataaacagttaaagagagttgcctttggaaaagggagcaagggtgaggaaggactctctgcttttcattataagccctttttactatatttatttatttgtttttgaggcagggtctcactctgccacccaggctagagtgcagcgtgcaatcacggctcgctgcaacctctgcttcccaggcttaagcgatcctcccacctcacctcctgagtagctggaaccacagatgtgtgccaccatgcccagctaatttttttgtattttggtaaagacgggatttcaccatactgcccaggctggtctcaaactcctgagctcaatgatccacccgccttggcctcccaaagtgctgaaattataggcctgagccactgcacccgcctataagccctttttaaagtaaatgacttatattattctgttaaaaatatttaacagtctcaccaaaattaaaaattgctccgtgaaaaaccctatgaagagaaagaaaggatagatgggagaaaatatttgcaaaatacatattctacaaaagactagtatctagaatatataagaactctcaaaacacaatagtaaaaagacaatccaattagaaaatggacaaaagatatgaaagacatttccctgaagaaaatgacaggcagcaagtaagcacatgaaaaaatcctcacatcattagccattagggaaatgcaaactgaaacaacaatgaggtatcactacagacttgaatggctaaaataaaaaatactgaaaacaccaaatgccagtaaggatgaaaaaaaattaatcactcatacattgctggtgggactataaaacagtacggccactctagaaaagtttggagtttcttaaaaaaacaaacatgcaactaccatgacccagcaattgcaaatctgggcattatcctagagaaatgaagacttatgctcacagaaaaacctgtacatatggccgggcacatgactcacacctataatctcagcactttgggaggctgaggcaggcagatcacctgaggtaggagttcaaaaccagtctgatcaacatggtgaaatcccgcctctactaaaaatacaaaattagccaggcgtgatggtgcacggctgtagtcccagctactcaggatgctgaggctgagaatcacttaaaccctggagtggaggttgcagtgagctgagattgcattccagcctggggacagagcaagactccatctcaaaaaaaaaaaaaaagaaaagaaaaacctgttcataaagcttataacagcttctcaatagtagtcaaaaacaagaaaaaaaaatgcagatgtccttcacagatgaatggttaaacaaactgtggtacatccacggcatggaagactactcagcaataaaatgaactattgatacatgcaaaaacatggatggagccccagaagttatgctgattgaaaagccaatcccaaggatgggcatggtggctcatgcctgtaaccctgcattctaggagatgagacaggaggattgcttgagcccaggcattggagaccaccctggccaatacagcaaaccccatctctacaaaaagttaaaaaattagttgggtgtggtggcatgtgcctgtcgtccagctacttgcgaggctgagatgggaggattgcttgagcccaggaggtggaggctgcacaaccatgaccttgccactgcactccagcctgagcaacagagtgaggccctgtctcaaaaaaaaaaaaagccaatcactaaaggttacagactgtatgatcccattttatatagtatttgaaatgacattttacacatgaagaatggattaatggctgccaggggtttgggtgcaaaaacggaggtaggtgtggctataaaagggcaacaataaacatccttgcagtgttagaactgatcttgactgttgtggtgaagacacaaacctacgcaggtgataaaactatgtaaaacttatacacacacgcatacacacacacataaaaagaagtaaaacaggaaatgtgaataaattggtggatttggccaggcaaggtggttcacacctgtaatcccagcactttgggagactgagcaagtggatcacttgaggtcaagagtttaagaccagcctggccaacatggggaaacccatctctactaaaaatacaaacattagccagcagtggtggtggacacctgtaatcccagcactcaggaggctgaggcaagagaatcgcttgaacctgggaggcagaggttgcagtgagcaagatcacaccattgcactccagcctggggaacaagagtgggactccgtctcaaaaaaaaagtgttttgaagagatttcattcttttggaatcaactccaaattctttccagcttcatgcctatgcacacacagttcattctgtttggacagctcctcctttcatactgcacatagaatgtgcagctcttcaactatgccctccaagcccttcaactatgcctaacaaattcatattattgtttagattgtattccacaaagaggtgtccccttatccttctgattacgttatattattttttctcctctttgcaatgatcacagttgtaatggaatagctactgatgtaatgatcatttaacatctgtctctcctattaaattataagctccacaatggcaaaagcccctttaagcacatgccacagtgcctgcacatttatttaacatgaaaagaagtagcatgaaactttcaaatagcattgcttcattcacaatgagggacgtgcatacttcctgtccccactggctaaaccaggatgctgagccacaaaaacatagataagcctggcacatgttcttaaagaggtccataaacttaaatgcccacagaaatcaaagcaagataacatagatgagtgaagcagctggtgtaagaacaaaagcacaagcactatgataaatgacaaaagaacacctggcctcagttccaagtacaataatgaattgtagtgactatggcaaatcatagcactaatgctccatctagcagaggctgactgctactcataactccagccaactgttgccaacagaaacaagaaatccagaagctggaagtctaagttttatgagaaatttccccattctaaaattctgtcaattattcaaatatattaacattttaccacctatgtaggccaaataaaacacttctgcaggcccaatgagcccatcggtttgcaggttgttctaaagcatttattttacttgatgatttgtggaaaaaaaaaattacgtacagacacagagtgtaaaataaaacacacctccaaaaaagctttctttttgagacagggtctcactctatcaaccaggctggagtgcagcggcacaatcacgctgactgcagcctcaatcttccaggctcaagtgatccttctatctcagtctcctgaatgctggggctacaggcacggaccaccatgccctgctatttttttttttattattttatttattttgagacagagtctcgctctgtcacccaggctagagtgcagtggcacaatttcggccactgcaacctctgcttcccaggttcaagtgattctcctgatgcagcctcctgagtggcggtattacaggtacccgctaccacacctcgttaatttttgtatttttaagagaccgggttcaccacgttgtccagactggtatcaaactcctgacctcaggtgatccgcccacctcagctcccgaagtgctgggattacaggtgtgagctaccacacccagtcctttttttttttctttgtagagacagggtctcactaggttgcccaggctgatctcaaactcctgggctcaagtatcctcttgtctgagcctcctaaagtgctgggattacaggtgtgagccactgcgcccagcaaaaaccatttctttttaagaaaaaacaatagtctttaaccatctcaagctaacattccctctctaaccacctcccctttctaccaccccaaaactcctgaagttctctacattctcttggaccttagaaatattggggcggaagactgagaagcactgattagttagaatgaaagggaggcattagagtcattaggaccaggttcaaagccagctctgccacttactagcaatgactctaaagcaagttatctaatttctttgtccatcaattttcccgtctatacaatggaataatgtaatgtcttcatcgtacagctgctttaagaataggattaaataacattatactaatgccaaacgtccaatacaggacctaacacagagcatgaactcaaaaaatgggtattataagatatgcaaaagacatggtaacaattgaatcttgtttagggtaagaattaaacattcagatctaaaactggtggggtacttcagttgatagatggaaaacatgcctaatagttctgtaatactcctaaattttttttttttttttgctgagacggagtctcactctgtcactcagctagataaagtacactggtacaatctcagctcactgcaacctccgcctcccaggttcaacaactctcctgcctcagcctcctgaatagctgggattacaggcacgcaccaccaggcccgctaatttttctgtttttagtagagatggggtttcaccatgttggccaggctggtctcaactcctgacctcaagtgatccatccgcctcagcctctcaaagcgctgggattacaggcagagccaccatgcctggcccctaaatactttttaataatttttttctactaggaggaatgttattttgtttcacatgcacaagacagatcatgatttgaataatgtaggtataaaaattttaccttcacaaaacagtttccagctatcagtactattacaatactatctaatacaacctcaagtcccatttcctaatccacaagaaagagattaatccttttatccttgggatgaggaacaggtacagataaaagaacaaatctgataatacatttaaataaaccccttcaaacacgtatacctgcttgtcctgtttggctgaggtaactgctcaatgacctgactgatggaacccatgtgtccaagttagaagaatccacagggtctgaaaaaaataactggatattagcatgaagacatttaccaacaaactttaatacaaaatcaggaatacagacaataccaatctaatagtgacactagcacatcaacttttgagtgactactacgcagataccacagtaggcttcctacatacattcgacacaaccacataaagtttaaatccacccagcaccaacaagagcaccaaaaaatgcaaaggggacagatagctttaaacacctcacctgcaaccttgttttctttcaatgttcattgaacccactattaccgtctcctcgttcttctccagctgtttgttcaggatggacacaacatcctagaaaatacacatacaaaatatccccattatatatgaaatagttaaaatgaaacctactatttgtgaacaatttttccaatcaactttattgagaaggtaatgtcttctaaatacttatgtttgctggttttcggtttaaaaaaaaaaatctgctcaatcttttcaaacaaggtatcactcaccaacacaggattttctttgtgcgtctggagattaggaagtgtcgagatagcatactgaagtgagaaccagaatcatcctctagaacctggctttcagctgagaatcttcaattatcaggcaaggagtatcttgctgagagaaatctgaatccaactacttccagtagggtccatctgctcccctggaatggaataacaaaagatcagttccgtgtacctactagccttgctcacgcagtctaaacctaaataatggggcggaagtacaagagctggaaacgggaccacttcaggactcctccaattagaatattatatttataattgctgcaacactttcctatcatgcctaccaagtcaccattcctcgttatttacaataagcctgactaccctccctatttttcatcaccttctcgtagacaccctttcccctccttcctaacctctttctccccgcccctttttccatcccccccgccacgtccttctggcgcctctacctcccccaaaagaatgttttctaaaatctgttcgccagaggccccacagcctttcagctttcctcagaccaccaagccttcttagctaacgtttccccaccccctccttagggccctccaacccctccccgtcaccgccgccatgcttgccaccccgccccctccggtcagccatcccttcagaccgaaatccaggccttcagagcccactgcactcccatttctctccaaacagtaccaggctcccggcgggaggtccctcgcgctcgagctagaggtctctgcacgctccccaagtccctcagatcgatccctaggtcgccgctgtcgccaccgccgccaccggccgcgaactcccccttcccgtcacgtcacacaatatcggatcgtccattcgctgccgccgcccgccactcaagaatcccgtggatgataggtagctgcggcagagtgccctgccccacgtaagaaaaaggaaccggcggcgcgtttccatggcagcatggacgttgcaggccctcccctttagtagagccgggaatgacggtatccttgaaccgaagggaccttgagagggcgtgaaataccttcccctgctccaggacgattgcatttaccactactcagacatttcagtacctctacctgctttttctgttcacgccccttaatccccgtccctcaccctctttcctggaaaaggagagagtttcccgctttctcataacagggcaaagaagaagcggcttgaggatggctaggtacttcagagctgtgaacccaacagaagagactctttcttctttgacacagggttaacctgtgtcaatcagatcccttttgtgggcctctaccctgaatccaagggcctgacattacatctctgccaggggtttttagtatttgtttgtttttacattgtataagggctccagtaagccatatttcttccattgcccttttccgcctaggacgtatttcaagcttcacacttgtttatcgttgccttacttttatgggattgcctgcagagactacagccccagacatattttgcacctcccattgaagaattgagcactgtcattctcaaactccatggtaaagagaacagctgccaccccttctactagatgacctcaaagatacttccaaacccagagattctattatcctaattatggtgcagggtcttaaagagggtgtggcagctgtgacgagtcttaatgaactaagccccatgtggatatgtgtttgttttgttgttgttgttgttgaggggtgggggtatattatttaagtggcgttggatccaggatagaattctagccagagcagctgtcaatagggaaagcacctagcacgtgccaaacatatacatagtaggcattcaatatgaggcagttttctctttctaccccagctcagatttatttcggcacagcccaaccatgattctccatttctgtaaatgcccaattcgcacgtgatataggcaaagctgaagtggagcttcctaccagtcttctcactgctgctataattacagtgatcctattttccaaaccaaattcaaagcatgttgtctgaatacacgttattatgggaacaaaaggactgactccttgaaactgtcctgaaaaatctagaatctattacgctataactggaatataattatggtcgccagtatgttttattagtggagctaaaatgaatggaccacacagagatgcatctcacttcttaatcttaaaatcatttataattgactctttcatactccactcctaaagctgcagaacaccagtgactaaacaaatctaatacttaaagccaggttagagcaatactaactacactagctggacaaagtgagttcatctgctctatttagagggcacaaccaaccaggtcctgttatgagtaaatcatgaccttgagtcccataaaatcccccaaaagttaccatttttttgcttttcttctccagcctgcttctgcttcctccccagtgaggcacaaataaacagatctgtttgattacttgacaagtgtgtttgtcgaaacataaatggctgggcgcagtggcttacacctgtaatcccagcactttgggaggcagaggcagtggattacttgagcccaggaatttgagaccagcctgggcaacatggcaaaagcccatcttaaaaaatatacgaaaaaaattagctgggtgtggtggcatgtgcctgtagtcccagctatcaggaggctgaggtgagagcatctcctgaactaggaggcacaggttgcaatgagccaaattgcaacactgtgctccagcctgggcaagagagtgagaccctgtctgaaacaacaacataaaaacctaaaaaccgccaggcgcagtggctcacacctgtaatcccagcactttgggagacgaggcgggcggatcatgaggtcaggagatcgagaccatcctggctaagatagtgaaccccgcctctactaaaaatacaaaaaatcagctgggcatggtggtgggcgcctgtagtccagctactcaggaggctgaggcaggagaattgcttgaaccctggaggcgtaggttacaggagccgagatcgtgccactgcactccagcgtgggcagcagagtgagactccgtcacacaacacacacacacacacacacacacacacaaaagccaggtgcggtagctcacgcctgtaacccagcactctgggaggccaagtcgggcagatcacgaggtcaggagatcgagaccatccggctaacacggtgaaacacggtctctactaaaaatacaaaaaattagccgggtgcgcggcaggcgcctgtagtcccagctacttgggaggctgaggcaggagaatggcgtgaacccggaggcggagcttgcagtcagcagagatcgcgccactgcactccagcctgggtgacagagtagaccccgtctcaaaaaaaaaaaaaaagcctaaaaacctcagcctgactaaaaatagataataaatgagtgagccatttgcattactaaacaagaatcttaaaaaaaactgttaagaaaactattaattccttgttaggcagtgtggcaattaaattaatcattaaattatccagaaaataaactacaggcagaatggttgcagctagatgagccaaaggcctttattgactcctaactgcaaaggaccaacagcacatctacctgtctacaggtaacatcttttcctaaaccacttagacagagaaatctaacttacctctaaagccctcccagagaaggctcatcagatcttggttaacttgctttaaagtttaacaaacctcattgtcagaaatttttcttctaatattatcttctaatcttctaacctaaatcctttattatagaatttaaagccatttcctctcatatgtctttaactgctatctttaaaacctagatagatgtcattaagttgggatcatctcattggtcctataattatataataaatttcaaaccatcaaacaacaaatctaaatactatatacttagtttgtgagtatttttctgaagcctcctcaaagacttcttaagcaaaagaacccagcccagcttattcttccctcacaggtattccaccaacctttaaagttgcttcacgatctatgaaaactcatagttttggagctcagtggcagagtactctactgaggagaattgacagtgccaaatttaatgataggaaaacaatcatatattccttttttttttttttttttgagtggagtttcactctttttgcccaggctggagtgcaatggtgtgatctccgcttacggcacccctgcctcctgggttcaactgattctcctgcctcagcctcctgagtagctaggattaaggcatgtgcaacacacctggctaattttgtatttttagtagagacagagtttctccatttggtcaagcaggtctcgaactccggcctcaggtgatccgcccacctcagcctcccaaatgctgggattacaggcatgagccatagtgcccagcctctcccctctttgtatagaagtatcaaatcttcacatccaagtatcatctcctgtccactctacttctctacgtttgcagtcggcttcaacctccataaatctaatgcctagcacaatgccagacacaaagtagttactctaacatgttaatgactgattctaaaattttcttgtcaaattacctcattatcagccaggtcggtagctcaagtaatcccagtactttgggaggccaaggcaggctgattgcttgagctcggagttcaagactagcctggccagcatggtgaaaccccgtctctattaaaaatacaatgtggtgtgcacctgtattcccagctactcaggaggctgaggtggaagaatcacttgaaccgggaggcagaggttgcagtgagccgagatcgcaccactgcaccccagcctgggctacaggtgagactctgcctcaaaaaacaacaacaaattacctcattatctttgacgtctgtagttctgatgctgttgccattccctcctcaaaattctcatcctgtgactcgataaatcctggtcttctctaccatctcagctttctttccaattcctaacttcctggaagccagtactataaataaaaatcgagagtgatatgaacatgctcaacacagatgaaccttgaaaacattatgtaagtgaaataagccagacacaaaagaacaaatattgtgtgattccacttatacgaggtcctagagtaggcaaattcagaaagagagaaagtagaatggtggctgccaggagctaggagagggaggaaagggaatttattgtttaatgatttacatagcttcagtttgggaagatgaaaagttctggagatggatggtggtgatggttgcacaacaatgtaaatgtacttaatgccctgaaccatacacttaaaaatggttataatggtacatttatgttatgtgtattttactaagtaacaaaagtttttcaatgagactaaactttaatatttaaagatgtgtacttagatctaaaaaattttaataacaggattgcaataaaagaatgtatggttaattgtataggtaacgtggggttgtaattcattaagaggcatgtgaggtgcttggaaatgttctattttttattccagaggcattacacaggtatactatttataattcataaatttgtacatttatattttatttattcactttatgtgtgctatgtttcacaataaagatgattcaaaataaatatcattatgctaaaactcataatatggtgaaagagggtatatacatgatctcaaagtatctccctaaatgtactgaattattacaaagagaaaagtggtaaatttgcagtgaagaaacctggtatcaccaactcaaccaagtgatctcagttaatataccagtaagggaacaaaaagccatcttgtcacttgatataatgcactgaggatatatcacactttaattgtattcttgccaaaaactataacctgaatctgatcatgagaaaaaatcagataaatccacattaatgggtgctttcagataaacagcccatattctccaaagagaaagagagagagagagaaagaagtgctgccaggtcaagaatgacaatcaaagtctcaagaaatgttctagatttgagaagactacaaagcaaaaccattaaatgtaacagatgatccagaactgaatcctggacaagaacttggtttccttcttctataaataattctaatgggagcactgttgatatctgaataaggtctgtagatagtaacgaatcaatgttattttcctgatcttgataattatactctggttattaaataaaaataaagaaagagaatggtaccaaattatccaagattggagctgggcagtttggtactagcaaaactaaagaaaagttaacctgcacctgacataggaacagcatgaggacaagagaagaatatacttagagactatggaaactgccagaaatcagacccaggatggtagaaggtgaaaaagttcattttgcaaattaaaaacaacaacaacaaaaaaaaaaaaacaaaacaaaccgttactcctaaactcttatgtttcaatggaaagaagggagtttttatgtcctggggctggaaatctaaaaagaatataagagaagacttcagtggacaaggacaccactgtgtcctagggctgagctgtgaaatagttactcatattctgaggtagtgtgtgtacataaagtaacgttacgtacaaagaagggaacaacagactctggggcctacttaagggtggagagggggaggggatgagaatcaaaaactatcagttactatgcttgttacctgtgtggcaaaataatctgacaccaaaccccgtgataatgcaacttacctatttaacaaacctgcacatgtacccctgacctcaaataaaatttaaaaaataataataaataataaagtaaaagtaacatagcatgacacagtgcctactcttggatcctacttcctgtgtcattattaccctttcccattctacttgagcatatcccttctgcagtgtcttcagtacagctaggtctcaaaggctgatctggactgtacagagctagtgtgctaactaacaagtggcaagaatagcagtaatgcatcttggcttactcacatataagcacatcacacagagtctcaagaactgaaagtcagagcaagtcagaaacccataaaactgaccaaaaatttcttcacaaactcaggttcatttattaatttcaatcacttaaatgcaaggtaccattttggctccatggtggtggtggagagagagcagtgtataggatgagtaatatctagtttctagcttcaaagaatttacaatctaggaaggagataagcatagaaataatgatagtacaagatacaataaaagttctgtaggaattgtgagacaaatgaaataattttagtcatgtggttataatgaatacttcttgagcacttactatgttctaattctatttactctcactcctttcttgatttcatccagtcacattgctataaatacaatcatatgccaatgactcctaactacgtctttgacccacacctctctcccaaattaccaattatgtatctaactgcctattcaatatcttcattttgatgtccaattgacatctcaaattcacatgcttaaaattgaactcatctcttctaccaagtctactccacctgcagccttcccctctcagttgatggcaacttcacccttctggttgcttataacaaaaagcttgaagatacttctttttattaacagaaaaaattttaaaagctatgtacttatataatacaccttcaacattagcaacaaatgctcaatcttcttttgttgaaatttttttttttcaaacaaatgctcatcttatttcatctatatccacccacttcccccaaactgatttctaaacaaatcccagactcatataattttaaccaaaatacttctgtgtctaaaatatagagaatattttaggccagcttggtggctcacacttaaaatcccagcactttgggaggctgaggtgggtggaccacctaggtcagaagtttaagaccagcctggccaacatggtgaaaccccatccctattaaaaaaacaaaaattagctgggcatggtggcgagcacctgtagtcccaactacttgggaggctgagcaggagaatcacttgaacctgggaggcggaggttgcactgagccgaaatcacgctgctcactccagcctgggcgacagagtgagactctgtctcaaagaaataaaataaaataaagaaatattttaaacataagaacaccgtcaacacacccaaagaaaatgaacaggccaggcatgtggcttacatcccagaactttgggaggccaatgcaggaggatcacttgagctcaggagtcaagtctgcagtgagcagtgatcatgccactgcacaccagcctgggtgacagtgacagctgtctaaaaaacacatatatataaagttaaattactgtattttaaaatcacttaaaacatactaccaattcaatagttaggcttgtttctttcattttgttttttatttttagtgacgatatttttattgaggtaaaatttacatacagtgaaatctatagctcttaattgtgtaatttttttttttttaagagacagggtcttgctctgtggccgaggctagagtgcaatggctgatcatagctcaccacagccttgaactcctgggctcagctcctgggctcaagcaatcctccagctcagtctcctcggggctgggactacaggtatgcaccaccacacctggctaattttctttcttttgtagagatggggttacactatgttgctcaggtgggtcttgaactcctggctcaagcaattctcccacctcgacctcccaaaatgctgggaacacaggcatgggccacctgcttggccagtaatttgatgagctttgacaaacatatacagccatgaaacctacatataatcaatatatagaacattgtcatcactccagagagttattcatggtcccttccagtcatccccattccacaaggcagtcatattgtaacttctatgaccatagattaattttacctgaatactattttatataaatggaatcacacagtacgtggtcttttgtgtccagcttctttgctcaacattttgcatgttgctgcatgcatcagtacttcattctttttcattgctcagcacattcaattgtatgcaacacaacttgttttattaattctcctattactgcatatttggtttagactattataaataaagttgctatgaacatttataaacaattcgttttgtgaacattgttttcatttatcttgggtagataactagaagtggaactgctgggtcataggatgtggctcctttcactttataagaaactgccaaaaacagtttttgaaaatgactgtaggccactgcagtggctcgtgcctgtaatcccaacattttgggaggctgagttgagaggttcgcttagccagaagttcaagaccagcctgggcaatacagggaggccttatctctacaaaaaaatttttaaaaattagtcaagcatggtggcaccagcctgtagtaccagctactagggaggctaggtgggaagatcaattgagcccaggagttcaaggttgcagtgagctatgatcgcaccattgcactccagcctgggcaacacagcaagactatgtctcttaaaaacaaattaaaaataataaataaaatgattgtataattttatacttccactaacaacatattagtttcaggtgcccacattctcactaacatttggtttgtcagtgtgaagtgatatctcatgtttgtttttttctcatttttttttgagtctcactctgtcacccaggctggagtgcagtagcgcgatcttgctcactgcaagctccgcctcccgggttcacaccattctcctgcctcagcctcctgagcgctgggactacaggcgcccgccaccacgacctattttttttttttttgtattttttagtgagacggggtttcactatgttagccaaaatggtctcaatctcctgtcctcatgatctgccaccttggcctcctaaagtgttgggattacacgcgtgagccaccgtgccctgccatttgttttttcttgaggcagagtctcactttgtcactccagctggagtgtgatggcatgatctagctcactgcaacctctgtctcccgggttcaagcgattcttgtacaacctccca

SEQ ID NO: 5073 - DNA, 25891 bp, Homo sapiens
cctggatattacatgtaaaaaaataaatatagacacagaccttacactatacacaaaaataactcaaaatagattatattttggacctaatggacctagacataaaatgcaaaactgtaaactcttagatgatacagaagaaatgcaaatgaccttggatttgacaatgacttcttaataaaataccaaagaaattactgataaatgaaacttcattaaaattaaaagcttatgcttatgaaagacactgtacaaagaattagaagatgggcagcaaattgggagaaaatgtttgaaaagacatatctcataaaggactataacccaaaatacacaaaaaaatcttaaaatttacaataagaaaaccaacaacaatatttaaaaatagaagatatgaatggatctcaccaaacacatacacaggtggcaaataagcatgtgaaaagctgctcaacatcatgtgtcattaggacttgcaaattaaaagaaaaatgagatatcactacatacctattagaagggcaaaaatccgaaactgagatcaccaaatgctggtgaggatgtggagcaacaggaattctccacacttctcttagccaaaaggccaagaagtgatagcagcaggaactcttattcactgctagtaggatgaaagtggtacagctactttggaagacagtttggcagtttcttacaaaaattttatattgatccagcaagtatacttccttgatacctatgcaaatgaattgaatacttagttcacaaaatccttcacgtggatgtttctaccttctttatgcataattgccaagacttagaataaccaatatgtccatcagtaggtgaatggataaataaactgtggtatacccatacaatgaaaactatggttattcaacactatatgaaaagacatggaggaaactcaaatgcatgtgagtgaagaaatcaatcagaaaaggttacatactgcatgagtccaactgatgcaggacaagcagccccagtattaagtcttagccagggaaggtttttggcttcacccagaaaagaattcaaggtgggctgggtggtattaaataacaacttttattgacatggcagaagtactgttcctttggagcagggttaccccataggcagtggtgtgcagggtagcagctcagaggcaggtttgactcatattcaaccccacttttaattatatgcaaattaatggtagattatgcagaaatcataaaatgagggtggtaacttctgggttgatgggttgttgcaatggaaagggggcagtacttctgggtgttgtcatggcagtggtaaactgacatggcacactggtgagcatgtgttaggggaggtgcttctgcccagacctgttttagctagtccttaatttggtccaatgtctaacccacctccagagttgagttccccttcctacctcacaacaatatgacattctgggaaagcaaaacaatggagtcagtaaaaagattagtggttaccaggagttctggggaggggtagggaataagctgagcctaaaggaattttagagtagtggaactattctgtatgatacaataaggtggatgtatgtcattatatgcttggcaaaacctacagaatgtatgacaccaagagtaacctcatgtaaactgtggactttgggtgatgatgtgtcagtgtaggttcagtgatgtaaaaatctaccactgtgctacactatgctgataagtgggggaggtggtgtgggagaaggggtacatgggaactccctttactttctgctcaatttcgctgtgaacctaaaactgctctaaaattaaaagtctattaaaattaaagtctaaataaagcctattaaaaataaatatatatattaacaatgctgcacctcttattttatttgcaagaaaaagtaataggccttggggaataaaaaatatactaacaagatttgaactaaaacttttgcataactgaaaaatgattatcaaattcagtaagcttggccaatgacatgattcttctatttggacccctgtattatttaatctataattttggtgaccattaatggtggttattaatgcaggatatgcaggtcatacaatgccattaaaaccaaatatcaaaataaactgaattttgagccagatcttcaaattgttacatttcataaaccatgatttccaaaaggaataaagcctatttgaataggcacatttaaataaataagatgcacgcttaatttaaaaatgaatgacatacattttgggggtatttggggcagcatttttaaccctttttgggagtgtgtgatcaaaaaatttgtgagctattgattcagaggccagacgcactagtaactaaatagtcttattgtcgagatcaatgacaaagacatgaataaggggcatttggagcccagcaaagggtcatttcttgtttttgctctgggagacatcacagcattaacatagagcttttatttacttttattttaaatacaaaacgttcatgggccacaggaaagcacgtttgcctaacaatttgaaaatgcccacattttggaattgaggtcttttcctgtatataatgttctttactttttgcaacatgtggttaatgcaaaaataatatttactaagggacaaaaattctttcagctatgccttcttggctggtcccttacccagcctttaaatttattcctgtctcccactttctgtttatttcccccagaaacaaaaggaaaatctttccatccatctgtataaggggcccctgataacacattaggcagtcactctcttagggagagagaggacaataaactagaaaatagaattgccatgtggaatagtgctgatgcatcttttcttacattttgcaaaggttgtaaggtactaaaatcgtggatttttagcccagggagaaacatctaatctagtctccttattttaaagatgaggaaatttagtctcagagagttttagtgcttagccatagaaccatcagtttgatgtagctcatggattatagtctaacactttcactacaactggggacactcaagctcaacaaattaagggacttttctaagattacacagccaatggggggtttaagaggagaccccggtgtttggacactcagaaccctgtgctggactgaagccccttaatgaggtaagatagttctgtcaaaagaaatgagggctgagaagaagtagatggtgagatccatcaggtcatgaagtctcagttcgcatttcctcattgtatgaaaaagatttggctggcctttatctcaccgtacctgggaggtaacctctaggcccttgaaatttcccagtgatagcagtgtccgttactcatggtgggcccttcagactacatctgatactttttctaagaggtcctgttcctgtcttatgtctcttaacataatgtccttcagttctatccatttgcagtgagtgacaggatttcagtcttttttatggctgagagtattcttttttttttttttcccagttggagtgttgctctgttgcccaggctggagtacagtggtgcgatcttagccactgcaacctctgcctcccgggttcaagtgattctcctgcctcagcctcctgaggaacgggactccaggcgcccaccaccacgcccggctaatttttgtattcttagtagagacaggtttcaccatgttggccaggctggtctggaactcctgacctcgtgatccgcccgtctcagctcccaaagtgctgggattacaggcgtgagcctctgcgcctgctatggctgatagtatttattgtctttatccattgtctttatccattcctccattgttggacactgaggttggacatttggttattgtgaataaagctgcaataaacatgggggaacagatgtctctttgatatattatttcctgtcctttgaataaatacccagtagtgggattgctgggtcatatggtagtttatttgtagttttttgtggaacctccatggtattccccatagataaatgtttgagatgaggatatgccaatcttgatctgatcgctgtgaattttttgtatgacaacatcactatgcacccataaatatgtacaattattacatgtccattaaaaaaatttttttttcagttccagtagctgccctgtttggcagttttccacactatagtgagaaggttacatctttggggatgaagaagcttcaggtggggaactttcccagacctcaccctatgcttctccctttggctggtttgatttttatcttttggctaaagtaacattgtaataataagtacagtactttcctgagtctatgagtcattctactgacattacatctgaagaggtagtgggagcctctgagtttgcgccagctggtgagaagggagtgtgacttgggagctctgggacctgtggctgctgtccaagtgaggacagttttgtggagggcagtgcaggtaacctgcaaagtttgcttaaccttgcaatttgactttagaagtcattggactcgtgttcctaagattctaaaactttggggagtaagacagaaatgagtttgaaaatacaaaggttaaaaccgtgagatattttgctttactttcccacagaaactcattttctctaaactccagcctttaccgcctcacgccagctgcactcaaacagtttcccaaggctcccagccatgacctgttctttgaaacatcccagtgcagaacaaacacagacttgttttgttttgttttctgctggggcagaaattgggcaagattgattattagaaagcaagataaaaatcttttagtaacttctctcacgtaggcaaaaaagcaagccaccagcaagcaagcaagcaagaaaaaaaaaaatcacctaatttcttatcttgggtaactgtggtttgctttttgccagacaaattcagggattacttgaacgctgggttgagttcacagcaggttgtctggcactcccctcttcaggaaatcagtctcgtcctgctttaattacctcttggaacaggcaatttttgtgcccaggcatgaattctggaagacagagagaatggaatcatcaagataagccgaactaggatgttgaaggcaggaaagtgcaggcgtgtagcaagaaccagttttacaggaaactaaaggttaatattattgtcactgttattagttttgttttacttgttttgtttattgtgttggatttttttttttttttttgagacagagtctcactcttgttcccaggctggagtgaagtggcatactctcggctcactgcaacctccgcctcctgggttcagcaattcttgtgcctcagcctcctgagtatctgggattacaagcacgcgccacacaccagctaatttttgtattgctagtagagacggggttttaccatgttggccaggctggtttgaactccggacctgaggtgatccacccgcctgccaaagtgctgggattataggcgtgagcactgtggtttttttttgtttttttttttctaactttagatgggagtcttgtcatcaaaataaatacaattgcgtggagctgcttaaaatctgaaaaccaaaaataggaaggcaggggcaaaaagttattttaagaacccccccaccccctccgcctccctgccgcctcccaatcacatcactcctggggctcagcggggagcaggaagcacgtttggttatgccatcttggaataaaagccatggctggatggatcggatccgcttatgatgcatgtagagccgaacttgaacatacaccagctgggggaggggggaagagggggagggggggttgctggggaggcgccgcactattgctgctgctccttcgttctgtagagggcactgccggccctgaaccactcgatctcctctcgttgaaggtgtggttcaggaggttgatttcctggggtgcttgacgatgtacttcagggcttgccagcgtcaagtccttcaggctctgaatggtcagcttgtccacaaggtgaatttgttgtcagctgggtcagcgaaggtcaggggcagcaggccctgcctcctcaggttggttcgtgaatcctggcaaagctcttggtgatgatggcccggccccctgaggtggcgaggctcagcgcggcgtgctcccagcttgagcccttgccatagttctagtccccaatcaccacccactgatgccatatttcttgtagcgggcagtgtcagggaaggggccaaactcgtgggtgaagcatcgtgcacagagttggccttgccattttcaatgttgatggcaccactgagcaagtgttggagatggtgtccaagtgcccacggaacttgagtcaggggccggcagctgagatgtgtcagtggtaccccatgcgggggtgctggtaggtgtcctgccctgggccaaactctgctggggaagctcatctgcatccggagcctccagcttgaacttcttgccatccttgcctgtcggtagttggtctctgggttgaacttgagggttcccacaatggccagggctgtgacagtcctggggatgtgatgaaggcatgggtctcggggttcgtgtcattgtggcccatgaagttctgttgtaggaggtgacaattatgttcttctcctgcttgttgatgtcctttctgtgcaacgaccaatgcaggggccacaagcattggccaggacgatgccacccacatccctcaaggtcgtgcatagccatcctgctcaatggaggcacggatctgctcggagcatggagtaatagtgactgggacttgcacttgaggccatgggccagtgcctgcttggccacacctgctgagcacccatatcttcatagcttgaattggtgcagctgccccacagacccactcagatgtccagagccattcttccttctctgccaccttgcccacttctgccacagggtgagccaggtcagggtgaagggcccattgatgtgcagcttcagttcactggggttaacttcaattagttggtcaaatggcacccagggtcaggcaccaagtgatctttgaattcatcagctagattggcaatgctgcctggcaggtcttgctcatgtacttcttcatcctgaggttgtaatggaacacggaatggttgtcccaatttctaagcccatgttgcagactgtcaccatgccagtgcaggagatgagtctacaacaggcccgtggtattccacgattgcacctgtgccacctttcatggtgaggtgcctgccaccttcaggatcacatctttgggtgaggtccaaccagagagggagcccatcgcttcacgccaatcaccttggggcacttcagctcccaggggatcccagtcatgacatcccagctcggcacccccaactccaatgcagatgccccccaggctgccaccattgggggtgtggagtcagtgccaatcagaagaaccccaggatattcatagttttccagaataatctggtaatgattccagatccaggcttccagaagctcaagccatatttgacacttccagttgccagaaattataaacttcgtggttgatgtccttggcctggtgcaggtctttctcactcccgactgggcctcaatcagatggtcacagtggatggtggatggcatggtcaccttgggagcctctgctgatgaactgcagcatggccatctgggccgtccatcctgcatggtcacgctgtccgccactgctgcaggtacgtcccgccccgctcaatttcctggctggtggggtcatccggggtctgtacacgatcttctctgagagggtcagaggccggttcaatcatttgcaaacaatgtaatgttcttctctagcaggtcatagtggatgtacttaggctcaaagggtctcatcgccccttggcccgttggcacaggactgatgccacatggtactgccgcacacccagagctttcgcagccaagtaaccagtaggctgtagggcaccattttgtgcaaagatcgggtcacattgcaaagacgggtcacgtctgtgtttgttttaaaagagaatatattgtatctacaaggtctgaaaatgcagtaagaaaatggggtgaagatgcttccagcatctggaagagggtaaatcttggaatcaggcactcagccagcactcactctgacttcatcacctctttcagctggatttctgagctcttccctggcaggccaaacccatgaaagcagacggcgccttgggagcttgattcttccaactgtcagggcatgggagtcattctgccattcttgtctcacagcaggagtactgaagagaaccctggcccttttggggaggggggtttaactaggcttgttcttacagaaataatgggctgataggggagattctcttcttcttcacaatttatgtcagatgtaaccctaactctctgaaagataacaggtttggtaattagagatgaaggaatttaattaatttctaaagtatttatggaacaggtactatatatctgacagtgagctgagaatacagaacagagggagaataagacattgctagcagagtgatagtcaagcaggtgaataattatcatctcatatataagagctatagcagagacatgtgcaggtaccatgggggtagaggtgaatgtccgattcacagaacagagacaatggagaaagaagagaagaaagcatctggactggagataatctgcaacgtggaaagggcagggtttttaaagtccatcagattaactgcaaatccctttatccactctgtgtccctgggaaaatcacttaacctttctgagtccctatttaatcaatatgatgaaagagtatactcacatcataagattatgatgaggattagatgagatcttttagactatcatctagagcactgccaggcccatggtcactccccagcaaatgacagctcagtggctaaattaatgtcaaattggattttgtcatttcagtggggaaatggagctgtgggctccattagtgggatgtaaagaagcaagagatgactcatctctcatttgaacaatcaggcagatacgaggacaagcacaattaggtttggagaacaaagggggaacatcagtgtggtttggaatcgttgcagttaacatgctgtgggatgtcacagtaatcacgaaggaggaaaaggaaggagggtcagttggactgccccaaggcaacccttgagccatcaggacagctcaacacctcctctttttcatctttgtacttcctgtcagtcaggcagaggaccgttccttcccatgattcagatgtatcccgcctcatctccctgaactttttgaggacagctataggcaggtacaagccctattggactcattacctcaatcattcttttaattcgatatctatattgaattacctacttatgccaagagctgacctaggacctgaaggaacaattgaatggaatagttgagttccctgtcaataatcttaaatgtacttgcatgtatttgaatattaggcatctctatgaccttcctacgtgcagacagtttaatttgaatagaggagggcatttttccctctcatatcaattctaatacctttatggcaacaagaaaagaaaaaaccatcctgaaatgtttcttagaaatatatgtccaatagtcctaattcaatagatatttattgggtgtgtattataaccatacaccctttctttatctttcagatgaataaaagaatcctaagggaggtagtatggcctaaatgtttggtcctcccaaaatttcagtgtctaagccctaacccctggtggggttatatttgaagatagtcttctaagaaagtaattaaggttaaatgaggtcataatgatggggccctgatccgttggattagcatcccatttccaagtagacacaccagaaatcttgcttctttgctctttctcgaatgtgtgcactgaggaaaggccatatgagcatggagcaagaagccagccatcccccaccacaaaaacagctctcaccaagaactgaattggctggcaccttgatctggacttcccacctctgcaactctgagaaactacatttctgtttaagccacctggcatatgatatggcagcagagctgactaagactgaagggccactgtatcagttagctattgctatataacaaaccctccacaactcaaccacttagacatgaatcatttatgattcataacaaatctgcaggattggtggctcactcctgtaatcccagcactttgggaggctgaggcaggtgggtcacctgagtcaggagttcgagaccagcctgaccaacatgggaaaccacgtctctactaaaaatacaaaattagccgggcatggtggtgcatgcctgtagtcccagctactcgggaggctgaggcagagaatcgcttgaacctgggaggcagaagttgcagtgagccgagatcacaccactgcgcccagcctgggcaacaagagtgaaactccatcaaaggaaggaaggaagggggaggggagggaggggggggagggagggagggagggggagagagagagagagagaaagaaagaaagaaaactgcatgtttgtcaggggttggctgatctaggctggtttccactgtggttagtttacttatgtgtctctcatccttttgctgggatcatcagggaaagtccttctcatggtgatagccagttaagggaacaatgaaaacatgcacatggtcttggagctggcatgtgtttacttcttctcattctattggacaaagcaaatcttttaactggaacgtggttacttttgcctcatttattggctaacgtaggtcaaacagatgagcccaggatcagaacaggaacatgctgtcaatttaaggacaaaggtgtgaatacatggaagggaagaaaattgggatcattaaggcaatcaacacatccaggattcaaatgcaggtctcccttgggccctggctagggttattttcacctgacaaattacttttttgttttaatgtgaaacacatacacagacatgattgctcttagcatctgaagtactgagcctcagcgaagcagaagataggcaaggtggctatcacagccaaccttccagtgtgctttactcccctaaatctcccttatacccttatacatattgtccattcccatgccgcaggctatcgcccctacaccatgactaaggtcatcctatacttcaaaacttgggtcctgagttttcatagtcttcttccaatttcatcaaaacctgctctcaggaggcttgctataagaaaaaaaagctgatccctgaattctggtaacttttactaaaacaaatagctctgagtatttaatctatatgtggctctgtgcctggtgttgggctgctggtattagaaataatcatagaactaattgttaaggagcatacactccagaaggagaaataatgcatgcacaaattaattgtttttattccctgtgcaaaaaaaaattgaatatagtgccaagcattatccagaaaggtggattacagtgataaatcagacagagccacaggccctactctggcagagttagagtttactaaggacccgaggtagatcagagaataccaggaaaagatgacatttctgtagttgagaagaactaggtgagaaatcagagaagggtatggggtgtaggacaggtaacaataagtgggttcatgaaacacatactgggttgtttataagcagtatcagtcttctcggaagtggttaatagaatcgtcgctggagttaatggctgagtttgagtctttgtcttaacactagagggaaggccatggacaagttacttaatttctctgctcagtagtgtgctagtaaatgttaaaaccagttttccaaaaagagggagaaaaggagatggggaagaaggaaggaagcaagaagcaaggaagggagggagggagggagggagggagggacaaagggagggagggagggaggagggaaaccaagctagctctgcctagtagcatcttctattttccatgatgtaaatacttcactatggcctactttaaaataccaacatggtatcagtgagaagtgatgtgcagtagataccattttctagtatttttaccacacagacacagttaacataaatatcctcaaaagctacgtaatagtgaaatgtagtaaaataactagaaagttatgagttttgaatacttggttcgttttaaatataattcatttaattgaaagtttatataacttaatttgtaacaagagctcacttaacaaccaacccataaaatttctaaaactccgtcagcttgctttggctcttgcactcagtgtgagccatcaccaggacagcatagattctgtgtctcaatgtctcatttataaaagaattatatttatttataaatagctccataggtttccctttttttttggagatagaactcgctctgtcaccaggctggagtgcagtggcgcgatctcggctcactgcaacctccgctcctgggttcaagcgattctcctgcctcagcctcccaagtagctgggactacaggcatgaccaccatgcccatgcccagctaatttttgtatttttagtagaacggggtttcaccctgtggccaggatggtcttgatctctcgacctcgtgatctgcctgcctcagcctcccaaagtttgggattacaggcgtgagccaccacgcccagcccatgggcttcttttaaggattaaatagatggttcatagaagacattctgcatctagaaaatcataaacactcagtaaatgttggtatcatcattatttttgctatcattgagtttatttatatgtaaagtatgaatagtatgataccaggaaggattcatggatgagtggggcacttggagatgagaccagccttgtgagaactggtcagtagccatagcctaccattgatagtacaaatgcacattatccccagatatgacctgttcgtcactgtagccttaggacatggcaattgcacacactggcacatgagttctttgtgcggaattgggcatgtggctgaacctaagctggggataacccattctgcacactcaactggagatcgcctcctggctcccttctgtcctagtactgctcatatatctggtttcttctctctcagagccatgggcaccccagaactctgccacctttttctttcttctgtcccatgactctccgggaacagagggctcaggaataaagctgacatttaactgtaagtactgccttaccagacatcttttttttattattatactttaagttctagggtacatgtgcacaatgtcagttttgttacataggtatacatgtgccatgttggtttgctgcacccatcaactcgtctttacattaggtatttctcctaacgctatctctcccccagccccccaacaggccccggttgtgatgttcctctccctgtctccatgtgtattctcattgttcaactctcatttatgaggagaacatgcagtgtttggttttctgttcttgtgttagtttgctgagaatgatggtttcagcttcatccatgtccctgcaaaggacatgaactcatcctttttaatggctgcatagtatccatggtatatatgtgacacattttctttatccagtctatcactgatgggcctttgggtggttccaaatctttgctattgtgaatagtgccgcaataaataggcgcgtgcacgtggtccaggcatttttctaaacactttacatagattcagtcatttgttcttcacaaaattggagaggcaggcacaagtatcatctccattttatggataacaaagacatgtccaaaatcagtctcaagtgagtgaaagagctagaatttgcacctcactgttggtttcaatacccacaccctccttccctacagagctccactgttgccgagctactgtgcttgtcatcgcatgctttcacatagacagcagcagcatcgaagccaagaagataattattttatggtttgggattttaaatatttttggcagcaaagcaacttgactctcttaattgtgctttgcttcatcttgaattaaataattacattgaattctgtgacaaacaatagaatgctagtagtcattcttccaaccacattttttaagtgtcttctatgtgctgtctggtattgctgtgtgcacttgtaatgcagagaatgagataaggcagagttgcccaagaggtatgcagtgtagtgcagtggtagaaaaatactaggggctatgtttgaagaaggtgaaaggttcaattttctcattcaaacatttggaacttttataaggacctaaagacataattacaggacactgtaataagtgtagtaaccaagttggtgcaggcagagaaagagaggagaggaaagggcatttcacacagagggaaaaacattataaagggaacagtcaaaacagtatttttaagaataattccagaagtggaaaagcaaacatctaacagagaggagtcttggctcctaagggtgcagggtataggtaaaaacaggggaaattaaaattgagcatgatgcaagttacagaagcatatcaggggtgtgagagtggtggacactgggtcctcccctctgggtttataggtggcagaactgagatggaagagtctgatgtacggttctcatagagacgacattcagacccagctcttcacgtttgccatttcaaagaacttttgttatcttctaatgtagagagaaaggggactcagattgctgagtaatagggaatcggaatgcatttgagatgtgaattctattggcgatgacagagtctcatttggataaacaatgctcagattgtttagggaatcgcattgatttcctaaacaaaataagtaagtgctccaatgtgtacatatagaagacatccaaagaggaaggggcagaagcctgatacatttagagagacctgctggtaggaacacagcaagtcactggcagggttgggattcgagtctttgtttctggctctcaacctaggacttgttacccaggatcaaaagtcctgatcatctctttgcagcaaaagtgctccttggtctataaactatcccataagttattcttaaagaaagaatgatctaaaaacaaattacttcctctttaaaacttcctgcatgataaaaattagaaatagcaagagccagcattgcagctgcaaatgagaaaataatgggcagtggtatttgcttacaggctgtgtcatgcacatctctaagcctcacttatgccccgtctcctgcccagaattgctcccctttccttcatatctacctaaaatacaccaatccaccaagcactgggtcaaaccacacttcctcatggcaacactcctaatatctgcagcctgcaaagatcatttccactttctgccttcccgagcatgaatgggaaattgactgtaagaaagtcaggagccaagtctgtagtcacttgtgttttccctaattgttttctgtggaaatgtcttatcatcatgacagaagaacatgctcctaaggataaaacgacatgtcttctctttattgtgttccctaatgatagttaatatatggacagtgcttagaaaataaatgctcattatgctcattcagtaaacatcgcatagcttatgcagaatatacaggtgagagatgaacaggaaactatccctaccatcaaaaagctgccactccctgggaataccgatgtttaaagaaatgaagcagagtcctattcagaataaatttgtacccttatttcaccaaagaaggtaccggaacacaacatagacttgctgaggtctatgagttaagagtaaagactcagagttcaaacaaagccggggggaacatcagggcattctgaggttctgcaggtggtctctcttgtccgggacaaagagtctgtgggagctgtcctcagaagggttctgaccctttgtgttttgaggtcctaaaataagacccgcctgagcctgagaagaggacaagagaaaaggagaactaacattctagggccacagtaggactcaacatgctgtcctgactggagccagcccaaagacacattctttcttagcgtgtgattgcacaggtggattgagggcatgttttccaagctcatggcagtaccttgaatagatggcccatcttcagcaactgtgcccagccctaccttcaaggagtcttcaggcagcttccacttctgcataccagaaggtgatcatgccagcaccctctccactcctcagacacagctcacccaggctggcttctattcactccagcacccttccctgtggggcagaagagaacagaaaggaccaacctggacttactctaatgcttgctcatttaatatgggaccccttggtgccactagggatgagccagctgaaggagttaccactaggagcatagggaaggtctgaacctctgtaggttgaggacaccctaagagcattagttatgcccagctccatcctcacctgcacatgaatgttggaaagaatacttggtatacagtaggagagagcatttaaaaatcaaatttattgaggtagaatttaggtacaataatgagtgcatctattttaagtgaacagtgtgaagcattttgttatatgtatccacccattaactagtgagggcatagaatattcccgtcaccctagaaagttctctcttgccccctcttgtcaactctccttgcttcccagcccagatacccactgatctgaggcctatcactacagcaagttttgcctcttctagaatttcatatgcatggaattatacagtatgttctcttttggtccagcttcatagggtcagcataattgtttccaacattttattatgtaatttttcagaatacagaaaagttaaaaaaattttacagtagattcctaacctagactctatcattaagatttccttccctgctttattatatttctatgcatttatccatcttctattcatctaccttttttttgatacatttcaaagtaaattgcagacaccagtcaacttccttttaaatacgtcggatgttttactaactcactttcaattttaattaatttactaatgcaatatttgttatgattttcttttaaggtaaaattaacatacaataaaacacaaaaatgtttaacatattttttttgagttttgacaaatacacatacccatgttaccaaaacccctatcgaaacatacagtttacatcactctagaattcccccatgccttttcccaagaaacacccttccccccactgcaaagcaacttctgatctttttctaccatagattagtttatctgttctagaacttcatatagtggaaacaccacatgtacgttcttttgtaagcctcttacttagcataatgcctttcacttcaccatgtccttgtattatcaatatttcattctttttattgttgaatagtattccatatatcaatatactgcaatgtgtttatcctcttattgatggacatcttgactatttcaattctgatcgataaagctataagtgtttttatacaaatgtttctatgaacatatgttttgttctttttattagggaaatacctgggaggagaaattctagatcatagagtacgtgtgtgttagttttataagaaacggccagactttctctgaagttttggtatcatttcacacacccccagaaactgataagagctgtacttgctccctgtaggaactaagtgtatgtttctaggttcttttctttctttcttccttcttttccctcctttagttatttattgttttactttagtattcccattagtgtttagtgatttctcactaggattttgttgttgttgttgttgttgttttttctgagatggagtcttgctctgtctcgcaggctggagtgcagtgtcgtgatctcggttactgcaacctccacctcctgggttcaagcaattctcctgcctcgacctcctgaatagtgggactacaagcacgtgccaccacgccaggctaatttttgtacttttagtagagatgaatttcactatgttggccaggatggtctcaatctcctgaccttgtgatgcaccagcctcacctcccaaagtgctgggattacaggcatgagccaccgcacccagccctcactatggtttaatgtgcatttccctttatatatgcttattggtcactcgtatatctcctctggtgacattctgttcaaatcttttacctactttttaaatttctttttgtgtctttttgttactgagaaaattattcatataatttggatacaagtcttctgtctgatgatagatacataatatttagtggcttacattttaaattttctttttatctttttgaattttgctgtatatatctaaggatacaacatgatgtttcgacatacatagagatagtgacgtggctaccatagtcaagcaattaacacatccattatctgacatagttactcccctttttaaattcagtaccttttgaaagtagaattttaactttttattacttttcttttatggctagtgcagttttgatgcactttagggaaatctttgcctgcatcaggccatgaacatttttcttctgtgttttctttttttcaagaaattttacaatttcagcatttacatttaggtctataatctattttgtttgttttggaggtaggatttgagatgctatttgtttatatgggttctttagaaatgatgtaggagtgtattatttataccttaaatatgtattagaatttaccattgaagccctctaggcctggagtttctttgggggaaggttttaaattattcattcaatattctcggtagatataggcctttaggttttctattttctctttagttacttttattaatttacacatttccaaaagaatttcatctcatctaggctataaattggaagcaattgtttataatatttatattatttaatatctgttcttaaggtggttccagcagacccaatataccatgatatatgccataacgggagaatgcagagcaaatgtggaagagtatagggaatgatttcttgaagtggtatttaagcttagttttagagatgagaaagaatttttaaggtaaggaggcaatgcagagagggtagaaagaggaaccgcatgtgcaaagaacccgcggcaagtgagagcctgacactgtcaaggcatcgtcgttcagtgtggtggatttggtggaagatgatgtgagctatgagagaattaaacaggagcttgaagccttgatacccaagattttctcaaattcccatttatctggtgttttgtttatttaattgcctctagcacaagaatataagcgttgtgaatgcaagaagttttgccaattttgtaaccattatatatatatcctcaggacctagaacagctcccgcgatgcagcgggaattcgtacatttttgttgattgaatgaatcagttaatcaatacccaaatgtgtccacattaaaatgttttctataaagattaaaaaaataatgcagctgagttaaaagtcctaggaggttgcaggctctccagtgttcagccctctagccccagcctgtcaacctggacaattcacagcaggcatggatggctataaggttttctgttctgacagtggtaccaccaagctttcatatgagaactggaaaaggctgctggttgtaggctcaccatcatagttaaatgcactgatgaaatctctttgaatttcccagagtaatttaggggctccctcctctgagcttccatggtatcctgaaacagctccttcattacacaccttatatctccacacacattattacacgcattatatccctccttttggaggtgcaaggagagagcttgaaagctaagaaggtagaagataaattttactatttcaagccactgccctgtggaataagagaaagttcacagtggtaaattcttcccgctttacccaactgggacgtttagaaagttaccaagcctcaccaccatttagctagatgttgaggcaagtcttccattttacagatgggaaaactgaggcttggagaggcagagtgcctgcccaatgtgacacagccactcaaaatggggaagggatgacatttaggactcctaactggtgtccagtaatacacagcaccagcatcaccttcttcttcatctttcctttcctccctctacagttgctcattcctctctgtgtgtcaccttcccacacagatcccagtgagcctcttaattcttgtttacaagcctgtcttcccatggtcaaaaataggacatagtaggtgcttgtctggtcactcatatatcacagtggttaagaatacaggaatcagagagaaagtacatttaatcccaactccaatgtaatgaagcattgggaaaagtatgtgacctctccatgcctcaaatcatcattggtaaaatcatgcacattgaagtcctatacaaagtaagtgttcaataattttagctgttattactgttaataataaatatttgttgaacatcattttcaggctaacataaaattcccaaaagacatagccatttagcaatcctgactggctagcccagagtcccatctgacctatgttaaaataaagttggaagaaaaaataaattactggactctgtgtgctagcagtgggggcagagataattcatctttctgcaaatgaaaattaatcatcttggctttgctcgcaggcaggcagcaagaatgccagttgctcccttccctgccactggcgggattgttcagaaatgaagaaagaagatgggattgttacaggaggcagcctcacaaactacatcctccactcagatatgggcattatcagcttcctcttggtcctttctattaccacttacttagccaccatggtgacaggctcccagcatagcagcctcgtgcttatagcattattattctttaatcggtttcaatacatttcaacaatacacgcttttatctaggactgctaaaaaaaaaaaaacaaacacctatctgctcaacaattggaatagagtctaaggcattagatgcatatgctaaaatgtctgcttgtgagataaacacacattgtgtgtgtcttcttttgtacctcagagaacatttctgaataggtggtggtccatttcctgagtctccttctcaaaattattaacagaaaatacaatccttcttcatatataggcaaagctctttacttttggtcccaagcattttgtgagtgccttctacaaagatactagtgatagttacgtgacacgggtgaggttcgtgtctattttcacataagacaaaattgaaacccagagcctttatagggctgggctaaagtcgtgtctcaactagggacagatttttctatcttccagacccacaattcttctacagcaatatggtaatgcctgttcatctacccaacacccattttccctttcttgtcactaaaaaagaacaccatgtgcccagctaaaaatactcacctttccatatttttctgcagccaactgtagccatgtgctgtgtgttggtgatgtgaagtgtttgagaaacaatcttaaaggatacagactcagcagccctttagccttgtagcccttttttttttcttttttttatcatttgggcctctaatgtaacataggagtctggaagtgcagcagctatcttgggaccatgaggtgacattggggccaatgctaaggatggaagacagaaatgatggaaagagtctactatcctatggcatggtggaccactacaccaagatgaaatggcctattcctgcctgcttctgaccacattaatctgttgttcttgggtgagttgttgacaaacatgagtcctaattgatactgaacacagtgtttctctttaactgtaatgtcctttatttccttgtgatatactttggatctgtgtctccacccaatctcatgttgaattgaaggtggggcatagtgagaggtgactggatcttgggggtggatttttttcatgaatggtttagtgccatccccttgttgctgtcctcgctgtagtgacttctctgagatctggctctttacagctgtgtagcaccttggattctttattacttctgctcccagataggaaatgcctgctcccccttgaccttctgacatgactagaagcttcctgagggctcctggaagcagatgctgggtttatgtttccgtacagcctgtagaactgtaagccaattacctcttttcttgtaaattacccagtctcagatatttcttatagcagtgcaagaataacagttctgtcaatcaagtaaactcctgttcttctattaaacctctgctcaagtgctcccattctgtgaaatcttctttgaacttcccagagtaacttaggggctccctcctctgagcttcgtggcatcctgtaaacagctccttcattacacccattgtatcaggtagctgagcatttgatgtctgttctctccccacaaacaccttcaaggacaaggactacaacttatagtcccagcctgtcacttagtaggcactcaataacattttatgtaattaattgcttcacctacgtggctcacccacattaatccattttttgttatctttttggaaatctgttggcccaatttttaatattgatgtttttcagttacatactcagaacttttgtagttttcttccaagaatgacccattcagtctaataattcatcatgctatgaagatgctgatgcccagcccagattcctactaggaatttccagcccaggtcccctctggagcaccattatcatatagctcacattggtgggtctactggttaccagcactgtttgggggcccatctgtcagaatccaagtcttagctttccacttattaaatatgtgactttgaagtggttatttaaactctctgtgtctgttttttctctatcaatgaggaaaacaataatacttaggtagaatttttgtgagggttaaaggcctaccacacatgtaaactacttagaaccatccaggttcatggtaactgttggttatgattttctcattagaccagcatacctgggtgccctatatacacttcccctcagtatgttcattccagctcacctctttcttctaaactcaggaggctgctcaccttcctgtattctctctctcgttaatgccatcatctctctagtctccctggccagaaacctaaattagacattgccttctcttaacccttgcttcttaagttgaaaaagatttgtcaaatggtcaaacatatttgaattttttgagttcatcttcacatcatagaactggtcagacacaaagtatcttgaatgaattttgggatagtctccaacttgtacccctgctgtgtttttataccatgaattacttccacctattttggccacaatcagctttcccttgtgcaaataggatcatgcctcttccttattaaatccctcagtagctccccataatctccaggatcatgatttcagccactagtcaaggagctttcttctctgactgttccctgctcatctgtgcagcttcacactctgctggtctctccacatgaccgtaccatggctaccttgaattgtctcttcctcagatccaccttgttaattcagccttcatgcctttgattatgtttttcttcccttctgctatgcccttttccgaacctgctcccctgcccagtctagaggattgattttctgctcattcttcaagttttagtttacctgcaccatgcttctgtattcctccaagatttctcagacagatgaggggctccttgactccagttcagatggacctgtcaaatttaaacctcacaggatggtaactgcttttcggcatgaccttttctttagattataaacttctcatagaccaaaacaaggccatttttgttcatcttttggctgcagtgcatagcccagtgcctgaaatagttgacactttataaataattgtggaaaagtcaggggtcctcaagccccagggaaccaggctgcgcatcatgaggtgagcaataggaagcaagcacagcttcatctgtatttacagccactccccactgcttgcattaccacctggctctacttcctgtcagatcagctgcagcatcagattctcatatgagtgtgaaccttatgtgaactgcacgtgcaagagatctaggttgtgtgccccttatgagaatctaatgcctgagatctgaggaggagctgaggcagtgttgctaaccctggggagtagttgcaaatacagataacattagcagagagtcttgactgcacacagaccataataaatcaattgcttgtagactatatcaaaaccttatccatgactggcaagtgacaagttgcatctggtggcaggctttaatcagaatctgacacttactttagtctgcgtatggcctgcccgttattttaccatttccacggcacctctttcccacagtgcacacttgtctcagtcagttttcgtaagcacacaagctatcctagccaaaatgagtaaaaaacaaatgtcactggaaagcttcttggaaaagggggaagacccaatgatgaaacagctagaagactctcttaagactgccaacaaaaagacggctgatttgaaagaaaatgccaagagtcctacttaaattatagcatcattgcaacaggaggatatattcttcaagcctgctttgtataatatttggtgaccaactatccagcagagccatgaaccttcaaaactgcttcgccacatggagaccaagcaccctgcattaaaagacaagtcttggagtttttccaaaagcaaaacatgtgaacacaaagaatgaaagcaattattgaaggctccacttcatcaaatgtgtctgcactgagagggtcattcttagtagctaactgcattactaagccaagaagccctttactgttggtgaagacttgatcctgcctgctgctaaggatactgtcatgaatttgtttggagaagctgcagttcagaaggtggaatgtgtttctctttcagcagcaccataactagaagaattggtgaaatagcagaggatattgaggcacaattgttagaaggtttaatgagtcaccatggtatgcaatccgggttgatgagtctaccagtgttgacaaaaggcaacaatgcttgtttttgtgcaatatatttttcaggaggatgtacatgagaataattatgtgtacttttgttgccactgaacaccacagctgcagaactattcaagtcttagaagattacatatcaggaaaactgaactggtcattttgtgttggtatatgcatggacagagtgctgccatgactggatggctttctggtttcactactcaggtcaaagaggttgcttctgatgtgagtctatgcactgtgtcatccatagagaaatgctgcctagccgaaaaatgtcaccgaacttaacgttttgcaggatgtgattaaaattatcaatcacattaaagtatatgcactaactcatgtctgtgtagctctgtgatgagatgaacatagagcacacacgtcttctcttaacacagaaacgaggtggttttctttcttttctttttttttagacagagt

SEQ ID NO: 5074 - DNA, 38183 bp, Homo sapiens
ggctgctggcaatccctggtgatccttaacttgtgggatccctccagtcacatgactttttcttcctgtgtgtcttcagttgttttatctctagggctgtctgtctccgtgtccacacttccccattttataaggacatcggtcatattggattatggcccacccataagacctcatttagcttgattacttctgtaaagaccctatttccaaataaggtcatattctgacatactgggattagaacttctgcatatctttttgggagacacaagccaacctcataacagagggttcagtacagggcaggacccaacccagcatggaagtgggctatattcagtggggcaggagaggggagaagctatgtaaatacactgacaacaatagtgtagtttcacacagataagaaggaggtacagatatagacagagagaaagctagaaagaaccctgtggtgttggattggaacggcagtataagtgtgaactcatggttttcaaaatgataggtatagaaataaatacagctgtcggacgtggtggctcaagcctgtaatcccagcactttgggaggccgaggcaggtggacacttgaagtcaggagttcaagaccagcctgaccaacatggtgaaaccccgtctctacaaaaaaaaaaaaaaaaaaattagccgggcgtggtggtgcatgcctgtaatcccagctactgggaggctgaggcaggagaatggcttgaacctgggaggcagaagttgcaatgagccgagtcgtgccattgaactccagcctgggcaacaagagcaatactccgtctcaaaaaaagaaaaaaatatagctgtaagtacaatatacgcatttgttcattcattctctggctctgtccaggagagacctgaggacagtgacacttgggcagcagggagcaagatcaccttgtgtgtgtacttggctctaaataccattctctactatgaggaacccaagccccttggagaaaattcccagtccgagcccagggcaaggtaaataggagaggagatgagcatttcatgctgcctgaaatcagggaggtcttaaagaacgatggggatcattgaaaaggacacaggagcccatttgaagagctgtcactggccaaagttggcatgatttgagcattaaaataaatcatggtaggtacgactgtaagccatttaataaaatagaaatccgtgagtccacactgattatataagttaaaaagaacacaagaaggaaaacaaactcttccttaggtagaatgccaactattaaatacaaaggaatggtgacattttatttatttatttatttaacaatagcaacttttattttagaccagggggtgtacgtgcccctttgttatctcataatactttagcattttagaatagtttttctaattctgtgaaaaatgataattcatatcccaaaccacatggtaagtgtagtacccggtagttagttcttcaatccttgcctctctgcctcacccctctaagtagttccctgtgtcattgttgccatctttatgcccattagcacccaatgtttagctcccacttataagtgaaatatacagtatttggttttctgttcctgcattaatttgcttaggataatggcttccagctcatctatgctgctgcaaaggacatatttcattctttttatggctgtgtagtattccgtggtgtatatataccacatttcctttatccagtccactgttaacgggcaaccaggttgattcatgtctttgctattgtgaatagtgccgcaatgaacatatgagcacaggtgtctttttgatatatactcagtaatgggattgctgggtcaaatggttgttctgctttaagttttttaaaaatctccaaactgctttccacaatggctgaactaatttacattcctatcaatagcataaagcatttgcttttctctgctgcctcaccagcgtctattgttttatgactttttaataaagtcattccaactgatgtgagatagcatctcattgtggttttgatttgcatctctctgagattagtgatattgagcatttttcatatctgttggctgcttgtatgtcttctttggagagtgtctgttcatttcttttgcccactttttattggggttattttattttattttatttttgcttgctgaattgcctaagttctgtacagattctgaatattagacccttgctgcatgcgtgtgcgaatattttctcccattctgtaggttgtctgtttactctgttgatagtgtccttgctgtgcagaagctttttagtttacttaggacccacttgtcaatttttgtttatattgaattgcttttaagaacttagtcataaatttttccccaagaatgatgtctagagtggtgctcctaggttttcttctaggattcttataatttgaggtcctacatttaaacttttaatcctcttgagttaatttttgtatatggtgaaaggtaagggtccagtttcattcttttgtgtaggctggccagctatcgtatcaccatttattgaatagggagtgcttcccccattgcttattctgtcagctttgttgaagatcagatggctgcgggtattcagctttatttctgtgttccttggtctatgtgtctgtttttataccagtgctatgctgcttcgattattgtagccttagatagttttaatttgtgtaatgtgatgcctcaggctttgttcttttggctcaggattgtttggctattcgagcttttttttggttccatatgaattttagaatagttttttctaattcttgaaaaatgacagtggtagtttgacaggaatagcattgagtttgtggaatgctttgggttatggccattgtaatgatactgattcttccaatccatgagcatggaatgtttttccaatgtttgtgtcatctatgatgtcttttaccagtgctttgtggttctccttgtagagatctttatgaccttgcttagctgcattcctaagtattttatttgtgtgtgtgtgtgtgtgactatgcaaatgggattgcattcttgatttggctctcagcttgaactttattggtgcacagaatactactgatttgtgcacattgattttgtttccaactttatagaagttgttcatcagttccggggacttttggtggagtctttagggttttctaggtataaaatcatatcatcaaggagagagaaagtttgacttcttcttttcctatttggatgtcttttatttctttctcttgttgattgctctggctaggacttctgaatgacagaatttttaaaagtcaccatttggcaatgtcatcatgataatgtttaattaaattaaggaacatcattgcatactgaaattatacaaggtgggagtgggatgagaaagcttaaaagtatctccctaccaaatgcttataaattacgagtggaaggggaagtaactttacaatagagaaacttgattggtgtcaagttaatcaaatgtcagagcgaacgacattagtgatgggacagattgacaatgaaagctaataggactcaccagaataatccagcatcacttctgtgctattttggccaaaaaagcataacccagttctaacatcagacagagccaaatcgagggacattattcaaaacaaccaacctgcagtcttcgagtgtcgaggaaaaaacaaggcatctgtttcaaactggaggcccgaaagacatggcaactagagccatgcatttagagagaatgcaaagtcccggatggattttcttgttacaaaaccatattgagaagcttagcgaaactcaaagggggtttccacatgaagggtatgtgagagttcttgtatcattcctttaacgctctgtattttgaaatagtttcagaataaaaatggaaatggaaaaaatgcaatgttaacatatacgagttactactttcaacaagttatcttccttttcagcctcaatttcttcatctgtaaggtgaagacagtaacagctacataaaggttattgggagagatggagaagcccccagccgaaggtctgctcacagcgtaaatgctcaagccctggtcttatgagtactacgttcttgccaacattttcttgggtttcttagtctctaaaagatcgtaattgcaagacacggtattttacataccactgaaggaaaaaacaaacaaacaaacgaaacattcaatgaattcctgacggtgtgattcttctcgcttagaacttttaatacttattgaagaactctgttagactcattcaaatgtagatttttatcccctgctgctctatgatgactttaaaaggaaagggtcagtcaagtgaattggctgaggtgttcctaaagctccttcacatttgggtctggtgtccggagtgattttgactcagagtctcgggttcttcgtttctccaccgacagcatcctctgtgctcctgagggcatccaggcccgcagcctcccagtcccacagagacctcagcaaagacaggcagagtggggacacctgggagaaaagagagcccgggacgtcatttaattccatcctctccagccctggagaagcccctgcagggtttttccatgccaggcaggacctcacactgaccggagtgcctgagagaaccacacatgccttcctctaccctgggcttctctgctagggtgaggccctgccagctcttcctggccaaccctgcccttcctggtagaggaaagcaaagaacaacaatcaggccagaattccagtggcttcgaggcaggttcctgccctccatttcctccattcccctcattcttgccctccattcccctcattcctgcctgctgcctttctcctgggaggcagccccatgtaggagaaatatgactgcgttttgttgtgtcttgcactgtgattcatcttgtctttattcaaacttttcatatttggttcaccgtgaatagttctgcatcagttgggatttttttaaaccatattgcattaaaatattacttacaacaattctgaatttttaaatgcctgtttaaattttgagcacgagagactgcctcactcacctgacttaattctgctggccctgctgtgctcatggagccactcattcattcattcattcattcatcattcattcattcatctattcatttgcacacagtcaaaggtgcaatttctcctctgtacaggccatgtgctaggtatttgggagggaagtgcaagccggacacaagccagcactgaaatagtgtcagaagaaagacagccatgaacacacatgaccatatgacacatggtggggtgggcggcagggcaaagaggacatcggggaaatcaacatgccaccagctaccacttgtaggggttctcctgtggccagctctgagctaaggtcttcctgcacagaatctcactggattcctcaacagtccttccaggtttgtagatgcttctgcaaaagtaacagacagatggatgtccgaggcttggggaagtaacacgcagatgatttgcacaaggacacgctttaagaagcagtgacttggaagtccaacacagatctgtctggctctgggctcaaaccagctattgttattgcgccacttccacctgcatccccatcaagcagtcagggaaggctgcatggaggaggccctggtcagctgaggcttgaaggaggcctaggagtttataggaaggtaaattggagtaggaggtttctggaagtaagaaaagtcacgtgcactattagcaaagtaggcctgggccggcactgttcctctttctgcttctctgtttcctgatgacatcaacataaataggaaacgtgggaggtcactctgcctagaggctccagaagaagactggtctctcccaccacacagaggtatggccggcgtccaggagcagggctgaggggtggggtcagagcaggggggaatgtggggagtccggatgaaaaaggacagggggagcctggggggcgtcctgtgggtagctgtgccctggggattggaggagttagggcttggcctcttaggatgacctgagcccagactcctagggcggccgtggatggggaggcagccaggggtgccaagctgcttgggtgttgtaggagagctctgggaggactcagcctcgctagcgggatctggttggtcctggtgggaaggacgcctagtgggggaagagagctcaggcctgggagtcaggcacctatagtctgtcttcgctttgtcactaagtgctggtggtagtgagagcaccccctgtccaccctgggcttctgtctcctcatctgtggatggggagcatggatagtccctgacatcttggtttagaaagagagagaacgcatgctcggtgtttgcccgtgtgtgcatttgtgtgtgtgcctgtgtgtgtatgtgcatgtgcggatgctggggatgcaggagtgcagagagactaagaggcagagggtgaaacctggaagcttgctcgctgaggcccagagctgggtgcggtgtggcttgagaagctcactttgaacttgagaaaagcccagcactttgcccagagacataccaggcactatccagcaatctctctctctctcttctctctctcagtctctctctctgtctgtctgtctttttagttatgacactctgccctgtgatttgggttgctgatttgggttggggcccaggtgtgtgtgttctgtacccaagtatgtggctgggtgggtgggtatctggggtgcctgcttcagggtgtgtgcaggtgtgtgtactgccctgagaatgaaagggcaggtgtttcactgggaccttgtcagacaggtgctagcgacagctgcatatgtgcaatttttagtcttcaaaaaccctgctgttatatttttgtacagccaattctaatttttttctatcatctttcctgctttgtaatcattttataatgagtaaacattcctattagcttttggtcactctttttttcatccagcagttttatttatattgttccatatacagatataccaacaccacaggataattcatgagttgtataaggaatgtatttaatctaaacaagcaactacacagaaacctaccttcatgaaaattagaataatctagaattattagcacaagagacaaagtccccagcaatttcttttccctagttccatagcttattctttcaccacatgtattcttccagaacattttctaagcatgatacaagcatatagtttttctttcctgtttgttttttgttttgttttgttttgtttttgtgacagagttttactcttgtcgccaggctggaatgcagtggtgcaatcttggctcactgcaacctctgcctcccgggttcagtgattctcctgcctcagcctcctgagtagccgggattacaggcatgagccaccacacgggctaatttttgtatttttagtagagacagggtttcaccatattggccaggctggtctcaactcctgacctcagatgatccgcctgtctcagcctcccaaaatgctgggattacaggctgagccactgtgccaggctggtagtttttctttttacagaaatgggattattttatttaatatatatatatatatattcctaattttttcacttaatattgtattttggaatatttccaatttctacaataatacatacagatttaactcgttaagtaaccctaagaaatatgtggctttattaggatgggtacaccacaattcatctaatctcacgttgatcgacacctagattgttctaatttttccacatctgtgaaagtgtttctgtagcctaaattactaaatgcagaatgctgtgcagaggttgtgcgttagaaattataataggtattgtcaaatcagcctcaaagtgctgagctaagctgacgtccccaaggtagtgcataaagggtccaatttacctttagagaattatcaatcttctaattttgtccaatattatgtatggaaattctcaatgtcgcgtgattttttctttccctgattatgggtgaagttgtacattttctatatgtggattggccttttgatttcatttatgatgaatgtggagaaatttttgttcatctcctgttgaattctcttttcatcttaacttttggagtgactcatttattacgtgtattaataatccatttatatatgtgaaaatatattctcccaggttatgacttatctttttctttaccatgtttaagatgtctttgtcatataaaaatgttttcattgttaagtcaaacctgtcattacttcttactttatggttctgattttggtgtcttgtaaacctctaagatcacaggtgtcttgtaaacctctttttctttatggtttctggttttgtgtcttgaaacctctaagattacagaaagagttttaatattttactattttggttttgactttgagatttttagcccacctagaatttagagaagtgataatgtgtaaagtaacttttaaaaataattaccatctaattgtcttaacattgctaatttgagtgtgtgatttctcctctcttcaatgatttgaagtgcccctattacatcctaggctctatacatacttcgttattttctttattgttttctcttccatttggctgtcactacattcttattatttttctagcgaatggagcaagtctctcatctctggtttgttataatttagatcagtttgccaaggccaggcacagtggctcatgcctataatcccagcactttgggaggcgaggcaggcagatcccttgaagttggacgttcaagaccagcctggccaacacggtgaaacccatgtctactaaaaatacgaaaaattagccgggtttggtggtgtgcacctgtaatccagctacttgggatgctgaagtgggagaactgcttgaacccaggaggcaaagtttgcagtagccgagatcacgccactgcactccagcctgggcaacagagtgagactccaactcaaaataaaaataaaaatcagtttgccaagcccattaaattcctttttggaattttcatgttgatgcattgaatttagagatgatctgagggacattgaccactggaagtaaagacaatagtggagcctcctgtgtgaggctttgacaggaggacactaacgtgcccccttgactctgtcatgcctttggtttctggcagactttcagtgatgccaacgtttccgccactgcttcatttgcagggtttgtttgttcatttaaccagaaatgtcttgtttattattaaatatttaggagtgctgtcaagatcagcttatccttttttcccttttaatccgttcatctgtttgtttgaatctaaataggtttcttaagggttctccttccatgtatggagtaccctctacttggccatgagtcttcttcttttaaaagtctttgtcaggttgacctatgaaattgtttttgtctggagtaatttgtattttgcttttcccccctagtttttatccctgccattcaatttcttcataagttgggaatgtttatccctgccattcaatttcttcatgagcttgggaatgtaatatgtgctgtttattttgagtaagaaggtgtttggtttttctcttctcttttctctctcttccttttctgtccctcccatcccttctctgtcatcctcctgtccccatgcttactcttcattcttgtgatttttaatctttatgtttttagggatttaaaatgtattgaacttatattttctggtcgggcacagtggctcacgcctgtaatcccagcactttgggaggccaaggtgggcagatacttgaggccaggagttgagaccaacctggccaacatggtgaaacccagcctctactaagatacaaaaactagccaggcgtggtggtgcatgcctgtagtcccagctacttgggaggcaagtcacaagagtcgcttgaaccccggaggcagagattgcagtgagccgagatcatgccttgcactccagcctgggtgatggggtgagattctgtctcaaaaaaaaaaaatagtatttttttaaagaaaccatatttgctgccagcatttgggtttatttagcacatatatgatcttcaaaacaagaggagatctttagcaagttttcagttctcttccattctccaccccagcctacagcaaactcccacattaaaatcatctgagttttagttcaatattcttctttaacttactgtaagtgttacaggtttatttacctcagtatttcagctttcttggatttttttttccgaaatataacctagagtaatttctttcagaaaagatctgaaaaactttctttgtccttaatactcaaaattttttgtgtcctttaaatgtcaaagaaaacttggcattttgtgattctggtttaagcataattttcccttggtattttcaagacatctatttaaagttcagagtctctatgtgaaatctttagccaatctgacccttgttgcattcaaagtatcctatttgttttctctggaagcatttctgggatcatcctcatattcttgcaagacgaaaagtttaccagtgaaactaggcatggctttattaaaaggaatcttgggagttaaccctgatctctgtcccctatacaaaacctcatcgtagtagcctccccccttgaatacagattccttactgtctttgaaaatattttaaaaaggagtcttgttctttattgagtggcctcttgtctccttgaaagcccgtgaagctttccccatttgctgttgtatctgtttggctgcacatggaaaatccctaagcacagaggcttaacaacatagaagtttctttttcccagcatataaaagatgcccagaggtgcagtttcaggctagtatggttgctccagagtgagagtgggaatccagcttcctctcttctgttgcatcatcttcacatatggcttccatcctcaaggtaacctcatggtccaaaatactgctgaagctccagctatcacctccaagttgcaggctggaagaaggaagaaagacagaggacaaaaatgaacccctcccacctaagtcaactgccattgagcagccttttttggaagcatacacaatgtttctattctcatctccttggatcacgtttagtcacttgactgcacctgtggcaacggagtataggaaggaaatagacctttttattctgtgtagcaataaactcagtaaaaccttggcttctgttgccaggaggaaagggacacggtcttccattgtctttcagataggtagctgacattgtctgccatacctgctcttaattctctccaccccctgcttctgatgctggaatttttgaatttctttcccaaacctaaagttttctctaagacttttcatctcttgactatttgctctattttatatatctatctttttcatttgtggtatccattctgtggttggcccactattgattgttgttgtttttttgtttgtttgtttttttgagacagagtctaggctggagtgccatggcaacggtctcagctcactgcaacctccacctcccaggttcaacaattctcctgcctcagcctccagaatagttgggattacagacgtgcgccaccatggccgctatttttttttttttttgcgtttttagtaaagacggggttctaccacgttggccaggtggtctcaaactcctgacctcaagtgatctgcccaccttggcctcccaaagtgctgggatacaggcatgagccaccgcgcccaggctttgattgatttttttttaaattatggatctctatcttcaaattccaagaactctgttctttgcatagaagtgtcttcttttaaatggctagattctcaaatctccctgaggatgctgatttagatgtcttaatgtactcttttatttttctgtatctgtacatgtctgtagaagtgtctgctgggttagcatatgtcagaatagatgtcgctgttttgacatttgggaaactgaatcactattggcatagaggtcagggacagagtcagaggcagcccactgcgggctcgaatctcaacctgttccttaccaaccgtgtgactgtcaccaattacataacatcccacccctgttttctcatctacaaagtggagcttctagtggtacctatacatagatgtattcatatccgtaaaaccttttgaataatgcctggctcatggaaacactgcaatattgtcagccactatcatgaattctctctgtgtatgtgagtactgttttgctctttgatgatattgatttgttttaaccttttaaagtaaaagacactaacctgtccccataattctggttggtatggtctatatgttgaagtgcacccaagtttatgttgcaaccaagccccaatgtgagaatatctggaggtagtgcctgtggcaccctataaaataccccaggagctcccttgcttattccatgtgagattatagggagaagactgcaaggaacaggccctaccagatagtgaatctgcccgcaccttgatcttgaacttcccagcctccagaactatgaaaataaactttgttactagtaagccactccatctatggtatgttgttacagtagcctaaggatgagtacattggtgcaaagattttctgtttgcactccgtcctttccttttatggttagtcagtttgacaaattacagaagatttcacttttatgtacttctgccagcctttgtcttgtgatgtctcctatgcttttaagcttaaagagttcaaaggcattcactcctctggtttcagctttcataggatgtaacattttacatttaaatttataattaacttgttatttggggatggtgtaaaatggggttttagataggcatttttatgttgttaatcaatgattttagcattttttaaatttaatatttcatcgcttcacattgattcctgattccttctcagtctgggtcaagtagagtttgtttccagccagcatgtccattgatagattctgtgtgtgtgtatgttgtctgtgcatgtatctgtatgtgtgtgtgtatgtctgtgtgtaggtggtatatgcgaggtgtatgtgtgtgtgtgttgtgcatgtatgtgtatgtgtgtctgtgtatgtgtgcctcttgtgtgaatttctgtgtatgtgtgaatgtgtgtgcatgtttgtgtgtatatgtgtatattgtgtatatacatgtatgtatctgtgttgttcatgtgtgtatgtgtgtctgtgtctctggtgtgtgtttgtatgtgtgtgtgcatgtttgtgtgtgtatatgtgtgtatattgtatgttctgtgtgtgtctgtgtctgcctctgtgtgtgtgtctgtgtgtgcatttgtgtgtatactgtgggtatgtgtgtgcatgttttgtgtgtacgtgtatatatgtatgtatctgtgtgtgctgtgtgttgtgcgtgtgtgtgcctgcgtgtgtccgtgtgcttgtgtgtgtgtgtgtgttgcatgggcatcttgagtgaagcttccaacaatctaacagaagaaaaggagccacactttctgttctgctctcttgggtacttcccagaccagtgaaatgaaagggaggaaacccccgcctccgaggagaaaagggaactggcaagcagagggtggggggatgacggtaaaaggagcggggtggggagagcacaggccctgtggaagtgaggacatgtgtgtgtacatgtgttcattccaggggatgacactgtggcatccaacagccgtggaccagcagcccacggggagcttataggagtcaaatcctaggcccccgtctcagctgctctgctgtctagcgcattgtgcagtgtaggtgtcagtgatccaagtggggacccagtccctcaggccacacagcgcatgtccatgccttcatgccgcaggagactgaggggtcatgcatgagggccacttctctgggttgtcccacaacacgggcggtgtccctgggacacgtggaaggggaggggcagctcactgctgacactccttctgcaggcctggaggaggcagaggccaggagggagaggtcccaagagcctgtgaatgggtctggcctggctcccagctgggcaggaacacaggacttcaggacactaaggacctgtcatgcccatggccagcacccaccagtgctggtgcctgcctgtccagagctgaccaggagatggtgctggcccaggggctgctctccatggccctgctggccctgtgctgggagccagcctggcaggggcagaaggtgagtcccgtggctcccacccacttccctgtccctgtctcactgctgcaccctgggggagggccgcagcgtatcctcaggatcctgcccgccagccccctcctgctcccctccctctgtctctccccctggccttccctgggcctcccccgcttcctcctcctgcacattcctgctcatcctgtcttggaaagtccagctgagcgtgtctggcttcttgcccacatttctcagggcggcactcccggcccctaggctccaggatggctgctctgccgtttccctgcccctccttccccagcagacactctctgtgcctcagtggttcccacctcgggactttgctcctgcagggccttggctggggttctctccctgcttcagccgctagcacctccttgtgcctgaagcccgcactgggatgctcctgggctcttgaggtgaaatggccctcccaagggctcccagagacctggcttctgtgataatgctgggaccacagtccccttaaaaataccaggctcctgaggacggggactagagaggaggtgggaggttgcagggtagaacctgccacgctgcatcccagggctgagtgtgtgccccctcccaggctgcacagtcggtccggggccaggcctgtgcttgatgcatgtccctgtcctggggtggggggaggggaccgtgccaggaacagcacactgcggaggcccagaaaccatgctgagaaccaacagaatgtcttgctctgccaggagaggagggtccgcaaccaggagcccaccccggcagacatgaacacatgtcatgtgcctggccacctggtgcctctgcagggacctgggagacccctccccagagcgggcatcccaaagcagctgggggtgatggtgacaagggtccctgcaggaaagagaggtgaccccttctacccctcttgtcagaaaccatcccgctgcagaccctgcgctgctacaacgactcaccagccacatcacctgcaggtgggcagacacccaggatgcccagcggctcgtcaacggaccctcattcgccgggtgaatgagtgagtgatgctgggggcaggggccacgggcagggctacgacgtcccctgtgcctggcatggggcgacagtgtagagagggacctgtcaggtcacctcggggtgggagtggacagaggacagaggaggagggaggccctgcaagagctcctgcccgccaggcacctgcgaggccgggtgctgccgtctgacctggggtttctgcggagtgcccctacactgatgttggtgacaatggtggtggtggcaatggtgaaaatcttctcttgtttatcacaatttaacacaattgccccacatgacctatcttagttcctcctcactgtgaggtggcagggccaggccacgaagccccagctgtgccactgcctgcctgtccagagtagaccaggagagatggcgctagcctgggagttcacagatgggaaaactgaggccctggaggtgagtgccagccctggccacggggtagacagtggcagagcaagctgtgtggacgtgtctgggaggggctccgcgctctcccagggcccccctccgtatgtgggctgccacctctcccacccagctctcctgggcacgtgccacaagggaaggggaccagaatcgctctggggtgttggccaggtctaaatcagccataaattaagtaattaaatagctggaaccagagaggcagatgacacccattggaggtcaccccagcgttggggggcggggccggctctgccacccccacccctcaccgccttcagttctccagggcgtctctgtcggaccttctccattctcctcaaagaccacctgcccctccctgtgacctgcttcctgctgctctgacacaacaggggaccagggagaactccccacccaccccacactcacactccccaccccctttgcccaccgccggggcctgggctggaccagggctcctgtctgaggcctgagacacgatgctgtctggtcctgttgctcagaacatcacggcccccaagtccccactctgccctgtgccacccaccatgccctctcccagatctttcccaattgccttgcaaacctgccccaaccccctctcagatgcccacaggagtgagcgcctgggcatctcctgacctggcaaccctgcggcccctctttctctgcttcctttgcagcagcattccctaaagagttgtccacattcaccacgtccagtgtctttccagccattcctcctgggcccactcccctaggatgctgcccccaccaggccacccaaactgctctggtcaagtcagcaaatgtcccagggagcaggatctcatggttgggcctccgccttcttcctattgaccaggggcagcccctgacaaggaggaccaccgcggcctccctgcagtttctcttgacctgactctgcccacagctcacccagtgcccccggggccctgcccatcctcctctttcccttgtctgctgcctcctgatggcaagacacccaggcccagtccatggacctcctctctctgtatccactctgcagagaccccctcaggcccctggggcatctcccaaaggtgacctcagcccacaattcccctaagctccagccctccaggcgtactggcctctccacctgtcactagacaacaggtgtctccgactccaaacgtcctcaaccaaagtcccgctctcacccgagcgcgctgctgcctctgtcttccccatctccctttctaaatgggagctcctagtggctcaactaaacaacagggaggattttgttttgtttttaagtctcttttgtcaccattccttcctactgctacatccctccaccagcaaatgctgccaaccttatctcaagcagaacatgaatccacccacgccagcctgaccaccctgttgcacgccacttcctgtcacctgaatattccagagcctcgtaactgggctccctgcttccaacattgccacattcccacctcagtctattcgaaccgaggaccctcaggaatcctttcaaagcatttatcaaaatctacaacacctctgctatgactgtttcccactcactcgcagtgagatccaatcccatcatgtagatggatgggtccctagacctccctatcacacgctctactccctgcgcactggttttaggccaagccacgcgcacaccaaactctgcctgtcccagggcctttgcacgtgctgttcccatttcctgaaatctcacaatttgcacagtccctccctcaatgcctttaacattctgcccccaggtcacctcttagagaagcctgcttgtcccatatttcaaattgcctccctggcccagcccttcctccccctcacctgcttcttgctttatttttccacatgaagttctctccactgcacacgctacaactttgttccatgcgggtccccttctcccaggatggcagctccgtgggcaggatttttggtgttttatcactgctggcccctgattctgaacagagccaggcatgtggtgagcactcgggaacctttcgtgagtcagtgatacccatacaccctgggctaagccgtgtcctctcccacagggacctcctggagccagtgtcctgtgacctcagtgatgacatgccctggtcagcctcccccatccccgctgcgtgcccaggagatgtgtcattccctgccagagttttgtcgtcatgacgttgactacttctcattccaaccagacaggcctctgggcacccggctcaccgtcatctgacccagcatggtgaggggctgggggccctgcccggggcttggtttcctgtgtggaagcgggggcaccaggggtggtccagggagtcttcaaggcagaaggctgtggcttggggtgggtgagggtttcttgagggatgagggtatggtctggttacatggagacttcagagcagggggcccctgacaaaggcttctcctgtgcccctggctgctaccacctcccactaagccagggcttccagcactgcaggcttgtcttgaagaaaaccgttctcaccactcacttagaaactaccaagttagaaaactctgtccgcttagttgtttcatctcatctctgaagcaacccattcctggatgtggcccttgaggcccaggaggtcagatgcctcctctgaagtcccacagcgagcagtaatgacagagatggggtcagccttcccgggggcttcctgcatggtagacaggagcttgtctcctcgctgccctggaggaggggccccggtgtgggccgaaatcccacagtgtccatgaagccatctgtggtctagggtggggtagatgattattttatgtagttaggtttatttgcctctatattagaaagaaatataacctgcacttcgaagtcctggattcaaggaatggttgcttagaatgaagctaaacctgaaaagggacacgttttatgaaagttttcgttgcgtggcaaaaacccatgctggtggcaggctggtaggaggtactgcaggctgtcattggggtctcagaaccacggcaggcttggtgctgttattggtgcctttggctgctgctgaaacgagacagagggaggtgactagtccaaggcctctctactgctgctggcagagctgagatccgtgcaggatggtctgagtccccggtcctaaccaccgaaccacctggtgctctttgcaaggtcacacggaaggggctctgaccatggcttcctgcccttttttgccacaacatcataaaccactgccagaggaggggatcagttaggccaccaggagtccatcagaagcaacatttcccacatgggtttgatggacacgagagtcccttccttcccgaatggagctcagggggcccagctggagggaggggaaacactgtatgccgtccaccgtgagaacttactgacagtggcggtgggtgcctcatgcagggggtaaagggcagggcccctgggagatcagaacaggcttcccgagggaagagctttgcaactcagatctgaagggtagacaggaggggagggcagtaagagctctctggcagggtaacagctgtgcagaggctgggggatcagaagggcatgggcagctgggaacctgctcaccattgtgtccagggagcatcagcttcaagggctggacagcggtgggagaagcaggagacacaggtaaggacctgtccctggagaggcttctgtctcctgcagtctaggtagaggggaccctctaggcatggagagcactgaggggaaatgacatgatcagatgtgatgtgagaatgctggggacaggggacttacagggtagattggaggagcattagttgggaagaagttgaaattcaggctgtggcctaaagcactcattcctagaaatgatgaggacacactggctaggagatggggacatgagggcatgcaaatcatagttcagatatacacacaatcattcattcaaccttctttccttgagcgcctacataagccaacgaagcagtcaacaaacagccagcaaccctgcccttggagcttacagcctggaaacaaggaaggtttctaaggcgaggagacaacttagatatagggagagaagtgtggcccttggcctcctggagcctgtgttggtagcgaggtagggtccagcctaatgcagattagcaatgaatcaaggatgctgggaggtctgggcaggcgacaggcatgcatctgatctgctctgagtctccatgtttggagaccttgacattttacttcctctatgagtttctccgtctgtgaaatgagctggtggactcaagaggttctcttgagttggctgagcaggtttctgatggggctcccagtctgcgcagtttgtggcgcttccgagagggctctgccgggaagagctccccctccatgacagcctcgggggctggggtgcagtgacccatgagggacgcctgtcctggctgtgggtgaggaggggcggttcccctctgtgtgtctgccgttctgggttgatggttcctgacatgctctagcatgccataacccagtccagcagagagcacttacatcctatgtgtgaggatgttttcgtttgaaagccatccccagcaagcagacaccagaaaccagaaatcaggtgccgtgtcttcattctgcattttcttaacaacccagagttcccaggagatagatgcttgccttgtggctgcaaggatttcatgagagccccaaagttgcttacgcgtatttgttcattcattcactcattcaccttgccccatattcactgagaagccgcatctcagcctggaggtagggaagggggtcaggaccaatcccaccacccccatctcctcacaccttaggggaggcagacacagaagcataggaatccctcagcgtggtaaggccctggtggagggaattccactgagctatggtgaaatgagagaaggaatggggattccgcctggagatgcagatccgaggatgttcctagagccggaggcatttgcccgggcactgacaacaggaaggaccctgggcaggaggaagggagcttggacagcaggagggggaggccgctgaaccgcaggcccctctgctagcaggagccacccaggccgcagcgtgggcgtggggagcctcaggacagaggaggctccaatgagtttcctcgccagcgctttttatgggttcgggtcacgtgcgcattgcaatctgcacggctttccattgctttcatgttgaaacctacagttttgcagatgaagggctgaggctcacagaggagacgggtcttgctcaaggtcctcagctgctgggggcaggggtggcctggaaccccctgtgtccacacaaaaggccatgcagccctgactgccccccagcggtccagcccttaggtgcccttcacttcctcccctccagtcagcctcctgagcccagggacctgcagatcagcaccgaccaggaccacttcctgctgactggagtgtggcccttgggagtccccagagccactggttgtccccaggggatctggagttgaggtggtctacaagcggcttcaggactcttgggaggtaggaaccacggccagctctgcccagcccgaagggatgggcagcacccctcctccagcacccactgtctcctgacaggacgagccatcctcctctccaacacctcccaggccaccctggggccagagcacctcatgcccacagcacctacgtggcccgagtacggacccgcctggccccaggttctcggctctcaggactcccagcaagtggagcccagaggtttgctgggactcccagccaggtaatgttgccagagccaggaaatgccccgtggtgggagggcaggctcatcaggagctcctggcacagcagggtcctgggctccacctgggggcttcccagatctcctgctgccatctttccagtagcgtcccgggccgtcccacctctactgtgaccactgaccagtaggactctgcatctgttcactttggtttccagttttctgcacgttctctgccaatggcaattacaataataacaacaacagtgtattagcagctgtgtgttaatggaggctacaggatgctcagggcttacccacatttttcgttcaatccccaaacactgaaacttagatactatttccattctcccgggagggcgtgcagtgcacagaactctctctctctctctcggagctgttggacacacagctggcaggttcagctgaagtttcagccctggtcttttggccccagagctcatgacctctgtgtgatgaatcaacggtgggcacccactgagagctatgggagggatgaatgacggagtacatgaggacctgctccaacccaggggatgaggcccagccccagaacctggagtgcttctttgacggggccgcgtgctcagctgctcctgggaggtgaggaaggaggtggccagctcggtctcctttggccattctacaagcccagcccagatgcagggtgagcatcttttttctccatcccctcccctctcttggccttgctctctccaagcttcctcctgtccctggggccccagcagaagccacagccaccctaagctctcctccctcccgtgtgccctccctctccctgccctcagctctgctggctcctcagggaggaagagtgctccccagtgctgagggaggggctcggcagcctccacacaggcaccactgccagattcccgtgcccgaccccgcgacccacggccaatacatcgtcttgttcagccaaggagggcagagaaacacataaagagctcagtgaacagtgagtttgctctagcccgctgtggggatggtctgggaccagcacaccctcattgtgtaacccgaatcagtcagggttcctcctggccccgtcttcatgtttgtcactttcaaagagatgcagtccagtgccaaaagtgaacagagaagcaatgaaaccacgacggcagtggccaaaaacaggagcagactttaaaacctctgatctcttgtccttttcttctgcttccctctcccatcctgcagctcctaaatctccactgctagccacaccctcctggtcctgtcaccaaaaccttccctttcatcctcattggattttcctctttctgatatccgaaattccccaccgactgatattctatcttaatgtaattgatctatgatgtacttttcaactggagcctgtggtgtgtacaaatagtgtgatccttggaggttaacatccctcgtttctgtgatgtaacaaggaccccagtgcaatgaacctctcacgttgtttcatgatgaccaagttcttccatccagtctttagcatatgtgagggcagaggccaatttgtcttaattacctgggtttgaatttaccattaactctcttgggtcctcactggaaaaaggaattctgattgttcaaaagcacaggatatattaagggcctcaataatgcctggcacataagagacctcagcaaattacgggcattcatattatgtttatacgtgaaggcatcaaggttataagcattctcttttttcttttgggtagactgaagctcagaaggttgagtggcttacttaaagctgcacagctattagtaggcagatcaagattagagttagaacttctcactccctgcccagtttctgctttctttaccctttgcctctttcaagttggggtctgccggccaggtgggaggtgctgtctgcaaagggcttccctttctctttggccatatctggctggggagaggcctcacctagatgttgttgaaggcctgttacagccgctttatggggattttctggcgatgagaacgtgtgaatgtcctggcctttagtcaactccctacactctgagagtgtcagacaagagagcccatcacactggtgggattgcaatctttgcctctccactgcttagctgcctttccttagggcaagttacttaatggttctgtgactcagtttcctgtttgtgaaaagtgaaggttaatagtacccaccatatagggctgttagaatggagtgaataattcatgtagaataagtatgtataacagtggctaaaacatagtcaggctgggcgcgtggctcacgcctgtaatcccagcactttgggaggccaaggcatgtggatcacgtgaggcaggagctcaagaccagcctggccaacatggtgaaaccccgtctccactgaaaatacaaaattagctgggcttggtggcgggtgcctgtaatcccagctactcgggaggctgaggcagagaatcacttgaacccaggaggcagaggttgcagttagccaagatcacaccactgcactcagcctgggcaacagagtgagactccgtctcaaaaaaaaaaaaaaaaaatagccagttgctagaatagaaccaactaacagtggttttatttttactgcaaaaaataaaaataaaaatggagtagtgcaagcactgggccacatcactacaaaacaagtgtatctcagcatctcccagagaataccactcaggtcaaaacatgatatagtgaagtggggatgaaaaggatccaacctgggcagaacctggggtctggtgccagtggagacagccccagtgtctagcatgagacacgggaatgttccgttggagggtgggtatgatgactctcctgaaagcttccctccctccagccagatggcccctccatccctcaacgtgaccaaggatggagacagctacagcctgcgctggaaacaatgaaaatgcgatacgaacacatagaccacacatttgagatccagtacaggaagacacggccacgtggaaggtgagggcctttgcccagggacgggagaaacactggggaggcgggagaagggaaagcaaccagaggcattccacctgcaaggcgtcgggcccttggcagtgaccagtgagaggtagccactgggacgtggtgatcactaggctgtgtggtcagcaggtactgtcctgtctcttggtgaagtaactgaggtttggaaaagtggcgtggcttggccaactgaacagctgaccctgagtccccaggcaacagaagaccctctgggcagggaggggttgaaggccactgggaagaaggttttcaaaagtcatgaaagtttggggttatttcctcagaggatctcatctggacacacatggaggctcagacagagctgcttctaatgagtcgggggtgccccaggccagggctcggtcccctgcctccacagagcccagaacagaaaccacagaaccaccccacaccttcagtctagaaatggggcaactgaggctaggagggaggtgggccagtggggagccaggagcgggccctggggtcctgaacccccattctcagggtccagagtccagtcgcctgcactgcgttcctgaaaaggccacaatatgggtgcaagctgccccagaagggctggagctgagaaggctcaaaatagggtgggacaggtggcttcagggttctgggcctcagtgtgtcaatgtcaggggctgcactgacaggcggagtccccggtgccatccgaagtgctgtcgtgggtgggccctcagggaggatccacggtggtgagagagaagccgcagcaggcctgggtatggcaggagctaggagccagcgaagccgagggtccaggtgggagggatttgcagctgtcccacgggcaccgggccaggcctcaccctcagtgccaacccacaggacagcaagaccggaccctccagaacgcccacagcatggccctgccagccctggagccctccaccaggtactggccagggtgagggtcaggacctcccgcaccggctacaacgggatctggagtgagtggatgaggcgcgctcctgggacaccgagtcgggtaggtgaaggctggagtccagagcttctgccaggaccagctcatagtttctcactgccagaaaatccccaatgcagcagccgtagcagcctgcaacaacttgtaggtgagccgtctccccgattagatggtggccaaagagaaagggaggcctttgcagagagcacctcccacctggtcatcagacccgcaagttgaaagaggcaagggtaaagcaggcagaaactgggcgtggagtcagaagttctccacccactcttcatgagcagcacagctgggcagaggatgccacatctctgggtgggcacagagatgtggggctccaaccccactccactcaggcctccttccctcccttggaccactagtcgttggaaagtgacactggtgttcagtacagactgcaagtgaggacttgagggagcagaggagagcaggtctcagatcgctcctcctttaaactgggacttaggcttctgttaatatggcccttggtttcttacttttgggactaccaagtttttgtggttgctcagcccgagtttcctgttaccatggaagaagaaaatctagagccacagactgggtccttggattggaaggttttgctgtgattccttatcttcccacctccctgcacttgctgcgtgcactgacccctcacctttcaccatagtgacaccaggcgactcccgcagaacaagacaagtccaaggggtggtttcagagagagtaaggtacaggagatattgggagcaacccaagtccccagccaggcttggtagcggcaggggcccgggagagggccacaaccaggtagaaaggaggccggaccaatgggcccaagagaggaggagaggggagtcctggaggaacctggcctgggagctcagggctgggcagcaggtgggatcagggcctctggaggggcctttgctcctgctggtgcctctgccactatgcctttccccatcccacctctaatccttcctattactggaggcccagctaatatgccacctccttcaggaagcccctgtgattgccatgaacagtggttcttgccctccctgtagcacctcctgtgctataatcctggaaaggatctgaccctcctgtgtcctcccagcactttgaacactgtgggggttagaccaatgcccttcccagcatggatctggcctctctcccctaatcccccaaggcagtagttccagagccctgggcctgcacagagcggggtcttaaggaatactgcaccaaccccacccctgccctgaggtcgatttcccgcccagatgctgacattcctctttctccccggctgcggaagtgctgcctatgtgggtgctggccctcatcgtgatcttcctcaccatcgctgtgccctggccctccgcttctgtggcatctacgggtacaggtgaggggactctgtggggctggggtggcagccgagaccccagagggcactggggaatcccacccagctccctccaggccctctctgccgctcccttcctgggcctcagtttcccctctgggcatgagcatgggagcagctgccatgaggtctctgatggctgtcacctccgtggtgtcttccaggctgcgcagaaagtggaggagaagatccccaaccccagcaagagccacctgttccaggtaggaactggctgcgagggcggagtgggggcttctctgttcctgcctctcttgtctctgtccccacctcctccttccttcctgtgggctttgggtggtagggatgtaggtggactgggctttgggagctttggggtggggccagcacttggaaattcattcccgggattccctggagtgcccacacctggcccgcctgccagagctctgcatggagcccagtggagagaactgagtgtggggatgcctgggaagggtgggctcacagagggggttcctgctaccaggatggatggggtgtcaggaggcagagggctccccaaggacaagatacctgggctgagctttgagggtcccagtggtgccaggtgcaaaagttgctctggctcagggcatcttgagggtggagacagaaacccttcaggaaggggctgaaggggtgggacaggaggctgggggccatgttgggaggctgagatgaccatggggagacaccagcgtgtgggtgatgggagccctatagtcaggcaggcagggccagctttgccgtggaggggtctcttggctggtgtggaggagaaatgggggtgagcatggagacaggcacccaggttagaaaaatcacaggaaaagggccctgtcctcaggtagcagggacatgggggagtccccgcccctctctgggcctcactttgctggtgtcaaaaggccgtggccagtcctgagaagtggagattcttctcttgtctgggggctccttgaatcctcctgcacccccgtcacctctgccttgcccccacctcggacctcctgatgctcaccggcccaaatgtctctgctcttcagaacgggagcgcagagctttggcccccaggcagcatgtcggccttcactagcgggagcccccacaccaggggccgtggggcagccgcttccctgagctggaggggtgagtgggctctggatcactcctgacctttggggttcatacggggggctgactccattgtggaaatcaggactcaagtgaggctgcctgtggctcactgtgaagggatccaagggagctggtttgcactaagcaggaggcacctgggggggatgtgaggaagaacttcctctttccaggtaaggaagtccagacaaggggagtgaccggaagtgaaagagggaaacagttggccttcccctccctggtgcctcagaggcgtcacactgcagaggcctcatggggtagctggggctgcagactcccggaactcggcgcctgagccggcagctgaccaccaactcggcagggagaagggggtggcatgttgatagaatgatggaagggttgcccagtgcacaggctgggcatgagcctggtgctgaggaggatggactttaaggtcaaaagggagagggtaccagccttgcagaggaagaccttggctcagcatggaggatggagctcctgagccacggaaagactgaatccatgtcccatgtcttctctggggcccctgctccctcaaccctgtcccgttcaggttctctctgtgagatctggggacatcagggcttccagagaaccatctccaccccaccaagacccttgtgcctgacccgatcatctgcccagggtggtcccaactcttctgcccattttcttcccacagggtgttcctgtaggattcggggacagcgaggtgtcacctctcaccatagaggaccccaagcatgtcttgatccaccatctgggcctgacacgactccagctgcctcagatctacccacagagcagcccccagcccccagccaggcccgcctgccgcctcccacacacctgagaaacaggcttccactttgacttcaatgggccctacctggggccgccccacagccgctccctacctgacatccgggccagccggagcccccacaggagggtgggagccagaagtccccacctccagggtcccggagtacctgtgtctgcctgctggggggcaggtgcaactggtccctctggcccaggcgagggaccgggacaggccgtggaagtggagagaaggccgagccagggggctgcagggagtcctccctggagtccgggggaggccctgcccctcctgctcttgggccaagggtgggaggacggaccaaaaggacagccctgtggctatacccatgagctctggggacactgaggaccctgagtggcctctggttatgtctcctctgcagacctggtattcaccccaaactcaggggcctgtctgtctccctagttccctctctgggcctcccctcagaccagacccccagcttatgtctgggctggccagtggaccccctggagccccaggccctgtgaagtcagggtttgagggcttgtggagctccctccaattgagggccggtcccccaggtcaccaaggaacaatcctgtccccctgaggccaaaagccctgtcctgaacccaggggaacgcccggcagatgtgtccccaaatccccacagcccgagggcctccttgtcctgcagcaagtgggcgactattgcttcctcccggcctggggcccggccctctctcgctccggagtaaaccttcttccccgggacccggtctgagatcaagaacctagaccaggcttttcaagtcaagaagcccccaggccaggctgtgcccaggtgcccgtcattcagctcttcaaagccctgaagcagcaggactacctgtctctgccccttgggaggtcaacaagcctggggaggtgtgttgagacccccaggcctagacaggcaggggatggagagggcttgccttccctcccgcctgaccttcctcagtcatttctgcaaagcaaggggcagcctcctgtcaaggtagctagaggcctgggaaaggagatagccttgctccgcccccttgaccttcagcaaatcacttctctccctgcgctcacacagacacacacacaccacgtacatgcacacatttttcctgtcaggttaacttatttgtaggttctgcattattaaactttctagatatactcattccatctccccctcatttttttaatcaggtttccttgctttgccatttttcttccttcttttttcactgatttattatgagagtggggctgaggtctggctgagccttatcagactgagatgcagctggttgtgttgaggacttgtgtgggctgccttccccggcagtcgctgatgcacatgacatgattctcatctgggtgcagaggtgggaggcccaggtgggcacccgtgggggttagggcttggaagagtggcacaggactgggcacgctcgtgaggctcagggaattcagactagcctcgattgtcactccgagaaatgggcatggtatgggggtcgggggggcggtgcaagggacgcacatgagagactgtttgggagcttctgggggccctgctagttgtctcagtgatgtctgtgggacctccagtcccttgagaccccacgtctgtagagaagttaacggcccaagtggtgggcaggctggcgggacctggggaacatcagggaggagtccagagcccacgtctactgcggaaaagtcaggggaaactgccaaacaaaggaaatgccccaaaggcatatatgctttagggcctttggtccaaatggcccgggtggccactttccagatagaccaggcaactctccctcccaccggccacagatgaggggctgctgatcttgcctgggcctgcaccagggattatggttcttttaaatctttgcctttcagatacaggaaaataatggcattaaattgctttaatttgcattattttagttatccagtttgcacatattttataggtatcttaggcatcgattggtattttttaactgggccaagcccattaaggtcttcttctgttgggtgctatcattttctgattaagtctttttgactattgacatacagtcttcacagatggtggagtgtttttcccccaaatctgttgtttgtcttataatgttgtatagaggttttatggtgtatgaatatgaatgcttctgtaatgtcaaacagatccctagtaaatccttcttcacttttactgtcagatttacaaaggtcctcccattgcaaagcagtgtttgcctaatttatatattgtttttctagttcattttgtgtttccaacttttcatgtaaaatttaattatttttgaatgtgtggatgtgagactgaggtgccttttggtactgaaattcttttccatgtacctgaagtgttacttttgtgatataggaaatccttgtatatatactttattgtccctaggcttcctattttgttaccttgctttctctatggcatccaccattttgattgtctacttttatgatatgttttcataagtggttaagcaagtattctcgttacttttgctctaaatccctattcattacagcaatgttggtggtcaaagaaaatgataaacaacttgaatttcaatggtcctgaaatacataacaacattttagtacattgtaaagtagaatcctctgtcataatgaacaagatgaaccaatgtggattagaaagaagtccgagatattaattccaaatatccagacattgttaaagggaaaaaattgcaataaaatatttgtaacataaaacaaaggaaaccctgaatttgtgtgtgcatgttggtgtagttggaggaaggggttgctctttgaacctcaattgctattgtaagtgatacagctccagtgactggaggaacaccagggtccttatcttgcgccgatttaaataaaacgacacggaaacacatggagtggttttaaggagtggaagtttaataggcaagaaagaaggaagaagctcccctgtacagagacagagggaggggggtccaaagctgagagaggaaaccctgagtgccacagaaataagccagttatatgaggaggtagagaaggcagtatctgatttgcatagggctcaggggattggtttgaccaggcatgtcttcatgtaacccctgaaaaacctggccctttcaccctagcattttaatatgcaaatgcaggcgccatgatgttctacacaggtgggactatgtgggggtggccatattgccaggcaaaatggggacaaggaaaagatggcgggaatccccatgtttgggtggacccagtttctaacgtctgcatttgcatatcaaaggttgccagcctgattctaagagccggggctttcctgctaacaagaaacgttttttggagctgcttttaaaacagaaacgaaaacttcccaaggaccactttcctctttatctgcctcaaataattttttaataattcctataacacaaggaaatgaatctgccaaacagaagggcctttggtctttggggcactacagtgggtacatgatggcgtgggaacaccacgcaatggagggagacgcagggcactcctgggaaaatccaggagggatgaggaagaggaaagacagtgagggaaaggaggataaagaacacacttttaaaaaatcgttcttattatctgaaattccaacacaactgaacgtcctgtatttttccctagtcatgagagtaaaaactaaatagagactgagttccccatacaaataactgagagtgatcgagagcttatcctggcaggccccattcgagtgacctctaagatcaattcatttagatactatggaagtgaagatactatctttatcatttttgtcattgaggaaactaaggcacagagatgtcatacacttgccccaggtctgccagcaggtaaggggcagagccaagatttgaactgtagccctgttctcagagcctgccctcaaaaggtaagtctctcacctaaagatccatacggagatgtaaatgatccatgttggttggcaagacagaaaaatccataaaccaaataaattgatttggtgcagggggagattgaatcagaggtgaccctgaaaagtgtctgtttatctgggagctgaacctgaaggtgcaattctcacccattggagtccagagagaccttccctggaggactgcagcccctcatctgtcttcccctgagaacccagcccagagccatgcatgtagtaggtgatcatgaggtgagcaaggcctgcaggaggctgtccctaagatggaggagaacaaaaaacttattgggggatgaaagggagggcaggaagcagaagtgggctagggaagccattggccatccaggttgacatttgtccccccatggggaacttgggggatgaattgcctgttggaagagcccagttgggtggaaatggccagtcccggagcccttcatggtggggaaccctgagaacacactcataaggaaggagcagggctggagaccatcagcagcttgggcctcacaagcatttcacagtttaattgatcacacagaacccttgcaccaagacaatcgtttgctcctagagggagccttccttcgtttggaaacaatcctttcccaaccccaacaaggcaacctgcatccggtggtctcaatcaatagaagctgggcagcccgggtgcagggtcagtgtgcccaaagcattgaaagcggtgatttgggccatgggtcatgctgggtgtcctgagcaggggtaacttcatctaccagtgacgcaggtagcaactctctgggtctggtggcacaggaggtaaaggaatttaccaaccagttgtaggtaaagaaaggcagatttattagagaaggtatgaaaatacgttgcaaggcgcaattacaatgagcagagaaggggctgtctgcaaagaggcagtggctgaagggaagttcatagagtcacgttgaagagggctacatgcagaacaagcagaacgaggttgttgtgccggttgtttgtgattagctgtctctcagaacaattgatgacttttctccccacttggggcctccccaacctggggcctcttcctcattgttgcttatttatcaggactccaccagggacgagtcaccctacaagtcctaactcaagtgtgggttcttcttagaacacagcccctccagtcccttggaaatccccaagtcttcccaaacgatgtaggacttttcttcttggtcactttcaagccggggcccccagtcagtgatgccttgcccaggtctcactcggccacgctatcgctataacttgtataacttgtacccatgttcagtggttcctgagcccttgtacctcgcccagaagaatgaagatatactggacattggagggtgaggagggctgagaataattttattgatgatgaagatggctttccgtggaaaggggattcaggggtgggaggtggggtgtagggggggttttgccacgtggctcggtctggggccctttatggattcaaaatgaggagtgtatgcgattggtttgtgagtatgcaaaaaaggttaaagtgacaacaccactcaaagctgtgcacatggtgtaagaaaaccaattaggaaagggtagggaggtatatgtaaaataggtgaaggggaggactaatcagaggtaagcatgccaaacagaaagacaagttctcaatccagtccagtggatgatttaacttgtagcttggctttcaggctttaaactgtctttggcttggaggtgggtttcacggaggacctgccccatctgcataggcatttgtccacctcctgcttctatcacgagcatgtctcagcctctctgtcctgccactcaactttgtccccctgcctttattaccctcttgtaattcctggctcacagctttgtgttccaactagactgagagctccctgagcccgctactgccaggctcacttcaggcttcaatgcccagctcagacgcagtgcatctgctaggtgtgtgtgtgtgtgtgtgtgtgtgtgtgtgtgtgtgtgttaaaagtgtttcttgctggtggttctggaaatttgtcattctctgtcctctatcttcctgttaaaaacttcagctgaataaatttaaaggagtttaattgagcaataaacaattcgtgaattgggcagcccccagaacacagcagattcagaaagactccaggggtgcctcatgggcagaacaaatttatagacaaaaaaaaagtgacatacagaaatcagaactgaggtacagaaacagctggattggttacagttggcgattgccttatttgaacacagtttgaacgctcagcagcgtatgagttgttgaagttatctgctgggattggccaaaactcagtgattgttacagatgcatactcctaagttagttttcaatcctgtctacctattaagttaggttgtagttcatccacaaggactcaaatatgaagtacagagtccttctcaggccatatttagtttgctttgacatccccattgagatgatcaactattcggctaagggctgtagacagtgaagaaatgtgactaattgctggatactgagtatattgagtgtgcaagagcattatatctaaaaaacaatgtacatactgcaatttaaatgctttgctgctaaaaaaaaataatgctaacagtcatgtgagccttcaagttgtcatcttttgctgctgggggttcttgccatgatgttgatagctgctgactgagcggagtggtggtgttgaaggctggggttgtgttgaaggctgtggcaattttgtgattggccaccaatggatttgctgcatcaatggactcatcctttcatgaaatttttattggtagcatgcaatgttattgatagcatttctttccaaattgaagttaatcttcttaaaccctgctgctgctttgtcactaagttgatttaatattcttcatcctttgttgttatttcaacatgttcacagcatcttaccaggagtagattctatctcaagaaaccactttctttgctcctctgtaagaagcagccctcacctgttcaagttttatcatgagattgcagcaattcagtcacatcttcaggccgtcttctaattctagttttctttctatttccactacatctgcagttccttcctcccctgaatcttgaatccctcaaagtcatccataagagttgtaattgacatcttccaaaccctgttatgttgatgttttgacctccttccatgaatcgcaaatgttctgaatgatatctagagtaggaaccctttctagaaggttttcaatttacttggctcagatccatcagaagaatcactgttatgacagctatagccttaggaaatgtgtttcttaaataacaagtcttgaaagcaggaattctccttgatccaagggctgcataataactgttatgttcacagacatgaaaacgacataatcttgtgtatcttcatcagagctcttgggtgaccaggtacattggcaataagcagtatatattgaaagaaatatattttctgagcattatatctcaacagtgaacttaaaatattctaaaccatgctgtaaacagatgtgctgtcagcctttactgatccatttccaaaacacagcagagtagatttagcataatttttgtattagtctgttttcatgctgctgataaagacatcccaagtctgggcaatttacaaaagaaagaggtttaattggacttgcagttccacgtggtggggaagcctcacaatcatggtggagggcaaggaggagcaagtcccatcttacatggaggcagcaggcaaagagagaatgaggaaggcgcaaaagcagaaacccctgataaaaccatagatcttgtgagacttattcactaccaagagaatagtatggaggaaactgtccccatgatcgattatctcccactaggtccctcccacaacacatgggaattatgggagtataattcagatgagatttgggtggggacacagagccaaactgtatcttttttttttttttttttttggatggagtctcactctgtcacccagtgccacgatctcggctcactgcaagctccacctctgggttcaccccattctcctgcctcagcctcccgagtagctgggactacaggtgcccacaccacgcccagctaatgttttgtatttttaatagagacggggtttcacggtgttagccagatggtctcgatctcctgaactcgtgatccacctgcctcggcctcccaaagtgctgggagacaggcgtgagccaacgcacctggccaactgtatcaatacttaaggggcttagggttcttggaattgtaaatgagcattggtttcaatttaaagttaccagtggcattagcccctaagagagattctgcctgtgctttgaagcattgcagcttcaaataaaaggctattttgtctaattgagtatctgtgtttagtgcagccaccttcactaatcatcctagctggatattctggtaactttgtgtagcttctccatcagcacttgctgcttcactttgttcttttatgttacaagatggtttctttccttaaacctcacgaactaatctctgctagcttccaacttttctttgcagcttcct

SEQ ID NO: 5075 - DNA, 14767 bp, Homo sapiens
ggagacaccgtctgtcttcacaaagtacgtcctccctccttgctgcctcttcccaccagctgacttatccagggacagagcagtagatgcctggcactcctcgatgcccagtgaaaccgactgtgcttccccacccccaccaccatgccccatgctcactggctcatttcttgggaggcttagagctggataatataagttcccttggaccctgctgtgccaaatataccaattcttctcccagcgtccaacctagcaagaaggtattaagtcctgcaaatcagatgagaattctgtctggcccctgccactcaataactctgtcaccctgaacaaatcacttcacttttttttttttttttttttttttgagacttgagtcttactctctcacccaggctggagtgcagtgggtgatctcagctcaccacaacctccgcctcccaggttcaagtgattctcctgcctcagctcccaagtagctgggactacaagcacccaccaccatgcccagctaatttttttgtactttagtagagatggggttttaccatgttggccaggctggtcttgaactcctgacctcaggtattcactctcctcagcctcccaaagtgctgggattacacgtgtgagccatcgtgcccaagcccacttcacttttcagcttcagtttccacctctggaaaatggggataatctttctttacaagattattaagagtggccaggcgaggtggctcacgactgtaatcccagcactttggaggctgaggtgggcagatcacctgagggagtttgagaccagcctgaccaacatggagaaccctgtctctactaaaaattaaaaaaattagccgggtgtggctgagcgcggtggctcaccctgtaatcccagcactttgggaggctgaggtgggctgatcacgaggtcaggagatcgaaccatcctggctaacacggtgaaaccccgtctctactaaaaatacaaaaaaaattaaccggcatggtggtgggtgcctgtagtcccagctgctcgggaggctgaggcaggagaatggctgaacccgggaggcggagctggcagtgagccaagattgcgccactgcattccagcctggcaacagagcgagactccatctcaaaaaaaaaaaaaaaaaaaaaaattagccgggtgtggggcacatacctgtaatcccagctactcgggaggctgaggcaggagaatcacttgaacccgaaggtggaggttgcagtgagctgagattgtgctattgcactccagcctgagcaacaaggtgaaactccgtctcaaaaaaaaaaaaaaaaattattaagaggatgcaggctgggcatatgtaatcacagcactttgggaggccaaggtgggaggattgcttgagcccaggagttcaaaccagccttcgcaatatcgtgagactcatctctatatttaaaagaaaaaaggaggccggcacggtggctcacgcctgtaatcccagcactttgggaggctgaggcgggcagatcacaagtcaggagttcaagaccagcctggccaacatggtgaaaccccatctctactaaaaatatcaaaattagctggatatggtggagcgtgcccataatcccagctactcaggaggctgaggaggagaattgcttgaaccgggacctgggaggcggaggttgcagtgagccaagatcctgcactgcactccagcctggactacagagcaagactctgtctcaaagaaaaagaaaaaagagggatgcagtgaaataaggtcagagcctgtgccagaagagttgtcagccagtcactcccctcttcccacccctcattgtcccctgcgtcacctaccccctgcctgtggggcctagacttgagcctggaggttgcctacaatgacaaaaggaaaggcttgtagtgggcagagggcataggtcaaagcacacagacccagagggtggcttcctctgcccggcctgttaccgctccacctccacatacataccagcagcccctgggcagggaggggctgggcaccagcagctccagataggaaggtccttgaactcatcctctccgacagccacatagtaatggccagttaccagctcttccctgctgacagtgggagcccctctagggtgcagagtctgggagagagaggtgaggagataagggctggtagactcgatgcttcttcacattcagcagactgaaggggtgggtgcactattccaaggtgccctctggcctctaggcacccaggctctaccctgcctctgagggctggcagagggccctctcccagtggcatagggggaagtcccatgtgggggaacatgctttcttttgcctcttcatcctcagccacagctgaagccagtggcgaggctctctttggggactttgggccctcgcagtccccatactcacttgcacacagccccactctgcaacttgacctttcagtcaggagcttcaacacagtttcccagtcctggctggcagcctgggacagcttcagctaaatgggggacttaccaggtccccattcctgaacacactgagacaaaaagcctggtagggggagtgtccccaggagtccctacatgtgaggggaagggtggcacagggccagcaataccataacactggtctctcttcacccatcaagcatgctggacttctacattcccaacagaaccagaggctcctagaacaaacccaacaccattttcttggccttactaaaacaaacataacacccctgctccctcacactggcactcactggatatagctgggagcacctgcaggcactgccgtccaatggccccatcacacaagtggcgagtcacgggaggaccctgaaacccattcaggcctccaaatcaggagagttggggcctttggttaggggtgggcccatccaaggtgggagtgagggggccggaaccagactggggcaggaagggggcgaggaggagtaagacagttacacctttcaccaaacggtgcttagatgttccctaagtcacattctaaccaccccctccccaatctgtgtttcacatctttctctttcctttggggaccccagtgtggagttaaaggtgcgacagaagcaagaaatagtgtcttgaaatcccacgccccaggaaagatagtagctgctccaaagtacccccctggaactggcagatcctgctgcttccctggcttcccagaccaattgggggcagttccaggaggagtgggaagacagaggggctggggcacaggttccccgggctcacttgtagtctgcagctcttcccacctgggtccttccctctatggggtaaatagctaaaggacagatagatcacaggtcatcttgtggagactgaggcctcaatagcctggcagagtcagtgttgggttggggcgcagctcaccagatatccctccccatggaatagtggcaatatctcagtccagaaacaagatattggcagctgaacctgccctaggaccccttgagtgctaagtgctgtctgggtaagtgctgagtaagtctggaaatccagactggggtctcagtactaccatgagattaaaggtcaagaaggctgggcatggcagctcacgcctgtaatcccagcttttgggaggctgaggcaggaggatcacttgagcccaggagtttgagaccagcctgggcacctcattgctaccaaaaaacaaaaaaattagccaggcatggtggcatgcacctgtggcccagctacttgggaggctgaggcaggaggattgcgtgagctcaggagttcgaggctgcaggagccatgatcgcgccagtgcactgcactccggcctgggtgacagagcaagaccctgtccaaaaaaaaaaaaagtcaagagaaactagaaactagtgcattatgcatcctgctgtatccaagaatattctcattcatgagataggtcgttttatctccattttgtatgagattccaaaaattaagtgacttgcccaaagtcacacaaggaatgaagcctagattctaagtctacctgcttccctcctctggccttttttttctttttttctctttttttttctttttgagacagatctcactctgtcccccaggctggagtgcagttgtgcgatctcagctcactgcaacctcccctcacgggttcaagcgattcttctgcctcagcctcctgagtagctgtgattataggcagtgctaccaggcctggctgatttttttttttttttttttttttagatggagtttcactctattgcccaggctggagtgcagtggcacgatctcggctcactgcaacctctgcctccagttcaagcgattctcctgcctcagccacccgagcagctgggattacagacatgcgccactcgctcagctaatgttgtagttttagtagagatggggtttctccatgttggtcaggctggcttgagctcctgacctcaggtgatctgcccgccttggccttccaaagtgccgggattacggtgtgagccatcgtgcctggccaatttttgtatttttagtagagacagagtttcgccagttggccaggctggtctcgaacacctgacctcaggtgatccacccgccttggcctcccaagtgttaggattacaggcgtgaaccaccgtgcccagccacttactccctcttgatccttcattatagtaagcaacctcagctgagagctaagagtaggacctggaagccagacatgagcagagactcaggtactcaaattcttctcccaccctgggagacagtctcctcctgcaacaaggatggccctagcctaacgggagagtctgggatgcctatgcacagtggggaggaatggtgggtggatttagagtgttcagtgatagggggtccaagcaagaagagcttttggaaaaagggctcaccctgtgggagagtggtcttcccacaggctgatcttggctgtgatgggcataacattagtaacacacagaattctatttgaatttcagttcaactatttgttatgtactttaggcaggttttctgtctgttttccctttctaatggaggcaaaaccaccccccctacataagttcagtaagtaccagtaacatgctggtacatacatggtaggtactgaatacacgctctgccgttacctcccttgctaggctgtttgaccagccccagcccactcactggagcttgtgaatcgttcaaatccagcggccacatactgccctctgttcttcaagtctgccaggttgggacagggtggccatgacaaggtgtgtagagggcacgcacagccagtggggcctgcacagtgatgtcacctcgcagaggaaggcctccatggtggggaagcggcgttgagtcaccaccactgggagcctgggaagaatgggtccccattccggtacaccactaccctcttggctgctgactgccacctgccatagtgtatcctcagtcagagaaacagacctgttgccaggcaaccaggaagggctgggaacattgccaatcagaggtggagtcctgccctctcacccaggaaggcgagggagactgtggcaggagcatttatctgcattcagggttttatcccatctgccctgggagatcacacttaaacataggtgttaccctactctccagagcctccttgccactctaaacacaaggctgagctcaattggggatcagctttgggagctgttccctaaggaggatggctgatcttttcctgggccatggctcccagctggctccggggtcaatgccccatgccagtagaagtgaacggcagggcccagaatctgtcctggccagaagcagaaatgaaagcagccagatcagaatctaagaaaaacctttattcccaacagacctctcattctacttcccccaggtactccttagccacacatttgttttttgagaccgtgtctcgctctgtagcccaggctggaggcagtggcatcatcttggcctactgcaatctccatctcctgggttcaagcgattctccttctcagcctcccgagtaactgggactacaggcatgcaccaccacgcctggctaattttttatttttagttgagatggggtttcatttcaccatgttggtcaggctggtctcaaacttcgacctcaggtgatccactcaccttggcctcccaaagtgctgggattacaggtgtgagccctgcacccggccccttatccacaaatttggattgagctacaggcagaggattgaaaatggtccttcctccttccctatactcatgccagctctctgctccagcttctcttggccccacagtcaccaatggccaggggcaggagcagaagccagagctggtcagggaggtaggatgagtcttgtctcactgccctttcatagcattcccctttggaacctgatcctctcctggcttctagggtctagccaggtggttctgttttccatggcctgcccctccactgttcctctcctgacagcctgcctttgtagaagacagaatctcaggtgactttgatctccatggtatagtccctgctttttctgtccttcatgactaggctcattggaggttccatctctggagcttctatagtgggggcctggcctttgggtggtttagtcctccagagatcgaggacactatgctctgcccccccaaggtaccatcccagatgatgtggtcctctgagaggcccaactcttgtgtccgactgttcggcagtcaggctctttgtggtctagttttctgggagacatctccttaatattgagtcctcatagagtgcagacagctgtgtcctggacttcctgggacaatggttcctagttttaaacctctgggggtctggtcctccaggattttcatctgcagcaggcaggtccctcaaaggtctgtcttccatcgtctggccctttggtgagcctgtcccccaaggcctggctgttgatggtatagacgacggtggtccagacttgctgtagcatggttctctgcacttagcccagcaatgtttttttgtgtagtggccaaacttcctggggatctgtggggtgatttgacccgtgacaggagtcatcctcctgttctagctctccagtggtcctgtctctgtaggactggtctccagtggtgcgcttggttgtgactggtccctctcacaggcctgttccccatgttctagaacacgcggggttcctctctgatcgggcccgcctctggggatctcagtgtttgtttaaaagtaggtactgttgggggagagaacatacattgtaccaagcaggcctgcttgggcatgcaggtcgtctctccctaacccccacccttgaccctaaatgttcagaaagagttccaggtagtgttacctccttacggctattgatggcctgttgcagccacagcaattccatggccaatggctgcggtggtactgaagctcttgaagctgaggttggctgtggggcagtctttgatcgtggcttctgtgaaggagggaagaaaggaaggagaaaaccttgagggaccagaccctggaaatggcctagccttagactttggaaactccctcccctgcactgcccaaccatgtggtgccctatcccggcagagggaagacgggaaagggatgcagcttatctagcgcaagcctttcctcttcagatgggaggctgaggcacagtgagggtcaggggcttgccctgatctttgcaggaggtacctggattctccatccttgtcgtgtctctggtcttctcttggctgggtttcctttctgcttcatctgaagccaggagctgtgatctctgcagaggcttccttgatttgctgactctctcctgacttcttcagcaccatctcctcccaggtggcctctccctcagactcttccatgggaagtggttccacagcccctgctctggatttgctaccctgtctcctgctttccagtctgatgggattttgccttctgagaaacaagagagatgtgagagccccagggctaaaccttccaagtatctgggcaccatgatctagcagacaagttggtgagggttaaggagtgggtgtgaggaggtgagtctactgcctcttccagtgagaaaagcttatcactgggaagggtggttccaccctgcccaagtccctccttcccttctctcctaggtgtgttctacctctgggagaatcgcggcctgggaatgcggccctcggtccactgaagcgtgcccaggtcgccctcgactctcgtacaatcgcctcatactcagctcgcaggctctggaactggcgtcggaccaagagccccggacgcaggcctggtatggagaacgagaggaaagaagtcccttatcacggtaaggagggggcatctcggaggactgtcctgaagaggtcgtcccggcgaatgcaagaggggactgacggcggggaaaggataggtgggctgtgcgctagggctccggggggctcgagggacgtgccagactggatgcccctcctcgccttaaggctcttcccgtttccctgatccggcgcggcgtgtggtgggagtggggacgcgcagggcagggagtccgtgggtcccagctttcctcacgcggttggggacagccggtatctccagaggttggcgcgcagttaggggactgaacgtgtagcatctcgctgggaggtccaggtacgagaccccatgatttccctaaaggaaaaatccgtgaaccccgcgcccgcccccgcacctgcaatgcagacaccttccgaaccagcagctctgctccatgggcgccaactgccaggcccgcccgcgcgcctgcgaagtacgtcattggtcgcgtcgctcctgagcatgcgcgggcgtgggctttgccccagccgttcccacggcaacctctaccgtccagggtagaggcgtcctggcgacaggcgtacctgcgtccccccagcccccgatgcccctcccacagccgcaaggggcactccaatcccgcaggcggtacctccataaccgaggctgtctccgcggagaccgggaggaaaggcgcaaggaggggaagcaggacacggagcccttgctttctttctggtttaattccattcaacgcccccctcccccatagcacctgggggccgcagaacacccgcccgagtctgtaaaaagtcacagtttgaagagaatgagaggggcatgtgggcctgcgtgggacgcctacgcagcggactgctcctcaggctcggcgttctcggcaggtgcagcttctggctgtgcccgtcaaggatcgtggcgctttggaccagtccttcctccaccccggtctcccatcttgcacaggtttagttccctcacctgtgcaaagggccggggagagggtctcgggccgtctgtggactgaggttgcagtccccgcctgccctctctcacccctctctcttcatccagatcgtgcaggtcagacacactggggtgtgtgcgcgcgcactcgcctgtttctgactgaggaccaggtgaggtggtagtgtaaattagtaaaaataattgttcatgctgaaaggataggaggacatcggacaagctttgctatgattgatgtcagctaaagtatcacaaagattttgatcagtagtaaaacatcccctacaaccacttttcttctaattttgggaaattctaaattcctgtacctgggtttgggcagtctgtggctaaatctgacaggactcaagaggtggggaagttggttgtgtgtgaatactcctggagggctggagaggaggaaacgacctctcaggaacacacacacatagacgggttccttggaaaggatacatagaattactaggtcttccagctgccaacaaagagaaaaagggaggcttctgttaggaggggaaccaggcaaatccccaatgctctgggggctatcttctggggaggttgaggggcccagagctcttgatccatgcactcccaccttttcacccagggcccaggaatggctttgggagtatgtacctctccacccctcatgcccccaggaaccaaagcacccagacatgaacccacattgctaagcgctggtccaggttacggtcagccattgtcttcttctgctcctctggcagcccctcagtgccccatcctcttcctcttcatcgtcctcctcctccccacacacatccaggctgaagtgcgccgggctagcttctcctgcatctcccgaacgtgctccagctgctcaaaggagcattcctccctggaacgaagcccctgtctgaaccctgggaaagagtcctggaaccctggaaccctgaaccatggtcccagccatgccccatggactgggccctacagccctatccacacacccgtgaaaccagcccccaggactcaccgaaggcctgcagccggccagagtggaaatcattgacaggttcaggagtcccccctccatctcatagacatcagtcacctcggtcaggaaggagtctgcaggggcgtgcctgcagagccgcttccacctccagccaggactgggcggcacttcttttgcctactctgggtggggtggacatgaccatgatcacagggtagggggcagtcaggccctcccgatcttttgtgccatctgcctatgcaccagtttatctgtctatctgcactaaccatctgcccatctacttactagcataaatgggtaactttatggttccccttgggcactggaaggggtgaggaggcgtgaagaggtcaaaaagaagtcttttctgctaataacacagccgagcagtgcctgaaagggggtccctgggttcctgtctgagtgcctcactcatttgtttttgaccctgaatgagtcacttatcctccctagtcttcagcgtatatagagacagctactccttattgccaccagggctgtcttacctcctcccaaaatatctttctgcccctcttcttttttttgttttttgagacagagtctcgctctgttgcccaggctggagtgcagtggtgtgactcggctcactgcaacctcgcctcctgggttcaagtgattctcttgcctcagcctcccagttgctggcattatgggcgcctgccactatgccctgctaattttttttacttttagtaggttggggtttcaccgtgttggccaggctggtcttgaactcctgacctcaggtcatctgctgtcttggccttccacagtgctaggattacaggcctgagccactgcccctagccctctttttttttttaattaaaaaaaaaattttttttttgtttgagacagagtctcactgtcacaaggctggagtgcagtggcacaatctcggttcactgcaacctctgccttccaggttcaaggattcttgtgcctcagcctcccaagttgctgggattataggcacccaccatcacgcctgctaacttttgtatttttaacagagatgaggtttcaccatgttgaccaagctggtctcaacttctgacctcaggtgatctgcctgcctcagcgtccccaagtgctgggattataggctggccaccatgcccagccaaccctcttctatttaaaaactcttttaaacaaaaacaaaaatcatagaaaacaaagccaaaccaataaaccaaaaaaactgtcttaaaatttccactgctccaggataaaattgaatgcccctgccagcctggccctcctgccttcccagttgcctttccgctactctccccacagccttgagcttcatgccccttaggcaagtggtgtgcaaaaccaggggaaacacagtggtcttatctggagcaactggagaaagaatacattgtatttagtgggaacaaacatggacacattataaggcagcatgcaaactcccaatcataaaaaaaattcaaagagaattcaaattgtgcccccaggtatttcctcaccatttcctgttccctgatactccgggcccccaaaccacctgtggttcctgaaacctttcaggtaatagctttcttccatattataccaggtaagcctctcagcgtggaacattcactttcttgcagagttgctcactccctctctgaggcgaatcctcacgctatgtgatcccagtgacccacctggcctttttgccacaagttgagggtagggactgggtctgagtgagctctgagttctcaggggtctgctccagaaggcatcaattattgcttaggaactaaaggcggaggccccccttgccttcctctctacaggcaacccagagttggggtccctcctcctttccttcccttctgtacccacctcttgaactggcccgctgcttgggggatggcagatgaggaagtcctagggccaaggagccgctgtggcggtaggcacagggaccctccgtagtgtgcctggggcctgggctggctgggccaggcaggcttgggactccgtttcttctttttgtcatccattgggcgctggctgggcctcaggcctagagggaagcaaccccacaaagatagccaggggcaaagttagcccttcacccagaaatcctgagagctgcaccaaggaagggccctgggaccttccagcttgtcacctcatctatacggaggggcagagccagatgccagtgtctgctgctgggatcgtggatgtacacttgaaggacttctaaggcccaacctaattccccttctgcctgaaaacctaggcccctcctgaaagggtggaccagtcacaactatcttggcgctactggggcttcctgtcacggtggctggggggcgggctggcagaggaaatgtagtgggagacaagacggaggtgagctgcagaagcccagccgagattagggatgtcttaactaaaccctattctatttatcaggggcctaagcagatgctacaaaccctgtcagcatgggagggggacaaggtgcaggtaggggcgcctgggaaagccccgcgtgtgggtaattgtaggagaagccgcagcatacagggcagggttcattgtgggtttccccacatagacaccggcatccctccacttccacccacccccaaccgaaaatattagggatccctataggtcccgcgggtgtgctttcagctgcttcatttttcccagtcggaaagtcctgctgggcttcagctgcagccagggtggactgggtggttggccgctggctgcctgggccccgacaaaggctgcgcctgtggctgggctgctccgaggtccccggtccagcagcgcccccaagcctccggtcggctggggttccctcctctgggggtctcattccaggctgctgctacgagcctaacttcgaattctgggactgggggggttgggggggtgggtggcgcttaagcattacactgacacatagctggctgccactgacggggtctgcgggtgtggggaggggagatagagcgcatcctctgcctctccgtgcagcagcttgacccaattagggacctgatagaagactggagccggagcctgtgctccccaggagcggctggggcgaccggggatctatttcccagcccgggctccaaagccatgtgccaaactcatcgctcagctccgcagccgcgctcgaagcagagcgtcagacccgcgtcattccgcccccgccctcactccctcagggggctactgactggaggtttggggtctcgagtgatgcttcggtgcaagttccctccgccctccgccctctctcccgggaacaccaccgggtgaaagctaagctggagggagttcatttgcatttaaagaaaagtgaccttctccttagcgcggtggggtgagatgggaggagcatccccgcgtatgctagcagttcctctcactcgacctcacctccccgcctgaacctaggggaccctgttggttggtgatgtctattttaaaaagattttccctttcccggcagtttcagagagaagctacagtccttacaaaatggtggtggctttgtcagaaagggggtggggcgggggagaggagagacaagtgagtgagtgagagagagagaatgtaagcacagaagaagcacaagcagcaacagcagagcatcaggaagacacttcgagcaaagacagccatcaatggagtgagtccagtgccctatgagcactttacatacatttcatccccataacaacccttaaggaagataccagtgtcatccccattctactgaaagtaagcaacagtcttttgagggcaaaacccctctctctacaatccagacagttttctctggtaagtggtgggggctgtattttgccgcagatgaagtgacagagtcctccccaccccccaggcctaggagacaggtgtggggagcaccaggtcataaggtaaccacgcgattccctggcacctgactccagtcctcagggaaacctgagcacctgatggagctgacccagtgtgactgctgctgcctgcagccagatcaatgggggcagctatttaaagcctggcagaggctcctggcgcaggtccccagaacagcatctgatacaacaggagagaggtcatgtttggccaggcggctcagcaggctcaagtgagctggcccagggcagtgcacacaccacccagcccaccttccccatccccgggcaggagtggcttcctggggttgggcctcttgctgatgtggggagcca

SEQ ID NO: 5076 - DNA, 19546 bp, Homo sapiens
cttgactctgtccagtaatgtacatcctatgcctattggctagttcaggttcactctccaacataaactgcaaaagctgttggaaggaaaatctggccattgataaccctttaaagatccctactgcctggaggaaagtcaaaactctttacctcctcacactgaaggacgtttaaatctattccccgtcctctgtccccaagaccacaccccaagggtttctgaagactccatacttcttaactctgtgcctttgcctttgctgttccttttgcctgtgggatgttctttccttctgcttgaagctccatttattctccagggtttaatgtacacgccacctccctgggagaggcaccttccacacttggctgagacctctatggtggcacaattcacaatctgactcaggtctagctgtttgcaagtctgtctccccatgggggaagggactgcatctgatttacttcttgttctaggagttcagcattatactcagcattatacagggcattatactcagtggtggcaggaaatgctcatttgtgatccttaattatttttttgagacagggtcttgttctatcaccaggctggagtacagtggcacaatcatggctcactgcagcctcaatctcccagactcaagaatctttcagcctcaacatcctgagtacctgggaccaaaggcacactccaccacacccactaatttttaatttttttttgtagagacagggtcttcctatattgcccaggctgatctcatctccgggtctcaagcaatcctgccacagcctcccaaagtgttgggattacaagtgtggtcaccacacccggcctgtgatccttattaacatgtcctgagtactttgtgacaagttttcaaacatgtgatatcatttgatccttgaaacattttacagataaacagggtcagagaatcatgtaaattgcccaagatcacacagctagaaagtggtgaaatctacatttgaatctccctctgctctttttaaaattttttattaacttttttttttttttttttttttttagagaagggtctcactgtcacccaggctggagtgcagtggtgcaatcatagctcactgcagcccaacccctgggctcaagagatcctcctgccttggcccccaaaggcactgggattacagattgagccacagcatacagccctgcccttgttctgaactagtgtgctatcaccaggacccgggcaggtggatcatctgaggtcaggaggtcaggattcaagaccagcctggccaacatgggaaaccccatctctactaaaaatacaaaaattacccaggcatggtggcaggtgcctatatcccagctactcaagaggctgaggcaggagaatggcttgaacccaggaggtggaggttgagtgagccgagatcgtaccactgcactccagcctgggtgacagggtgatactctgtctcaaaaaaaaaaaaaaaaaaaaaaaaggccacgagcggtggactgcctgaggtcaggagttgtgaccagactgaccaacatggtgaaaccctgtctctactaaaaatacaaaaaaaattaccaggtgcggtggcatgcacctgtaatcccagctactcgggaggctaaggcaggggaatgcttgaaccagggaggtggaggtcgcagtgagccgagatggcgccactgcactccagccgggcaacagagagagactctatcttaaaaaaaaaaaaaaaaattattctggtaggctcagccccatgtggcctcttaccttggcactatactggttgagctctccactctcatggccacgatgatgcactcccccaggggtccccaaacagcactggtgattttagagtcattgcaaggatcttcatgtagggctcattgttgtctgtgtggggcagtagatgttaggccctgggcctagaactgtaccctttacctcaaccccagccctattcccagccctcaccaatctggctggatcccgcaggtcaaaaaagctcacaaagcactggtagcccatctgcttgtccgtggaaacatgatgatgttgcccccaaagtcaaaaccgcaggtccggacagccgaattggtcttagaagggccagctgctttcctggagtcaggcaaagtctgggctacaccatccattgcaatgcagggaggacattctagagaatgctaccatcacatctcactgtttgtcttgctccaggacccaaacttaaaaagtattttaacttttctttttttttttcttttttgagacagtttactctgttgcccaggctggagtgcagtggtgcaatctcggctctcactgcaagctccgctcccgggttcacgccattctcctgcctcagcctcccaagtagctgggactacaggcgccgccaccatgccccgctaattttttgtatttttagtagagacgggatttcaccgtgttagcaggatggtcttgatctcctgacccgtgatccgcccgcctcagcctcccaaagtgctggattacaggtgtgagccaccgcgcccggcctttttttttttgagatggagtttcgctctttcctgcaggctgctgtgcgatggtgtgatctcggctcactgcaacctttcaagcgattctctgcctcagcctcctgagtcgatgggattacaggtgcccaccaccatgcctggctcattttgtatttttaatagacggggtttcaccatgttggccaggctggtcttgcactcctgactcaggtgatccacctgcctcaacctcccaaagtgctgggattacaggcgtgagccacccacctggccaagtattttaacttcttacctagactctttcctcagacatcctgctaatgggcactactcatacgtagactgcaatatatctgtctctccctcagactgtgcttctccaagcaaagacctgatctgatttccctccatgtccccagtacccagcatagacctggcactaacagaacagcttaggctgggcacagtggcttgtgcctgtaatctcagcactttgggagccaaggcgggtggatcacttgagctgaggagttcgagaccagcctggccaacatggtgaaccctgtctctactaaaaatacaaaaattagctggtggccaggtgcagtggctcatgccgtaatcccagcactttggaaggccgaggtgggtggattacctgaggtctggagtttgagccagtctggccaacatggtgaaaccctgtctctactaaaaatacaaaaattagccaggttgatggcgcatgtctgtaatcccagctatttgggaggctgaggcaggagaatcacttgacctgggaggcggaggttgcagtaagccaagattgtgccactgcactccagcctgggtgaacagcgagagaatctgtctcaaaaaaaaaaatcagccaagcatggtggcgtgcgcctatatcccagctactggggctggctgagacaggagaatcccttgaacccgggagacagaggtgcagtgagccgagatagtgccattgctctccagcctgggtgacagtgagactctgtctcaaaataagaaaaagaaaaaaaaaaaaaaaaagaaaacttaatctatgcttcctctaccaggcgtgtattttctcatctatctttcttgtctcttattccctagactggaaactatctaggatttcatctctattttcctaggacctgtttactcaaacaggtacactgtaggtcctcatatttgctaaaaaggtgaatgaacccagcttacctgtttcacagtcccagagacgacactgttgtcagctgagccagtgaggacatgcttggtgtcccctgaagagttgttaagaaaatgacgaagttcacccgagcccttgtcctcttgggatgccaagtgaatcatctccctgtcagccccaaagagcctttctacccctcttacctccttatccagaactggaatttgtcctaatgtttcctcagtcagtgaagagaccagggagtaggaggtatcgttctctaggccctcacagcacccccaactcccaactcccaactcagcctctccatcgctgacagaccctagcacacggactcagacccaaaataaggatacagtcagcgtccacacaccacacagctccggttggcccatgtaggtgcccagcctctcaccattcacagagtaccatacattgacgatctgaaaagtcaaaccacaggatagtacacatcccagtaagagcaatggcttcctattttgcccaggaaccctcagcagcctgtagcaaggctgattctgccctcttctgtttatttcttggaaacagcagggagctggtaaaaagaccaactcctggattctcctcccttcctgaagggagcaacagaggagtcaggcggcttgtaaaggcatcctcatttgttagctccagctctcctggactcccaacggctccaaagaataaaaggccaagttgagctccagtccagaaaaacagatctctgatgtcttatccaagtgggagcagctggtagtaaggaagtctgggttctggtgctgctctgccactgtctcactatatgatctcaaatacagtgcttctctcctctgaacttagttttctcatcttgaaaatggccaggccgggtgtggtgactcatgcctgtaatcctagactttgggaggccgaggcaggcggatcacctgaggtcaggagttcaagacaagcctgtcaacatggtgaaaccccatctctactaaagatacaaaaaattagctgggcatggtggcacagcctgtagtcccagctactagggaggttgaggcaggagaatcgcttgaacctgggaggagaggttgcagtgagtcgagatcgcgccactgcactccagcctaggcgacagagcgagatccgtctcaagaaaaaataaaataaaatggccaggtgcctcaaaaggcagtatcatgaggattgtttggcattgagtagcaggatgggattgacttaaaatgagactagagacaccctattaagttccctgtgtctgaataacacagcctgcacctatcctggtagaaagattagatatccctaaaggtcgcatcccgttctctgggcaagctgaccctcatctttatcccctttcacagtggtctcttgcttttcttggagtgcagtggcacgatctcagctcaccgcgctcaacgatcctctcgtttcagactccgaagtagctgagaccacaggcgcgaggccaccatgtcggctaatttttttgtgtgtagagatgggtcttactacgttgctcaggctggtctccaaccctgggctcaagcgaccctcccacctcggcctctcaaagtgctgggattacaggcgtgaccaccgcactcggccaatagagttcttccccacctttcccggtagaatactttcgccaactacccccggcatggcctctccctacttctcacaatgggctgctctttggttccccgctacggcaaaactggcgtgtccacccatcgtcctggcagaaggatcccgcccctcccggacccctccagccaacactcacagggtccttggccacagtaaagaggaggtctccttcgcggtatacttaatctgcgtaatggaccgctcatggccctgcagtaggatcggcttctgtgggacaagacagtaacgtcagtgctcggaattgggccccagcctcagcccaggacccccactcaatacccctaactctgaaactcaccatcccggctgtgacgcgaggaaggccgcaacgtagtaagaccggaaaaggtttcgaggtcacttccggattatgggtctccgccccttcgttccggaagtagaagacagcggcgttgccatggcggcgtctctgggtaggtagccggcccccccttccatggatttcccgaccctcgcctcgaattcatttcctgctccacatccacccttaaccccgacccctgctacaaccccagaggccggactcctggattcatctccctagcttcctgggcctgccttagccgccagtcgcagccgaggcgaagagagcgaaggagggaagtggggcggctagctggggctagaaggccaggagagggcggggtgggcggccgtttggggtggggtcagggtgactcactcgtctgcattcagggcaggtgttggctctggtgctggtggcgctctgtggggtggcacgcagccgctgctgaagcgggcctccgccggcctgcagcgggtcatgagccgacctgggcccagcagttgctacaggagatgaagaccctcttcttgaatacgaggtgcgtctctgtgaaaggcccctctctcggtggagttgccgccaagaatttggtcttggagtcaaacaggtctgggtcagccccaccacttactcactagaaattctcggaaaagcagttgtccttgagcctcagtttcatcatctgtaaatggcgattataataataaccatcgataggtcagttgcaggaattaggtgagatacgtagagcacttagcattaggcctagaaatagtaagtgctcaatctatggctgccattattcacattttattgtgattccttcagttcataaggcaacatttgtgagcctttccagagggagggcttggggctcaaattggccctgaggggaggagttcagaggaggaaggctggagctggaggacttggggaaggcttcctggagggctgacattggcttcaaggccttgcaggatgggaactagcagaggtgagggagagggagtttgagcaaaggcacagacttcagtctgtttccctctttgccctggaaggatcctcctagagggattagtgttctctgggtccttataaccctgcctccctccaaggaaagacattgctaggagctcaaagaaggcagtgctgctcagtcaggccatcacactgactgcaggttttcctctttccagtacctgatgccctttctcctcaaccagtgtggatcccttctctattactcaccttggcatcgacaggtgggtcctggcttggaactgttctgcttagtgtttgaggcacctggaagagtgattggggggggcggggtggagcttgaaacacctcattcccatcaggagagagggctgactagctctagttccctcttactatcctcttctctgaacaagaggggacagtgtgctggttatgagtatgttgctaggcactggagttggtttgaagcctggcagtatgtgtgaccagcggaggaagaaggaaggttcattttgctgtgccaagtgctggctttccattcttgcttccactgtgtgctacctacctgaccatgagcaagtcacccatttgagcctggttttatatagttggcttcatagcattgtgaggattaaatttaatgaatgggaaacactaggagagtgcctggcacacagtcagagctccatatacataaatttcctttctcttgaatttgtgactgccctctactacgtcagatactgcactagtcttacacattatttaattcaatcatgactctgtaaagcagatatgattatcttagaaaatgaagttgcaaaactttgtcaatttcacctctcaagtcccacaggatgtcagtgcagaaggatttgaagccatatattaaagtttatgctcgactgggcatggtgactcacgcctgtaatcccagcactttgggaggcaaggagggcagatcatttgaggtcaggagttcgagaccagtctggccaacatgctgaaccccgtctctactaaaaataacaaaattagttgggtgtggtggtgtgtgcctgtagtccagctacttgggaggctgaggcgcgagaatggcttgaacctgggaggcggaggttgcagtagctgagatcatgccactgcactccagtccctgggcaacagagcgagactctgtctcaaaacagaaagaaagaaataatatgcacttatttaaagagtttgaaaacctctggcctcatcattcactgctgtggaagaatgctgaacccttgaccagctgactacaggtagccattcacaagttttaatcaaattgcagttttaggttctttttatctcattaccctttctgcctgttcctttaatatccatcctttctaataaccagaacagtaataactatttatgaagcatcccttcagccagggactatccatgcattatcacagttcatcttacgacaacccaacaaaagaatggtatactgtgacccctattttacatgcggggaaacaggttgagtgtttgaatatctaaccaagattgcaagggaaactcagatctgcctcactccaatgccctcactttccactcaccgtgctgcatccttcttccatctactgttgcaaaccagaccttagcagccatgacatccttgtaaggtatgtaaacttaagaaggcagctctgggcagggcacagtggctcaggctataattccagcacttttggaggctgaggtgggcagataacctgagcctagagatcacctaggcaacaacaacaacaaaaatacgaaaattaactgggcttggtggtgtgtgcctgtatcctagctgctcaggaggctgaggtgggaggatcgcttgagctcaggaggttgaggctgagtgagccttgacctcaccactgcactccagcctgagcaacagagagagaccctgtctcaaacaacaacaacaaaaacgaaaaacaaccaaaaaagaaagcagctctttgtaagtgggttgtatcaatttcttagatgggtaatgcctccatgctggggcctcccaggggatgaggacaggacagtttgctcctttgcctcacacaggcgagccctgggagtgctgggaaagaattgctgaggagccagtgtgaacatctggtctgcagttgagtcttgttaccatggataactcgctgattcgtccattggtcttttttatgtgtatgtggtgctttttttttttttttttgaacggcatttcgctcttgttgcccaagctggagtgcaatggtgcgatcttggctcactgcacctccgcctcccaggttcaagtgactctccttccttagcctccccactagctgggatttgggcatgtgccaccacgcctggctaattttgttcttttgtttttgttttttgagatgggccttgctgtgtcacccaggctggagtgcagtggtgcaatctctggtcactgcaacctcgcctaccaggttcaagcaattctcctgcctcggcctcccaagtagctgggactacaggctgcaccaccatgcctggctaatttttgtatttttagtagagacggggtttcacaatgttgccaggctggtcttgaactcctgacctcaaatgatccacccgcctcggcctcccaaagtctgggattacaggcgtgagccaccacacccagcctaattttgtattttcagtagagacgggtttctccatgttggtcacgctggtctctaactcccaacctcaggtgatccgcccgtccagccttccaaaatgttgggattacaggcatgagccactgcgcctggctgtggctcttttttgatgtgataagaacacttaacaggagatctaccctcaacaaattttaagttaactcattagtctttttcttttttttttgagacagagtttcactcttgtttctcaggctggagtcagtggtgtgatcttggctcagtgcaacctctgcctcctgggttcaagcgattctcctgctcagcctcctgagtagctgggattacaggcgtccgccactatgcctggctaatttttgtatttttagtagagacggggtttcaccatgttggccaagctggtcttgaactcctgacccaggtgatccgcccgcctcagcctcccaaagtgctgggattacaggcgtgagccaccctcacccagccaactccattactctttttcaagtttgcttattggcagtcagccccttggacttcaaaattaaggaacagatcctgggctatgatgccctctacccacaccacaggtccacccaatgtcctgaacaggtcctgctccttccttctgacactttttatttttaactccataggcctgagcttgggctgaaacagaaacaaaatgtgcttcatctgatgttctgctctgttatatccacagtttaataacggcgcaggctttggagtcaggcaagccttggtttaaatctcaacttgccttagtttatgtgacttctttgagcctttgtttcttttacgcaaaatggtataatccccttcttgcagtgttgtgaaaactgagatatgtacacaaagcacctaggccaggtatgtgcttaataaatggtggctgtgcttggtgttacctgactctctactcatccttgggatttgggtgcctgcctgtccgtccagatgtccttgagatctcacgagttctctttggtgcaaagacctcattctcattatcaaaccaggctggtcccagacctcagagttcaggtttcatgctggaatcctgggaagcactgaacgtggagtcaggagatgtgggtttgagtccgagatttgctgtgacttcatctggaagatggggttttgataccttttttaaaggtatgaatgatgatgatggaagtgttttgtgcctagaaaggcatttgttgcatctcaggcattctttcattctgaccacccagatctgaccctggctgtgcccatctgtaactctctggctatctcttcacactgattgttgggaaggcccttggagaagatattggtggaaaacgtaagttaactactgcgagtgcgggacgcagctctgtggatctcgacatacctgtgttagttccttccagaacccatctccccagagtgggtgaggacacggccttttcccatcctgccctttccttgcagctgttttgcttccttgtggccatcagagttcccttcccctggacagtctggagaagacagaggctggggtttgggattgaagaccagaccccatctgagcccttcctccagcctgtaccagctcctactggcatggctgagctcagaccctcctgatttctgcctattatccaggagcagttgctggcatggtgctcaccgtgataggaatttcactctgcatcacaagctagtgagtaagacccaggggcaacagtctaccctttgagtgggccgaacccacttccagcctgctgcctccaggaagcccctgggccatgaagtgctggcagtgagcggatggacctagacttcccctctctggccttagcttcctcctctcttatggggataacagctacctcatggtcacaataagagaacaagagtgaaagagttttgtaaccttcaagtgctgttcagctgcgggatttagcacaggagactctacgctcaccctcagcaacctttctgccccagcagctctttcctgctaacatctcaggctcccagcccagccaccattactgtggcctgatctggacttcatggtggcaggttccatggactgcagaactccagctgcatggaaagggccagctgcaactttgagccagaaatgcaaacgggaggcctctgggactcagtcagagcgctttggctgatgaggggtggaaccgagggaagaaggtgcgtcggagtggcagatgcaggaaatgagcttctattagccttgcctgccccacccatgaggtaggcagaaatcctcactgccagcccctttaaacaggtagagagctgtgagccccagccccacctgactccagcacacctggcgagtgtagctgtcaataaatctatggtaaacagacaagaggttagtaagtattcttttattgtacaaaccctctcccaggcttagtcagctactcctttctctggccagagaatcccataagaaatagcccccacagccagggctgctctgctcagaggaagggaaggctgggctgtgggttaggagcaggagaacggggagggctgaggaggccgcagtgtaccctgtgagcccagcggggtgctggctcctgaggaacaagctgctggaggctaaggacaaaaggtggccagagtagggtccccagttgccctctggagctgctggctctcaagatggcagagctggggctgaggcgagatagcagccccagccccaggctggttttccagggacaaggcctcttccactatctggctgccctctgcaggaggtggaaggccatacagaatggagccgtgagtatggccagcctcagctctcagccaggaggtccccaaccccaaggaaggaagaaactggaaattaggaactcttcctcatttaacaaggtaggaagttaggagatcatttactttcaatcacaagggagggaactgttcctggggcccaaggctgccagtttccagctcagagctcctcccaccccaactactgtttcctgatccaacagcttacctgatccaagggctcctctgtctgagtgtcttctcatctgctacttccagggcccccgctgtctccttccttcggtggggagctccatataccctataactcctaaagaggggaggcagcactgggtgatgcccaggctgaagagccctcacattcctgccctggaccttcatgctagcccctttccctcccctgaacctggttctgcatccccaccacctcccaggatggcaaggaagtgagaggtgggcctttggtcccacccccatccctctatatcccacccctgaagtcttatcgctttaagcactgccctttccaggtgcttttttcatgtgatgaggccctgtgaagaagggacaggatatacagacgggggcagctggaacagttatgatgaggtcagtaccagctttttttttttttacgggcagtctcctgagccaagtaggttcagactcctttatcttttttttttttttccagtgccggctttgtgtctgagattctgctcccatggacatccccaacaacagcagggaccaacctatgtcactgtcaaaggcagctgagaagggcctgagccccagggacccctcacctgatgggaatgagagtgtgggagcttgcttcttggctgaatggtctgctggggtctggcatagaaagcagatggcttaatcggtctggttcctttggagagggctgggttacctgggccctgtggccttgggcctagagagggacactgggcttggaccctgattgctggccattcttacctttcctactccccagttaggcttcagagagcccctgacgcctgcaggaacatggcagaggagacaccgtctgtcttacaaagtacgtcctccctccttgctgcctcttcccaccagcctgacttatccagggacaagcagtagatgcctggcactcctcgatgcccagtgaaaccagactgtgcttccccaccccaccaccatgccccatgctcactggctcatttcttgggagggcttagagctggataataaagttcccttggaccctgctgtgccaaatataccaattctctctcccagcgtccaacctgcaagaaggtattaagtcctgcaaatcagatgagaattctggtctggcccctgccactcataactctgtcaccctgaacaaatcacttcactttttttttttttttttttttttttgaacttgagtcttactctctcacccaggctggagtgcagtggtgtgatctcagctcaccacacctccgcctcccaggttcaagtgattctcctgcctcagcctcccaagtagctgggactcaagcacccaccaccatgcccagctaatttttttgtacttttagtagagatggggttttccatgttggccaggctggtcttgaactcctgacctcaggtaattcactctcctcagcctccaaagtgctgggattacacgtgtgagccatcgtgcccaaggcccacttcacttttcagttcagtttccacctctggaaaatggggataatctttctttcacaagattattaagagtgccaggcgaggtggctcacgactgtaatcccagcactttgggaggctgaggtgggcagatacctgagggagtttgagaccagcctgaccaacatggagaaaccctgtctctactaaaaataaaaaaattagccgggtgtggctgagcgcggtggctcacgcctgtaatcccagcacttgggaggctgaggtgggctgatcacgaggtcaggagatcgagaccatcctggctaacacgtgaaaccccgtctctactaaaaatacaaaaaaaattaaccgggcatggtggtgggtgccgtagtcccagctgctcgggaggctgaggcaggagaatggcatgaacccgggaggcggagtggcagtgagccaagattgcgccactgcattccagcctgggcaacagagcgagactccactcaaaaaaaaaaaaaaaaaaaaaaattagccgggtgtggtggcacatacctgtaatccagctactcgggaggctgaggcaggagaatcacttgaacccagaaggtggaggttgcagtagctgagattgtgctattgcactccagcctgagcaacaagagtgaaactccgtctcaaaaaaaaaaaaaaaattattaagaggatgcaggctgggcatagtgtaatcacagcactttggaggccaaggtgggaggattgcttgagcccaggagttcaagaccagccttcgcaatatctgagactcatctctatatttaaaagaaaaaaggaggccgggcacggtggctcacgcctgaatcccagcactttgggaggctgaggcgggcagatcacaaggtcaggagttcaagaccacctggccaacatggtgaaaccccatctctactaaaaatatacaaaattagctggatatgtggagcgtgcccataatcccagctactcaggaggctgaggcaggagaattgcttgaaccggacctgggaggcggaggttgcagtgagccaagatcctgccactgcactccagcctggatacagagcaagactctgtctcaaagaaaaagaaaaaagagaggatgcagtgaaataaggcagagcctgtgccagaagagttgtcagccagtcactccccttcttcccacccctcattgcccctgcgtcacctaccccctgcctgtggggcctagacttcgagcctggaggttgcctaaatgacaaaaggaaaggcttgtagtgggcagagggcatagagtcaaagcacacagacccgagggtggcttcctctgcccggcctgttaccgctccacctcccacatacataccagcagccctgggcagggaggggctgggcaccagcagctccagatagggaaggtccttgaactcacctctccgacagccacatagtaatggccagttaccagctccttccctgctgacagtggggcccctctagggtgcagagtctgggagagagaggtgaggaggataagggctggtagactgatgcttcttcacattcagcagactgaaggggtgggtgcagctattccaaggtgccctcggcctctaggcacccaggctctaccctgcctctgagggctgggcagagggccctctcccgtggcatagggggaagtcccatgtgggggaacatgctttccttttgcctcttcatcctcgccacagctgaagccagtggcgaggctctctttggggacttttgggccctcgcagtcccatactcacttgcacacagccccactctgcaacttgaccttctcagtcaggagcttcaaccagtttcccagtcctggctggcagcctgggacagcttcagactaaatgggggacttaccggtccccattcctgaacacactgagacaaaaagcctggtaagggggagtgtccccaggatccctacatgtgaggggaagggtggcacagggccagcaataaccataacactggtctctttcacccatcaagcatgctggacttctacattcccaacagtaaccagaggctcctagaaaaacccaacaccattttcttggccttactaaaacaaacatcaacacccctgctccctcaactggcactcactggatatagctgggagcacctgcaggcagctgccgtccaatggcccctcacacaagtggcgagtcacgggaggaccctgaaacccatgtcaggcctccaaatcagggagttggggcctttggttaggggtgggcccatccaaggtgtggagtgagggggccggaacagactggggcaggaagggggcgaggaggagtaagacagtttacacctttcaccaaacgtgcttagatgttccctaagtcacattctaaccaccccctcccccaatctgtgtttcacactttctctttcctttggggaccccagtgtggagttaaaggctgcgacagaagcaagaaaagtgtcttgaaatcccacgccccaggaaagatagtagctggctccaaagtacccccctgaactggcagatcctgctgcttccctggcttcccagaccaaattgggggcagttccaggagagtgggaagacagaggggctggggcacaggttccccgggactcacttgtagtctgcagtcttcccacctgggtccttccctctatggggtaaatagctgaaaggacagatagatcacggtcatcttgtggagactgaggcctcaatagcctggcagatgtcagtgttgggttgggggcagctcaccagatatccctccccatggaatagtggcaatcatctcagtccagaaacaaatattggcagctgaacctgccctaggaccccttgagtgctcaagtgctgtctgggtaaggctgagtaagtctggaaatccagactggggtctcagtactaaccatgagattaaaggtcagaaggctgggcatggcagctcacgcctgtaatcccagctctttgggaggctgaggcagaggatcacttgagcccaggagtttgagaccagcctgggcaacctcattgctaccaaaaacaaaaaaattagccaggcatggtggcatgcacctgtggccccagctacttgggaggctgggcaggaggattgcgtgagctcaggagttcgaggctgcagtgagccatgatcgcgccaggcactgcactccggcctgggtgacagagcaagaccctgtctcaaaaaaaaaaaaagtcagagaaactagaaactagtgcattatgcatcctgctgtatcccaagaatattctcattcagagataggtcgttttatctccattttgtatgagattccaagaaattaagtgacttgcccaagtcacacaaggaatgaagcctagattctaagtctacctagcttccctcctctggcctttttttctttttttctctttttttttctttttgagacagagtctcactctgtcccccagctggagtgcagttgtgcgatctcagctcactgcaacctccgcctcacgggttcaagcgatcttctgcctcagcctcctgagtagctgtgattataggcacgtgctaccaggcctggctatttttttttttttttttttttttagatggagtttcactcttattgcccaggctggagtcagtggcacgatctcggctcactgcaacctctgcctccaggttcaagcgattctcctgctcagccacccgagcagctgggattacagacatgcgccactacgctcagctaatgttgtattttagtagagatggggtttctccatgttggtcaggctggtcttgagctcctgacctcagtgatctgcccgccttggccttccaaagtgccgggattacaggtgtgagccatcgtgccggccaatttttgtatttttagtagagacagagtttcgccatgttggccaggctggtctcaacacctgacctcaggtgatccacccgccttggcctcccaaagtgttaggattacaggctgaaccaccgtgcccagccacttactccctcttgatccttacattatagtaagcaacctagctgagagctaagagtaggacctggaagccagacatgagtcagagactcaggtactcaattcttctcccaccctgggagacagtctcctcctgcaacagaggatggccctagcctaagggagagtctgggatgcctatgcacagtggggaggaatggatgggtggatttagagtgtcagtgatagggggtccaagcaagaagagcttttggaaaaaggggctcaccctgtgggaggtggtcttcccacaggctgatcttggctgtgatgggcataaacattagtaacacacagattctatttgaatttcagttcaactatttgttatgtacttttaggcaggttttctgtctgtttccctttctaatggaggcaaaaccaccccccctacatagagttcagtaagtaccagtacatgctggtacatacatggtaggtactgaatacacgctcttgccgttacctcccttgcaggctgtttgaccagccccagcccactcactggagcttgtggaatcgttcaaatccagcgccacatactgccctctgttcttcaagtctgccaggttggtgacagggtggccatgacaggtgtgtagagggcacgcacagccagtggggcctgcacagctgatgtcacctcgcagagaaggcctccatggtggggaagcggcgttgagtcaccaccagctgggagcctgggaagaagggtccccattccggtacaccactaccctcttggctgctggactgccacctgccatagttatcctcagtcagagaaacagacctgttgccaggcaaccaaggaagggctgggaacattccaatcagaggtggagtcctgccctctcacccaggaaggcagagggagactgtggcagggcatttatctgcattcagggttttatcccatctgccctggggagatcacacttaaacatggtgttaccctactctccagagcctccttgccactctaaagcacaaggctgagctcaatggggatcagctttgggagctgttccctaaggaggatggctagatcttttcctgggccatgctcccagctggctccggggtcaatgccccatgccagtaggaagtgaacggcagggcccgaatctgtcctggccagaagcagaaatgaaagcagccagactcagaatctaagaaaaactttattcccaacagacctctcattctacttcccccaggtaactccttagccacacatttttttttgagaccgtgtctcgctctgtagcccaggctggagtgcagtggcatcatcttggctactgcaatctccatctcctgggttcaagcgattctcctgtctcagcctcccgagtaatgggactacaggcatgc

SEQ ID NO: 5077 - DNA, 17032 bp, Homo sapiens
agaccgcatctctacaaaaaatttaaaaataagctgggtgcaatggcctgctcctgtggcccagccatgattgcaccactgtactacagttggtaacacagcaagactgtctctaaaaagaaaaaaatagaagaaaaggaagaaagaaagccagatgtggtggctcacgcttgtaatccagcactttgggaggccaaggcgtgtggatcacttgaggccagaagtttgagaccagctggccaaatggtaaaaccctgtctctactaaaaatacaaaaaattagtcaggtgtggtgtgcatgtctgtaatcccagctactcaggaagctgaggcaggagaatcgcttgaacccagagctggaggttgcagtgaactgaaatcgcgccactacacttcagcctgggcaacagaacagatgctgtctcaaaaaaaaaaaaaaaaaggcctgacatggtggctcacgcctgtaatccagcactttgggagaccgaggtgggcagatcacaaggtcagaagattgagaccatcctgctaacacagtgaaaccccgtctctactaaaaatacaaaaaattagctgggcgtggtggtggcatctgtaatcccagctacttgggaggctgagccaggagaatctcttaaacccgggaacagaggttgcagtgagcccagatcacgccactgcattccagcctgggcgacacagtgaactctctctcaaaaaaaaaaaaaagaagaagaagaaaaagaagaatagataagaaaataagtttattcactgacgagatcaagctccaactcctcagcaggacacacaaggccacatacccaaggagcccccacctgccctcactccatctcagcctctccatggttcatccatgtccacgccctcccagatctttgatacccagcaggctcagactagtatgtcaggaactatgtagaactaatatgtcaggaactgtgtgagattaataagaacaacatttcttatatatattagaaatatatatatatctcatatattgagcactttctgtatgccaaacactatgctagaattaaaatgtctacatgatttcatcaaatcttcacagtaaccttctaagatagagaaactcccattttgtagatggggaaacagtaatagaggtttagtcatttgttcaacttcgcactctaacaactcgtttcttttgtttttttatttttttgttttcttgttccgaagtcttgcctgttgcccaggctggagtgcaatggtgcagtctcagctcactgcaccctccgcctcccggttcaagcgattctcctgcctcagcctccccagtagctgggattatgggagcccgccacacgcccagctaattttttgtatttttagtagagatggggtttcaccatgctggccacgcggtcttaaactcctgatttcaggtgatccattcaccttagcctcccaaagtgctgggatacaggcatgagccaccgcgtccagccataactcatttctttgatggtccttagtagaatagcaactaggtttcttggcatctcagatacctctgctaaagcattttacatgtctatcctctctcaagaccctggttctggctgggcccggtggctcacgcccttaaactcagcacttgggaggctgaggtgggcagatcacctgaggtcaggagtttgagaccagcctggccaactggtgaaactttgtctctactaaaaatataaaaattagccaggtgtggtggtgcatgccgtaatcccagttacttgagaggctgaggcaggagaatcacttgaacccgggaagtggaattgcagtgagccaaggtcacgccattgcactccagcctgggcaatagagggagactctgctcaaaagaaaaaaaaaaaaaaggctgggcgcggtggctcacgcctataatcccagcacctgggaggccgagacaggcagattacctgaggtcaggagttcgagactagcctggccaaatggtgaatccccatctctactaaaagtacaaaaattagccaggtgtggtggcacatgctgtagtcccagctacttgggaagctgagacaggagaattgcttgagcctgggagacagagtttcagtgagctgagatcatgtcactgcactccagcctggctgaaagagcgagactcttctcaaaagaaaaaaaaaggccaggcacagtggctcacgcctgtaatcccagcactttggaggccgaagcgggtggatcacgaggtcaggagatggagaccatcctggctaacacggtaaaccccgtctctactaaaaaaacaaaaaattatctgggcgtggtggcgtacgcctgtatcccagctactcagaaggctgaggcaggagaatggcgtgaacccaggaggtagagcttgagtgagccaagatcacgccactgcattccagcctgggagaaaaagcgagactccgtctcaaaaaaaaaaaagaccctggttctccagcccagtaccaagttttatattcatctttagatccctgtggtgggctacacagtatttgaccaatgtatcagcagccaatacatgttaattaatgaaagttggggggggcgcagcaagaagggagggagagagagagagagaggcagtggtaggatggggtgagtgggtagatcaggcccagaggctttagtgtgtgctgccaagctctaaaagtttttgggggtgtggggaaggcaggggacactgggcaggcatcgtaggtgccctggttgggggcctggcaaagtcgatgtcaaagcgaagtcagtcttaatgaaagagtgtagcagctctggatggtaatcaggaatcctggaatctagggcaggctggggaaagagaggttgtggcacagtgtcctggagaaggtggggtggagggaggagagaaaagccagctccgagggattccagggacaaaaggtcaggatattggcactcggaacaacccccttggtgggtgccaggtacatccgggctctttaacccccctccctgctggctcacactccacaggcctccacggatgacttcttttcattattcaggtctctgctcaaatgacttccctgaccacccagctatgttgaccctcccctccccctcctattatattacagggttttgttccctttattgctcaaccgctatctgaaataatcctgcttatttatttgtgttcttgtttgtgtctgcttccctctactatgctataagttccatcagagcggggatagtgtttgtccttttcttttttcttctttcttttttttttgagacggagtctcgctctgtcgcccaggctggagtgcagtggtggatctccgctcactgcaagctccacctcccgggttcacgccattctcctgcctcagcctccaagtagctgagactacaggcgccgccaccacgcccggctaggatggtcttgatctccgacctcatgatccgcccgtctcagcctcccaaagtgctgagattacaggcgtgagccacgcgcccagcctgtttttgtccttttcaccaacgaatcctcagtatctacaacagtgcctgtacatagcgggtgctcaggtggcctaggttagccctgaacgtcaacaaggggccagagtaaatgtggatgccctctccattgctgaagactccactaccaacactgctggctgggtgaggcagttgtagatcctgagagggtctatagggtcaagattaggagaggtagaaggtgggcttgggatttgtgtcttctaccctacagactccccagggcctccttaccctggagtcattaggtcccggctgatctctgcagaaggggacagcagctccagtgagtgactcagcctgtgcctgggttactggtgaaaagattcttgtaagaaattaggagtcttggacactgggatctcatggggtctggagatggaggatgctttaacctaatggttctttttaagttttttttgttttgttttgtttttttgagacagagtctcactctgtcacccaggttggagtgcagtgcgcaatctcggctcactgcaacctccacctcccaggttcaagcaattctcctgcctcagctcccgagtagctgggattacaggcgcccaccatcatgcccagctaatttttgtattttagtagagacgggattgcactatgttggccagattggtctcaaactcctgacttcaggtgtccgcccaccccggcctcccaaagtgctgggattaaaggtgtgagctaccacacctggcgacctaatagttcttgagaggaaagaggatggggggctttagccccagggctccttagtggctgggagctttgggctaggacacaagggttcctaagagggcagaagactgggagctgggggtaggggctatgggcttggatacgagggttccccagggagggatgctgggcaccagattctctagaggtctgtggttgagagctgggtcaccgtattctttgaggggagagatatcccaaatctgtctgtttttcccagctgggaccagcacaagccagttcttgcttaatggatagagacaaatttgtctgggaaggcagcaagtggaccaagactaggagagagagagagaacgcgactttctccctctgctctcctccctttttctttctccctgcctccaccccttttccagaacccctacccacatctctctgtgaccctctcacgccccctgctgcttcttccctggcagcaatggccagtccaaggaccagatgactgagatgtcaaaatcccatctcttccctcctcctgatctctctggaccagccacagaggcaggaaactggtctcaaagggagtagctctgcggaaccaggtgggtcctggcttccagaaagtgacctgtatccagagtatgtctgctgtcggggtttttgctgggatctcagcctaagaagtcctcatttccagccggacgcaaggctcacgcctgtaatcccagcactttgggaggccgaggcaggaggatcacccgaggtcggagttctagaccagcctggccaacatggtgaaaccccacctctactaaaaatacaaaaattagctgggggtggtggtgcacgcctgtaatcccagctactcgggaggctgaggcaaagaatcgcttgaacccgcgaggcggaggttgcagtgagccgagatcacgccattgcactcagcctgggcaacaagagcgggaaactccatctcaaaaaaaaaaaaaaaaagaagtcctctttccttagagaaactctccttgacgctcagactaagttaaggcctcctagtctccatgtttctattttttcttttttctttttttttgagatggactcttgctctgttgcccaggctgagtgtagtggcgcgatctcggctcactgcaagctccgcctcccgggttcacaccattccctgcctcagcctctcgagcagccgggactacaggcgcccgccaccatgcccagctaattttttgtattttcagtagagacggggtttcaccgtgttagccaggatggtctcgatctctgaccttgtggtccgcccgcctctgcctcccaaagtgctgggattacaggcgtgagccacacgcccggccagtctccatgttttcacaactctccaattcttctttatcagtgcttccactatccacttattagttagcctttgatggatgtctgcttccctatgggactgtgggcacaagagggtaggaaccagagtgtttttgctcattaagacaactcaatacttggcacagtcctggtacattgctagtgcacagtgaatatttgttgaataaatgaataatcagtaacttcaaagggggttcttaggtggagctttaatgggaagcgtcagtgccattgcctgggctctggggcagctgtgagtccagatctcatggcttctgttcagggcctggtccacatccagccctgaccttgtgcccaaaggccattcaggcaaaaagaggtggaagagtcttctcctagaggaggtagtgcaaaggtggcattagagcattaaggtggctcggatccagaatcttctcccacttttccactcctccaacctgagtttgcaaaagcactaccttccactgcccccatatctcttcttgtggcctattcttcttccctcccagaggtttccttcccctcaaaatgtgccgctcccttgagctgtttccaatgttgtgctcatgaacttgaacatcattctctcttacctgtaaagcccccaggaagagacgcccttgaggcttggcccagaggttaaggaggggagccggcctaagggaggcagggcaagggccttcatcttcgacccttggctcaagaccaccctgacatactcagcttcagctgaagagggagtcccaagaccaggggcagatccagccctggcccgacccagaagacaacaccaccttctgcagagtgtgtgggaaagggacggtagagagaagggaagaatgagccgggcctactgcctgtggcctcacccctagctgccttaattctgctcttcgctatgcctccacctactggccattctcaccacttaaatcctgccccaatttttttggcttgaccctttttgaaaccacacctgccccaagtaaatatgcagtctaagtcaaactgtttgcttgctgtggggagcttcaagatatgtccctcgcccctaccacccacctgaggccatccataagccttatttttatttttatttttttgagacagggtctcactgtggcccggtcagagtgcagtggcacatcatagctcactgcagcttcaaactcctgggctcaagtgacctcctgcctcaggctcctaaatagctagggcagcagacatgtgctaccatgcctggcaatttttttttttttttagacagaggtctctgctatgttgcccaggctggtgtcaaactctggcctcaagtgatcctctggtcttggcctccagcacctgggattacaggcaagcaccccatgcctggctaattattaatgaaaaacaattctgtggagccagtcttgttatgttcctgggctggaaaccttcctaatattgacatgttggactcccctcttccctcattgctccagctccactgaatacaggcaatgccccactgtccccctttacttgatcttggaggtggagctgagccaagatgggttctctggtgtcccaagagcaaggaggtggcctgagcctgctgctgcttgagtcccaggtccaaagagaaggcccagggctctgcatgaggctggggaatgtcgtggggagaaatgattatcctgaggcctcaaagctggggtctcaaggaggaaaggggccgtggtagagggggacagaggcaggctgagctggccagggtgggaaaaatagactccgagaaatctacctcggagattgaattctgcctgagtccctggagggagaaatatcccgggattgattctacatcacagcttctgaggctagtgggggcagatgctgagatctcggcctgttgtccagccaggaatcccggcgcaggcagccatccagggcaggaaccagctggagtgtgaagagataagatacggggatgtagaaatcagggcatcggagccgcagtcccgacctccctccctcagttgactcccctctgagcatttggcctcccccttgcagctctcaacccttccctctccctaaaagtgtggacttagattcccacggccagccacccagcagtgctttaccaatcttggctagggttccacccctggggtgtagttaccggcaaccgaaggttggaagcgggaagagcagccccccaagcgcaatcctcatgatgggatggcgtttgctggtcaggggcccgagacctgtctcaggcgcagcacctcctccccatccacctccagcagcacagagtcccctccatcttgacttccacctgcaggaaggtgggaagcaaaatcagaggcccctgggatcttttctgccaccttcctgtgaggcagcctagtactatagtggaaagaacatgccttaaagagcagctagcatccttggccttgggtcactcagctcttgtcacttatatactgactgagcttagaattcccatcagaaaagatggggccaagaatagctactttgtgggggttcgtgtgattaaacgagatgacagtggtaaagggatgcccaataacttggttttgttccctttcccagaccagctccagacatccctcccctgaggaccagagctagcttacctggtgccatctccatcatccagccgtggtccagcacccaccgtaagctgggcccagtgattgtgcagttgatctcaggcctgccgtctcgaagtcccagcataaaccagtcatccttagggttggtatcccataaaaaatcactccctctgggtcccaggttcgaacctcaaaggaggaggaggttctgaaggacacagaaggaaagattgtgtatgtcatgtgtcctttgagaaccagtgtgggttgggggagatggtgttcacagataaggaaaggaagacagggaaaagagaagagctgatgggagagggcagaaccaggggactgggtcaagggctaggccaaccccatactttgtgatctggtgaggtcaaaggtcatgacagcgataggctcttgtcctgggccattgctgaggtggaagccggagggtcgtgggcactctatcagaaagagaaaacaaacaaagctgagtagggactgtcagagacagacagagggagaggccctgctacagggccagaggagagaagggaagacgcatgagctgagtgccctgtcccgctcctgcacctgggtggggagaacaggtctcagggccatccctggcgggtgtgacgcagtagtagcaacagcagcaacagcagcaggcgcgaggagccagtgggcctctgctctccataatcagccactgtccactcggcggctcagacaactttgggagaatgtgtagaggcaggcagccttgcgtgtgggcggtggagggttaaaggttgccggggaggagggggtaaaggaaacaggggcactgacccttgacccctgcccaggggccagtcacaagactcagctatcacccctctggggatcaatggggtgaaggacagagtccccccactatcatcctccactgccgagaaagtttctgaactgggagaggatattccatctccctctcctcctctagggcctgatctaggtcctccaagatttctgtccactcggggagcctcattcacaggcctgaggtctagaaacagtcctcccctgcgtcccaagtagcatcctgtacaggactagaaatgagataatggaatcctaaatttctagctgagtgaccttgggcaagtacttcacctttgtgcttcagtgtccttgtctgtaaaatgaggaaaataatactttacgggtgactgtgaaagagggttcattgagaaaatgcaggcacagtgcctggcatctggtctgactcctcccccagtcttttcccaggcctctgaggcctgtctcccaagaaggtattgtcttgtgtatgattcagtgaatattaagaagggacctgccccccgcctctcagttatcttccttatccatttattacagggcctaaacagtctagcagtagaaatcacccactccctgaccattttattttattttattttattttattttattttattttagacagagtcttgctctatacccaggctggagtgcagtggcgtgatctcggctcactgctgcctctgcctctcgagttaagcgatcctcctgtctcagcctccttagtagttgggactacaggtgcacgcaccaccagcccagcaaatttttttgtgtttttagtagagacggggatttcaccacgttgcccaggcgatctcgaacctctgacctgaaatgatccgcccacctcagcctcccaaagtacctggatacaggcattagccacaaggcccgaccctccctgacgcattttattttatttatttatttgagatggagtttcgcttttgttgcccaggctggagtgcaatggcacgatctcggctcacgtaacctccacctcccaggttcaagcgattctcctgtctcagcctcccgagtagctggggtaaaggcatgcgccaccacacctgtctaatttttgtatttttagtagagacggggtttaccatgttggtcaggctggtctcaaattcctgatctcaggtgatccgcctgcctctgcccccaaaatgctgggattacaggtgtgagccactgtgcccaccccatgacccattttaaatgcaaatgacagaccgggcttggtgggtcacatctgtaatcccagcactttagaaggctaggcgggcagatcacttgaggtcaggagttccagaccagcctggccaacatagtgaaacccgtctctactaaaaatacaaaaattagccaggtatggttgcccatgcctgtaatcccactactccgagggtgaggcaggagaatcgcttgaacccaggagggagaggttgcagtgagcgagatcgcgccactgcactccagcctgagtgacagagtgagaatccgttaaaacaaaaaaaagagaagaaaaaagaaaaaaaaattagccgggcgtgccggtgcgcgactgtagttcagctactccggaggctgagacaggaggatcgcttgaactcgggaggtggaggctgcagtagcagagatcgcgccactacaccccagcctgggcgacaaagcaatacaccatctccaaaataaataaataaataaatataaaaataaaacatttaaaaaatgcaaatgcccccaagagtaacacttcatgctactcaagagctgcaggaaacagctttcagagctgagggtcttaagcttacccagggtctgggcgggtgagtgagcctgaggctaaagcaggttatcactgcatagtcaatttaaaaagcactgcgggggagcctttgaaccgcggggtatctcgacccaggttggacacccacacaaccgcaaggaagccgcttcactccaaccttgaactctacccaggagccagtcacaagatccagctgtcgggggtggggcttggggggggacgcggccgtgcctgtctccaagctgattggctgacagttgtgccccctgctgcgacagaattcgagggggtgggctatgcccggacagaggatcgcctcgctggcctactctctcctcccgtacggcgccggatcccagctccacttaccaggccgcggctaccccgccgtcccccccgactcccgccacccgctctctcaggctcttcaggatccaagtccgtaggccctttaaggggtctagttgccgttgcgaggccctgggactttggtcccagacagcggggatccggatggcttccgtgcggatcgagaggccaaggagggagactgtggagatatcctgaggctgattcgggtgaagactgcggccggtaacccgggggtcagagtggcgcggccagagcggggtcgtaggaggcgggggcgggggaggggctcgccttgggaacctgctcggggagcagcggggcccttctgctctaattagcttccgtacccacgccttaggagctagccgaattcgaaaaactctcggatcaggtgagatcagtgaagaaggtgggggctcagcgcccaggttctggcggaggctggggaggaaagagggatgggttccccaggcgacagctccaggctgggcatacacccacgtcctctttcttatctctttgtcacaactccaatctcggcagccctgagagcagatggctttggagacaacctttctatcactgtttggtagcagagattcttccagcgcccgggaagctactgggtaaagcacctggcccttagaagtccacctctccagccggcctcagaggtctccccacaggctccagaagccttactccccttttctctctctcagggccctgcgtggtgggctatgggataactatttcatctacagtacatggaagggacgcaccatttatctggaggatatctatgtgtgccggaatatcggggtactgggcagaagctgaggctggggtgggagcaaagcaccccaagaccccactgttatcccctgtccccagagcccagccggtgtcattttctgatccccttagctcaaacaatagctattttttgcctctttctctccacaacaggtcaagggattggttcaaaataatcaaaaaggtggctgaggtgaggagatgggtggggcgacaagtgaggacctaagaagcaagggtatatggaggggggacccgggttgaaagagggagtgagaaaaccttttcttttttgaccccagaaaagttagtgttgtcttctcccacaggtggccttggataaggctgctcccaattccgcctggccgtcctggactggaaccagagggccatggacttgtacaggccctaggagcccaagatctgacggaagctgagggctggcacttcttctgctttcaagagaggcaacgagaaagttggcaggaaagtgacgccatccctaggaggatctctgtcttggtttctccttccccatcagctgaagcactcttcagagactacgtccacagacactgatgtgaggcctccctggaggaaggagggttaggggtgcctatcctcaagtattggaagagcaaattgagggagagacctttcttccttgttgagggtgaaaaataaataagaattacatgtctgatgtggtgttgggtctttcttttatttctttttttttttttttttgagacagagtcctgtcgcgcacgctggagtgcagtggtgcgaactccgctcactgcaacctctgcctcacggttcaagcaattatcctgcctcagcctcccgagtagctgggactacgggtgcgcaccacatgcccggctaatttttagtagagacggtgtttcaccatactggccaggctggtctccactcctgatctcgtgatccgtccgcctcggcctcgaaaagtgctgggattactggtgtggccactgcacccagtccaaagtctttttttttttttttgagatcaagtcttgctgttgtctcaggccagagtgcaaggagtgcaaaggtttgatcttggctcactgcaacatccgcctccgggttcaagtgattctcctgcctcagactcccgagtagctgggattacaggcgcctgtaccacatgcggctaattttcgtatttttagtagagacggggtttcaccttgttggccagctggtctcaaattcctgacctcaggtagtccgactgcctcggccccccaaagtgctggattacaggtgtgagccaccgcgcccagcccacagtcttttctttttctttttatttttttgagacagagtctcgctctgtcacccaggctggagggcagtggtgagatcttggctcacgcaagctttgcctcttgggttctcaccattctcctgcctcagcctcctgaacagctgggctacaggcccccgccaccacgcccggctaagtttttgtatttttagtagagacggggttcaccgtgttagccaggatggtctcgatctcctgacctcgtgatccacccaccttgcctccaaagtgctgagattacaggcgtgagccaccgcgcctggcctgacagtcttcattttcatctggtatgccctacaaaagctcatgcctggccgggctcagtggcttatgcctgtgatccagcagtttgggaggccgaggcgggtcgatcatctgaggtcaggagttcaagagcagccgaccaacacagcaaaaccccatctctactaaaaatacaaaattagccaggcgtggtggcggcgcctgtaatcccagctactcaggaggctgaggcaggagaatcgcttgaacctgggaatggaggttgcagtgagtcaagatcatgccactgcactccagcctgggcaacaagagcaaactccatctccaaaaaaaaaaaaaaaaaaaaaagctcacgcctgtaatcccagcatttggattttgggaggccggcaaattgcttgagcccaggagttcaagagcagcctggccaactaggaaagcaaagtctcgtctctacaaacaatacaaaaaaagccagcacgcaatggcatctcctctaggcccagctactggggaggctgaggcatgagaatcgcttgatcccaggaagggaggttgcagtgagccgagatcatgccactggactccagcctgagtgacagagccataccagtctcaaaaacaaaaacaaaacagcaacaacaaaaatctcaacactttgagaggttagggtggaggatcacttgagcccaggagttcaagaccagcctaggcaacatgggcaagacacatctctacaaaattaggccgggtgcagtggttcatccttataatcccagcactttggaggcaggcagatcacttgaggtcaggagttcgagaccagcctggccaacatggtgaaacccatctcaactaaaaatacaaaaattagctgggtgtggtggcacccatgtaattccagtacctgggaggttgaggcatgagaatcgcttgaacccaggtggcagaggttgcagtgagtgagattgtgccaccgcactccagcctgggtgacagatggagactctgtctcaaaaaaaagaaaatggccaggcgtggtggctcacgtctgtatcctaacactttgggaggccaaggcggtggatcactggaggtcaggagtttgagaccagcctggcgaacagggtgaaaccctgttctactaaaaatacaaaaattagctggtcttggtggtgcaagcctgtaatcccagctactaggaggctgaggcaggagaatcacttgaacctaggaggtggagtttgcagtgagccgaattgcactactgcactctgggcgacagagcaagactctgtctaaaacaaacaaacaaaccaaagaaaacaaaaactaaataaataaaatttgcccaggtcagtaacaaatgcctgtagcccaactactcaggaggctgaggtgggaggatcacctgaaccctagaggtcgaggctgagtgagtcacgtttgtgccaccacactccagcctgagtgacagagtgagaccttgtctcaaacaaaaaaaaaataataggttgggtacagtggctcacgcctataatcccagcattttgaaaaccaaggtgggtagatcaatagagtccaagagttcaagactaacctgggcaacaggcaaaacccggtcactgcaaaaaatacaaaaacattagccgagcttggtggcaaatgccttagtcccagctactggggggctgagatgtgaggacggcttgagcctgggaggttgaggcacagtgaactgagaacctgtcaatgcactctagcctgggtgacagagcaaagccctgtccaaaaaacaaactttaatcactaatgcagaagataaaagagtataaactaggaaacttatacttccaaaattttgtttgtttgtttgagatggagtttcactcttgttgcccaggttgagtgaaatggcacgatctcactcactgcaacctccacctcctgggtccaagcagttctctgcctcagcctcctgagtagctgggattacaggcatgcgccactacgcctggctaatttgtgtttctagtagagatgaggtttctccatgttggtcaggctggtctccaattctgacccaggtgatctgcccacctcggcctccaaaagtgctgggattgcaggcgtgagccactgtcccggccaatacttccaaaatttatcttgcccccatcttgttttgtctttggttttcaggtttactttttttttttttttgagacggagtctcgctctttcgcctaggctggagtgcatggcgcgatctcggctcactgcaagctctgcctctcaggttcgtgccattctcctccctagcctcccaagtagctgggaccacaggcgcctgccaccacgcccagctaatttttttttttttgtatttttagttgagacggggtttcactgtgttagtcaggatggtctcgatctccgacctaatgatctgaccacctcggcctcccaaagtactgggattacaggcgtgagccacgtgcccagcccagggtttacatttttaatgttattaccctcaccttggtcccagatcttctaatattcatagaatatctttgcactccagtatcactccattttcacaaccacccccagtctacatccttgggctccagcccattcatcacttcattagccatctataaaatgatccggccaggccaggcgcagtggctcacgcctgtaatcccagcactttgggaggccaaggtggcagatcacctgatgtcaggagttccagaccagcctggtcaacatggtgaaaccctgtcctactaaaaatacaaaaattagctgggcgtggtggtgggcacctgtaatcccagctactgggaggctgaggcagcagaattgcttgaacccgggaggtggaggttgcagtgagacaagttgagccactgcactccagcctgggtgacagagtgagactccctcttacaaaagaaaaaaaaagtgatcctattaggtgttggggctgattggagtggggtgaaaagggcctgggttcgtccattctaagggaaacagagtggagggtatttaggctaatggctttttaaagggagataaagaaaacttgggctgggcgtagtggctcacacctgtaatcccagcactttgggaggcgaggcgggtagatcatttgaggtcaggagtttgagacca

SEQ ID NO: 5078 - DNA, 13395 bp, Homo sapiens
gtgtagtggcgcgatctcggctcactgcaagctccgcctcccgggttcacaccattctctgcctcagcctctcgagcagccgggactacaggcgcccgccaccatgcccagctaattttttgtattttcagtagagacggggtttcaccgtgttagccaggatggtctcgatctcctaccttgtggtccgcccgcctctgcctcccaaagtgctgggattacaggcgtgagccacccgcccggccagtctccatgttttcacaactctccaattcttctttatcagtgcttccaatatccacttattagttagcctttgatggatgtctgcttccctatgggactgtgggcaccagagggtaggaaccagagtgtttttgctcattaagacaactcaatacttggcacagtgctggtacattgctagtgcacagtgaatatttgttgaataaatgaataatcagtaactttcaagggggttcttaggtggagctttaatgggaagcgtcagtgccattgcctgggctctggggcagctgtgagtccagatctcatggcttctgttcagggcctggtccacatccagcctcgaccttgtgcccaaaggccattcaggcaaaaagaggtggaagagtcttctcctagagggggtagtgcaaaggtggcattagagcattaaggtggctcggatccagaatcttctccccattttccactcctccaacctgagtttgcaaaagcactaccttccactgcccccatatcttttcttgtggcctattcttcttccctcccagaggtttccttcccctcaaaatgtgccgcccccttgagctgtttccaatgttgtgctcatgaacttgaacatcattctctcttacctggaaagcccccaggaagagacgcccttgaggcttggcccagaggttaaggaggggagccagcctaagggaggcagggcaagggccttcatcttcgacccttggctcaagaccaccctggaatactcagcttcagctgaagagggagtcccaagaccaggggcagatccagccctggcccgacccagaagacaacaccaccttctgcagagtgtgtgggaaagggacggtagagagagaggaagaatgagccgggcctactgcctgtggcctcacccctagctgccttaattctgcctttcgctatgcctccacctactggccattctcaccacttaaatcctgccccaatttttttggcttgaccctttttgaaaccacacctgccccaagtaaatatgcagtctaagtcaaaacgtttgcttgctgtggggagcttcaagatatgtccctcgcccctaccacccacctgagtgcatccataagccttatttttatttttatttttttgagacagggtctcactgtggcccagtcagagtgcagtggcacatcatagctcactgcagcttcaaactcctgggctcaagtgaactcctgcctcaggctcctaaatagctagggcagcagacatgtgctaccatgcctggctatttttttttttttttagacagaggtctctgctatgttgcccaggctggtgtcaaactccggcctcaagtgatcctctggtcttggcctccagcacctgggattacaggcaagcaccacatgcctggctaattattaatgaaaaacaattctgtggagccagtcttgttatgttccctggctggaaaccttcctaatattgacatgttggactcccctcttccctcattgctccaggtccactgaatacaggcaatgccccactgtccccctttacttgatcttggaggtggagacgagccaagatgggttctctggtgtcccaagagcaaggaggtggcctgagcctgctgcctcttgagtcccaggtccaaagagaaggcccagggctctgcatgaggctggggaatgtctgggggagaaatgattatcctgaggcctcaaagctggggtctcaaggaggaaaggggccagggtagagggggacagaggcaggctgagctggccagggtgggaaaaatagactccgaggaatctacctcggagattgaattctgcctgagtccctggagggagaaatatcccgggatttattctacatcacagcttctgaggctagtgggggcagatgctgagatctcggcctgtttgccagccaggaatcccggcgcaggcagccatccagggcaggaaccagctggagtgtgacaagataagatacggggatgtagaaatcagggcatcggagccgcagtcccgacctccctgcctcagttgactcccctctgagcatttggcctcccccttgcagctctcaacccttccctttccctaaaagtgtggacttagattcccacggccagccacccagcagtgctttaccaagtttggctagggttccacccctggggtgtagttaccggcaaccgaaggttggaagcggggagagcagccccccaagcgcaatcctcatgatgggatggcgtttgctggtcaggggcccaggacctgtctcaggcgcagcacctcctccccatccacctccagcagcacagagtccccctcatcttgacttccacctgcaggaaggtgggaagcaaaatcagaggcccctgggatctgttctgccaccttcctgtgaggcagcctagtactatagtggaaagaacatgccttaaagaacagctagcatccttggccttgggtcactcagctcttgtcacttatatactgactgagcctagaattcccatcagaaaagatggggccaagaatagctactttgtgggggttcgtgtggttaaacgagatgacagtggtaaagggatgcccaataacttggttttgttccctttcctcgaccagctccagacatccctcccctgaggaccagagctagcttacctggtgccatctccatcatccagccgtggtccagcacccaccgtaagctgggcccagtgattgtgcagttggactcaggcctgccgtctcgaagtcccagcataaaccagtcatccttagggttggtatcccataaaaaatcactccctctgggtcccaggttcgaacctcaaaggaggaggaggttctggaggacacagaaggaaagattgtgtatgtcatgtgtcctttgagaaccagtgtgggtttggggagatggtgttcacagataaggaaaggaagacagggaaaagagaagagctgatggaggagggcagaaccaggggactgggtcaagggctaggccaaccccatactttgtgatcttgtgaggtcaaaggtcatgacagcgataggctcttgtcctgggccattgctgaggtggacaccggagggtcgtgggcactctatcagaaagagaaaacaaacaaagctgagtagggacattcagagacagacagagggagaggccctgctacagggccagaggagagaagggaagactgatgagctgagtgccctgtcccgctcctgcacctgggtggggagaacaggtctcagggccatccctggcgggtgtgacgcagtagtagcaacagcagcaacagcagcaggcgcgaggtaccagtgggcctctgctctccataatcagccactgtccactcggcggctcagacaactctgggagaatgtgtagaggcaggcagccttgcgtgtgggcggtggagggttaaaggttgccggggaggagggggtaaaggaaacaggggcactgacccttgacccctgcccaggggcccatcacaagactcagctatcacccctctggggatcaatggggtgaaggacagagtcccctcactatcatcctccactgccgagaaagtttctgaactgggagaggatattccatctccccctcctcctctagggcctgatctaggtcctccaagatttctgtccactcggggagcctgcttcacaggcctgaggtctagaaacagtcctcccctgcgtcccaagtagcatcctgtatcggactagaaatgagataatggaatcctaaatttctagctgagtgaccttgggcaagtcattcacctttgtgcttcagtgtccttgtctgtaaaatgaggaaaataatactttacgggggactgtgaaagagggttcattgagaaaatgcaggcacagtgcctggcatctggtctgaatcctcccccagtcttttcccaggcctctgaggcctgtctcccaagaaggtattgtctgttgtatgattcagtgaatattaagaagggacctgccccccgcctctcagttatcttccctatccatttattacagggcctaaacagtctagcagtagaaatcacccactccctgacccatttattttattttattttattttattttattttattttagacagagtcttgctctatcaccaggctggagtgcagtggcgtgatctcggctcactgctgcctctgcctctcgagttcagcgatcctcctgtctcagcctccttagtagttgggactacaggtgcacgcaccaccacgccagcaaatttttttgtgtttttagtagagacggggatttcaccacgttgcccaggctgtctcgaacctctgacctgaaatgatccgcccacctcagcctcccaaagtacctggattaaggcattagccacaaggcccgaccctccctgacgcattttattttatttatttattttggatggagtttcgcttttgttgcccaggctggagtgcaatggcacgatctcggctcactgaacctccacctcccaggttcaagcgattctcctgtctcagcctcccgagtagctgggagaaaggcatgcgccaccacacctgtctaatttttgtatttttagtagagacggggtttcacatgttggtcaggctggtctcaaattcctgatctcaggtgatccgcctgcctctgcctccaaaatgctgggattacaggtgtgagccactgtgcccaccccatgacccattttaaaatcaaatgacagaccgggcttggtgggtcacatctgtaatcccagcactttagaaggctgagcgggcagatcacttgaggtcaggagttccagaccagcctggccaacatagtgaaacccgtctctactaaaaatacaaaaattagccaggtatggttgcccatgcctgtaatcccagcactccgagggtgaggcaggagaatcgcttgaacccaggagggagaggttgcagtgagccagatcgcgccactgcactccagcctgagtgacagagtgagaatccgttaaaacaaaaaaaagagaagaaaaaagaaaaaaaaattagccgggcgtgccggtgcgcgactgtagttccactactccggaggctgagacaggaggatcgcttgaactcgggaggtggaggctgcagtgacagagatcgcgccactacaccccagcctgggcgacaaagcaatacaccatctccaaaaaaaataaataaataaatataaaaataaaacatttaaaaaatgcaaatgcccccaagaggtacacttcatgctactcaagagctgcaggaaacagctttcagagctgagggtcttaaggctacccagggtctgggcgggtgagtgagcctgaggctaaagcaggttatcactgcatatgcaatttaaaaagcactgcgggggagcctttgaaccgcggggtatctcgacccaggttggacacccacacaaccgcaaggaagccgcttcactccaaccttgaactctacccaggagccagtcacaagatccagctgtcgggggtggggcttggggggggacgcggccgtgcctgttcccaagctgattggctgacagttgtgccccctgctgcgacagaattcgagggggtggggcatgcccggacagaggatcgcctcgctggcctactctctcctcccgtacggcgccggaatccagctccacttaccaggccgcggctaccccgccgtcccccccgactcccgccaccccgtctctcaggctcttcaggatccaagtccgtaggccctttaaggggtctagttgccgtttcgaggccctgggactttggtcccagacagcggggatccggatggcttccgtgcggatccagaggccaaggagggagactgtggagatatcctgaggctgattcgggtgaagactgcagccggtaacccgggggtcagagtggcgcggccagagcggggtcgtaggaggcgggggcaggggaggggctcgccttgggaacctgctcggggagcagcggggcccttctgctctaatctgcttccgtacccacgccttaggagctagccgaattcgaaaaactctcggatcaggtgaaatcagtgaagaaggtgggggctcagcgcccaggttctggcggaggctggggaggaaatggggatgggttccccaggcgacagctccaggctgggcatacacccacgtcctctttctcttctctttgtcacaactccaatctcggcagccctgagagcagatggctttggagacaatctttctatcactgtttggtagcagagattcttccagcgcccgggaagctactgggtaagacacctggcccttagaagtccacctctccagccggcctcagaggtctccccacaggcttcagaagccttactccccttttctctctctcagggccctgcgtggtgggctatgggatatatatttcatctacagtacatggaagggacgcaccatttatctggaggatatctatgtgatccggaatatcggggtactgggcagaagctgaggctggggtgggagcaaagcaccccacaaccccactgttatcccctgtccccagagcccagccggtgtcattttctgatccccttcactcaaacaatagctattttttgcctctttctctccacaacaggtcaagggattggttccaaataatcaaaaaggtggctgaggtgaggagatgggtggggcgacaagtgaggacctgagaagcaagggtatatggaggggggacccgggttgaaagagggagtgagaaaacctttttttttttgaccccagaaaagttagtgttgtcttctcccacaggtggccttggataagggcgctcccaattccgcctggccgtcctggactggaaccagagggccatggacttgtacaagccctaggagcccaagatctgacggaagctgagggctggcacttcttctgctttcaaggaaggcaacgagaaagttggcaggaaagtgacgccatccctaggaggatctctgtcttgagttctccttccccatcagctgaagcactcttcagagactacgtccacagacactgatgctaggcctccctggaggaaggagggttaggggtgcctatcctcaagtattggaagagcagattgagggagagacctttcttccttgttgagggtgaaaaataaataagaattacatgtccgatgtggtgttgggtctttcttttatttctttttttttttttttttgagacagagtctcgtcgcgcacgctggagtgcagtggtgcgaactccgctcactgcaacctctgcctcacggttcaagcaattatcctgcctcagcctcccgagtagctgggactacgggtgcgcaccacctgcccggctaatttttagtagagacggtgtttcaccatactggccaggctggtctccaatcctgatctcgtgatccgtccgcctcggcctcgaaaagtgctgggattactggtgtgagcactgcacccagtccaaagtctttttttttttttttgagatcaagtcttgctgttgtcccaggccagagtgcaaggagtgcaaaggtttgatcttggctcactgcaacatccgcctccgggttcaagtgattctcctgcctcagactcccgagtagctgggattacaggcgcctgctccacatgcggctaattttcgtatttttagtagagacggggtttcaccttgttggccaggtggtctcaaattcctgacctcaggtagtccgactgcctcggccccccaaagtgctgggatacaggtgtgagccaccgcgcccagcccacagtcttttctttttctttttattttttttagacagagtctcgctctgtcacccaggctggagggcagtggtgagatcttggctcactgaagctttgcctcttgggttctcaccattctcctgcctcagcctcctgaacagctgggacacaggcccccgccaccacgcccggctaagtttttgtatttttagtagagacggggtttcccgtgttagccaggatggtctcgatctcctgacctcgtgatccacccaccttgcctcccaagtgctgagattacaggcgtgagccaccgcgcctggcctgacagtcttcattttcaattggtatgccctacaaaagctcatgcctggccgggctcagtggcttatgcctgtgatcccgcagtttgggaggccgaggcgggtcgatcatctgaggtcaggagttcaagagcagcctgccaacacagcaaaaccccatctctactaaaaatacaaaattagccaggcgtggtggcagcgcctgtaatcccagctactcaggaggctgaggcaggagaatcgcttgaacctgggagaggaggttgcagtgagtcaagatcatgccactgcactccagcctgggcaacaagagcaaactccatctccaaaaaaaaaaaaaaaaaaaaaagctcacgcctgtaatcccagcattttgattttgggaggccggcaaattgcttgagcccaggagttcaagagcagcctggccaacatggaaagcaaagtctcgtctctacaaacaatacaaaaaaagccagcacgcaatggcatgccctctaggcccagctactggggaggctgaggcatgagaatcgcttgatcccaggaagtgaggttgcagtgagccgagatcatgccactggactccagcctgagtgacagagccataccagtctcaaaaacaaaaacaaaacagcaacaacaaaaatctcaacactttgagaggttgaggtggaggatcacttgagcccaggagttcaagaccagcctaggcaacatgggcaagacccatctctacaaaattaggccgggtgcagtggttcatccttataatcccagcactttgggggcaggcagatcacttgaggtcaggagttcgagaccagcctggccaacatggtgaaatccatctcaactaaaaatacaaaaattagctgggtgtggtggcacccatgtaattccagctcctgggaggttgaggcatgagaatcgcttgaacccaggtggcagaggttgcagtgagctagattgtgccaccgcactccagcctgggtgacagatggagactctgtctcaaaaaaaaaaaaatggccaggcgtggtggctcacgtctgtatcctaacactttgggaggccaaggcggtggatcactggaggtcaggagtttgagaccagcctggcgaacagggtgaaaccctgttttactaaaaatacaaaaattagctggtcttggtggtgcaagcctgtaatcccagctacttggaggctgaggcaggagaatcacttgaacctaggaggtggagtttgcagtgagccgagatgcactactgcactctgggcgacagagcaagactctgtctaaaacaaacaaacaaacccaagaaaacaaaaactaaataaataaaatttgcccaggtcagtaacaaatgcctgtagtccaactactcaggaggctgaggtgggaggatcacctgaaccctagaggtcgaggctgaaggagtcacgtttgtgccaccacactccagcctgagtgacagagtgagaccttgtctcaaacaaaaaaaaaataataggttgggtacagtggctcacgcctataatcccagcattttggaaaccaaggtgggtagatcaatagagtccaagagttcaagactaacctgggcaacagggcaaacccggtcactgcaaaaaatacaaaaacattagccgagcttggtggcaaatgcctgtgtcccagctactggggggctgagatgtgaggacggcttgagcctgggaggttgaggctaagtgaactgagaacctgtcaatgcactctagcctgggtgacagagcaaagccctgtctcaaaaacaaactttaatcactaatgcagaagataaaagagtataaactaggaaacttaatcttccaaaattttgtttgtttgtttgagatggagtttcactcttgttgcccaggttggatgaaatggcacgatctcactcactgcaacctccacctcctgggtccaagcagttctcctcctcagcctcctgagtagctgggattacaggcatgcgccactacgcctggctaattttggtttctagtagagatgaggtttctccatgttggtcaggctggtctccaattctgacctcggtgatctgcccacctcggcctccaaaagtgctgggattgcaggcgtgagccactgtgccggccaatacttccaaaatttatcttgcccccatcttgttttgtctttggttttcagagttactttttttttttttttgagacggagtctcgctctttcgcctaggctggagtgcagtgcgcgatctcggctcactgcaagctctgcctctcaggttcgtgccattctcctccctcacctcccaagtagctgggaccacaggcgcctgccaccacgcccagctaatttttttttttttgtatttttagttgagacggggtttcactgtgttagtcaggatggtctcgatctcctgcctaatgatctgaccacctcggcctcccaaagtactgggattacaggcgtgagccaccggcccagcccagggtttacatttttaatgttattaccctcaccttggtcccagatcttacaatattcatagaatatctttgcactccagtatcactccattttcacaaccacccccatgctacatccttgggctccagcccattcatcacttcattagccatctataaaatgatcctgccaggccaggcgcagtggctcacgcctgtaatcccagcactttgggaggccaaggtgggagatcacctgatgtcaggagttccagaccagcctggtcaacatggtgaaaccctgtctcactaaaaatacaaaaattagctgggcgtggtggtgggcacctgtaatcccagctacttggaggctgaggcagcagaattgcttgaacccgggaggtggaggttgcagtgagacaagatgagccactgcactccagcctgggtgacagagtgagactccctcttacaaaagaaaaaaaaagtgatcctattaggtgttggggctgattggagtggggtgaaaagggcctgggttctgccattctaagggaaacagagtggagggtatttaggctaatggctttttaaagggagaataagaaaacttgggctgggcgtagtggctcacacctgtaatcccagcactttgggaggccaggcgggtagatcatttgaggtcaggagtttgagaccagcctgaccaacatggtgaaacctgtctctactaaatacaaaaaaaaaaaaaaattagccgggcatggtggcgcatgcctgaattccagctacttgggaggctgaggcaggagaatcgcttgaacccaggaggcggaggtgcagtgagccaagattgcgccactgcactccagcctgggcaacagagcaaaactccatcaaaaaaaaaaaattaaaatgtctctcaaatctgtccatagctctatccttacttgcaaattctcactctttgaaaattgccacaacctccttactggtctcccagcctccttctgtaattctcccccaattccatgggattttttttttcacagatatacattatgtactttattttttatttaaatttaatttatttctttattttgagaccagtttatgcagctggtttttttttttttttttttttagacggagactcgctctgttgcccccaggctggagtgtagtggcatatcttggctcactgcaacctctgcctcccaggttcaagtgattctcctgcctcaacctctgagtagctgggattacaggcgtgcaccaccacgcccagctaatttttgtattttttttagtagagatgggttttcaccatgttggccaggctggtctcaaactcctgacctcagatgtctgcccgcctcagcctcccaaagtgctgggattacaggtgcgagccactgtgtcaagccataatttttgtatttttagtagacatggggtttctccgtgttggccaggctggtctcgaatcctggcctcaagcaatcctccatccacataaatgataatacatttgcccacgtggcatcaaatccacaaccttggtgttagcacctggctctaaccaactgagctaactggctatgcaaatcttgatttttttttttttttttttttttttttgtgacagggtcttgctctgttcccaggccaagtgcagtggtgcgatcatggctcactgcaaccttgacctcctgggctcagtgattctcccacctcagcctctcaagtatctgggatcacagtcaggtgctatcaagccggctaatgaaagcaaaatttttgtctgggcacggtggcacatgcccgtaattctagcacctgggaggccgaggcaggtggctcacctgaggtcaggagttcgcgaccagcctgactacatggtgaaaccctgtctctactaaatacaaaaaaattagctgggtgtggtggcacatgttgtaatccaagctatttgggaaactgagacaggagaatcacttgtacctgggaggcagagttgtagagagccgagattgcaccattgcactccagcctgggtaacaagagcaaaactcgtcccccaaaaaaacaaaaaaaaaaattattaatctgggcactgtagctcacgcctgtatcccagcactttggaaggctgaggcgggtggatcacttgaggtcaggagttcgagaccacctggctaacatggtgaaaccccacccgtctctactaaaaatacaaaaattagccagattgggggcaaacggctgtaatccaagctacttgggaggctcaggcaggaggatctcttgacccgggaggcaggggttgcagtgagccaacatcgtgccactgcactctagcctaggcaaagagtaagactctgtctcaaaaaacaaacaaacaaacaacaaattttttattggagactggtctcactatgttgtccaggctagtattggactccagagctcaagcaatcctcccacttg

SEQ ID NO: 5079 - DNA, 15763 bp, Homo sapiens
cctctgccacacgcttctgattggggaggaaggagcctagagaggttacacacaacacacccagctctgccacctactaggatatcacttttcaggttgcagcttaaatgtcactccatcccccagaatctcaagcaggattagtgtttactgatttgggcttccattgttccctggctcacccaggcatagcaccaaccacactttagtgctattgcttgtttaattactgatcactttactaaactgtctcatcctaaggcaaccgtccatcagttctgcgacctaacaaccgttggcctcccgatttctcctgtccgttgctgataaactgcttgaaagaaaagtctacatttgcctccacttggtcctctctctcctccctctcagtccacacccgggctccaggctcctcgctctactgaaagtgctctttttgtcctcagcctccctgatccttttgtgcacctggcctgtgggccccccttccttgaacctcattcttcttggctttcatgacgtcctctctccggtctcttcctgggaacttagagatctaggccttctcctctttctcctcttctccctcttctcttcctcttcttcttgcctcaagtccctctgtgctgactctgctccttcttttcccgatcctttcccttaggccacctcacccacaactgggtttcacccaaatccttgagggggtgctccaggtgggcccgttgcacgtggccgtgcagggtgttcagtgtacaggcacacccgccaggaaacaaggaagaggctccctctctgcaatttgtgtaaaggccccgcaggttagtgtgaccctggcatccatacctcctgccccatgcctctcccaagctccagccctgctctctagctgctcacaggatagttccctaaacactgctggcagaacctgcccagcctaggccggaaagaggctgacagagacagagccggctgactggatgatctggagataggttcttggcactctgttcttccatttcaccccccttttcaaagactcagtcttagccaccctgccctagcccatgttagatggaaaaaaatagtggtgagcagggagcagaaggctggagagtagtagtgcaaaagaacaagggggctgggaagaaaaggagcaaatggggcaaagcagacaggagggaggtcagctggcttctcagctgccaaagctcttccaggcacgtcatctcatttggtctcatgaaaactctctaagtggatattactatttttctcattctacagctgaggagagacaagctagtaaaggctgctcaagatcactaagccagcagtggggaatattgtgaaatatgaaatattttattatttcatagagacagggtcttgttatactgcccaggctggtctcaattcctggccataagcgattctcccacctcaacctctcaaagtgctgggattacaggcatagccacctggccgaatccaggtcttttgacaccaagtgccctattcatccctttgccctccctaatctctgggcagatttgagtgaggcgataggctgggggatatggcattgggatatggggttgcacctgaggagaagccaacagcaccagggtcagaatgggcaaaggacataacacaggcaaggccattcctggtggggctgggccagggagctgaggggctcctagaagggcaggttccccgacttctctgagcttcagcgcctggaggtttctgggcagccacacgctttcagcgctgacccttcctcttcctttatccttggaaaataacccctagggcacaaacccaccgaagcaatgatactaagtgtcagggcattcctcgactctcccacccctggggaagaggcctggcccaagccctgagaacccgttcccacctccacaggcagtgccagggactccaatagggtgctgaaattccagaagtcttgatatcagactgggtcctgcacccagctgccaccgcatcctccccctgctccgcagctgcctctgaagcttgtacccttgcccccacctctgtctctctgcagtctacctgactgcactttctgatgacccccactgacctctcctagcacccatgtttattaattacttaaacctaaagtatttacggagctccacctatgtgccagagcagggctgggcaggaggattcccattccaccccagattccttttcctttgggttctacccagatctccctctgtctcaacagctctacccttaactcagcagccctgggatttctccgtgggagggccccctgcatgggtataccctccactgagagtagctgaaaggagcccagggagcctcccaggcgatcccttcctccctccagcccaccccaccacagggccttctcacttctccaacacactggagtcaccctcagtctttaaagaagaggatgggaatcagtctctcctgttttgtgtatagaccccatccttacacctcagttgctgttccgaacacctccctccccaggctgagcaaggaatttccagcctaaatgttaaagcaaaggcggaaggactgcaggcttccaatcctccctaatcctctcatctctccaccacctagtttccccagagccatcagtcaagccctttgtgggagaatgtggagtgggcagtaagagctgacccacccctatcgggcatctctgagtctactctgaagttaaacctgcctcacaggttcccactccccttctgctgacgctggaatgcaggactgatggtgggtggagaaccatttcccctctttccggattccccctgccgaggctcattactctttgtgtctgttctgggagcttctcaccagggcccctctgctccaccctttcccgggactgtcctcacaatcacgccatccccctttccaccttgctcccacccccaccccagaaccctagtgctgggaatctggaggccgagaccttcaccccagtctccaagaggctctctgacaaagtgaaaaagccctgagccacagaggaatctggaagtgtggaaaggggcaggctggtgctggaagcccgaggtcggtatttgccccatgctgcaagagtcaggaatgtggccatcgacatcagtaggagagataaagtctagctggcagctctcctctccagcccccacgctgcacctccacaggtcccagaagtttcctagcagttggggtgggcaggaatcagacaaggacctgggaattagcttggagaaaaattctagaatctgttttgttgctggtagatttcaaagtgccccagggtttttaaatgactcagagagacagacttcaaccccttgagcccgtctttcgaattaaattgaccccctttatctgccctcctgtatatatgaagccttccttactttgaaggaaggctccagtacaaataattagtatttgtttgatgatgagtgagtgacaatttacactcacattcactgccacctgaggaaatagactggacagtcttactgttttccctgtacaagtgaagaaattgaagttcagagttaggtgacttccccaggttacacagctagcaaagtatccaggctggctgacttaaagcttagcaataacagtaaaggcagtacatagcttgttgactccacatactttattataaaatactgcccaacttgaagttctggaatccagtgggggaatataaaggtgaaagcaggagagacccctctgactggacctcttacctcccagaagccttgtatgcaaaaccagtgggcattcatttgtatgttatttgcatcccgtttgcctcccagccttcagcaggccccgaccctcccctggccagcttccccctgactgccccctggctggctcccattgagcactgtggggctctccccaccattagggacagatcaggaacaatccaggctcaggctctttatctgtgctctgcctcccacctggcggtccactggccaggcttttccagggtcccttctctcccaggtctgccctactatttgtctccccttccccctcagctggtagctcgataagaatcaataggtccactccagagcaaaaacacagccaaatgtgtcataccaggccctgccagaaaaacgagctgctggagctgacaacttgaaggccaaacacctaagggttccccccaacacttcattcagcagggatggtcatcagcttcagggggcaggcagcatgaaagcctccctacctccatccttctcacacagaggtggggagagcatcttggaggatgcagtcccctggggccaggcttctaatccagacagccttacaaggggggacaggggaaggactggcttggagaaaagtcctagaaaagaggggagggcactggccaccagggctgggtcgctgctatgatggtcctaggagtgcctgcctgtccttcaggccccatgcgatgtaggacacattacttttatttatttatttatttattttgagtagagtttcgctctggttgcccaggctggagcgcgacggcacgatcttggctcactgcaactctgcctcctgggttcaagcgattctcctgcctcagcctcctgagtagctgggattacggcacacactgtgcctggttaatttttgtatttttagtagagaaggggtgtcaccatgtggtcaggctggtctcaaattttttttttttttttttttttttttgagacagagtcttgcctgttgtctaggctggagtgcagtggcatcgaactcttgacctcaagtgatccacccgctcggcctcccaaagtgcttggattacaggcatgagccactgtgcccggcgatgtgggaccattatcatctctgtgagagatttttggtctcttttgtcaccgcccttctctcccagctctagaactgggcctggctcacagtaggtgctgaatgcatactggttgaattgtaaatgccaggatttgtttaattaaggatgcaggaaaggtgatataccggtgtgcagaagtcaggagcattccctgtccaaatcacagtgttccactgaggcaaggcccttgggagtgaggtcggagaggggagggtggtggagggggctcagagactgggtttgttttggggagtctgcaccttttgctgagtgaatgtatgtgtgtgtgcatttgagagcacacctctgtatgattcgggttgagtgtgtgtgaggaaacgtgggcaggcgaggagtgtttgggagccaggtgcagctgggtgtgagtgtgtaagcaagcagctatgaggctgggcattgcttctcctcctcttctccactcccagcctttcttccccgggactcctggggctccaggatgcccccaagatcccctcccaagtggataatttgggctgcaggttaaggacagctagagggactcacaggccattccaccgcacaccaccagacccccaaatttcttttttctttttttttttttttttttttgagaagagtctcactctgtcgccaggctgcagtggcgcgatctcggctcactgcaacctccgctcccaggttcaagcgattccccttcctcagcctcccaagtagctgagactacaggcgtgaccatcacgtccggctaattttttgtattttagtagagagggggtttcaccatgttggcaggatggtctcgatctcctgacctcgtgatccgcccacctaggcctcccaaagtgctgaattacaggcgtgagccactgcgcccggtcaagactcccaaatttcaaactcgccagcactcctccacctgggggagaagagcataataacgtcatttcctgccctgaaagcagcctcggggccaacaacacctgctgtccgtgtccatgcccggttggccaccccgtttctgggggggagcggggcttggcagggctgcgcggagggcgcgggggtggggcccggggcggagcggccggggcggagggcgcgggctccgagccgtccacctgtggctccggcttccgaagcggctcggggcgggggcggggcctcactctgcgatataactcgggtcgcgcggctcgcgcaggcgccaccgtcgtccgcaaagcctgagtcctgtcctttctctctccccggacagcatgagctcaccactcgctccaccttctccaccaactaccggtccctgggctctgtccaggcgcccgctacggcgcccggccggtcagcagcgcggccagcgtctatgcaggcgctgggggctctgttcccggatctccgtgtcccgctccaccagcttcaggggcggcatggggtccgggggctggccaccgggatagccgggggtctggcaggaatgggaggcatccagaacgagaaggagccatgcaaagcctgaacgaccgcctggcctcttacctggacagagtgaggagcctggagccgagaaccggaggctggagagcaaaatccgggagcacttggagaagaagggaccccagtcagagactggagccattacttcaagatcatcgaggacctgagggctcaggtaaggggtggagggacctcaactcccagccttgtctgaccctccaattatacactcctttgcctcttccgtcattccataaccaccccaacccctactccaccgggagggggttgggcatacctggtttccatccgcgcacctagccacagggtccctaagagcagcagctaggcatgggagggcctttcccaggagagagggggaaggggacagggttgagagctttacagaggaagtggacacatggagggaggtaaggaaaggcctgtaaagaggaggagacactggctctggcggaatgggactattggagggttaagcggatgtggctaaggctgagtcatctaggagtaaacaagagccttcctttgggaggagccaatccagggtgtagggggcccagagtgaccaggtgcactgggaaaaaatgccaggagagggccaggaagaggacttgttagtagcgactcacttctggcaggcaggccagccagctagccagcctgctgaggcttcccaagaggggcagagtgctggatctgggaatccaggaaaggagggaatggggtggggctagatgaaaagggataggtgtcagggagagcctctggctattcctgggaccaggaagttttcactaggatacataacacttttacacactcaccccacccatccctggctttctattcatggaacaacctctctctacaaccctccagatcttcgcaaatactgtggacaatgcccgcatcgttctgcagattgacaatcccgtcttgctgctgatgactttagagtcaagtaagtttgggggctagagagctgggggccaggggtggagctaagaaggatctgctccccaggctgggtcagttaggggctcacagtggatcctgttaggtgtgggtggatgagagtcagggtccatcagtgtattcatttaactgtcatttgtataaccccgtttaagaatactgtcctccaagtgccaagaatggtgctcagggattaccacctaattgctgactcaagttgctggtttgcaatgggcacagaacttctcttgtaggtggcatgagttgagaaggttctggatcagagataggggcccctctgatcacctcactcctataggtatgagacagagctggccatgcgccagtctgtggagaacgacatccatggctccgcaaggtcattgatgacaccaatatcacacgactgcagctggagacagagatcaggctctcaaggaggagctgctcttcatgaagaagaaccacgaagaggcaagcaggggcactggccaggccagggattgaggggccaagagaagtctgggtcggagaatagacaagacaaccaactgcaagtagccttgctaagacgtttagaaatagcagcctgggctcttcttaataagaccgttctgatgaagagcattctcagggggtcgagtacaccctggctcacctgaatacaggtcaaaatgatatgggttagaaaatgagatgagaacagaagtagaagcagctaaactaggagctgggggtgataaaggaatgacagcagatggagttggcagcgcttcctaaagatggtagaaggagcaggtttgtgaaggggagggtggataaaggaacagggtgaagttaagagaaaccatcagtgagtgggtggcatttctacccactggagtagaaaggccagaactgcattgccctgagtgcaagccaaggggttcctcctgtctcttctccaactgtaggcctctagaagaggcaatcacagaagaaaggccttgttggagctctgaccctgaaccctcctcattttgcccctgtcacctttaggaagtaaaaggcctacaagcccagattgccagctctggttgaccgtggaggtagatgcccccaaatctcaggacctcgccaagatcatggcagacatcgggcccaatatgacgagctggctcggaagaaccgagaggagctagacaagtactggtccagcaggtgcgtgaggggaggggatggctgccaaggtgtgggagggaggcagacggaataggggcctgatggactgtccccatcctgcagattgaggagagcaccacagtggtcaccaacagtctgctgaggttggagctgctgagacgacgctcacagagctgagacgtacagtccgtccttggagatcgacctggactccatgagaaatctggtgagtgccttcacatcacctgccagctcctccttcacttggcctcagacccaaccctgtctcaacccaaatcctatccctatatcatgagttcctttagctcagaaagagtcagtttcctctttgcatttccctccactctatcccttatcccagtacttggcacatagcaggtgcccaaaaaagtttccaaaagtgagggatgagcagtcctgggactctgggctcaccctgcccctcctctctgtgcccctgcagaggccagcttggagaacagcctgagggaggtggaggcccgctacgccctacagatggagagctcaacgggatcctgctgcaccttgagtcagagctggcacagacccgggcagagggaagcgccaggcccaggagtatgaggccctgctgaacatcaaggtcaagctggaggctgagtcgccacctaccgccgcctgctggaagatggcgaggactttaagtgagtggggctctccacccacacgtgctgggatcaggagatcacttctccccaaagtctgagcttttggaagcacccatgtgtctgttcactggtatccactgagcactgggccgttgctccgtgggtgctccgtgtcttcaagggagtaacagttacagaggtctcccccttgaagaaagcaaactaagtatgtccctagctgtacttagtatgcaaatgaagtttggccttgagtttcccttttctggagaagaggctgagggtgatttggagataaaggtagaggtcaggaggctttttccctctactttcttgtctcccttctactccacggggctgtttataacttgggcttggtcttctgttaagtcttggtgatgccttggacagcagcaactccatgcaaaccatccaaaagaccaccaccgccggatagtggatggcaaagtggtgtctgagaccaatgacaccaaagttctgaggcataagccagcagaagcagggtaccctttggggagcaggaggccaataaaaagttcagagtcattggatgtcactttgtcttcttttggctgttttcattgtgcacaaatgccctaacccacagtcccatccctgatccagcagaaaccacctctgacccctgagggtttcatatagatggggtgtagaaggaagagggatctgtattcttggaaacacttctgagagacagaggaggagcagtagatgtgatgggtcacaggctgtggggatccctacaagggaattgtggaatcttgccttgaagcgatctggtgttcaaaaggtccctgactgatcattagcagaaatctgaacagaggaggaaattaggccaaagacagaggacagaggagacagggagacacatctggcctcccctaccctgctgctttatgcccttggcccactgcccagggcttcccacccacagtttttcctccaaccccaggccatactcatcctccaaacctatggtgccctcaactctgttcttcactcaacggagatatgatttttagggtgctagaggtctggctagaagttgagtaaagatcatggaagttcccatctaggaaagaggtgcccctgagtaagcacccgtataggtaagatgggcatcttaaaactaaccgaggctgggcacagtggctcacatccgtaatcccagcgtgccaccacacccggctaatttttgaatttttcatagagttgggatttcactatattgccaggctggtctggaactcctggcctcaagtgatcctcccgcttgtaccctttggagtgttggatgccactttgtgtcttccttggctgttttcatacttgtgtgaaaatgccctaaccaacatgattacatgtagatattcgttgcagcagttttgccaaaacaaaactactaaagtcaaggcacccatcactcaaagacctaggttaggttaattttttttttttttttttttttttttttgaggcagagtcttgctctgtcacccaggctggagtgcagtggcgcgatccggctcactgcaactgcctcctgggttcgagggattcttctgcctcagcctcctgagtagctggatttcaggggcccgccaccatgcctggctaatttttgtatttttagtagagacgggggtcaccttgttggccaggctggtctcgaactcctgacctcgtgatccgcccgcctcggctcccaaaatgctggattacaggcgtgagtcaccacgcccggcctaggttaatttttaaatgttgggttaaggcaaaaaaaaattttttaatttaaaaattagccaggcatggtgacattacctgtagtcccacttaatcaggaggctgaggtggaaggattgcttgagtccaggaagaaaggttgcagtaagctgtgatcatgccactgcatttcagcctaggtaacagagtgtgatctgtttcacaaaaaaaagctggccgggcacagtggctcacgcctgtaatcccagcaattgggaggccgaggcgggcagatcacaatgtcaggagattgaggccatcctggctaacatgtgaaactctgtctctattaaaagtacaaaaaattagccaggcagctgggtgtggtggccatgcctgttatcccagcactttgggaggccaaggcgggcggataacttgaggtcaggattcgagaccagcctggccaacatggtgaaaccctgtctctactaaaaatacaaaattagtgggtgtggtggcacatgcctataatcccagctacttgggaagttgaggcaggagaatccttgaacccaggaggtggaggttgcaataagccgagatcatgccattgcactccagcctggcaacaagagcgaaactctgtctcaaaaaaaaatatatatataatatatatatgtgtggtatgtatatatgtgtgtatatatgtatatatgagtatatgtgtatatatgtgtatatggtatatacatatgtgcatatatatgtgtgtatatgtgtgtatgtatatatatacatataacatacatatatatatatatacatacacacatacacacacacacacatatatatgaaataaatttaaaatcttgctgggcatggtggctcatgcctgtaatcccagcactttgggaggcaaggtgggtggatcatctgaggttgggagtggagaaactctgtctctactaaaaatacaaattagccaggcgtgatggcgcatgattgtaatcctatctacttgggagactgaggcagagaatcgcttgaaccaaggagttggaggttgcagtgagacgagatcgagccactgcacccagcctggcaacagagcaagactctgtctcaaaaaaaaaaaaaaaaaaaatagccatggtagtggcatacacctgtagtcccagctacttgggaggctgaggcaggagatttgcttgacccagcaggcagaggttgcagtgagtgaagatcgcgccactgtacttcagcctgggtgcagaacaagactccatctcaaataaataaataaataaaactaaataaaataaaatctccctctccactccctagaagtaaccactgttaaataccttttaaaattagacatatacaagacatttcattatgttttatatatgtaaaattatccagctctgcatcttgatttcttttttatttttttttaattgagacagagtctcactctgtcgcccaggctggagtgcagtggcacatcacggctcactgccacctctgcttcccgggttcaagcgattctcctgcctcagcctctgagtagctgggattacaggcacccaccaccacgcctggctaattgttgtatttttagagagacagggtttcaccatgttgatcaggctggtctcgaactcctgaccttgtgatccactgcctcggcctcccaaagtgctgggattacaggcgtgagcaccatgcttggctttgattcttaaattctactttcttcatttaacaatacgtctcggggctgggcatggtggctcatcctgtaatcccagcactttgggaggctgaggcggacagatcacgagatcaggagatcgaactatcctggctaacacagtggaaccccatctctactaaaaatgcaaaaaaaattagctggcatggtggcgggcacctgtagtcccagctactctggaggctgaagcaggagaatggatgaacctggaaggcggagcttgcagtgagccgagattccaccactgcattccagcctggcaacagagcaagactctgtctcaaaaaataaaaataaatgaaaatacatcttggacaccttctgaatcagtatacatagacctgccccattcatttgagtagctgcttagtactctacgcgtggagtacaaattaattaacctaacctaggtctttaagtaatggatgtcttgatctttttttttttttttttttttttttgagacagaatctcactctgtcgcccaggctggagtcagtgctatgatctcagctcactgcaacctctccctcctgggttcaagtaattctcctgctcagcctcccgagtagctgggactacaggtgcatgccaccatgcccagctaatttttatattttagtagagacagggtttcaccgtgttgccaaggctggcctcgaactgagctcagcaatccaccagccttggcctcccaaagtactgggattacaggcatgagcaaccacgcccgcctaaaagctttttcttttcttttttttttttttttgacagagtctcaccctgtcgctaggctggagtgcaatggcacgatcttggctcactccaacctctgcctcccaggttcaaggattctcctgcctcagcctactgagtatctgggattacaggcaccctccaccatgcccactaattttttgtatcttttagtagagacggggttttcaccatgttgatcaggctggcctgaactcctgacctcgtgatccacctgcctcggcctcccaaagtactcggattataggtggagccaccgtgcctggccatcttgatctttagtagctttgtttttgcaaaaaacagacacagccaacgttataggatgcgcagctgactgaaggtaaaacaggaagtccctggggagctgagcagtacttgcagctgagtcaagctgatcagagtaatccaagacgatgcacctgatcgattagccctcccattagacaatgtctcacagttcccagggtgcttatgcatttgatctcattacaatcctgtgaggtatgcaaggctgtgggtattattggctctggctctgagagtggatactgaggtccacaggcatcatgcaacttgtctgaggtcacagagctggaagcttaagcaggaaccacatctccaggttcccagtccgcaggtctttcctctgtgtgctataactaactgtgcgggctgcacaatagaatccccgggaagctttacaaacaatactgaggcctggtcccagcaccagagattctgattcaggtgtttggagggcaggactcagggcaaatgttgaaaagctccctaggtgactccaataggcaggcaaggttgggggccagacccaagctgacctggggtttgcagcatgacattccttcctgattcaggttatggttgtgtcagatttattatttatttatttatttatgagactctgtcacccaggctggaatgcagtggtgcgatctggctcactgcaacctccgcctcctgggttcaagtgattctcctgcctcagcctcccaatagctgggattacaggtgcacgccaccacgcctggctaatttttgtatttttagtagggcagggtttcaccatgttggtcatgctggtcttgaactcctgacctcatgatccgctcgctcggcctcccaaagtgctgagattacaggtgtgagccactgtgccaggctggctgtgccattttaaacagcgcactgctggaaaatcccgaggcctctggaacaatcctactcattcccagcatgggaagatgactgaggggcagcctattttgtcccccaagcaccaaaggttaaattatcaatcccaaggttataacatggagtcatctgttccatattatatcagtcctatttatccattctctatcaaagtgcaacccaacccagatgataaaattaataaatggtactggagatacagaatggcatatagtgccatttgagggaaaaaagcaactcatatgtatataccttgtacatgcaaacatctctacaaggagacaggaaattggaattcgtgattgcctccgggagagaaattggtaggggggaaacaagggggaaggaagactactttacattgtgtgtcctttataccttctgaattacttattactaattacaaagaaagcagggaaggattgttaacttcctttttttttttttttttttttttttttttttgagacggagtctcgctctcgcccagctggagtgcagtggcgcgatctcggctcactgcaagctccgcctcccaagttcacgccgtctcctgcctcagcctcccaagtagctgtgactacaggcgcccgctaccatgcccggcaatttttttgtatttttagtagagatggggcttcactgtgttagccaggatggtctcgactcctgacaccgtgatccgcccgcctcggcctcccaaagtgctgggattacaggcgtgaccaccacgcccggccgattgttaacttttcaatggtacaggaatctacagacttccaggaaggaaatgttgctgctgtctttgttccactcttttttatttcttttttctttctttttttttttttttttttttttttgagacaagtcttgctctgtcacccaggctggagtacaatgcacgatctc

SEQ ID NO: 5080 - DNA, 11889 bp, Homo sapiens
acagcaaggtgggaaagtcctgctggaaatttttggagagcacattttttaaaagttgaaagttcatcagcccaagaagaaaaggacacagagagtttgggccgacatatcgcaactccattagcgcgaaatgaattcacgttactctgcctctgaacatggagggccctgtacagaacaaagacatatgcaccatcatgcaaaaaagccacttgaaacatgagggagcatagaggaagtccttgaagaggtcttttccaatttttctcaacccacatattttataggaaagcttaaactctcactaaaacaatggattaaaaaatgagaaaccctccttccagtttcacaatcatttgtctcatcctctcgagagttgctagaaaaaagaaaaaaggacaaaatacgtggcagagctccagcatgaacaaacttgaaaaatcctgcctttgctaggaaaatattcttaaatttcaaacacattccaacctacccgatacaaggtacaaaaagatcattgtcaaaacaaagaaaaccactcacatgccaaagatcatggaacctaaagcaatcaataaagccaggactgattaataagcacagcctacttataaactgactcgtcttttggtttgtgatgcagggagacttaaatttcaaagacctcccgtgtgcttctgaaaattacaaatgagaaatattggagtctatactgctatcaaagtggcaagttagttctccttaaaagctgtacttaaataaccatgcgctgtgtcctttaagaaagccctaggatcatttccccagccagcctcctctgatcccttctgatccgtgtgggtaagtgcactgtacctcctgaccatgctcttggtgggacttttttagcatgaccttgaaatactttgttttactgagtccttgcagtcaaaaggagtctcttggcatcctgaaactcccaagtcaagcataatgtgtattatcaaaaagatgcccaaaaatcctgtggaattaatctttgaaagctaacaacatcaaaataatagtactttaaaatctctttgaagctatcaagaaatggcaaagatgtttcaacatgtgcatcaaccctggtcaattggaacagcctcccagaacactctattaaagagaattcaagagtcagatccattcttgggagaaaacagagtactgatgaatgagtgatgtccgccagtgacctggaattaaggaatgatgcaagtagcctatcggtttgtcattcttgttcttatttatcctcactctctgcacaggttcttacatgaaatcctaaaaagaaaatccactaaaatccaaagagtggtacaatcagcacgccccaacctacttagaatactgtgggcctggagtctaaaaatggaaaccagttcatgtcaaaccaattgttcttcgtggagcacagggaggatattaggaatatgccttcataaagcctgagtcagactggtatcctctaggtgactttcaaaactataggtctggaagcacctctcctatggcatctttgtaaaactgattaactattttcaataagtttttctatcttccccatggaaaattgcaagcgcgctgcatatgtaaaaatataaatgtgtgactcatctcgcctaggaaatgctgacagaaccaggaatgtatgtgtgctcctgactccataaatgtctcccgggccccggttcatcttgacattcccacacgctcccatgccatcgtggacaagcttgcattcataaaattctgaccctgggatgcccctcctcaaggaaaattggaggtcagcacagtgcttgttggctctgagccatgaacttttgacacagcatctgcatttctcggccagtcaagggtttgtatgagagggatcctggctgacgggactgcagaaggcagccatttggaatgcagcatgagctgcaacttctacactccttccggagtggtcagcattgcaatgtgaggatccagtaaattgtctgtgcctatttttttttctttttcagatggagtctcactcttttgcccagctggagtgcagtggcacgaccttggctcactgcaacctccatctcttggattcaagcattctcctgcctcagcctcctgagtagctgggactacaggcatgcaccactatgcacagcaatttttgtatttttagtagagactgggtttcaccatgtttgtcaggctggtctgaaaccctgacttcaagtgatcctcccaccttggcctcccaacgttctgggattacagcgtgagcaccacgcctggcccctattctgaatgtagtgcaggcgacttccactagtgacagggaggatctgtactagccagagatgtgaagtgattcatggcacggggaccctgacactgctatagccctgtggtgttgacaaggcacattggagacaacacaacaccctgcgtgccggtggccagatttacgggctgaactgcttcctctattctgacataatgcactgtgacagagtgacgaagacagcgtttgtgcctgtaaaaccctcatgatcaacaggaaatggagctctctccaagttaagtcctggaagaaatcgcatgccgatgtcatggcagcctctgctgctggggctaagccatctgcaattcagatggaatctgatccgttcggaaacagttacaaagtccaaaaatgggcggccagagcttggctcctgacagagcggggtggagggggcaagggactcagcaaacttggagctgggcaaggatccaatattttttttttccttttgcccagtatctgtccattcctcttaacatggcaaatgaaatcagacttcaacaccagaaccttgatgagccgattactgaaaaaagaatcagttcttcccctgcacgctccatgcacccttcttcctcgtctttccctttctgttacatcccctgcacacgttccttacctgagctgccggtatcgatccacagcaccacagaggaaatcacgaaaagaggacgaagaaagtctgaccacttctaactaaacgtattacaaaagtatgaagattcacaggatatttttggtagaaggttcctaagggtcagttgtatgttgttccaatcaaccagttgagacagaaacattgacttacttgagtagaagtagtcagtatctctccgaacaaagttgatgccagaactctctgctcatgtgagtcatcccaagggctaattctggcctgctgcctgtttttgtaaataaagttttattggcacacggccaacccatccattcacttactgtctacagctgcttttgcactacaacagcagagttgggtattgaaacagagactatatgacccacaaagtataaaatattaattttacgggcctctataaaaacatttgctgattcttgacctagagagtgctttcttggaggtgggggacttgcaatacctgataaagctcctaagaattccaagctctaccatatagcagtcttggcaaacatgtcaggggtatgtgccacatggttataccagactcaaagcaaataaaagacaaagaatagcctctggccgggcgcgatggctcatgcctgtaatgccagcactttgggaggccaaggcggcagatcacgaggtcaggagatcgagaccatcctggctaagacagtgaaaccctgtctctctaaaaatacaaaaaaaatagccgggcatggtggcaggcgcctgtagtcccagctactcggaggctgaggcaggagaatagcgtgaacctgggatgcggagcttgcagtcagctgagatgcaccactgcactccagcctgggtaacagagcaagactccatctcacaaaaaaaaaaaaaaaaaaaaaaaagaatagctctcataacagatggactgcttcaccagtcctatcgttcgcattagttaagctaactccacctgctgtaggagatatgtctcaaagtcacaggggtttacacaatagaagtttatctctcactcctgaaatgccttattgaccagaaggagatgtgcccacgcagtcattcagggatcaagactagtttcatcctgcagccgattccattggctggagtcacaaggccaaatctaacaccaggagagtctagaaaatataatctagtggtgtggcaggagaaaagggagacaggctgaacatttagccccacaactcattctgagatcttaacgaccccatttcttctccccttcctctcttttcatagcatgatggtctttcctattagaaaggcacacataacacctgttcagttttatggataaatacatcatgtatcatccttcccagaaaatatccatcctatccaaggagaatgcaatgctcaacttaagaaagaacaccacggagaagcgtgagaccagatacgaggaggccctggttcctgattctactctcccgccagcttttggccagacacttcctttcttcagcttaggttttcccattcatttcaggataaacaattgagtgtccgtggtctatgtttcagctctttctgattctttgattctatgaaggaattctaatgatggagtttgatgccttggtgggaaaaagatgtttggatgctattctcagtgtcgtctacaaaagcaaaacacaagcccacttccacaagaaactcagactacaggagacccaaataaatacttcacaaaagaaacaaaggaatatattacactgcagccaaaggaaaccacgccccaaagactgcttctcccattgcaaacagttttatatgcaatctgctcagggtaatttattatttcaggcactgttcacaacatcaccacacagaaatcaaaatttgatgaaattgtttagccatcacaggaaggataaagaggggctcagaagggtattcatttgataaataaatatattttagaagagaatattctggtaatcactatttattaatgcaaacttctcgaggtttgcaggattcaaatgcacattttctcctcactaaataagcatacatgtttgaggagccggtctaaaatattaacagtcctcctgcaccagaaatattagtccttccctccttctctcctgctcctgtcaagaagccatagagcatacaatagcagcgcctagctaaccatgtaatgataactccctactctactcactgtgggaatctgtcagttaaagtctaaagatacataccaccactatgaaaatgaactaacacaagtctgtctgcagaccaggaagggcctgaatgcgtcgacatttcactatttaattggttggggccagcttaccagcacacacgtgtattctgcaatggcacgctgtactatgactctttttgacagacttatttagtgaagaggaggtattttttccccagataattgctcaaaatcacgctttcaaagtcaaagtgattcaaacttgccgtctgtattttggaaacacaccagttggaaggaatgcaaattcatgttcctatttcttagcgtgtgtgcacgaaagaggctgtttggggtcgtttctttttattttttttcttcttttctctgagcaatgaaggagaaggaatacaaaccccacggagtttagcccatccccagtgagctcagatgggccaaatcctacagacaacacgtttcacccagcataggtccagagccctagagacagatgttgaaactgagattctgccagtcaaaacactggagccttcaatgttctggagggtctctccagcaggacatacagttgtagcatccaaatcttcaggatgcttgaagagtcttcttgcttttcggggggcacctggcaaagtggacacaggaaggactttgaaattgaccatcttcagtgtaactcagggaaatgacctcactctgttgctcctcgtccttggaacggagctggttgtatctaccgtgcagggatgtagagggcttaaattaagatgctccaagtgggcacaatgtctcacacctgtaatcccagcactttgtgaggccaaggccggtggatcctcgaagtcagcagttcaagaccagcctggccaccccatctctaacaaaaatacaaaaatagctgggcatggtggcatgtgcctttactcccagctacttgggaggctgaggcaggagatcacctgaacccggaaagtggaggttgcagtgagcccagattgtgccactgcatgccacctggatgacagagcaagactccacctaaaaaaaaaaaaaaatgatgcttcatataaactcatcctggatgtgatacgtgctgcatggacagctgcccacattgtccgtgtccctcccactctgccctaaagagatctgctggcgttttccccccccacccagcatttttggttattccgtaaagatcattagatggctcaggcatcagccagcgcagagaaatcctaataagaggcagagttgggagatgtgggcaaagccatttctgatgctaacacagccaggacatcatgggaccacatgcagagtttaggaaagtgctgcagtacaacggtcctcccagctaggacactgttcaacaccaaggcatgggactccacaggaagaactcgaatgaggctcccaggggtctcaaagtatgactgcatgacatacaaaaatgccccatgatgacgcaacacagcgcttcttgcacagatttctacataagccaagaactaaactgtggggccaaccctgtgactttatatactcgatctcaacatttctgaagacaataaaaacggagataccatcacctctacatttaccactgagtccagtcctacaggattacagaaccataatcccttccaagagaggactttcagataaccctatctattcctcctttccagatgatgaaaataagccctgcaaaatacttatcaaaaagtaagaaaggtagtagctaaagtctccttgggagaatggagctgatccgggtccctttcaaggtcaaagttctgattgtgatttgaaatgccatgtggggttcctgcaacttggaataatcagtcatggtattatcattcttaccatcaggatacctacataggatcctggagatggtaaaagaaaacgcttcgtaaaagacaaaataaataaataaactattagtatttaattgagactggattgccaggcagtcaatttaattaactgcggcacaattaattgtgaaattgaggtttgactgtgatgttgtcaattcaagtggtatcgtgtagacttggttacagcaagagaactaaaaccattccaaggacattgttggaataaaattagcagtgcaagtgttactcaaaataaagacatggaaatcctgaaggcaaagagccatctttggcaaactaccttgtttttccatctgtcaaatggagctcacacagccaacttcacagcaaagatttaaaaacagatgcttataaaggtgaaggataggtatgattcagcaaggatttggggtgggagttggggaaaagggggcacacattgactggttgattgatttgagatggagtctcgctctgttgcaaggctgcagtgcagtggtgcaatctcagcttactacaaccttggccttctgagttcaatgattctcctgcctcagcttcccaagcacctggaagtacaggtgcccaccaacacacccgctaattttttgtatttttagtagagatggggtttcaccatgttagccaggatggtctcatctcctgaccttgtgatccacccaccttggcctcccaaagtaatgggattatagacgtagccactgcacccagccacgttgatttattctatatcactacccacacttaccaatcacccctttggataaatgcagtgcagttttcctgctgctttccaagctgagaaggaaaaaccggaccactggggacctttatcttcagcatctcatgcctcaagcatggacggctgcacagctctgagagatgggtactgatcattgtcttagagacatctgagtaacaagatcctttcagagcatcggtagaaactcccatttgactctcctctctgggtggaacctctgtagaaacctcacaggagccttagccatcgctagctgattccagggagtgagggcctttcacctgccttaattcagtcctgagcaaaatcatgcagtggccaccatatctgagcacctcgatggggggcctgtcacgtacgtattccgagacagacataaacttctctcttcttgttgctgctgctatgttaataacagaagcagttttcacttggagccaaaccaatgcctaactaatatgataaaaaaaaactataaaggttagaaggagatgaactaaaacacaggcgttatctctgggagtgggaatggggatggcttgttttacttctgtatgttttccaaatgttctctaataatgtaattctttttgtaacgggggaagccacatgcatgtagcataaaacaagataagacccaatgatattcgagaggaaaatatatacttcctgtgtctgtatagggaaaaaaaaaaaaaaaactgaaattctgagcagggaggacgaaggagacctggccgtaaaggagagcagatgctgtgaaggtcgatgctggtcctcatagcctaaaatgattgcacctgcttcaaggtgtagggagagtaaagtggggagggacatcaaaatgtacctgaggaaataacaagcgctggtgataggtttggatctgtgtccccgccgaaatctcatgttgaattgtaatccccagtgttggagtggggcctggtgggaggtgactgagtcatgaggatgaacccttcataaatgatttagcatatctccttggtgttgtcccagtgagagagttctcatgcgattcggtggttgaaaagtggtagcgcctccccagtcgctctctgttgctcctgctctggcgatgtaagatgtgcctgctcccctttaccttctgccatgattataagtttcctgaggcgcccccagtagcagaagctctatgcttcctgtgcagcctgcagaatcatgagccaattaaacctcttttcttcagccatacccagtctcaggcatttctttatagcagtgccagaatagactgacagagttggtgacgtgtgagaaactggaacccctgcacttcgctggtgggaatgcaacatggtgcagccacttggaaaacggtttgatatttccccaaaaagttaaaaagaattactgcgtgacccagcactccactcctaggtatatacccaacataattaaaaacaggaacccaaatactcatatgcattattcacagcagcatggattcacaagagcaaaaaggtggaaataacccaaatgcccatgatggatgaatgggtcaaccaactgtggtatcaatatacagtggaatactattcagtgaaaaagggaatgaagtactgatacatgccacaatgtgggtcaaccttgaacacatgatgcattgtatgatcccacttaaataaaatatcccaaataggcaaacctactgagacagaaggagaatggtagggaagaggaatgggtagtagctgcttaattggtacagacttttattgtgggagatacaaatattttggaaatagatagatgcggtatttacacaccattgtgaatgtatgctattgaactgtctactttgaaatggttaatcttatattatgtgaatttcacctcaatttttaaaagtaggggaaaacaaaaagcgtccttgaagtttccttgcttttatgtgtgttgctgcttcccagatgggagcttggtgtgaggctgggatgggagtgcatgtttgggatctaggaagggggtccttcaggacggtcacagacttgcaggcaccccctgcaccccctgccctgctgatgatccgagccctctgtcagaacctcctttcctttaagcacttctttcgaggtgagctttcactgttttccttcttctatctcctctcccctttcatttttgtaacaacaaaattttatagcccctcaaagaaaaaggaaattaagcgactcccccagacaaggacacatcagagagggcgtctatggtgggattctaatagggaaaataaagtaaaggacaggcctacgagctcatctccttatagcttgtggtgtgtgctttgcttgcggggcgaggacagaataagagtgccaccccacaaacttctatggtcataacgaataaggcaaatgaacagcatctggggatctcagtcctctggaggatccaaaaggacttctgcttccctgtgggaggccatttaatttaagagctcgaacctctctgacaaacaccatcaggcccagcctttgaagagctctcgggctctcctgtctgaagaagtcttgccaaaataagtggttcaaaacaaacagttgagtaatgatatatagggtaccagagataccacatatgggagtaaagaggaagatattagagctgtaggaaattgcctggaggcatcaaaaaggttcctgtgttgacgtgtgcgtgagcctcgttgaaacctgattgtcccaggccaggggaaagctctctgatgagcttatacatgctagttcaaaaacataaaacgaacaaaaaaagaggtgtcaaatctaagccagttacttccttttgatggccctgagaaaaagaaaagggcatgggaggtggagtgcggcgtgcatactttggtgctatcaaacctctgccctccatgtttgcaactgaaccaggcattaaagacactgacatgtcagcactaagatctgcctcatggaaaaagtattttaaacggtagttgcagtaaaaaacctagagtggggaagatagaagtagtatctggtgagctcctggtgggtctcaggcatttctctttggattattttatttcagcgtcacattaatccaagagatggtcttatcttcgcggtgtggatgttcaggcttggaaacgcaacgccatgcttttcgcagctgcaagatcccagctgagacctagatcaagctatgatggcaaagtgcatgcaactacatcacccctcacgtcttgcttaagcagaaattacttgctcagtcagcctcccaggctgccaccattgcgtgcctgtggctgttagtcacaggcccacgcacatcacatgctccgaatctgagactctgaccaacagccctgagtgctgggagtgagcgaggacctgaggtaccatgagcaaaagcagcttctcggttctcatttcaaaactacgtaagaaataaagatcagaaagaagtaggagtgtttccaagatgctggtaagattaaagtgtgcagggagatttgcaaggaaaaaaactttcattcttcattcatttgttcattctttcatccaagaaataattatccagtgcctactctgtgccggaacggtgcaggatatacgaggatggacaacaaagacgtgagcttgaaattgtcattcgatggaataacaatgccctaatgttgctggagcccagagcggggcgctggctaaacgcacattgaaaggacatggcatctccataaaaagactttgcaaaggtttccaagcaccggcactaaaaggcaggagggtatcaggggatggagggtggcagggcaaagggtggaagaggggtgacatgtggctgctgagaaagctggaagaggtttggtcctaatggcaagggtccttacgttctaggagccagaggtcttgcctgtttcctcccaccctccaagggcctggcagaatttctgaaaggctgaattccatcttgacctcc

SEQ ID NO: 5081 - DNA, 12048 bp, Homo sapiens
ggagacctatgagaaccaacacaacagctaggtgtaagcaggcaagctcatgaatgagctaacagaaatctccaatgcctaggaggccaggccatttctacaatgagtgaagcaggccgatgggtactatggcaaaccacagggcacatgccccagctaaagaggggcagccgctgccaagtccagccaactgtagccaaatgtaaaatgcaggcaaaggatgccagatctgcttttcgagataagcaggaaatcccaattttgatgggatgtctcccaagttttaaatgttcacgctaatttatttcattaaaaaatccaaaacaaacttcagcaggccaaaccaaagacatcacaagccagcaatttgcagcttctaggatatgactgggaaacgaggatggagactccagcactagaaattttcttacttcttacccagggatcggaagggcaaaaacactgaaaataagctgacctccgggaaggcggtggtggcagcagccagggcagctgctgcccaggagtgaagcaaacctctctgaaagccaagaatgagccggggccttcagaatcacagccccacatcttgacctaagttagtcaacaaatgctcactgagggccgactatgtgcttggcactgttccggctctgaaaaagcagcagtgtagaaatccaatgaaattcctgctctgcactttgggagccaaggtgggcagatcacctgaggtcaggagttcgagagcagcctggccaacctggtgaacactgtttctactaaaaaatacaaaaattagctgggtatggtggtaggtgactataatccagctactcaggaggctgacgtaggagaattgtttgaacccaggaggcggaggttgcatgagctgacatcgcgccactgcactccagcttggacaacagagtgagactcctgtctcaaaaaaaaaaaaaaaaaaaaaatccttccctagaggaatgcacttatgtgtcgcatttccggcaaaatgaaaaataagacagttttcagtggttttagcaaaggctgtgatagagggtctcctcttcagctatagtgccactcccttcttggaaactcaaagacgacaaaaacgtgtagtgaaacgggctccatgggcccagtgctccggcattccagaaatgaagagaatggggtttcctgcttgtttttggatgtatccccaacacctagaatggtgcctgcacgtgctaacattgctgaatgaatgtgacaattgagggctaagagatattcccaagagcccggtgcgggggcggagaaataatatcactgaagttggtattggtttttcccacatgaaaagcatttctcttgcttccaaatgtctatgtgatcatagataggtagaatcaggtcttaaggtaaataatataatcatgataattggtctttccctgtgttagcaagcttgggtattcagaaacaagcagggcaaaatctaatagcccactacaaaaaggaagtccaaatggagcaatgtggacttctccaatcatccttccacattttcatctctgcttctcacttaggacaatcccttttctttttttttattgcaatgtgttttaaagtaagtttgccggctgggctcggtggctcacgccttatccctgcactttgggaggctgaggtgggtgaatcacctgaggtcaagagttcaagaccacctgaccaatatggcaaaacctcatctctattgaaaatagaaaaattagccgggcttggggtgggcacctgtaatcccagttacttgggaggctgaggtgcgacaattgcttgaacccggggcgggggtagtttgcagtgagccgagatcatgccacttcactccaggctgggcaaaaagcgaaagtccatctcgaaaaataaaaataaaataaataaaaaatgtgtttgccggtccagggaaaacaaatacaaagcagtgttgtgcaaaatcacacaccggtacgtttggttgactctgtcctaaacacagacagcagtcgtggtgggcacggcaactcaccgcacgccggtcagctgcgattgatttcaagacccatttccattgtagatactttataattgtactctaatgtagttaagatggcactcaagataaatgaatcatctcagatatgggaacagggtgctcctcatacaaattccctgaccgttccccgtgctctgagaccagaagaactctgctcctctcagtcccagttggtgataaaattccctttgccttccttgaaccagatcctgacagccagcagccaagcgttcccaatcgccgactgtctccatgtctctgtgttggattttttcttttttttttttttagaggaggagggaaagtaccctgtttatttccaaactcccttgcatctgagcacgataggctggcatttgctgttaaagcagaaaattataaggagggcctaattgacctcttgcgtctttgaaaaagcctgtctgtggtctctaattgaccctctaggtacctatggacaatgaatgaatcttcaggaaataatggagggcgatgattaatagcccgggcctggctgacctccatctctcacagttcttctccctgttacttcccttcctcccctccatgacactgattccttgcatttcataagcagcgatttattattatcacagaataataaataccctgcgtagacacttttaagaatcggagacatcacgattctgcagagattgtgataacatttattaagctggcattctcatttttcttattggcatggctcagaagagtcctcctctggcattgtgggcaaagtcaaacaagaggcttcttttgcactccttgtgaaatcattccaaatgtgagtcatttggaactgcaggggcttcttacttccagtccaaagggtgaacattgtccctttgccttgctcataagaggactaaagcccttcagacgtacagcaacaacaacaacaataagcaagtagtaaaaaaaaaaaaaaaaagtggcactcctttagtggggaatgtggtactggctgcatatattaccttgatgaatactcacagaagccccgagacatcgatgttgctactgccccattagtcagaagaatacactgaggtgcaaagagaataagtaatttacctaaagcccaaagtccaaagctgcagctctgtatgctatacacatcgccttccaagtattcaacaatactgtgccaaatgtacaatattaaggatatgttttgggaaatgtgagtattagaataaaaagagtacctttccctttcagtttggttgaaaaatgcttcctttccccggacagtatagagaatacatttaaatttagaaatatacacatgcctccaatgaggattctgagaaactagatttttttttttttttttttttttacaaaatcatagcattaactatgagagaaagagaaaagacagagagaaagagagatagagacaaagaggaaaaaatccgtccttccaaacccacctggcccccaccaatgtctccacattcctcgggaccttaaatggcaagggagccagaagtgtctgccaggccctgctggtttatccgggccccttttcttcttactcagtgctttgtggagaacaggccgcctatgcagcaaaattaatgcttgggtaaggcttacagtctttgtgaaggaatggattgtctccagcaccaggtcccacctctgtcttcagaaagcactgggccacattcagagtcaggggctctgggtgggcagtgggcttctgacagataggtgcagcccacggactcagaaatagagaagaagggagctgaggaaccaaatctgcgtgccctgaatggaagctgccttaggccacctctacggtcctattcaactgcagcattttaaaagccaaatgagatgtcctggggatttttttttgtccaaaggcacatatatatttgtgtgtacctgtgtgtgacacccacgtatatgcatggatatgtatcatacaatatatgtacatatatcaaggtcttacctatatctattactgtgcatatatgtgtatatatgtatctatatctatcacttctacaacccatcagccagaactgttttcatatgctaggttttactgtatggagcttaaaaccctttatgcctcaggttgcaattttttgaattttcacgatcagaccttggtgatggctttggcggtaggatataaataattcccacatacttagtgttccaataatggaacactaggcatttactacggggcttataccactgatagtgaaaatcttgacagttcttctcttccctttcatcatgtccacatgcatctggccaccaagtcctccccatccctgctctagtgctactgcttagggcaggccaccttcagcacttttctgcatggtagcaagaagctgataagagggaagggtgccacatggtttagcctgttacccattaccaacttgtactgcactcaaagtatcttggaacaactcagatttgttgcctccctgcttgacggcgtgtttgatgccctcagaaaacacttccactcctcagtagagcatcacagccctctgctgtatgacacccgacctttctaacttttctctctgcaccaagctgtgggagtttgctctcttaaactcccacgttccaacccagccaagctctccgggcagccacacttccctttgccagctgtgaccaccaatactgccccaggggggtctgcaggacctgcagggccacactcattggcacctcggtgacttcacttctctggtcaccctgctgtctctcccaggcctcctccctcacagaccttctagggaaagctctctatcatggtcaactttgagccgtgtatattggccacaggcatccctccttctattgggcgccatactgctcacttattattgcctaaaacctgctcccttgtaggctttctttaagggctctagcggattcttagagatagtagacagctcactggtaaccacagttcaaatgaaaccaaccaattcacagccacaccctcaccactggctttattgggctcgaactccaggcacacccacctaccctaatcaccccatagccatgggtcagacacctaaagacaaccccttgtcccagagcccatggaaatgacccaagccagccaatcctaagcctgcttaccctgccggccccttctttcctgtgaaaatcacaataaaaacattttttaaaaaaatttaagttccgggtacatgtgcaggatgtgcaggtttgttacataggtaaacctgtgccatggtggtttctgcacctatcaacccatcgcctaggtattaagcccaacatccattagctattcttcctatgctctccctcccccaaccccactcctcacaagccccagtgtgtgttgtttccctcccgtgtccatgtgttctcattgttcagctcccacttacaagtgacaccatgcggtatttggtttctgttcctgtgttagtttgctgaggataatagcttccagctcaaaactcttgacagtctccccctctccctctgcctcctgcccaaccctggggctttcccaggtaactccctgtgcatgtggagtccccatggatctgtgagtaacaaaccatctttgcaatagcagtcatttctcatcttggccttaccataccacaataagaataaaacctgttaaaacagagagaacaggggagaaaggaaggagaaaaggaaaatgaatgaagaaggaataaagaatgagtaattaatgaacaaatgataagttacttaaaatctgctttttcttaggaggagaaagaactaacaggatgcagaagtcctcttctactcgggctggggatatgcgtgagaaagacacgcgtggatccgtatgagctctcgttctgaatgcggaaatctgacctcccaccggatactcagttcaggggctcctggaccctccagctgctcctctactcatcgctccctcactcagaaaaccagcgagaagtgaacttcctcaaatgactgacggtaaatatccagcatggagctggattacaaactgtataaactgtaaatagcatcacgctattcccttttaaagaagtgtcagtgcttttttcattaagattcagatgctatggagggggcagatgcgccttctcccctcctggatcccaataaaacaccccgtatggaagcagatggctttgtgtaaatcagatgacagtttacggatgagacggcctcatcggaacggcattacaagtatcatcttttgaggggaaatggggttatcaagtccagctttaattggaggtcacatttgcatgtgaaattctgggtccctgtaaggctgcctgggtccctgggtcatcaggccagtaacctctccaccattttctttccagaggggccccaggtaatgcatgagaaaggaagtgttataagaagccaagaatgggtgccccccacccccaaccaagagccagttctgttaacacagcagagagccctccccaggtctcaaagttccctgcctttgctgccacaggtaagagggggtggttttgctcactgcaaaccacataaagaaacaacacctgcttgggcacttaaccctggaacgggaaagctgaaagtggtttctgttattttgatctcgagcgtaaaatgaagagcaatcatgtccctggagtctcggcagaggcaaacaaagctgatggaggaagacaaagtctgctttttcaggatgcttcatgggaggctgggtgttaagcgctcctcagcctgcctgtgtgatctgagaaacggggcgggggcaggtgggcgggggcagtggcatcaggtgcctgcctcccgccgagggtattcaccattcaaagcaaggcgcgaagagcaaacagctaccagacagaatcctttaggtctaggctattcctttccttgaaccagagacaggaacagaacaccttagcccagcctccctgcaacattccaacactgaattgtaggatgggagtcccaatttcccagacatcagggcaatattctcccatttcctacaacactgggtcaatgtaaaggttaaaaatttaaataaatataaataaataggagatcacatcctcctttcttgggaaaattcagacaatgctacacaaaagtttggaagacgagattctaaagatcacccagaaaaaagatataggagcatgctgttttcattaggtttcttcaaaatcagtggtatgatttcacagtattttgtttcatggaatatattcacgatatttgtttatggaataaattcatgatatttgtttcatggaatatactggatatctgtttcatggaattattcacgatatttgtttcacacaatatattcatgatatttgtttcatggaatatattccgatacttgtttcatggaatatattaggtatttgtttcactgaatatattgactgttaccagaatcctaacatgcaatgtctttcttcaaaagacagtgtcatgcattccttacagtgatttatcaattaatgctgagtccccagccaagtgataagtcataccatctctcttactcttttttcttaatccttaaaaaaaaaattaggtccgccctcagcctttatattccaattctcattccacactcctgactttttcccaagttattcaaggatggaaaagcgtatcatctcaagctagctctttcccgccttcccatccaaccaccccactctgctgccatccccagcacgcccaggagtaagatatttgacaagaattgtcagggttaacaagaactcccaaagcaagactttgagttatgtcagacaaaaatgaaaattcaaaagaggagcattcatccatagtagaaatatcatgttctaaaaccatgaaaatcaaaaaagaaaatgatttttgaaattatgtccccagacaaacaagtgctcttgaccagaggccagcaaactacaacccacaagctaaatcagtctaccacctgtttttctaaataaagttttattgtcacacaaccatgcccattggttatagattatctatgtgctttcactaatgcatgatagcttagtagttgtgataggtacctgtaggccacaaagcagaaaatatttatcatgtgaacctttgcaaagtttgcagatgctgtctagactcaaaattcatttcagtgtctctcaaataattgggtttgctttgttactctggtataaatggaatgatccagtgagaacttttaatgacaatagtaaggaattattaatttggtttagtgaagaagagaatgttaaagaaccaaagaaatttttaaagattcacagccacctttttgaaataaagattaaatccctaccaggtaacttcattcaaccatgaacatttatgaatgtgtattgcgtgttttcaacctaggcatttcccttcattgttgcgggggtgggatggaattttcagtcctcctctcctgacttttcttttttttctttcttttttctcagtcaatctgtccttgtttattttatctggctaaataaaaaatcctttaaagattccccaattctatggggttcctgccctacatacaccatacaaatgtttgttacaggtatttggatatctcgatcatctaagacgttcatcttacccttaggcttcatatctaaactgtaggattaagccttcagaatgtacttgattcctataatatgtagtgattttgctaatgttgttcagttttgttccttgcccagaatgatttccattagctcgcttgcagattagcagcctaatctcctaaaagagctcttcgatcaaatggtctggagtggccacatgtcttgctgctgccaagtgactatttaagagatggacaaaaaggagacacacagaagtcgagatagcatgattaatggtcgtccaactttctctgaaccgcatatcatgactgaatgggaaaccctgaagagattaaagggggaattacattaccatgaataatataaaaaagtgatattctgtctaaaaaccttttgatgcaagtgactcgaacaaatatattaacagagcttacagcagattcaatcaggttgaacctccccagaatttattttgaaataagctttatatatctgagacgtgaagaatgaatctatcgtggctggcaggaaagctattaacatgcagattttaattctgcctttgattctacagggttctattgtccctcctttacgaccggcaatctctcccaattacggatgtagtacaccccacaaatctcaataccacagtgacactctagagagctgagatttattttcctcactttttctaacttctaaaaataagttcaaatatttattatcaaggcaccgataaaagtatgattttaaaagcatgaattatattacaccaacccatccatctgttggaaatgccagtttgggctatatttggggggcaaaacttggcagttaagatagaaaccttctttacaaaaactagggcacattaacttacaattaagccttgatgttaatgaggttacagcatgtgaccagttaagggctgcagccaaaaggcaaatattgaaatgaaggcgtttattttcaaaccaacaaaccgaactaaaccattacactaagtcccattagcattctagttattgggcaaaataatttcactccaaaattaattaaataaattggaatgacctggaatcacttctgtggcaggcggatgaacaatactgcatgaaaggcaaaatcatttagagtcaaccggcccatcagttccttgaggatgatgtttaaattgatgggaagtgaaagttaaaaatatgattcatccaatgaggcaggatgtactgttaaaatgtttgcaaaacaattttaaaaataaaccttacttaaaaaaatgctccccctaaattcagggataggatgtctttagattaaaataatatgttaacatgttcacacttagaaaattcggattctgctctgcgtgagtcacatttattttctaagcaatctggtttttttttttctttaggaacaaaaattaataaaatacatgactgttgaatgcaattaagggatccaagggctactgccaagtttttgaagagaatcaacagcagagtcttagctcaatcatatccacatcagtactacggattaaatgtttgcgtcctcgcaaaattcgtatgttgatttttttttttttttttttttttttgagacagtcttgctctgtcacccaggctggagtcagtggtgtgatctcagctcactgcaacctccacctcctgggttcaagtgattctcctgctcagcctctggagtacctgagattacaggcattcaccaccacacccggctaatttttaaatgtttttagaaaagacggggtttcaccacattggccaggctggtctcgaactcctgactcaagtgatctgcccatctcagcctcccaaagtgctgggattacaggtgtgagccacccgcccagccatatgttgaaatttaatcaccaatataatatattaggaggtagggcctttggaggtgattaggtcattgaggcaaagccttcatgaatgggttaagggcttaaaagaggcagatagagagaccctttgcccctcccccgatatgaggacatagcaaggaggtgaacattaggaaccagaaagtgggccgttgccaaacactcaatctgccagcagcttgatcttggattcccagcctcaagaactatgagaaatagatttcaggtgtttataagccacctagtttagatattttgttatagtagccaggacagactaaagcacaaggctttctggatggcctaataatgagaagtagaatcacttgtaactaatacagtgtctagagcacagtcaacactaggcaatgccagcaatcacacttcaccacagggtcattgaaacctggcatttgggtgcatgcttgtcgtttgtgagctatgtgaccttagatacacatctaacctctctgtccctcattttttcatctgtaaattggggatactaatagtgtcccctctagtagaattgtattaatttgaagagctgatgtacacaaagcatttgttatagtgtctccgatgtaaaggctcaatcaatgtcatctcaccctatccccgtgggttgaaactggcagacattccaacaggcctggtagttgttttttttttttttttctgagacaaggtctcacactctcccaggctggagtgcagtggctgatcttggctcactgcagctttgacctcccaggctcaagcaaccctcgaacctcagcccccaagtagctgggaccacaggcatgcactaccatgcccagctaattttttctatttttgtagaggtagggtttcaccatgttgcccagactgatctgaaacccctgggctcaagtgaccacccgcctcagcctcccaaagtgctaagattacgggcatgagccaccgggcctggccaggtctggtagttcttaacaactactgttgtgcccaggttttctaggctctctctggtacacacgtcagtaacttatctctttagatggagctttctcaaagtgtggttcatggacaacagtaccagaagaacctgatgcacttcttaaacacactgattcctagaccccatcctgatgtactaactcagaatctttagggagtgggactaggaatttatattttaaaaataagttctagctgagtctcaggtatccagaagttttgagaattaattatttcaacaaacaatataacaatggaatcgtaaataatcttttcttgggcaaggtaattgcaatcccacaatatgagtgtaattaacaaagtgatgaaactctgggtccagtattcttttgaacaatctcttgccccactttctagtt

SEQ ID NO: 5082 - DNA, 12212 bp, Homo sapiens
tgtcctccacttaatgaagtggactgtcaaactgatttgctatttttttgttttaatcatctagccaggcagatcagacactcgagaattagagaaatactaatttggactagacactgaaatgtcttatatactgggagcatcataaagctagagaaggcttacaaagcaagatggtgccactgagatcagcacactggggtttttaacagaaacctattacttgatttactggggtggtagaaccctaaagaagcggtgaacatccaacactgaaatttgagctggctcttcccagaaaggtttcagcggcttaatctcatgcaatcttgcaacattcctgaattcaaaccctgaagtagagagtcagcccgagaccctcttcagaatccaccgagtctgctgggcaggaaagctagcttgttgagttgtcctgctgcaaatgaaatagtaactttctcagaagcataggtattgaaagattcctttaagaggccaagtcctcaaaggcatgtatgcaacgtgaagtcagggggcaggccttcctggttccaatgcatgttttcacagggttgtgtctctatgcttgaggggagctcttgggcctatctgagggatcatttaccacttgctgtaggaaagtccagtgaaatcacttctagtggtgagtcttggccaaatatactcctatgtagaaggcctgtgtagaggttatgcttggaacagttgagtagatgttctggcaacctgtgatggccttactaagtatgacagtcagccaaaaaaaaaaaaaaaaaaaaaaagaaaaaaatcttctggtcacagaacagttgaaggtgtttcaatttttgtccactacccattgccaacatgtctttaagtcactgccatcagaatctgtagtggagaccatccagacatcttttgccatgaataacatcaagtcttcctgtataccaggcgctgcagtgagccctggccaggcaccacatcaggctcagacagtccataattttttgaaatcgacccagttggaggtagcagaaccaggactgcattccagggagcgggacttgacagctttagcaactgcgtctgctttccctccgctcctagcctctactcacccaagatcatgtctgttcaggatgcagctctctattcaactccccaactcaggcctcctttcctggcggctcaaatggaagcttttttttttttttttgagacagagtctcgtctgtcgcccatgctagagtgcagcggcgccatctcagctcactgcaaccttcacctccgggttcaagcgattctcctgcctcagccactcgagtagctgggattacagacgtgtgccccatgcccagctattttttttttaaataattttagtagagacagggttggtcaggctggttcaaactcctgaccttgtgatccgcccaccccggcctcccaaagtgctgggattacagcatgagccaccgtgctcagccagaacctttctttaacttgattactgtgggtagttacaattttcaatggccactagaatgaagtcttcagagacactaggacctgacctgtgattgccctcgctatactcccagggactaagcacatggcctggcaaaaaaacatagccttccaaaatctcgttttattttactattttatttactttttgaggcagggtctctctgttgcccagctggagtacagtggtacaataacagctctctgcagccttgaacttccggcctcaagcaacgtcctcctcagtctcccaagtagctgggatgacaggcatgcaacatcatgcccagctggttttaaaaaatattttatagagatgaggtgtcagtatgttccccaggctagcctccaatcctagccccaattaatcctcccacctcagcctccaaaagtgctgggattacaaggtatagccactgtgcctggccctccaagtatttaaaatgaatggatatctcccaaagactaagtgtaaatggctgaacaacttacattcttaccacatctgctagatggtaaatatttgtgcgctatttaaaagaaaaaaaaaatcagcataaggagatagtcaacttgaagggtgatgacagatctctgataataggagctagtcccttcttaattccaattaggagctacacgttggtattagtgacattcaaacctctatctaaaacaaatttttaaactttttttatcaagcatattacatgcagaaaagcacatacataataagtgcacgactcaaatttttcacaaactgaaacgcatggaaccaagacccagatggaggaagagaaaaaggactagcatttaaagaaggctctgggctgggtgtggtgacttacacccgtaatctcagtacttcaggaggccaaagcagaggactgcttgaggccaggagctccagaccagcctgggcagcatagcaagacctcatcttacagaaacacaaagattagccaggcatggtgaaatatacctgtggtcccagatacaaagaggtcaacatgggaggactgcttgagccctggaggccaagcctgcactgagctgagatacaccactacactccagcctgagcaagagagcgagaccctgtctcaaaaaaattaaaaaaaataaataaaaggggcctctgcatgtgaagtaagtgttgatgcttcaaaaaccaccaaatggcagcttcggaaggcaaagaaagagaaacgcagggagtggttggggacactgcctgctatggttttgagcactggctgcaagcaaatgtgaggtaagcaaaaggatgagaaagacgtgagcatttactgaattcctaccatgtgccctaaggtattttagttaattatttttaaacaaagaaattgaggcttagagtgattaatgcacttgttcaaggccacagatgccaggctgtgtgacaccacagcccctttatcccccactgtaattcactgtctcatctctcagcctgcatttctttcctttaactcccttctttaaaaaaagatggctattttcataataatgacttagtaatagctttaattataactttgttgagtcctcagtctgcaacaagtgttttcccacattatttccttatgcccatctttcttatgagaaaactgagacttggagaaattaagtaacttttctgagctctcatagagatctcagtaatagcagagctgggatttgaatccaggagcctggttctatgggttgcactgttagacatcgtctctaaaagtacatgcaattataacagaattcctttataattccgttcctctaattcctcattagaagtggaaatgaacgtctacgtacttcaaacactggttagaagggttgacagaaattttgtgccctagactagagattctctccagttggcccttgttgagtggcatctgagagggtctgcaaggccacagccaagtctccctagggcatggctggaagaaaataggttgaggggccagaaaggaggggcccaggtagggcctgggggctcacacctgtaatcccagcgctttgggaggccaaggtgggcggatacttgaggccaggagtttgagaccagcctggccaatatggtgaaacccctctctactaaaaagatacaaaaaattaggtgggtatggtggtgcctgcctgtagtcccagctgcttggaggctgaggcaggagaattgcttgaacccagaaggcagaggttgcagtgagctgagattgactactgcactccagcctgagcaacctggtaatagccatttctctagagcctgtcacctgtgcatttcctagtaagcctcaatttaggatttagattgtcaccacagctccagagtcaccaagcgtgaactggctccttggagatcttgtcacctgtgtctcacaggactcatttctaccacccaggtgcagaagcactggaaactgtggtggacacaagcttcatcgaagcctgtccaaccattcagttatcaccctggtgctttgcaaacatcattacaaggctttaatccagcatcgagactcaagttcacccagtccctctcctgccactgtgacatggttattcagcagttcagcagtgcatacaggttataagaataaggacgaagccatggggggaaaaatccccctctttctgtcttaggacagcagcgggggtttttacccctgattgcctcattaaaaaaaaaaaaaaacaaccttcacgaaagttgggaattactatattcaatgtagaatgccatttgtcattcatttgatattcaacaagtatttactgaattgcttctatgagctataggggataattaaaaacttgttttacctcgagaaattaatttccccagaagaattaaccataagcagatctatgagaccctggctattgggacacttaagactctggtggttgtggtaaaccagaataggcggacagtttcagatttaaaggaattgattagattaggccgggcatggtggctcatcctataatcctagcactttgggaagctgaggtgggcagactgcctaagctcaggagttcagacaaccctgggcaacacggtgaaaacccgtctctactaaaatacaaaaatttagctggcatggtggcatgcacctgtaatcccagctacttgggagactgaggcaggagaattgctgaacccaggaggcagaggttgccgtgaggcaagatcgcaccaccgcactccagcctgggaacagagtgagattccgtctccaaaaaagaaaaaaagaactgattacattggtaggggtagaagagagacaaggggagaagaggaggaagaattacatatttaaaagatcagtgagggtttttgttttttttttaatctgacacagaaaaaatgagctctgaatcttgaatcaagacttgtatcaattccggttatccccatgatggcaggtcattcaagcttggaccttagtcttccatctacaaaatgggaaggtcaggggagatgtcctttaatggaccttgtgattctaaatttgaaaaacttatgattcctagaatgaaaagaagtaatgtgtgtctatacatttatttgtcaaagaaactgggtcattgtcatcaagcaaaacagaaaccagagtcctgaatgtgtacaacagaatcttgaggaagcagattacctgccatccaggatcttagggttaggagatggaagcaatttcccccttcctgtttgaggattgagtcatgccctgtcagagcacttaggccggccttacacatggacaggtgacagaccaatactttgatcaatgatttgtagttgatggagaagtcccctggaggactggaagacagatcagtggagagactttgatctgtgtcattcgcttccaaaacctttaagctcacataaacatagactcccaaggcactgacgtcaatgataatcccatgttctccaaatgtgctggcccctcagttatttgggaaaaaagagcccatgataaaagggagataaacatacacacacaaacttactccaaagcaaatgctgagtcttctcctgctggcttttggctctgctaagaggctatctgggggcaagacttattgttgtttagaactagaaatctacaactcagcagctcttgctcatctaaatcagagtgggcgatgcactgaagtaggccaccactccccacgtccacaaaaataccgcagaatcagtaacccatcatgaaccctttcccaacgagcccatgcgcagtgtcaaaatccttttcaacacagcacttcaatggctgtttcaattgaccagacttgggtcatgaaatgaatcctattttacatccttcatcaaattgttaccggatgagctgggagggagggctgtgtgcacttcttgcgtataaacttggttggtgactgtagtccaggcaattgccaaataagaatagaatccataaaaaccattttagtaggaaagacaggttgcagtctggatgcttggaaaagtaggcactttctgactgaagtaatcacaaccaactctcggactttccttgatccccttctaacccctaagtgtttcattccagcagggtgacaggatagagatctgcttcagggaggcttggaccccacccaccataggtccacagaacatgaataagtcagctgatggttgactaaaacgtatatacaattttaatacatatactagtgtatttaaaatttcattctaaactaatgtaatcaaaactaatgtaaaaaacatacagtggttatctctgaatgataggactacaggtgatttttattttcttccttaaaactttggcctttgtgactttttacagatcgcatgcatgtgtgtgtgtgtctgtgtgacatgggtgtgtatggacgtttgcacgcaggtgtgttttaatggaaaaaggggggaaaatgcaaatttctaagggatgcaaagacatattaaaaatccatgagacaatgagatagcataggactagaagagctgcaggtctttcctctcctgccagattattaatggtcattatttggggttaggggcatgtgaattttagacatatatagtgagccagagcctatgaatggctcacagcattggttccaacgttcccttcctctcttcaatctcagagtgactcttgctaaactttggacagatagtaacagaatttgtctaattatacagaatgggtgaaaatctttctatgtcctgtaactattggctcagtcacctgatttaatggtcctggaattcattttttatgacttattaatgtgaaattcacataccatatgatttaaccattgtaaatatacagtttgatgtagttagtatatttatccagttgtgcagccatcaccacagtcttgtcctagaacattttttgaccccccaaaattgccccaccctttccaggtaatcccctccactcactcccagcccaggcaaccatcattctgtttgctgtctatagagtttcatcttttctagaaatttcatataatgtcatcatatactatgtggtcttttatgaccggcttccttcacttagcgtaatgttttgaagttcatctatgttattaaaggtatccagagttagttccttttcattgctgagtatattccattgtgtcgatagactacatttgtttctccattccccagctaatggacatttggtatttccggcgtttggctatcatggatgatgctgctatgaacattcatgaacaagacttgtataagcatttattttctttccagtaggttcttaggaagggaactgctgagccacattgtgtgtgtttaactttttaaggcactggacaactgtttccaaattcattgtaccatttacattcccaccagcagtgaatgacagttctagttcttccacattttcacaactcttgggtaataaatctttttggttagagctaagctagtaggcatgtcatggtctggggctagaatcattttacagtggcagcgatgaggtcagaaaaggcctcagattggcagtataaaaattattccgcaatttacagctcacagctcaccagttgtaggactttaagaaactcacttaattgccaggcatggtggcaggcacctgaaatcccagctactcgtgaggctgaggtgggagacctcttgaacctgggatgttgtagttgcagtgaactgagattgcaccaaggcactccagctgggtgaaagagcaaagctccgtcttaaaaaaaaacaaaaacacacacacaaaaaaacaaacacacacacatacacacacacacacacacacacacaaaatcatttaacttctctgagctcagattccccatctgtcaattggaaactataatagctctagattatgaagagtcaccgttgaggtaagatgtgtaaaagattgtgcctaagttcccatttatttctggaacaaaaatatattgataaatatgtacataaaatagaaagggatatgaaaatagacggcgttggtatcttttcttctgttaaccaagccaagatgttcactccattttcctttgcacctaaacttctgcactcccccactcaccagtgtgccatgaagatgagttgcagttttgtctgtctcatctctccacttttcttgtcattgacccaccccttctcatcattaaccacttttagtgagctagaacataacagaaggcgcccttctccaattgtgaatacttcctcaagccttctccttcacaaagtcaagaaggactagacccagcctgcaataggagcgtttatgacaaatcacaaattgaaaccctttggctatcatatttatgcagctggtggcaagggttcatatttgaagctcagaccaaagaaagagtttgctcctcagccctgatgctgcaggcttggcttctgagtgtgtcacctactgaccctactatttaaagaaaaactggaaaggccagtaatttggatatggcctagctcaagatacattacagactgtccccaattccctggatagcccgtggctggaaaagtgcattcctggtttattgccaatgtccttgatttgcgtgctctgccatttacttagacaatcaggctacgttgcaagccagggcaacaaaaacaccgccaggagccaaacaggctccaggggatgcaccagtgccttggtggccctgaacacttaagtgattttgttccccttccatttcgtgtggtacattagcttttatcgatagctcatagcttcagcaactgttcttcgtttactaacctgaaggacagaggaacaagaggtacccacacagctgatatgcaagaaaaaaaaatagcacgggatgtcttgatcagtctcaatgatttcttcccttgctacagctctccttaatgagggagtcacaattattgcaagttaatcatgtctcagtcccccagagggagaagagtgaaatgaccacttgaaatctgaccgtggctccctccaagaaaatcctggtggcacgcgaggcattcatgaaactgcgggctctgatttatatcactgctatggagactggcagaggattcttcggtgttttcataatacaactactaaacaaaagttagcccaggagctagatggaaatctatgttatggaagagaaagagatcaattttttcattgctctaaaaaacttaaatttccaactagaatctgcaccttggagcaatgcagtgagtctatgactcacggatgcttgaatgctgtaactgcttccctttctgcgtagtatgtgatcacctacggtttttaaaaacattattgttaaaaccaaaacaatcacagatatgatttgttgagtaactatcacaaaggcagacacaattcttgtttattctttgagacggagtttcactcatcgcccaggctggagtcggtggtgcaatctggctcactgcaaactctgccttccgagttcaagtgattctcctgctccgtctcctgagtagctgggattacaggcacttgccaccaagcatggctaatttttgttttttagtagagatggggtttcaccatgttggccaggctggtgtcgaactcctgacctcggtgatccacccacctcagcctcccaaagtgctgggattacaggcttgagccacactgccctggccggccacacacaattccttgcactttacctaccttgcctcaattcattctcacgcaatctaaggaattataaatttgtattgctattttgtggcaaaggaaactgaggttcaggagcatttgaaattgtcaaaagcctcagcaaggaagagaaagagccatgatgtgaatcaagtccactggagtgtaaagatttatctatggtgttgacctctatctgcccttcacctgcgtacttcttttaaggaaatcagtcatttaataagtcttgcaagttgtcttacattattatgagattggcaaggaataacagagaaagtgaagaagggaaaaaaataaaggaagagagaagtcaaggaaaaaaaactgatcgcatcctaaatcattctcttaaacatatccatcgcaaaacatacaacctttagcactttaaaatgtacggagtttattttacatattaacatatgaatatgttaataagggtgtttaacatattaaagcattaactttaaaaaatggaatttgaagccaggcgcggtggctcacgcctgtaatcccagcactttgggaggccaagatgggtggtcacttgaggtcaggagttcaagaccagcctggccaacatggtaaaaccccaactctacaaaaatacaaaaattagccaggtgtggtggtgcacgcctgtggtcccagctactcgggggctgaagcaggagaatcgcttgaacccgggaggtggatgttgcagtgagccgagttcacccactgcactccagcctgggcaatagagtgagactgtctcaaaaaaaaaaaaaaaaaaaaaaggagttggagaaaaatagccacacagcctgtttttaattaccaaagatccattgttatctgtgatgtgtcagaccctgtgctaacagggaatctcagagctgggcccaatgggactcaacagacacagccagaatcacatcatggaggttatgtgcagccctgtttcaaaaagcaaatccagggctgggtgcagtggctcatgcctataatcccagcattttgggaggccaagcaggcggatctcctgatcccaggagtgtaagatcagccttggcaacatggagaaaccttcctctacaaaaaaatacaaaacttagctgggtgtggtggcatgcgcctgtggtcccatcactcaggaggctgaggtgggaggatggcttgagccccaggagatcgaggctgcagtgaacatgactgcaccactgcactccagcctgggcaacagagcaagattctgtctcaaaaaaaaaaaaatctgtaaagtaaaaaagggctccattctgtattatcttcagatatccaacatcaaaatttataaaataattcctgatgaattaaccatagatttactgtatgaccccgtaatccactcccaggtaggtggttaggtaggtagtttggcttgatataaatacatatccctaaaactggaaataggtgttccaacaaaaacttacacagaaatgttcagagcagctttatttcaatagtcaaagggtaaaaacaacacaaatgcccatcaacagatgaaaggagaaaaatattggtatatccatacaatgcaatgatattcagccacacaaagagagatggacatgctacactgtggctgaacctcaaaaacacgacgctaagtggaggaggccaatcacaaaagaccaatattgtacaatagcatttataggatgtggacatagttttttgagagccatcattccaatcactatgcctgtgatagtttgtttatgaagcaatagaaaactagtacagtgaccacccttaatttattcatttgtttgttttgccggttcaacagatacccactgagcacttgctgttgcgaggcactatgctgggctccagaaacactgagtaaataagagacttcgtgcctgccgaatacagcttatggttgggagattcactcttaggcccttctcacaaagggagccacaagccgaaagatcacgaggactactgatggttttgagctgtgacactaaatcagcagggacagtggtccattggtgactctctgatgaaagacaagtaccctcttcccaggtacaaatggatataatgctgcatattatttcagaagattctaagatactcagggtccattcatcaaggccatagttaagaacacttggcctagagatttttgagatgactctgaaaaagaaatatacaagtagagaatgtactgcgagtgtctgctcattgtttccaagttaaaacttacttggctgctgggagtggtggctcacgcctgtaatcctagcactttgggaggccaaggcgggtggacacctgaggtcaggagtttgagaccagtctggccaacatggtgaaaccccatctctattaaaatacaaaaattagccaggcttggtggtggcgcctgtaatcccacctacttgggag

SEQ ID NO: 5083 - DNA, 12544 bp, Homo sapiens
aaaggaaagtatctaaactaacccaaacaatcttgaaataaagaacaaagtttgaatcctattattacctagcttccaggcaatcgagcagtaagtataagaaaaaaaattagatcaaggagtacaacagtctagaaatacacccacacatatatagtcaactgatttttgacaaagtgccaaggaaattgaatagcgcgaggattagtctttgaacaaatagtgctagaacaattgagagtcttatggagagaaaaataaacctctaccattacctcacaccatatacaaaaataatttgagatggaacatagatctgaatgtaaagattgaagttatggagtgtctagaagaaacataggaaaatatttttgtgacctggtgattggtaaaggttcttagaacaagaaagcctaaacaaatgaaaaagataaattggacactatcagtatttataacttctgcttttcaaagataccattaaggaataaatagacaagacaaaggagaaaattcacagtacatatgaaaaaaaagaatgtatccaaaatatatatagaattcctataattcaatattaaaaagactattaatttttagaaaatggccaatacataaacaagcagttcacagaaagaaaatatatgaaggccaatgagttcataaaaagaggcattagtcactaggaaaatgcaaaataaaactagcagagatagcgtttctcacccacaaaaaggctataattaaaaagactgaaattacaaagtctgatgaggatgtgaagcaacataaactcttacacacttctagcgaggggttaaaatgaacaattactttagacaactgtttggcagcattcttacaagttaaacactaagagtcaatatttcacacctaggtatttatcaaaaatacataaaaacataagggcataaaaacatgtaacaggatttatgaatattcgtggtagctttattcataatagccaacaaatataaacaaccaatgctcatcaacaggtgcacagataagcgaattgtggtgtattttcaccacaggatatatccagcattgaaaaagagaacccctaatacacccatcaacatggatgaatcacaaaacattatgtgaatcattaagcagaagacgacacatacaaagcagtaggtatgatttctataaatgaagttctagaacaggtaaaacaaagttacaatgattgaaacaagaatgcttgttctgggaataaaaggatttattggaaaggagaatgagatacttaccgacgtgatgggaatttcttgtttttgtttttttggtttttttttttttttttttttttttttttaaagacagttcactgtcacccaggctagagtgcagcagtgccatcttggctcactgcaacctctgcctccaggcgatactcaagcctcagccaccagagtagctacggttacaggcatatgtcacaaggccagctatttttttctttttttttttcttttttttgtatttttagtggaggcggggttcaccctgttgcccagactgatctcaaactcctggcctcaagtggtccaccctcctcagctcccaacatgctgcgattacaagcatgatccactgaacctggccctggaatgttctattcttaactggggtggtggatccatgattatgtacacgtatacatttttcaaaatccagaaactgtatatttaaaatatgctaattttatagaacataaattatgtaaattatgtctcataatatatgtatatgtatgcatatacattttctctctctctcacacacacacacacttcgtgaagagaattattccacaggcccaattttatattagtaaaacagaccttacttttgatgctacaatccaatcgacaaaaatgcttgaaaaggttaagattatttatgaaaatgtttctaattactatctgagtacatcaagctttgtggaaagagagtaggcttcagtgtcatattcccaggtcattatgatgcgtttgcttctcattagctatgtgaccttatgcaagttaatatcagcctcagacggtttttgacggaaggggtaggggaagcaacgctggcctcacaagttgcggtgtggcttcagtgtgctaacggatgtagaatacacgattcagggccccaggtttgttattaccatcagtggtcccagcccgtttttgataactttgtaaacaccaagtggtttgggaagccagtcattctacaatccttttcccaaatttttgtctctgaaaatgactaagcaatttacaaaaacaattggaaacaacttggtgactttttttttttttcaaatgggtaaggcattccggatataattatgtttaaaacatgattcagcacactttatttcttctgaagttttctatttccttcttttataaaacctactatttctatcttatttttaaagatcaattgctgcatgttttcagagccctttcagaaatatctttggttattactcatctgtgaaaaggaatttaaacaaagtttgagaactgttcatttctcaaaaaagacagtggaattgagtatcgtttcctgggatgttaagtcagcgtcaagaccaaattcatgagattgttttccaaagagagacaggagtaatacgaaagaatgactgaggtttcatgaactgtatcagcttcctggcagagagcactcgactttatatagtcggatactgtgagtcagttgacattgttcttaagaaacttgtttttgttagcatctcagaatttgccagagccatattacatttaagtcttgcgtcctcaatcaatttgaccaatgaactttttgaagatcaatgggcaagataatagtagtagaggaaaacaccaatgatagttatttctcatttggggtcagcattgccaagctgctcaggtttccatggcatcatttccaaaccctcctattaaattctaaaggagaatagatctttgctgtggacagtgtaaatttgacaacaaatacagggttgatagactggtggaatagaaaaaacaagaagctacgggatggaagctaggccatcgtcaccactgccatggggcagaacagaagaagcatgatgttttgaccccacagaggagacaacactcaaatcctcttcagtgaacgctgtgtttctagggtactgggaatgagaaaggaagatgttgtatgcacagaaacttaagtattttcttaatgcataattaagaaaagaaaagaaacccacagaaaagtgaggcaaaccactgataaacaggcaggttctatttctgttaactgggtaagcccagattctttaaaagtattttaaagccgttgatgctatcaactttgaaatgtggtttgaaaaagcggatattacatttagcatatgcctaataactgccctcaccatggaaacattgaaggcagaaaccattgttttgttttcctaatcgtactaccaagataagacatagagttctcgtaaaccggtgcccgcggcatgatgggatctccagcttctgtacacctagttgtggaggtggatcctgggtggaccattggaactatcgtaataagaattagtcccgtcatcagataatttctgattgaaaatccgagaactgagttatgcacagtgctcagttagtcactgtttttctcataatagccgcatgtggaaaactgaagccggtcttggggtctcaaggtcaacttcatatgataaacatcttaaggcatgattttagtcccgtcttctttcccaatcttgtttaattgcaacgtggccttcatgctattctctctattgtttccacagcctctctccaccttgagacacacacaagcaggtgggtaggtataagtaccaccttgctccctcgacacattaatcaatttgtttcatggaaaaaaaagaagacaaccatctccagttgaaaattagaatcaggctggattacagctgcagaatgaactaggtagagcagaaagccaaactcaagcctgtgtttccaaccagtagagaggtgactacaaacaataatttagacaaaaaatagtctaggactttatgatctacatgcttagcatcactgaacattactaactttgaagttcaatattatacttggaggtgtatcctttgtgtgctggagagaagcaaagaaccaggcttgagtctaaaatattcccattaacccaatacacaacaattagatgtgtgtgtatgtgttgtataactctttaaaactaaacgatcaaggtaactatggaaataaaagtgaacattaacaattgccacagtacacttgcctgtagctccgctattcaggaggctgaggtgggaggattgcttgagcccaggaggtcaaggctgcagtggccatgactacactattgcactccttcctgggcaagaaagcaagaccctgtctcaaaattaataataataataataataataataataaaagcctcaataaaagacattactctatggaatcagggatacctggtactcaaatacatcacagacacaatatctgctcagctggtaacaatctgtcaaggaaaatattgcatatcaactcaaaagatgcatctagaaaatcttgtgtctagcttgctagaaaacaaaagatactgtgtgagtgtgatttcctcttacctctgtgaacaaaagtgtgatcgatgaaggtgagaggggcagggaaagacagagaaaggcacgtaatgatgacagacattttctggaacaaggggaagctaatgagttcacagaagtgctagaagggccctggaaaataccagggaacctcagacaaaagagtctcccaggcaaggaagaaaacaaaatacatgaaatattggctgcaacatttaagcaaaaattaaaatggcagccatgtgggcgaagtggaaggagctgagtctgagagaggagtgggtggaggaggaagtgtcttaggcaggacctcacccttctctatttcaggcacttgttctagcctggagatggtttcctaagtagaacagaaaaataaaagaaaagagaagtcaatccaaactatttaaacataaagaaaatatctgaatgggggagcctggtatgacagcctcttggattcaaaccatgtgagaggggacagcgaaaggactggtatttttcgaggcctgactctgtgcttactgtggcactgggaggttgcagataaaaaagaagaatgtcttcccttatttcaggcataagatggtcaagaggggcatcccacttttttttttttctagctatagtcattccatctcatagtcgtgtgtctttgtgacctgtcagcctggagagcctccttttctgtgtgggtaactacagtttactcagcagggtgagatggaaactcctgactccagtgctcctctgacctcacggtctgctttgaggaccccgctctgctaccagagaagctgggcttcctgctgtcgctcttgaaggaaggaatccaaggattactgttaagctacctgtgagtgcttaaggacagaaaagacccttcattgccctttgaaccaagcctaggacttggcgtaggagataccaatgaatgaagccaacatgctcaaacacagagttccttaatccaattggatcagcagcccttggcctaactgcaggttggtccaaacgtggctaacaaaactctacaacagaggttagaaagttgtgggatgccatcaacaggacccggctcctatagtatcacaatcacctgcccaaaagacaatggatcctcacctagcccatgctggcctaattgttttgcttttggcaggtgaccttgtgtttcacacacgcagaatctagtagataacacaggtaaaagtggagctgctttggataaaatgtggaggaagaacgctcgaacaagaatgttgtcgtccagctcccacttcttgacatgtgttctggacagcgggggtacctgtccatgaccaccgttccaactagaggtagaaccaggcctagaacgtctcttgcacaacatgaaaggatgtttccctcattagagtattaatttctcgaaggcatctcatcagcatcctgtgaccccagagtccaggaacgcacacaggtgcagaagccatttgattttagcagtggttcatttttttttattttagcatgtggttcatcgagtacctcttgcctcttgagataaagaggagctagggttgctaatggttgacttcctcttcttctttccaatccttgaattcgtatgcaatttcttagattccgctggtctcactgccagtagaaaattagtatgaaacgaaaacatggtttggcaagtgacaatgtttagcgagaaacagaagacattcactaagcaggaaaaaaacccattttatcagacacactttttactttattataggcctggagttttaaacactattactgacagcttaaatatcctaggttatgatttctcaagctagggaagacctcccgacctacactgaccatatcaaagaactgaagcaaactccggaaaaccaactctgctcttcatttgttagagttgatgaagtataactggtcattatttaaagtttaattttttttcctttgccttcatatatgaaatttctcactgggacatttcagtgctcttagaagaataccagcagtggattcgaaatcatttgtcatctttcaagatctgagactctttcttgaccaattagaaaagaaggatgttagagcaaacagacagcttagctgctaatgacgggcaatagtcaatattttatgccaccttgaaaaagttgcagtaactgaaggtgttctcacattaattcttgcatcaattatcgacagagaatttaatttaaaggcaactagtcagtaacctaggggtgtgttttaaataatttataattgctgcatgggtgtaatcatattgctattgattaccatcagtcacttctacaggtccagcaggtcttatgctaattacttttagtgagatcaccttttaactctgtattccctggtaacaggaactcattataaaaataacttaatgaagcgcaatgtttagagtccttacagaaaggagggaagggaggagggtgaacttaggagaaagccagggttgaaagcactaggctgagatttacagatcaacaatcctaaacctgaaattacatattttattcaaatatcagatgggactgagacaaaagaggtgaaaaacagggtatatgaaagaggggcaggcagaaaaaagagaactaaaggaagatgtaaacaatttcagttttgagaaaattatctgaatttcactttattcattcatccaggatcactttttattcactatgaaacagctagccatcatattgagggatttaggaaaggcaacctgtgatttactaaaaatttgtcaaatgaggcccactgtatgcttccttttatatcctcaaacagtgtgagccaaagacaggttgttccccctgatgaaaggagattgattcagttattaagtggtgcaggaatgtacctaagtctttataataatagctatgaacgcattttactaaatattgacaaaacatgctcgaaaccatgatttcctgtatactgttaccttgaacaaggctaaggctggcatttagataaaaacagaaagtgaatgaggaagtcatcagtaaataatagtataggtggcccatagacaaggccgctcagatgctggtctagggaaagactggctgtggaaaatactggctgagtgagcagacacatgtagacactatcactcttctctctcttaatttgttcccctggcaaaaagagagcactacaaaggttgccaaggtggcaggaagtgaagacatcagcaccatttcagggaagccggaggcttgcccagttcagacagcaacttgtggacaagccctcctgactggggctggggaacagtctcagaaggcccagatagggtgggagggatgtccattaagaacatgaggattagaatgatggaggtcaaatttaagaatgatggaggtcaaatttaagaatgatggaggtcaatttaagaatgatggagaggcaagaggtcaaataagaatatgaaaatggggcttttattattgatgtttctttttatttattttcagaacttccatttttaagcaattgcatttcaagatagatgtgcctcatttacaaaatctatgtgtcagtgtgtatatgtgcttcaaaactgtatgacattgatgttgtttaggaaaaaatgtgtgtatgtgtatgtgtgtacatgtgtgtgatgtgtatttccctaggagcaattatgtaataaatgcaatgtttttgtgccacttggttcaaacttcagaaaattcctaacatttaggagaaagagaaaaaaaaacagagattcatttctgaaagaagagacataagatggtacacatctaatttaataccaacaatttgggtgactataaacagtgggagtttacattaatagaaaattcatcataaactatggactttctccagtacagcaaacgtaacccttgttctgaagatgaggacaacagtatctttaaacctcgggtgcagctgttgtgatcgaggcggaacaaaacaaaatagggaactatatcgcacaagttaaatggggggaaaatacctgcagaaattgtcacctgcccacactgagagtttgctcacaaaattctcacttaaacctagtgaaaaggaaacaacaaatttctagcttattccatttccccgggcacgcttagtactttcaagcttggctcggttttctcctagtggagaccagtggacaaggccaatacttatggctgtcgtatagcactaaaatacattatatttgaagctgcaacatctagcatcaaccgccaagggcaagaatgatcactctgagacacatcaagtcggctcgctttcactgcagactcttagatgggggacccagtttgcagggtttaggctgctgatccatgtataaatcggggcggggggtgggggagggacaaagatcttcttaaaaagccagatagaagcatttgactatgcaccattgcagtgtgaaaataattagatatgaacaatatataaataatgagtggagctgtattttaataaaattttacttaaggaaacagaaaatgactgtcattgccaatccctggtacgaatccttatcatcttattattaagccgtattcctgaagggtggacacagagtcgactccacagggcaggcagtgaagctgacctctgagttgaattcaaaggagacatcttcttgtaaaagggaagaagtcagccgggatgggataaatggtcagtttctgggggagctggaggtggtgaggaggactgaccagggaagctttctaagggcatcaggggagattatggggcttggggaaaaaggagaagcttgaaattgccactgtgaggaatggaaggaaattagatcgagtaaacagaaatactgctgggcagtcttgagacatagttgagactagaattaaaaagaaaaaaaaaatcaatatcctcttagaactgtaccaacagtgacaaaggcatagaactaaccctgggctattttaggggaatgtatttcgttgtctagtctgtgtctaagatgagcaaagcgattctacatccagccacaagagcatctcagaagactcctagtggcacataaaaataagttctggctcggtcagcagggacacatttaagtcctcattagaatgaagctgtctccatcctcaaaactaacaaacaaaagccgtctttgagttctggaagacaggaagctgggatcctgagaaaggctttctgcctagagctgtcagttagcaccagctaatagacctagtggacctcaggatgtgagaaactaaatccctagacaactacaaaaagaatagggtaacacctggaacaacagggacccaagggccaagggagctgcctctgggcaggtacctggatttcagttctgagaaggaaacaacaaatcaaggaaagctttctcctcactgtaatccactagcccaaagtgggttctcaagtcactttcagaagggagaagcaaagcacaaagccccagttgcccaacaccttgggtagggttaaacattttatgcaggaatcagcatctttaagagctcaccttttaaaaggagccagctttttgttgtaaatggcactgacactacaacaaaaagttgatttcacaaagatgattcattaagaaataaaatattcatggctgacagcttgaggatcgccatacagttatattctaatgcacctgtcctctctgacaagtccaatgtgggtgtcatgtcgccaaagttttatttagaaattgtttgtcagagtgagctttctaatgtgatgaaaaattcatcccctcattaagaagattttacatgaaatgtctaggattttcaatgacaccaggacatgaaccaattactgttaaacacttaaagagacagagtcctaagctcactagcaaaactcttaattgcacaaatgtggagaaaattcaacatcccgaaaggcaaatgggattttgatttggaaatcttcttttgttttgtcacatctggaaaaccactatctttaaaaacctgggggaattcaaatgcactattttatggaatccacatatatcttatctgaccctttgtacttacacattggctgatggattttggcattttcagccacttgttcaactcccgaaaaaatgattcaagtgttttggaagggtgttgaggtgtctgtagtcatttcttgtgtgtggtgtgtgtgtgtgtgtgtgtgtgtgtgtgtgtgtgtgtgtgttttatatactttgttgcttcattgccttcccaccttactttcataatttgtgtaaatatcaaacaggtgccttggagcgaatgcactgaataattccaaaacgtggggagttgggagagaggggaaagaaaagctcaacagattaaaatagagttgggctgcatagagagtcaggagaaatccacaggggaattctggtataatgaaatagcattttacagtcatgacaatggattaagttgacattgagactttttttgacatacagtctagttcagtttaacttacgggagaaaatagttcccaaacctaccctagactaggtatacacacacacacacacacacacacacacacacacacacacacaccacacacacacaccacacacacacacatatagccagactgtcacttcatcacttccaattcagaaaaggtttgagactgacaatatgaaaactcaaatttctcctccttaaacccagcgaccctataaactttaagaattttatattcactttcataggatagaagctttggtgaacagttcgaggaaaaagtagccttgcccctgtatctgtgcatcacaatcccataagactctacaaagctttccaagaaggaaggactctgaataagctttttaccatacagctgttgcagtggaaccagaatttcatagcctttccttgtgctttaattatagctgcctctgcagtttctttagacatattctttctctatatgtttttcttttcatttacatttatttctcccttcaatatatattttacatatatatatatatatatgtttttctttgtaatattttatatagttctggaaagcaattggacaatacatatcaatgtgtaccaagtgtcttaaaacagtttagagtgagatgaaattctagacatctatcttaaaacttctctgaagatcagatacggaatttgtacagagatgttcaatgatgtgttatttaaaattgggagcaaatgtccaaaagaagagaaatgttcttttgtgaagccaccattcaaaattacatttaggatttatttctcatataataatattgagtaaataaagtagaatacagaatgcacaaaatgtactcagagattcatgagcaaaaagtaaatgctttttttttttaaagaaaaaataccaaatgtgtacaatgggtatggtatactttaaaaaaaaaaaagtacagtcaggcgcagtggttcatgcctgtaatccgacactttgggaggccgaggagggtggatcacttaaggtcaggacttcaagacctgcctggcaacatggtgacaccccgtctctactaaatatacaaaaattagcctggtgtggtggcgacacctgtaatcccagctactcaggatgctgaggtgggagaattgcttgaacttgggaggagaggttgcagcaagccaagatggtgctactgcactccagcctgggcaacagagcaaaatctgtctcaaaaaaaaaaaaaaaaaattccatccccatccctgtacgtggatgtgattaaactcaactctaaactgagtcaaattctacacactg

SEQ ID NO: 5084 - DNA, 100000 bp, Homo sapiens
gtggtggggagggcactggcagccgccgcctccctatgggggagcagggtgtgaggtcatgggcaccaccatgagtgttgctgcctccgagggacagtgcccagaccgcccatacgtctgggagccatcctggcctctgcccagcaccagccccacccctgctacccctcagctcttgactggtttcctgcccttgctgggcctcagtttccccacttccccaatggaaggctgcaacacggtttccgtgggccccgtctcaccccgtggggttctgcccatacccggccagagggaccgacaggcaggccacgacccacacatcgtcccgactcagagctccaagaaagtcagagcggcccgccacgcccgggcccgcccgtcctggtggggcccacactgcccgctcgccccctgtactggaaggtcatgttggtgatcttgatcttgatctcctcgcccagcctgcgctgccggtcatctcgaagagcttgctggccatcttctcgtacaccttggcgttgcgcttggctgcttgagctcgtcgaagaactcctcccagaccagcatgaggccgcgcatctcggcgtcgtccagttgcgggcccgccggtgcttctccgcctggggagacacgaggtagccgggccctcggccgccgccatgccggaggcgcctgtggggtgagagagcgcgctcagcgagggcccggcccggccccacgcaccatgggcgggaggcgccgctcacgctcgctcgaaggcagctcacgctcaaaatggggcctacatctgacaggcaggaatttagttaaaagcttttaaacggaaacgtcattttgatgtcacgtttccatagcaacagagcaactgcataagctacaacacagaaaccttttaactgaaagcacaggaatcagggccgcactgacgggccatcaatattcggcgagcgggccaggcccaaacccagcggcccggctcccggccctgcctctcaccgcccccaggcggatcggcccccagttcagtgccgccccggctcacgcaggccaagagggggctcgggtgggaacaggcaaggagaaagggggcaaaaggtgggagaaacagagaggacgaggacgaggaggctgagtcccccaacgctggccactggccctggtgggggtcctgggctgtggacccttaagctccctcagaaggcccctgccttctgaactggggctgggccctggggccctgggtgtcctggtcctggggtcctggggctgggccctcacaagaaccccaaaccccccccttggctccttttgcttctcttgctccagcccccaggcgccctgggccttaggtctgggacactggaagcccgggttggtcagagccaggccctgcccagaggtgcagacacagggacacagacacgggcctctggcaccggccggtgaggacagcagtgatggcaaaggtgagcctgtttgagacacaggagggaatcagcccagcaagccagggggaggccacagggcactctgggaagagccacgggcatggcagggcacagtctgggtacgcagggagctgatgggcagcagattcggcacagcgtgcggagacggggctcgaggcccaggctgcggggcaggccccttggggctgagggactgagatgcccccaggctggccggaggaccacagcctgccgagagcccagatgcagcggaaccggaaccggagcggtggcctgggggttctgcccggagaagtgcgcccaagggcatcggcacccgaaacgtaacacatgcatgtcaggcagggctctgtggagccacggcacctgtgcagcatggactgtgctgggcgcggtgcccaggctaaatgccactgggtcagcagagggacagcaggcacccccctgccctcctcaggcctgaccaactgcaggaactctcaggtgtgggctgccccaagaagggcagctgagcctggaatgaggaggcatctcgcctctgcccgctgcccctgctgtcctctgaggcaccttggaggtgggaccgaggctctaggggaaggacagggcaggggcatggcgggggtgcccagccccactgtgggtgcccagctagggaaggcgaactggggctccctcttgcccgcagtcaggataggaagtgtatggggaggccccagggatgtgtgaggaactcagaggggtctctgcaccccctacactgggtccctgtcaaggcctggccccaccatcagccccatgagactagtccagtcccttccatctgggctcaggagacatcatccctactgcctggcactggggcatctccactcgactaaggtcagcctccgtgctgggggctggcacagagagctctgtggagtgcctgcagatgaaggagtgacagaaggcctacctcctctaggaagccctggctcctcaggaacagggttcggccctccccgtgaggtcagggaccggtccgaatgccctttccgtagccatgactccaagggcagaggtgggctggctcccagcatctcttggcatctcccggcacaaggggtaagcagaaaggcatgggtcccagcagtggttctgggtgcagctctagcgactcagcatggaccttagtcatgtctccccactaacctgtttcctcacctccacaacaggggtaacaggatctgactatatcaccagcatggtgctggctaagggggcacagccctcccagaaccctggggaggtcatggggccctacgtgccctctacccccttccacaaatccaccttggagctgctggggacagcgtcagcctactgtcctggctgaaggggcagctgctggccagtggacaccaccaccactgccggggcccccaccggacggctctagaggaggcacctacacccctgcctgcccgagttccagtggcgcagggaggcagggccctgcctggcagggtgccaccccacacccgcaccatcctccggcagcattcccagggtaaaaggctcaactccaaccctctcttcccaggctcagtgcactgggaggccctggacagggcaagctccatggcctttcccgaggcagagccctcacactgcctccaatgtgaggacaagaaccaggcaggcagcagatggcagcaccaggcacccagctctcctgcctgggagggtccccacatctgtcccctgctggggaggggctcgtaccttggcaagctgcatggcctgctgggaccctcagtcgctacggggtctcctagggccagaggctgtcaaccagcagcacctgagggagaaggggcaggtcaggcctcggcaggagctgtccctgtgcagacctgggacatgggcggggccctgctgggctcaggctagaagcatgctccctagcctccatcccttctaaataatgaggctgggcccaactagactctcatcctgctcagcattctgggtggattttctgccctgcctgacaggccagcaggacatggggactgaccaaggggggggcagcagggctcccaaacacagaagcccagagaggaggtgggcgtcccactgagggcaccttccaggagcagcagtggtgagcacagcctgtgcagatgggtggggatttggcactgaggagttcagggcttgggtgaaggcagagaaccacgtggagtcctgggcccaaatccggggggcccctgggcaggctccggagcctggacttccccagagcaattggggccaggagggaaggatgtggccaacactgccgccgctggggcagggtagaaggttgggcgggtgggtgtccagagggtacaggggccaggatccacctcaggaccagcctgtcctagcagttttggggtagctgcctgaccaagcatggagggcaggggcctgtgcacacaaggggaacccagaccacaacttcagccctctgcctccagtgatgccctgaccctgacctcacaggtccacaggcccacccagggcccagacacccccgaccaggacacctggaggcctggtgtagggtggaaaagccggccacactggcgggcccccccagaggatgtggctgcaacaggactgggtccttgtggctcaagccacttgcccaaaaggcagccaggctgctggggctgcagagcctggggacccgcaagcgatgtccacatggtttcccaaaagaggtcctggtgatgacacaaggccggtccacctctacccacagacactgtcacggtgctcatggaccagactcgtgggctcgcgaggatgcctttcctcaggccccactgcaggcttccctgaggggtgcaccccacacccccggaacggggcttcctctgtcctcggttggctgtgtcacatcatgtagaggcaaggccccctacccagtcccttcagtggcggctccacccggtactcacctcaccctggctacttccccatctgacttacagtgctccacgcaccacgcaggggaagcgacttccagatcccaacaagccagtagcagccaaaatcaaataccaccgaaggcacagggcacagctcggcaaggggaagggtgtgctctccgatgaggaagaggaaggctgtgttgagggcagctctgccgtggcaggggagggactgcaaagcccactcacgaggggttcaccgctgcttcccactggaccccgcccctcttctttctgaaattaccagccatgccaggtgtgctcagtgtgccaggctgtcccacctggaccagggagaagggggtgctccatttctctgaagtgaccagaatttaggtagtctgaaaggagaggccactggggggccctggagcggtgtcacctatgaggagacagattagggagctcaagtggcatgccccgccccaaatgctttaggcctgtccaccacatccctcggcagactgatccctatccctgctcagagaaagggggcccccgcacgtgcccaagaggacaggcagcaggagctggccccttggccgactggcccccgtctctcctggcacagacagcgagcagggaaagaatgggtggacgacccctgccaattagccagaaccagacgggacctcgcaaacattgactaaataccctgcaccagaggaagccacagggtttttgttcttgcaggtggtaagacatctgcatcccaagatgactacaccaccaatcaccaaggcttccgagaggtcgtccggagcttagaagcatccccgctgggctgagcagaggcttcttggagtaggcgcggttcagacaggacaaacaagctagaatagacggggcaggccctgcggacacacagcagcccggccacaccagaggtgggatgtgccagctgctttgggggttacctgggagcagctggccagggacgcaggtgtcaatggccaaggaggtggaagggtggtgggccctgtgagaaccagctctagtctctgtgctgggcctgatgacctgcttcagtgccatgggccaagtcctgggcttgtgtatgtcatataagcttatgatgtcacttgaccatgaaggctccagcagctcagcagctcccacagctcccatctgcagggcaggaagaccacctgtactgtggtttgggaggcccttgcagaagcacccagccaggcccatgccctggggccacttcctcatccctggcacagaaaacacggggcctgtccctgctggcagctgcctgggggaccctccataatgccaatgttagctggtgggacagtttctgcccctgctggagaagcacttaggagactgcttccaagactccagctcagcaaggtctaggttctcatgaagcaaagcaagcctcacacagcaaaactgatggtttccatttttttcctttaatttggatgtacaatgtttgcagcagttaaaaattaaatatacatctctcgtcagtccttccctttgctctcagaagcattcaggtctggtggggctccgggactcgcccatcacagccctgctggctccaggggagctcaagctcagcgacagtccctctgaccacggtgcaaagcagtgagacctggacaaggaggccccacttggtcagagcccaccctccgtaggcaggtccacgttggccacgatcctccaaggctggcagtaccacccagattgcagcgggagactctgctcttagaaacaactgaggggaaggcgttccttgactgcaccagagcgtgacaggcacatgggggaagagcggcccctgaaccttccaggtgccttcagttgtcatgcggcattctgagcagctccctccttcccaggaggcccaggccggcaagcgagtgtcctcgtctgagccatcctgagctctccaaggtccctcagcagctctaagatcttccttcttctcactcctacacgtgacccctctggaggacagctccaagtctacctggccagcagctgtggtcccgggtcctccccgcagagggaggaagcgggggagggacaagcccgatgaggatgtctgctgggaaggatgctcacaggtagcaagagaagcctgactcacccaccagacacacagaactaacctcactccaccccgcaacgggaggaagttccaccgccaggcggccacacaccgagttattgctgtctactatccgtcccgagctccacgtgggctcatctcagctccaagaggaggagctgttcattggctccgagggctctgaaatgacccctccatgaagatgggggcgaggggtgtcctttagggcacagggccttctcagatgctacttctgggtgtctggagggggttcagcttcacattttccccttgaaaggacacatgcgctgcagaaatgagggtggacagtaacaaagagcacttggcagctggaaacatcacctacatgactcagctgggcccgcagcggaagggaggcacattttgggaaagaaacacgcttcagtcattgccaaacaattctaccctggtttcattaaaatctttcccgatattaccagcaggaaacaaaagcaatctccccacagcccacccccaaaacttgacaaccaaattaatcacattgcaacaaaatttggataatacgatgggtgcttgccacagatttttaggaacatgataaatcttcctcccttctgcagagagctgatatggagaccatcttcgccagtgggatcctagtggcaatgaatgagccctgccctgaccacgtcccacgcctggatgtccgtcacgcggctacttgacctggcgggtctaaggaaagtcaacttccaggaagaaccgacacgggcactcttgaggccatgcatctccgtcttgagaggtgtgtgtgtaaaattatagatgtgtctatatgacatgcatggatactttatgtatatgcgtgggtgaagtcatttttactaatgagctcatttcatctccggagcacacaggcaggtctttgggggtgggggacacctactgccagagcgggtgttctgagccccttgctaaggactggtttagatcacgtcgtaaacaagaggaagacaactctatgttgagcccagcgatatgcattccaagggaatggctctgttttacattcacgtgttatttcttacaaatgtaaacatctagccaggaacaacatctggcctgtgatactgtgtctcagagctgctgacataacctgcgggggaggcgggaggcgggtggggagcagccacagttctgagaactttcccctcgttcccaaaccttctagcgggctttccaggaaaaagcaggatgagaaacaggagcccccaaccaatacggaagaatggtgattttcttacgtgttaaattcagtagcttcccttaagggcctcctcaaacatcggacccctttctaccgctcctgtgccccgccacgaggacgaggtggtcctggctgggggaggcctctgttgggagctggtggaaaagcctcatacaggcctggcagaggctgctcagaggaggggctccctttcagctcccctcacgtatgtgggcagcatacaagtccacatctcagctgctccccagctgccacatagagagggacaggtggaagcttgggggtctcaaggcagcacctgcacagagttccaacattcctccacttaccacattcaatacccaaaacatcgacgggcatgaccaaaccaagccactgacagtcgccaaccttgcctggctcgcctctagggctgaggaagcagagcccctgcctgtctcacagccagtcggcaagcagagctcccaaatccagctcctacatcagcagcagccggccatccagaatccacttccattttaatgacttggctcctctgggcctgcaaacaggagctggtccagggacctggcctggggataggagtggcggctctgacagggccgtggggcatctccgatgagcacagatctgcactctcctgactaaaaggggtcaccgtgcaagatgtcgctggaacgggggcagaagggatgctgggctctgtcactaacagtgccaagacaccaagtttgctgttgaccgagagaggctcagacaaaacacagctcagtgacactcttagggcatcatccatggagcagcaggtcccaacacctgccagccagctcctaggcagacgccaccccgggctagcaaggaacaggagtgggaggcccatgtctctggacacagtggaggctgctcaagccagggagggctggccttctcagctgagtgacagggaggctgctgtccctgactggtggtggagaacgacagtcgtctgtgcccgaggaggaggggctgcaggtgagcgcacccctggataatgggggcctgtcctcagtcctgctgtggccacctgcccactaacgcctctctaatcccagtcaccttgtgaatgcataaacaggaacatgtacaacggaaatgtcagcgggtctcaggagggctatgccagtggctacaggagagggagcgtggccgggggccctgtccacaccccggacgctgtcgcatgcagcacaggccttgcgattcacatactttacacgggcatgaaagagttacgttaaaattaatctctttactgatataattaaattttaaatcctgagagaaaagagagaagggagaatggtgccgggtgtctagcacccccagccactggcccagcaaggccatggcatctgtgcatccagacacggggcgtggcatgcacaccccaccagggagaccaggccagtgttcccaaagcctgctcacggcaccttctactgcaggacagcagaggggcaacagccagcctgcaggagggaggacttctggcccagatgcaagagcagctgcaacctgcaacaaccagcaggtgactatcaggagaaaggacctggtcacccacatggggtgcagccagctgctcctgctttctggaaggcctcaggctcagccccaccaggactgcagacactcctgcctggccactgccacaaagagcacttctgccacatggcagagacacgcacgttgccggccgcccgcggcatgtgcggaagcccatagggaccaagctggctcggtggaggcagggacaagggcgcagacttccaaaggctccggccccagctgccgcctcacagtctctcccacatggcgctcagcaggtggtgaccttgtggacatttcgtaaacaagtcagcagccggtgaatgggcttcctggggctgcaaccacctcaagcacagactggaaggccctgcggtcgagccctcctctatctggtgtctgtagaagtctgtggcgaccaggcagaaaaggttcacgtcccctgctccagcttgcccatcctgctgatgacatgtgggaggctggtgcaggagttaaggaaaaggccggcaaatgaggggaatgctgcctccctgtcctcacctgggagttcctctccgaaacagtctacaaaggggtccagggagcctggagagcgagcagagccccggaagggcccctggatgcctccagctgcatcagcgcctccacctccattcctgcaacccttggctggcggatgccctgcaggcagggcacccactcggcagcactcacctggcctggctcctgtgcacgctggtggccggtgcttccgctggcctccactagccctgctccaatgcagtgagggcaagccgtgccaggcacgccgggcaaggctgtgctgtcagcaccaggacaactgtgctgctggaggctcttgtggtctgtcttggggaagggctgtggaaagggaaactcctggcagccacatctgggggtgggaactggatctttacttaagcctttccccgagagggcgatcgaggccaatgaccaaagctaatgagaagcagtgtcaggagaagcccagccacacagagcccgcggtgggcgggacgtctgcagagaccaccgcccaccctcgctcccctcacccaggccctcccagaaaggcccctcagctgcgaccctcctgccatacaccggcccctctgagaggccctgtcagcaaatgtctggacgtgctcctttctgtacccctgtcagcattttacttccctgggctgagggcctgtcaccctggcatctgtggggtttttgcaaaggttaggtttcaaaacctatcatgaaacatgagcctcggtgttgacaagggaaacggggccagcaccagggacccaggaggatacatcgccgcgacccacgggctggtggacgcgctgacaaagaagcaggagaggtccacgtggccatggcgaccggggccctctgcgtgaagttggagagggacagcatgaccagtcccggaccatggacgactgcccggtgctgtgcagagtctgaaacacctgcaaggagaagcaggcgcctgagtgtcagggctggggggacgggaagcacctgctgcgcctgggtgggggggtggggtgggggccagaggcattgctgctttaaagcggaggagctgggctctgctgcgaatctgctgggaagtcggaggcaactccacctccaggctttcccactccatccccacccacatgcaacctcaccttatacaccacggtggccatgaactgggggtatggctgctgttggacagaaactctccgatgactttgttcatgatgtcctggggtgggaagaagtcgtcagaaactggggcaggatcctggccaccactctggcttcacaaggaaagcctttcctgatctgggaggagggacgcaggtcagagactggcaccagctcccacagctgccccacctgccgcggagggccttggctctaatactggggaaaatgccgatgtgaaatcagggctgggaggaccctcggccgtgagggactttccaagtggggaaagtcagagcctaagcaactggagtagaattttgagactaaaaaggcaaaaccccagcccttcctctgtctagctcgtggaggcagctgctcggcacaggccctgggctcccacaccctgtagggaccagaactcctaagaggatttgaaagctacgtaaagcctgggctcccacgccctgtagggaccagaactcctaagagagtttgaaagctacataaaggaatatgcagaaacggcgcagcgggaaggatgttacaaagagatttttaaaaatcataacaaaagaacccgttcccattatgtttttgctgctttccaatgcaaatgctccacaaacatccctatgtgttctaacgcttcgtggcactgttgtcaacaggacttttttcttgttaccacacagggccccatctgtgctctcgctgcttcttccctaccagatcctgaaacacgccccctgagcagtatccctttcagtgctgaaaagcaaccatccgttcccgtctcatcagtgcacacatgccagccgtgtgtaactgagacacacgggaagcgctacgaaaatggcagtgcacttcctcacaggtgctcctggctctacccgcccgcagacctcgcccagcagtggcatggcagccgctctgaagacactgctccacagagagaaatctgggtcagctgcgaggtgcctccctgtggcgtctggagagcggtcaagcggaaggcgtgcacacactctttggagcactcgccacctagcattgggcccactagaccacaagccccttgaggccaggactggtcgtggcgcctccctgtgcccgtctgccagtcgcagtggtgctcagtagcatatggggactgaagaacgatgcagaggtgcatttaaaaatcgacatgggggccggcgcagtggctcacgcctgcaatcccagcactttgggaggccaaggagggtggatcacttagttcaggagttcgagaccagcccagccaacacggtgaaaccccgtctctactaaaaaccaaaaattagctgggcatggtggtgtgtgcctgtaatcccagctactagggaggctgagcaggagaatcacttgaacccgggaggcggaggttgcagtgagccgagatcacaccattgactccagcctgggtgacaagggaaaaactccatctcaaaaagaaaagaaaaaaaaaaataacatgaaaacagaccagcacaggcttggctgttcagaatgcctcatctggtcaaacagggagcaaggtccacctgagtatgctcttgagaaaagccaaatggctccccactggccacctgattggagagcacaggcaaggcagtgcaacaaggctccagatccaccatgtcgccagactgaggcctgagagcaaatcaggggcccttgtccttgagaaaaagccctaccaagctctaacccacttccagagcaggtgagggaagccaattctatgcacgcacagcagtggggggggtggggggcagaagccactgaccacacgggtctcaaagatgcatgtgtgggttccacctcatcctcctgccgctgctcctcaccctgctcacaggcaccacggcccccctcccacagcccgtgggctcccctctcacgataggcagccaggctgagccagctcctcctcactgtacggcttctgccccaccctcccagaggctggtcattcctgccccctgccacacccccaactccaggtactgtccctgagccctcaggagagatgggcaggcactgggacaaccttggaacggtcaacgctacacctgagtgctggggtccaaggaccaccagctcgccagtggaaccctagccaaggcagcccatggtcaggctgtggtggggaatcactggcaggactccagcaacacgccaggggatcagcagacacacacaaaagcacagcttcaggccaaagttctagggaagtaacggctgagggatggggcttcgcttcttacctatcaaaaagaacagatacccgctcctagcaacaatcactgactcgctgtcgggggctgcaggattagggtctgaagttctacccgactgactttctcctttcctgtaacaaaagtgttcagtacgaaggttacctctatacaaccaataggctctgtagacagtgctttgtacacaggggtccagtgagtccctggagatctaaagcaggtgatatcagccccttgcttgcccaggacccagcccagctcagccacatgggtgagtgaccacagggacggtcaaccctgaccaggtactccagccctgggggctccagagctttcttgcaaggtgatggggccggcttggggcaacaccagaagtgtgaaatcagagggacctagtcgaggtcccttgagtgagcatgctcctgcctcccttgaacaggacttgggctgccttatgggcaccgtgtacatgctcacctgtgtacatgcaggtgagcatcaggcccaggccgccatggcccggtgcgggctgtgcacgttcactctgtccacactcagcttgaccaggattctgcatccaggcgggagagctgctcagagagcaggaggcgctccaggcctctgaggcacagtggtaaatgatggagggggtggactcctcacttccagacagcatcaccccacaatctgcacagggagaaaggcctctgtgtcaaagaatcgctgcacagtctcaggtgttcagcctcctcccgaccaagtcaaaactggcccactggtatgatcctgcaaggaaaagagaaggaagcccactccccgtgtgcagaggaagacagccagggcccactcacctgtattattgtgctgaaaattccggccctacgtccagaggatagttctcaatgaggtaaaacgcagtggacacatgaccagtacgtgctgctggctgtgaatgttcacgcagctgaaaacgggagacacatccaggctcagccacccccatccaacgtggagagggcttcacagcatgtccggcccccgcgggagtgtagagctatgggccaggcgggctcccgggagcgcctaccccgcgtggctccccaggcccctgcaacctggcctgacccttcagcctctgcttgaccactccctgagtgctgagcccgtctacctccccaacgccctgccctctcggcctaactcagcctcccctgtgccacctccatgctggccaccacacacttcctctctctgtccctcaacgaggccctagatcccacaccccaggccagtcccctctacttcctgagtgccctgtgcttttccttcatggccatgccatcatgacgtgctgccttctgtgatcccccgacagcgccggccttccccatggacagtgaggacctggtagccagggactgaatgagtggccactgtgaacagaggagccaaacgatgccccccaacacccacaaaaacgtgcccagtgatgcgtatatctgtcaccacgtgtcccacctccacctcggaggcacgtgacacggcccctctgcccatggtgctgaggtcaccccacgcaccatttctacctggatgccacaagctctctgcatcccaaacgcaactcctgaccacctcaactctccttccctgagtcctccatgcccacagcaagagccatagaacagccaacacaccagcacaggcagggctttggcctgtgtctggggcctgttctggggctgcccccaaaatcacgtcactgcaccaacatatgtgcctgatttgcaggcctgtgccccgtgtacttggccctatgccaggctccagggatgcagagacagttgccagccgtccgcctgtccgctagcacagcacccactgcccagcaaggatgacaggcgagaagggcctccccacgggctgtgacactctggcctggatgagggcaatggcccctgatgagccgctgtccctgctccacatgtcccaaatcctgccagacggccaccggcatgtgccctggctcacacctccctccttctgaactgtgcctacagagaccttcccgtctccctccaggtcttccactcaactttgactagcccccgtttcctgcccacttgtcaaaggggatcactggccattcctcccagacccttcccatctttgctcctaattcttgccctcaactcccccatgtgggtggctgatgaaatccaccctccctctaaagacagctcccgtgtgcagaagcctatgactcagagaggctgggccatctctgctaaagcctctgcgactttggaagagtggcggtgagaccagggtgtcacaagccctctgcgcttgtaagacatcgctgtgaagagcttgacttgctcgctgaggggttgggcaccagccgtgctttgtcaaggacacgtgtgtacagaacctgccgtccagcagctttagataaggtgaggtcggaatcacagtggaaacaagagggaggtactgggccagggcgggaaggtgcagagaggaggctagcctgggtaataacagggttctgggagcagagaatgagaccgatggcctcgagagcagagtcaggaatgggcacgtgggagagtgtgctaagcgccactgagacagcagcagaggcgagagctccagctcgctggaggtgcccgaggaagcctctagacgcacctgtgctcttgcgtctcactgacctcagccatggcacccacctgggttcccacgatacctggcctgccatctggccaggagcctgggcacttggagagggtgatgctgcttcttcacagctcattctgagacccccgccccagccccagccaggctcccactcactgggcgtccctttcaggttggagaggagatagtcgctgatgaccgggatgagctgcttggcagtgcgtccagcaggtcgcactccagcacatagaggacgccgtgcagggctccaaccctgctggcaggtggctgctcctgagcgtgctctccagcaggcggctgacaggctccgccacggcctgtcctaggcacacacagacaaaagctgctgcatgccaccagagctcacgtcccagtggtcctccccacagccgaggcgggggcgctgccctcacgcttgtgtgcagaagagactacaagcaggccggagaccatcctgagaggcctgtgtgcaaggctggcccctggctggtgttggacggtgcccaccatcctcactgaggaggggctccctgtgctcagctgcttgtgtgggcccagggttggtgctgagaacttgccttccctccgggagtccagagtctgggcacgaggcggcagagggtgcccatgtgcccagcccccagtaaaaaccctggcaccgagtctctagtggctttcctggcgacgacactgcacacgcgctgtcacggctcactgtgcggggagttaaggcgtcctgcacgaccccgctgggagaggattctggaagctcaagcctggtgtcctcgggcatcgccccatgggcctctgcccttgctaattttctttgctgattttgttttgtgtgctttaccataacacatcttagctgagagtctttctagaaaagcctggggtagtcttggggaccctgatagtggtttctgtcaacttcaaccaaaatggcctcaatttcacttagtatccaaacctagcagggttaaatatcgacctaaacacttagcccacgttcttcactttcaatctctctttaacagtgaggagacccctgcagaagtcagcaaggaatgtcaccctccttcagccaagactatggggacacagaattcccatggagcgctggatggccaggcggcctcttgttttgtggaatgatgaggttctcggcagtggtaggagcctctccgcaggggaaatggccggcgacacagaagccactcccagccatcccaggaacaaggaccaaaagaggaggctgttcttgtgggtcacttccttcttgggcccccacctcaccctgtgctatcccctcacacgcacacgccacacggcccctccctaaggactgcgcacggccccaggtcccacttctgaaagcccacatcaggacctgctctcgggtggcacggatttcacaacggtgggcaaatacctcaaaagacatgctctggatacgtgggtaccaagcatgacgcgctgaaaaccttcacagaggatgccatcttccagaaagcatgagtgcacaaagagctgggagtgagtgtccatgaccatcctccttaggatctgcttttcaaaatgattatttctcatttgattactgatggcacaacactgcctagggggatctgggcctgagcacaaaaccacagttacaattcaagttagcccagcactgaaacttcccacaaaggagaaggaccccttccaagagccgctttgacatcgtgtgggaacacccagagggtgttcgccgtgaagagagatgcccacacagggaacccacacactcattgtttccactccctggacggctgctgagtcaccagcatggcaccaggctgaaggacaccacaagggaagatgactggcgtttgggctcggggaggacagagtctaggcaagagcagtaagactcgcagagagggagtcaggctccaggtcacggacatgtgctcacctcaacctctctgcattttgtgtgacccagacaagccagctaacctctgaccttggccgcctagggtgggccaaggtcacccttggccttgtcaggtgggggtgcgggaggaagagctccgcaaatgtagcggctggagtgatggcaaaaaaaaaaatcattcaccgtcatgacagcattgtcgttctgacacacaggagcccgtccagagcacgggctaggcaggccctgatgggcaccaccatgcattctcaccaagggccccagacggctggcacacggcagccactcaggtgtttgttgaaaaatgagtttccattgctatcataaaatggattactaggtaatgccacatgacaaggaacagaggtgccagctctgacagttctgccatccttgaatatgcttcgccagatgtcgggaccacgggcaatgatttcacgtgtgcaggtgatggatacttggcaaataccatgtggtgagtgccacagaatacaggtaccatgctgcactggctgaatcctgataaaccagaagcagataaggaggaactcaagaggatgaacacttgaccgctgggatggtctgaatgtttctatcctcctgaaactcctacactgacacctaatttgcagtgccacagtacaagaaggtggggcttgggaggtgatgaggtcatgatgggagagcccttgtggattggggcccttctaaaaggctgagggagcttgttcactccttccaccgtgaggacccagccagaagatgccatctatgagcagagagcagccctcatcacacaccaaatctgctggcaccttgaccatgaaaacttcagcccccagaacggtgagaagtaaatttccactgtttataaattacccagtctaaggtacttgtggtagcagccaaaaaagactaagacaaccaccacgctaaaaagagactatagcaccagatttgggactagaaacacagggtcactgtgacaaaacggcccccaggagagaagcgtccagccaggaagctcggggggcctggaacataactgagaaggggagtgaggcagtcagcctcagggcagagcatggggaagccagtagcatttccaccatctacgatgcctcagcgcaccacacaccgtggttctgtggggatgggctactacaatgatgtcataagcccagggaacgggaccccaaaccatggcttggccgccacaacccacatcacagtgacctgtgaatggactgaccgtcgctgaaccccctccatctgagaagcactgcagctcacgtgggccgtggatccggttcgggtcaactcttggaaggaggcagccgcacccggcacctctggccaacaccggtcccaaggcagatgggcccccgtggcttcagcacagaaacctctgtgccacctgtcattaccatcccaaggacggcagctgccttgcaggtggcaggcaccaggtactgagcgaggtctcgtcttctgaagggtgcacccttcgcagttctgtcagcgtcacatacatcagctcaactggttgcgctcggtgaacaagtctgagaccactagaagctggagatgtggaaaaccagagggcaaggggagaatcgcgctgttagaatccaggcaacgcatccagaacgctactacggcaagtcgtgttcttacacccaagagacattactgtgcgggacgcatgtgtgcgtgtggtgtggtgtatgcgtgtgctgtgtctgtgtgggtgcgtggtacacgtggtgcatgtatgtgtgtgtatggtgtgtacatgtggcgtatgtggtgtgtgtgtgcgcatgtggtgtgtgtcgtggtgtgcaagtggtgtgtgtgtggtgtggggtgtgtatatacatgtgtgtacatgtgcatgtgtgtggtgcatgtgtgtgtggcatgtgtgtggtgcgtacatgtgtgtggggtggtgcacgtggcgtgtgtgtagtgtgtgccatgtgtctggtgcatgcacatgtggcatgttgtggtgcatgtgtgtggttgtgtgctgtgtgtggcacatacatgtggtgtgtggggtggtgcacgtggcatgtgtgtgttgtgtgcatgtaacctgtgtggtgtggtgcatgtggtggtgtggtgtgtgtgtgtgtgtgtggtgcatgcatgtggagtgtgtgtgcatgtggcatggtgtggtgcatgtggtgtggcgtgtgtgtgtggcatgtgtgctgtgtgtgttgtgtgtaggtgcatgccgtgtatgtgtgtgcatgtggcatgtgtgtgtggtgtctatggtgcgtgtgcctgtgtgtgtgttgcatgcatgaggggtgtgtgtgcaagtggcatgtgtgtgggcgggtgtgtgtggggggtgtgtggcgtgtgtggtgcgtgtggcacgtgcaggtgtgaggggatgggaaggctcacttacggatctgaccacctcactgatcaggatggccggggtcctcctgctgagctggacggcaggatccagcggctgtacaactcaagcaaaaactgcgaacaggatggatgtcaactccagcccggtgtttcctgtggaatatgcgagatgggtattttccaagacatgagatgagaggctcatttcaagaagcacctcaaacaaatcaaatgactgataagaatttcaaatttctgttaaaaagaaaaaggccattggaaaacctggagttgactggagactgggtggtgacgaaggtgcaggggcgtcggcctcctcctcctcttcctcgtcccattcccctccctcaggggtgtgatgctgttccccagccacacggagtgtatggacacctgccacgaaacggggcactgctcagtgctgcggccacagtgccaggctcctggtgggtgggtgtgccactgggactcagcacatgcctaccgtctaacagtctgccccttagcaagggtcgttcgacaccccaggttacgggcaagggagcccacagagagggtggggcaggggctggacagcgctgggaagctccagcacatgctaaaggcatgaatcaggggccagtcaaccccaggagcgctgaggagggtgacacagaaagaggctctacgaagggatgctttcactcctaagtgactctgaatggagtccccaaaacacggaaccaatacgtgagattccttttccagtctcccgactggcagtcattgcggtaaacccaaggccagagctccctcgcgcctttgtgacccgcgtctagatcacgcagccaccacgcagtcagcacacctcgactgtcctcctttctgcctggtctcgggaagcctcgagcacttggcacagtgctgtgggctgtgtgcccataaaaagctgtctccatcatcactggcactagccccaactcacgttcttggcaccaagggccatttccccctgggacccagcaccctgcagggagtgggcgaggagtctgtatgaacagctctcaggcaaggaggagcccctgcactcccctcgcccagacccctaacccccacccctctttcccaaagcaagtagcggctcagtccagtggcatctaggggctaaacatcccagacagggcagggtggcactgtccttcagccccagacagggcaggggtggcactgtccttcagccccagacaggcaggggtggcactgtccttcagccccagacagggcaggggtggcactgtccttcagcccagacagggcaggggtggcactgtccttcagccccagacagggcaggggtggcactgtcttcagccccagacagggcaggggtggcactgtccttcagccccagacagggcaggggtgcactgtccttcagccccagacagggcaggggtggcactgtccttcagccccagacaggcaggggtggcactgtccttcagccccagacagggcaggggtggcactgtccttcagcccagacagggcaggggtggcactgtccttcagccccagacagggcaggggtggcactgtcctcagccccagacagggaaggggtggcactgtccttcagccccagacagggcaggggtggactgtacttcagccccagacagggcaggggtggcactgtccttcagccccagacagggcggggtggcactgtacttcagccccagacagggcaggggtgggaccgtacttcagccccatatgatcccatgacagttggtttgcggacgctggacacaacgcaaacattgaaggatgtgccaaatgcagcggggttggggggatagggaatacctcgggcacagaccagtgtccctggcccaggacaaggccagaggcacccagtgagccccaggcctctcactctcagcctgccctcagaaacactttcatgaaaaatacagtgcatcctattggtcattttcacttatcttgggtggaaacatctgtcaaaggtgaaaggacagaagagtgggacttctttttccaactatgctagaaaaatacaggctggtccagtagctccctgcttcctgtcactgaaaccggcaggccaaaacaggacagtacaggcagagagcagggaacagaaacaggcttgtgacatcacaggtttctgctgtgaaggctgcaggccaggaactcagaagaggaaactctcagagctcataatgtttctaaacaccatattctgacccatttccacagaaacaaaagctacaaagagaacttcctgcacaactgctttcactaaatcaggaacccggtgagcgaaagacacagcaccgggtggagggaaaggtgcaagtcggccagcacagccgggccccgcccagcatacacctgtaggctccacgccatgtgccatcatatgcaaatggccctacgtttctgtttacattttttttaagggacagagtactggtctgttgcccaggctggagtgcagtggtgcaatcatggctcatgcagcctcaacctcctgagctcaggtaagcctcctgcctcagcctcctaaaatgttatgattacaggtgttagccaccacacccagacccttgaatcccttcacttatctgaggaggaacagaagcacagaccaatgtgacctgctaggaagtggccgagctgtctgcctgcacacgggctcccacccagaactggccacagggacagggacactcagggagccccccaagagctgccccagggacactcacggccacgcctgcggccccccataccatggcccttcatggcgttacttcctcctgagcatttcagctgactccactctgtcctcacccccctttttgtgtctacggtccttgcttaagtccaagtcacgccctctcactgtctcttacacacatctctatcctacatgtgaggtctcttaactactttctggaatacagaacataaataaaaacaaaactatgcttcctctgcttgcgggacctaggaataaaacagataaaaacaatgaacattaaattttttttaaaaaaaaggaaaacttcctttcatttaaaaagtgcactgagcttttctcctggtgtgtcaagcgccaaagtctgaggacagaaacggacagaggccaggcggcgggggcggagactgacctggccgagtttgtagctcatgctccccagctcccgctcggggttgatcttagcagcagcttctcgtggctgatgagggcacctgtgaacaccagcaccctgagtcttgtctgcacaggggggcagggccgcaggcccaccccataccagcccagctcctgcccagacggcacccagccgtgagccacctgccctcgccgccactggcaggagggcccaggttgtgcgagccctgtgggtcttggggatttgtcactttataaccagttaagctggcagggccagtggcaagctggactctgtcactttttctctatgacaaataagactgcagcagtcacttgtacccctcagctcccacctctgtgaataggaactggttgtgggctgagctgcaaaagcttggagtcagcagttgcaggcgagccgacagtccaggcaggcaagctctctgggggacccaataagcattttggtgaacagtgccttccagaaccccacctcggtgcccaggctgaccagtacagccggcaggagcgggagcaggataatgcccccacttaacctttcacacccccccagccccaggccagcctcctcatgtctttctgctgggcatccccccaattcccgggcaccacctcccgctaaatgtccccagctaaccctctgccagaccccagatcaacttgcctcctcaaaggggcctccacgcccccttccctggaagcacttgctccccttggagctccaggagcgcctgtgtatgcctcccacccacctctgtgcccctcttttctgccttctatgacaggtcttgctcctgggtcctcctgacttatgagctccttgaaggctggatccatggccctccaatgctcagtttacttcaacgccctaataaacatttgagtctcatagacactgcgtataaccattgcacgtccacatagaactttctgcaattaaagccttcaaggtgcttaaactcctaatagctacggaatcacagagctctacgctaaaatacttttgagtgaaaaacgtgcatccaaatccccacacaactctcttcttttaaaccaggtgacaagctccgatgcctgtgataggcaggcacacaaccggaaggcttggtgggagagtgggcagtgacaggcagggcccagggggggagaggtgcagggagcggggtgctcaggcccagctgtgccctgccctgcagccactccacacatggtttcttaggaaaagctggagattcagcttgtgtagatgaacttggttgattcttaacataagcaactaattcaacttttaaatcctgctggtcttacagcccgtgagattctttcgcttctcatttcttgactggcaggagagaatgcttctcattcatttccagatttacttcctccctgggcctgactaagactcctgcttatgaaaggggcagcgtatttagcccacagcctccaactcagaccacactcaggtcttcccgcatcactggtgtggtgagcatccagtcttctctcattctagcccaagtacaaccgctcccccgcaccctttccctcaggtcctgtagtagccggagacagagaagggacaggatcccatgcctgatataaatgatgggtgcaatattctctctctttgaaaccattgcttgaatctcttgctccacaatccctctgatatgctcagcttcctcccaaacctacattttagaaaaaaggtaaagagtgttttgtttcctcaaaatcttacaagtgaaaaacaccagaactttccctccgctttgcctaaaggaacctgtgtaataccaaatgaaactcacttcctaagtgagcacctgtccgtgagcccttaagtggtgttctactagttgcctgctcattcctgctctgctaacgtcttcccctaaatgctcaaaaccccacgtcagttcctgtcacgtttccagcttctcactgaccaggaggccacctttggtctgcatctcctgcacaggccacacggacggtgttttcaattctagcaatgaaggaaacggcctggttgaagctgctggacgcttcagcggggaacccactgtccccagcacctgcttgtcccagagacacgtgggaactcaagcaaacctggtgtcgagagctttcagaggcttgtccggggctgctgctccaagcagcttacagctgggttgccggccacaggcacagtcattcactgagcaccagtgaggtgatggcctgcacggccaggacgttgatctgggtcctctcttgtcttcctggaaggagagcccacatgtcaacaagagcagcaagacacccacaaccaccctgcctgcagaacccagagtcttccctgcctcaatgggaggaagaggagccttaagtgcaccaaaggatttctgtcaggctgagctcacggggcacaaggcagggcctccgcacacacggccctgaaacaatctgatgggcaaaagcccatttttcaaatcaaggactcctttgggccaaaactccaaacatgaattactttttaataaattatctttgaattccctcatacatttacaggccttgcttatgacaccctgttagcttctatgcatgaatttaaagacaatcttgagacttgtgacatatgtctaccctccaaactgtcatttctgtgagttcaaaccacacctttatcagaatcaagggcctgcattccacaacttcccattctgctggctccgctgtaccaggcacagttattattaatatcgtgttagcgtaatgtacgtgaacacttcaagaagcctgaaaaatctctgcaagacattagaaaaatgaaaccaggtactactcatggcctttataaaggccttttcattttaattcaacctacactcctctgaatattgataaactaaaagatatttccagaaagggcacaatcgtattgatccttaacatggaatgcaccgtaataaaatgcattcagccattggtaatcgcagcccccagacctcagcaggctttgtccctgctctggaatatagtcaagacaccattcagctactctttcaaaaataaggtaagagaaaaaaagaacaccacttgctgccttattttattccccaccaaaggcctgcaagcggccataactgcccatgtgcaaccagcacagggtgtggccttacttctggtgggctctcctcctgctccatcacgagggctgcgtcaccaggacaccaaggagggtggcccaagtttcttcaaactgagtacgactgtccagcctagaaatataaatgttacatgagagagtgtcaacccttctcaagcctgtaacgagagctgacagctacgccgacacagcacggcccctggagaaggctccacgccaagggcgtgagtcccttaaacctcacacagttctatgatgcggggaacactatcccctccatttctcattgaggaaaccgaagtatagacatcggctgcactgtccgagacacatgagaggcagtggcacaggcccaagtcggccctggcagcctggtcaacccccagtggagcagacacaggacagggcagggacgcccatgcaggcaacctcgtgcagggccagggccacttctgccccatcactaaatgggctaaaatcttccctggagtccagccctgagactgtgcagctggctgccaactctgtggataaaactaatggccaccaagctgtccgcttagagtgggtgaaatctgagtatgtgaattctacctcaataaagctgctaaaaatttaaaagtcaaagtaatggttctctgacctgtctagaagaatagattaaaaagagtgtatcaaggtaggaacggggattcatgaaaatacatccgacagaccctccatccctattgatgagctgcattcgagtgtatctacgaacagttgtttctgacagctgtgcttcatgtccccatcatgatgtctgaggcagccagccacttgtggtaaggccagagagacgggatggggtgcttaggacaggagaactagagcatggacatcggggtccccgtgataaacggggtaaagaaagaacaagagacagagagaagagagcgtgcaggactgattcagacacagatacagacaaatataacaatttacgttacaggaaaaaaatgaacaaagaaaatgagcacagacaaggcaaggactgcggcacagtcttggtcacgcacgtccgatgggcagttcaagagcaagggcacccaagtaagcaaaggtgctcggttaggcaagggggagagagcaggaggccactgataccgatcctcacagccaggaagagaggagctccgtgaggcagctggcgtgaggtacctgctcagggctctctttggacattgattataaaggggaaagtagaggcaaggtgtctcctgccacaaccttctgggatccaaacagcctcaaatctgcagaagcccgagggactggggagaggactggacagtggagtcagggtcccctgccagactttctaggacaagacaggaacattccaggaaacaccacagcagggcaagtcactgagaactgactgattacagtcccaccacaagatcacacctcttgccatcaaaaggggcaaaagtggtgacttattcatttagacacttatttagaaataaggggtaacattgtttagaaatgtaatttctaaatctgcaacaattctatgaaatagacacgacccccatttacatatgacaaaactgagggtctctagaggttagacggacttgccctgcgctgctcagtaggagggctggaagcagaccaggactgtctgagccccaagcctgctttctccccatgcgcctctaggctctggggaaggcgagtgccaagaaacctgactccatctgctcccgtctgttgttcccatatgagaaaatggaccactgagacacaacaggatcagactggtgaacacagaaaacattctgagacaagtgctgccactgtttagcctaaatgcaaaatctaaggcagatttggtctcacgttgtccactacacatgaacctttcctgacttcaaacaagcccggaatcacaaagctgggattcaagccacaaaacacaggaactgggatctattttctcagtataaaggagttttgccaacactgcaaaatgtattcacataggtttgtattattatcatgcttaatcttttctggagtcaaatgagaagatcccagtactgggggctctggatttcctcccggagatgtccgacaatggtgacctgaaggagaggccccaagagtacctagtgtgttgatgcgtagatgaactccttaaagacttccttttcctggaggaactccacggggatctcagggatgctgtgccaaaatcccctcccggtttgggtgaccatccaagcttccacacctgagaagtgaaaaggaagtgacatcatccgagttgagtcaggacagacatactgtgaggaagcaggagcccgacttctctccactgggctccctcctcactaccccaacactgtcccagagctggaccttctcccccagaaaacagctccaactgcttcctgggacttccttccccatcaagtgccctcccaaatctgctctgccctcccacttcctgtcctcatcctgaggctgctggcacacccactcagggagtgctgggagaagcaggcaggagttagagacagcacccctcgcccacaacagcaggtgctgtgctagaataaaggcaggcgttcaatgaggttcagctcagatatgttattggcaagcaggcatgaaaatgaaccatacagcttatttctgtaaactctgaagtcagttctctgtgcgtgaggtgctcagacaagtgccatgcacagaagaatccagaggcaggttgatgctgttcaagtggcaggatcagctcacggtctggccagctcagcttacatgcctcagtgaggtgacaaaggacccaacggaaccccaggattcccacagcccatctgcacaaagcagagggggctctatgataatgaccagctaatctcttacctcaccacaggaaagcccttctttaaatcggttatgctcccctatgctcctctctggtacccacccagggagagactgagtgcctgttacagctgccttccagatgaccgcactcagggaactcctcaatgccagtgagagcttgctggaggaattttacctacagcgtgcagcccgtcctggcctatcctcaggttgctctggacggcatgacctcaagaccgtgccctcctgcatggtctccacgagcccctcaaaggagcagttactgtctcataaccagatgctaatgaacccacagtgactcgctgtgcccaagagtggggccgagagcaaccccatgcagcaagtgtggcctgcttctccagcaccctgctgctctcttcccaggaaagcctacaactccctgttctgcaactgcttccagcaccgcaggcactggcctcttcttcggaataagcccgccatctggaataccttcattccctgcgcagaatccttatctctcaggatcaaacaatactgcgtccttggagcaagcctccctagatctccagcatacatacacacacgtgcacacacacacacaggcaggcacgcacccttctcggcagccacaagcctcttccctgggacctggctccattctccctgacctacacctgctgctcacaccctgccaggtcggcctttctttcctgcctgaggatgctgcaggccctaaggacaggccccatcatcttatttcagcgggctggtgggagatgatgccatttcactgggcagagtcagtccccctccatcaaccctcactctcctcaagctaagctcctcatgttatctgaacaagggttctgatcaataacacctaccttttttttttttgagacggagtcttgctctgtgcccaggctagagtgcagtggcgcgatctcggcttactgcaaccttcgcctcctgggtcaagcgattctcctgtctcagtctcctgagtagctgggattacaggcgtacaccaccaccctggctaatttttatatttttagtagagatggggtttcaccatgttggccaggctggttcgaaatcctgacctcaagtgatccgcccaccttggcttcccaaagtgctgggattacagcatgagctactgcgcctggcaataacacctactttaaaccaattctgaagacaactgcaaactgtgtagaaaaacatgaattatctccaaaggaaaatctcactcactcgagggggttggtttctggtctgctattaagcaaagtggtctagttgctctagaatcaggtctaacacaatctcttagggatgtagggcctcagttcattttagaaaacccagtatttctactagcgcctccacacgtggtgcctgaggaaagcagcctggcaccagaaccacagtgggcaccagaccacagcaggcagcctctgggctgcggggattctgtcccgccctctcacgtgtgcccagccagggcctaccggtgcctttcaccgtacttggtcttctgcaaggaacgagcagactcacagtgggggcacacgtgtgtagctgttgacaaggggcaggcgggccaggctgatgatgagttcctgagcaatggcgtgagaaacgccggcacgccgctattccttttatgacccaaggcaacaccgactgcagagactccaccatttctgccaccatctcacaggctgcagtgatatcttaggatctaaacaagcaacggttaagagaggactttttaaaaaacacatcctatatgccagtgtagaaagcatgacctacaaccagctgctcaagctgtaactgtggaatccacttgactctgagttggccactgaaggcctgcagattctaccttcatatccgcctataccataaattctccccattttctgctgggattgctggaatggtcctgaacctgagctctggccttgttcccagccctctggcccactctctgtgataaggccagcagcagcctgtgacagctggagccatcctgtggctcctcagcctcagacttcctttaggacacctcctctgcccctcgttttctctggtctcccaggacctgtgtctgtccctcagctagtatcaaagggccatgttgcatccttgcttcactggctttcctaggtcagagtgcttgaggggcttggggcatggttcggtgggcatggaaactcccaaggcagacgctgtggacacttcacacccttgggaagatcacagaatggtgtcttgagtctagaatatcatacctactaaaatatgatttgttgaggcatgagtgtgtattacgtggctattacccacaggccacgagattctacagtttgggcaactcctaggatagagaaggacttctcattggacttaagcaattaagccccacgctaacgagtggctttattaatatttttttttttttttgagacggagtcttgctctgtcgcccaggctgagtgcagtggcgggatctcggctcactgcaagctccgcctcccgggttcacgccattctctgcctcagcctcccaagtagctgggactacaggcgcccgccactacgcccggctaatttttgtatttttagtagagacggggtttcaccgttttagctgggatggtctcgatctcctacctcgtgatccgcccgcctcggcctcccaaagtgctgggattacaggcgtgagccacccgcccggcctattaatatttattggatgacctttaagaagtaacgtcctatcgaggtgataaaaaaacaaagaaagcttcccactcttgcctaaagagggccatggggaataagcatatcatcttcacccaaacagaacccacttcagggcccgttgctctaactcaaaccgccaagtgtctcaactgttttaaagcaatggaaatctaactaaaaatcatgatagcatttgttgatattcataacaagactgtcatccgttccaggtgctttacatggagggattaactgattgtttcaatccacacggttggcactattcttatcctcaccacagaagcacaggatccacagctgaggtgccactcggctggaagatgcagagtagggaggtgggtgttttcatattccttggtagcaacaagaaatcatgaaatcacaaactgaagcctgaaggacccacagaggtttggatacaaattcagagaagtccttggctgtgcattaaaatgccattgcttctgggtcatttctaattacaaaaccttgaaccgggaaccagaagagaaaagtactatgcagaagactaagacaggaaaactccatccacaaccaggattgcacaaaagcggggagaaaaagcccaaaacactggtgcactcatgattgaaaaggcgtgtttcctgagccacagagcatggaaaagatcctgatgctccaggtaagcgtgctgtgtaaaatgtgtggacaggctccaggtgaggcaccccacctctgtgggacaggcaacaggggccattccccaccagacactgggctaaagaagtgaagcaccccagcagcctaggggccctggcaagaacaaaagacacttggccaaagaatttcctcccaacaggcactgccaccattttcctagtaaaatacctactctagaattgggagaaagtgcatgaaaagccgtagtatatgtctaagtctataactggcttaaatcactgggtttggatttttttttttttctgtaggaaaagcggaattttcttttaaatatccaccaaacagatggctgaacctgacactgaggttactgaatactcatgtgggaaacatttatttatcattatcactcaacaaaaggttgttgcttgctgaccagaggccgagcattaatttctgaaacacaaagaagacaaacctgttccctgccctcaaggatctcagaataactgcagagtggggaagtgcggggggaagggagcgctcccccagtggcatcccagctggtctgtagggtcgagacagccgcatgtgtacggataaggtgttcactcggaaacaaaagagctggcaaagcatggactacagcctccctgacagctagggaggagcagcaggacacagcggagctacggtcgcttccaggagtccacactcaccgcggtgcacgtctctgtgaatgatttttaagtcctgaggaacaacatgtaagaaaaaaatgggtcctgagacttactctgtgtgtttggatctattcctcctcctcctcgctgatggcttttggggtatttgtccttctttctggactaagaactgctctccaggctgcactgcaactaaaattacaacagaacaaagagaagaatttctaccacttccatcagtgctttttattcaacattttacatttgtgcagcctcacaaaagttgaagggatagacagactagcctagattccttagaaccaattttagacaaacagacaatactgactgaggtaccaatctcttggttagtggtatatgtctgaagatttgaacttcagatttattcagatttctaagtccctcgactgtctcctgttggccatctctcaccctgaggttatatgagacggctcaagatactatcaaaatcatcactataacctccaagaagtctggctttaagtagtaatccctggatctttgttttcaagttggctacaaatgcacagatgaaaacaatatgaaacatgaaaacatcactctataacatttaatttaaaaatacaaagcttcaaaacccctctaacatgtaaactatgacgtccaattttttaaaaattgtggctaatgacccttgtgaggatactgttccttgaaaagaacaagccacttttattttacagtacgttaatattaaatgcagtataaaaacaaacattttaactctgacagaaaacaaataatcttctgaatgtatgttattaatcttatgatcatataagactaaatacataaaacagctaagaccaaagatacagagacataaagtttagaggtatttttgatgaaagctgaaacttcaaaatctaaataaatgactaaaaaagcaaattccagttaaattccagtgtagactccaatatattggagagaagagatggggcccagcccttcctgatgcatattttatctacctctccatccccaattctagcttagtacctggcaaacaggcagcacaaaataaaaacatggtgaagcagacaggaatatgataggaacccaccgttcatggacggggactcaccggcctccaggatgaagtgcaccagtagatgagggagcaggcgtgggtcacaaactctgtggaggagaccacgctccagagccaggcagctgcagggccaggcagcagcagtccagccctgcctggagatccagactcaggggatctgctcatggatcaaatgccaggacagggcctaaagggaagtaccgagtcacagatgcccactcgtgtaccttcgtttggggaagccgtgtgaatcacagttgtggaaccgtcaaagcactgaggggcagcgcgtccaggtgcccttgcccttccagaaggacagctctgactggctccattacattcagtcctgacccacctattccccaaagtgccagtcccctctctgcacaaagcccccttactctgctgcctctctctccttcagcgctgtgggctcctgtagaatctctcctgggctacgtggccaccaggccagaggctcttccttggggctcccacagcacagggcttgcctctgtcataggttgaatttgagagcgtgggttctagggatagcaggcctgggttcaaatgccagaatggctacttcctagctcagaggacctgggcaagtcactgaaatctctaagccttgctttcctcacctgtcaaatgggagtaacagagcctatctcacaggggttgtgagagtcaaataagatgacgcatataaagtatttcatcctgcatacagcaggcaataatataatcagcagcaatcaccctgtgctgtgatcacacgctgactttcccacttcccactaagctgaaacctgaaggacagggatcacaaaccatatgactccacgtggttcagataagggtgtatttatcattttgtgagtaatggcactgatgccctttggactcctcccttctttggtgtgaggtggaggcggagcctctgtgggtctgcaaagtgtgtccttgctgaggcaggcagcacagcgatggccctttaaggatacaggccagactttaatgcatccagaacggtacacattctgggggcgaattacaagcactaacacaaaccaagtaagtattccttggcgacatgtccaggccaacttaagacataaagtacttccagatgattatttttcatgtctcaaaattaggatccacctaacatggtaggtgcagatgagaaggggacctggctgacctcaaggccaccatgaggagtggcgaggtgagggtgaaggatggctacaataacttgacggtgcaagacttactgccaggctgagatggaaaagtgactggactggtcagagatcttgctttcaaataaaactgctttaccctcttcagtgtcagccccatgccccctccccacagcaacatgagctcccgagctgcctcttacctcaagggttgccaccacgaatttcacaatgtcctttctttctcaggaggaaggtgcaaatgactgggcagtttggagaccaccaccaggtactggccagggcccgggccagagtgggcagggactgatacagtgcagcatcccctgaaacagaggacctcgtgggtgggtgcaaacgtgagcacagatgcatcaacttcgaaaggcagtcaacaattctctgagaatctgatgaaagctcaagacattgttcctcagtggcacatctacactccgtccacaggactgcacgtggtttggggctgcatctcccctgaggtctggcccagcctcctcaagggcttagagccctatgtccatgaccatgtcaatgaatggcaaagtggcaaaacacaggaagaaattctgagccgaggacacccgtgctgctctttagctacctctgtaaagctttcaatgtattagatccactgcctttattgtacatttacttggtgcaaagtactatctggccctggaatgctttttaaaaataagataaattttaattttaattaccaaacagatattcaacttgctccagtaggccgccggctctgcaggcagctcgggctggaagacatgatgacagcagggagctgctgcacggtgccgctcacacgggccagagtcacctcacgggctgttcaaaaagggcactcttctggccaccagaaatttcactcatccctaggcttaagcatgagctagcaggcttaggttgaactcctgaaatcagagcattaaaggttaacaaacaataaaacagattatgagctttcaatcaggtaagaaaaacacaacagaaaaaagaataaggcaatgtttctgagaaaatacaaattggtataccatcaaaaatatttttaagaaaattctacttatgcctgttataaatatttgaacaatttcattcaacatatgcttagtaaaatatatattgttctctcttagtattttaagtaatattttaattttttatgctcttggatttgcttgaataaaaattttggtatgacaattttaattcataaaaacaaaatcaaagctaaagtgtcaccaagacctcagtgatacaccaaccaccctaaagtttgaaaaagatgttcaaatgcagcgaaatacgtaaaagtagccatatgaatgccaaaattttggttggaaaaatggtatttctatgtcaatttggattatgttttagcaacccttttgtttagccatttaaagattggtggcgatccttcaggtaaaacatctatcttagtttaatactcagaaaagcatcatgaatgccaaagttgaagctttcttttacagtcagaacttttacagctgttcaaagcccaattagcaatttggaaaacctaataaacagatcactaagcaaatttatcactcagtaagttagctttcctgcatgaatcttaagataaacaattttaggccgggcgtggtggctcaggcctataatccagcactttgggaggccgaggtgggcggatcacctgaggtcaggagtttgagaccagccggccaacatggtgaaatcccgtctctactaaaaatacaaaaattagccgggcgtggtgggcatgcctgttaataccagctatttgggaggctgaggcaggagaatcgtatgaacccagaggcggaggttgcagtgagccaagatagcgccattgcactccagcctgggggacaacaggagactttgtctcaaaaaaaaaaaaaaagataaacaattttagtaaatggattttgggcaattctcctgttgttttcagttgagctcttcagtacgtcagaacacactgttgtgttgcctccccacaaggtctcttttcatgaacacctgccgtcactcccggcctctacaggcattgtcctcccaggtgcccacttccctcccatttgctgcatatcaacgcagggctaaagcacaggaggtttctcccgtcctagtaggtctgagaagaagccctgcttgggccatggctgcacatacccaagaggtggcccccccactgctcacaggacctgcccacgggtgagggacaggacaccaaggctttgcatggcctcctagctctgcgcagggtgccctctgacatctggggtggggggtgaagaacctcactacatctaacagaggtgtgagtagaggaaatctcgctgcaccaagggtctcttttacgactaaagatcaacttccaagacactagaaacaagttattgagtcacgcattacgacactgtgttgaagtctacggcaaatacgcaaccttgacttccatttgtcttggccatggagcttagatgataacatcctgtgtttgttcctccagtggaggccaatagttctcatcccaaaccatacacccagccttggggccagctggatttcaaaacaacactccgtggattctaatgtggctgaaacaatgtgcttttctgtctcgatcagcataaccccatgtcccgaccccatctgaaatggagtcctccccacttcccggccccattcagagtgggtctctccgacatcccgtccctgcccagactggagtccccaacatgtgttgtcaacaaggggtcacatgatgatgagacaaatcccacttggaagtcacaagaaaagctgaggattcctgcctccactgctccccccgtaccgagttcatcatgaaggcattcatatcttcagcaggatccgattcaccagctctgcaccttccagcagtgcagaatctgacctggtccaacactggatttgacaagatgaacgtaccagtcctgggaagaaaaaaatggataaggggaacatgagggcggcgttcaaggggacttcacatccctggagctacaggcctaggccagtgcttgggacaccgcactaggctgagagggctgccggccggcaggctgtggctatacggctcaccacccacaggttttcccctttggacttctgttacctgcctgggcaccctcacagcctccccctcacctggtgaacttccaataggccttccaaatatagctaaaccactaagggttagcggccctttgccatcctctcctgggttgtctgctttactcatctctccccagcaaccagggcgggcaggtgcttagcgaatagagcctaagaaggcaggactgaaccttcgctttcttatattgggctgctggtttttgaaatctaaattcatattcataagctgaactttgtccaggaagtagagtaccaaggctctaccaaggctctaccaaggctccaggtggtccctaaccatgagtatgagcagtggaggtgctgacaacataccagaatggctggcagtggcagtgcaactccaggtggccagaaggtatgaggagatggagggaggctaacggcattgacatgtgcttgaggcctgtgcagtcaggggcctgcaggccacggccgactattccttgattcacccactaatactcaccccacactcctaccaaaagggtcccacatcagcactgcttggctccctcagacttgatggccccccacgtctctaaccacagcttcactgagccgagccgagcgccagaacccttgggtccacggcacctcctctgcactctctgtatctgccacaggtgacagaggcaccagcgccctgtgcctcccatgcagacacgctggacacttactttgtccggactcactgttccagtgacacgtgcccatccccgtccagcgggtgggaagagactggaggagagggactagtgagtcttgcatggtggagagacgaaacctgtccagcagggaatagagcctttggtgctaaaatacaaataaaaatgaaattacagtataatttgtttttttttttttttagtcttgtctaaactctgcacactaggattctagaaatatacactctaaggagatgcactattagggcttcttaaaggaaaatacacttgtttaaacctttttcttcacagctatcttctcatcatactcaaacaggtcatgatacaaatgcaggccctagtttacttttaagtatcacagttgtactccattaatattttccagaaatttcatttatactcaaacactgcaacaggcaataacagtataaaagctaataaaggctttcttaataaatgtaaaacagatcatctaagactcaatgcacaaattccactatcaaatatcccagtaagacaactgataggaattcatggtcattcaaaataaaatcacctcatctggcacaagatatttataatcttttaatctccctcattggactgaagactaagtctagggtcaaaaagtaataatagtttatctcccgccatctgcatgagagtgacaacttcataatgcaaattacaaaagagcttggccctacagactgaaaatcatcccaaactgtccacctaattgtgcccaatcccatttaaaaacaccatcaacaaggactctaaagactgaaaagcataatagacaaggtactctaaagactgaaaagcataataattttgtgtgtttttccttttttgcagtttcagctcaaagtacacagcatgataattatatctccttctctgctgtctctctctccctctcacacacacaatccctgccccccaccccgcccgcaagggaaggaaaaaggtaaaagtttaacttattctgcagtcatggaaatacactacataggagatgtagggatttctgacaaaggcttctcaaagactttgcaaacacaactaatgattaaatgctttgaagacataaaatggcaacaggatgcagatgtaagtcctgcatgcaaggattgagtaatgtctctcagatttgccaactcttgtttagcaattagatgacatgtttgattttgctaagataaacctgataacctattttcccactcatcacaggacagtgaaacaggcattctaaatgctacctctcaaacagccaccaggagtgcaaactgcctccactccgtcacagacgtgatcctgccggtcatcctttactctttagaaagtgagatctggttgtttaaaagtaggaaggttctattatggcacttctgcagtaaacccacctataaggcacatgatttcttgtcctgtgaatttattcccgtacaaatctatatcctttatatcctgggttgcctaacacaaggacgacctgtgtttccagcattacctctgagcgagcccgctgctctgaggtattcctggattctgttgagttcttccattggcaactgggccatgctgctctaatagcaaaaacacattagtgtgtttgtaacacctaacaacccaaaataacctcatgctcatttaaaaggatgaactgatgtgtacagttcatcctagtaagggcagactagaaaaaaatacagaaacagtcagatcggacacacgagtaacggcaagtttgcagatgtttccatgtttctacggtgaccatgtcaagaccatacttacggaggaaaaagccagccacctgttttgcttggctgctaaattttcaatataaatcaatatcagggtttctcttcccaatacctgtaaatttcagccagaagcatttctacccggcgacaagcaaggatgtcgaccatgcgagccagcacaggaaaggggtgcacagaagcctgtccacatacagcgtgagcacagctcccgactggctggatggatcccctccaagcactgaagagttttcttcagcatggttggctaacagcaagaagaaaagaacaaaagatgactattttgcaaatcagaaattaaagttaaaaatttcaatacccatttttaaggcagggaaaactgcaactggcaatagtcggcaggatgaagacgtacagtgaaaggttttcacaacgagactgaattgcctggatgaacaggccgctggcagcagagtccgatgaacggcactgatgaagtcctgtactggaggctcgtgggaaaggctgatcagatttgaatgtgatttacaatgagccacgttaagtgctcggagtcatggaggttctgacactaggaaaaatatgatgagagattcattttcaagtacacaagaagagaccaggtattaatgcatagaaaggccagaaagggtaagaaggagaaaacacatcccaaatataaacctcactaaaatatacagtgtatgagcacaaataattgaggaggtaggaaactcgatttaccaaggcgtcacctccaaccacgcactgcggcagaggctgtgtgaagttaggccccctggggaagtgggtacagcagtccagctctcagagacactaacaaatggccaagggtcaaaggacaaagcaggcctcagcgagatccgcaggtagcaggggcagcgttgcgctgggatgaccccatcccagcactgcctgccctctcccgggcttcgggccggctaagccagtggggttctccaattctctttttccaattttgtgatagttcagtgggaaaaaaagaatcccctatcactgccacgttttgacagaactgttgaatccaaaatatgaatggatcccacatatcaaataaatcttagtgtagatatttaagatttataagaaaataaaaatatatatttttaaacatgcagagcttttcatcttgattcataatcctaggcagaaactgtaaaatgtgatcaattccttgatattggttaacgattaatatttttcatttgggatcatctgacagtacaggttgaataaccctatctgaaatgtttgggatcagaagtattctgaatttaggatttttttcaggttttgaatatgtgcattatacttatttgttgagctccctaaatccgaaaatctgaaaccttccaataacatttcctttgaacataatgtcagcactcaaaaagcttcagaatttggagcattttgatttcagatttttggatttgggatgatcaaactttattaacttataaaattagtatctttttcttatatttctgtgaaaaacagcattataaattatattatccttaaaagtagaacaaatagaaaaactacttcaatagagaaagtaaagcaaaaagtgactattaataaattgtctcaccagaaaaagtctctaggataacacctctttcagttggagagtcggcttccttttcgattcagaatatttaacactgttttgctatgtgacagtagtatctataagataccatgttgtgacaaagaaatgcatatgttttaaatatttttaatataaatatagaaaaagtattaatctagaccaaaatctaacagcaagttatctctgagtagtatgattacaggaggttttatttcctccgtttatttgtttttttgtaaattctccatggtaaatatgtgatgctagtttatggttaaaaactcccacaagttatttttttttctttaaagagaacggcatttaaacagaatccatcataaaatgtgacaaagaacatctaacaccttttctacaaattaacttaaaaaattattttagagcaggggtctcgccttgtcacccaggccggagtgcagtgacacagtccagctcactgcagcctcaaacttctgggctcaagcaatcctcccttctcagtctctcagtggctgggaccacaggcatgcaccaccacgccaggctaatttttctttcttcctctcttctttttttggtagaggcagggtttctctgtgttgccaggctggtctcgaactcccaggccaagccatcctccgccctcagcttctcaaagagctgtgattacaggcacgagccaccaccttggataattttttattttttatttttttagagatgggtgtctcacaccatagcccagcttgtctcaaactcctgggctcaagtgatcttcctacctcagcctctcgagttgctggatttaggcataagccactgctcctggtattaatttttaaaaaaatttaaaatcagaacccactacagtcaatgcacttactttgttttttaaatcattagttattattattccattgctccctcaaattaacaaacatacccagcatcatgtaggcgtgagccaatagccgggcatttataaatgagtcagctgcaaaaactctcacagtccaacttagaatccagtgactggaaggcaggcctggtctccaattatatgtcacagcagaagtaaacattcattctagatttagttcgatggagcttggcaggacaccgggcggtctgggttccagagggtccatgcaagtgtcactacacaggatgttctcctggtccccacctccctcaaccccgtttacaggcatttcaaattacgacataatcacagaagagaatgagagcccctcttcgtactatttctctattgcacttccaagtttggctgccaagtcagaatcctcctcttctccagacatctggggactaagtactttgtgctggacagactgtgtcttctagaaggagcaacagatgcattgacaatgttttggatggcagtgagcttatttgcaaaatactgaagatgattatgtttaattctagttctaaacagacaagttgttttaaatattgccatatcagaatgttgtatgtgtaatatatacttcagttatctattcctaagctacaataaaccacatatgaaaaactaaagaaaacagaattaacaggcagaaaattaaaatgcttgcctgaatagcaaaatccaccataaagctgcacatcaatcagcacctttatttcagaactcacactggctatgtttgataattgagcaattgctttgaaattctccatctgccgtgaaagttgccaactgccagaatgaaaacctccctgcttcatgttttactgttcgtttcccaatgaaacatcaccactctaaacatgttgatgttatcgttatggaaatcctgtttaaaaacacttcttccccactaacacaggttatttcactctcactgacttctcactttattgtttttttctttttgaatacgtgggaattataaaccttggactcttggctctagtccatacagttaaaatgttgacacactcccaaactgcccctctgccttcagggtctgaccgagcgacgtccttcccattgcggcaaagggccttaacggggacgaggtcacatcaagctaagaatattctgaaatacaacaacttttcctgtaatccctcagatttagaagagaactggtaaaaaccaaaattctacagatttaaactttttaaaaagtgcttttctctgtttcccaactggtgaagtgaaaacaaactacagcctagccatacaatgctagcagttgcaaggagcgagccaccgacgcgtgggcaacacgcgacagaactttagacacgctcaccgaaaggggccagactcagaaggctgcacaccgcgtggttccgtttctttctttttccccagagacaacgtcttgctgtgtcacctaggctggagcacagtggcacgatcatgctcactgtaacctctaactcctgagctcaagtgatcctcctgcctcagcctcccaagcgctgaactacagggacgtgattgtaatttttaaattttttttttctggagatggggtctgctaggcagcccaggctagtcttgaactcccagcctcaagtcatcctcccacttcagccctcaaaatactgggattacaggcatgagccaccacacctagcctatagattctatttcttggccttctgcaatgggctgaacagagggacagagcacggattggtggttagacctgggaggggcaggatgtggcagaggaagagggaactgtttgaagtgacagcactcctctatatttgatgtggttgggggaggggggctgttactgactacagttgatagaaaagtacattttctgtattgtaaattatgtgtcaatgtgaaaactaacgaacaggaaacgtgccctttctcgtgggccgtcctgccagcgcagtgtgacttacactcaagctgtaattgtgcactttgcataatacagctatagggtaatgagcctctgaaagagaagaggcagtatttgcaattcaaaatgagcagtagacataaagaaggtccactgtcaactcaaattcagccccaatttgtagcgcacaagcccccccaaatctcaggccatacaccgcccggtactggtggcgaatgaatgtccaaatctagggtgactcagaacaagatgagctgggaagtgaccaacacatcatgtgtacacaacacacccacaagcgccaaagtataggcaggactctaacagttcaccaagaggtagacagattgagagtgaatcataaacccacagtgacagagtccataagagaggggctaggtagggcaggacccacataaggacctcctggagcagagcacccagtgtcgcctggagccactcccatctgggagccagcctgagaggagatgcacacaaaccgagagagggtcaagagtagcagcaggaatttctgcaactggatacagcaattttatggctgctgagtctatggctaaaaaagagcagctgtgttttgtatttcacacttctagtaattcatttttctcatctcatgaaataaaaagatactcatcccccaccacccacagctggaaaaacacagtgctaagagcggggtttaaaccagaacagctctgctctctatgggcatcttggacacttatggggatttttttttccttccaccacggggacaccttagacactcacatgcttgttacatattatcttattttacctttacattaccattaaagaacgatattttttgaaatttaattattaggttaaaatccattgatccattaattttttttttttttttttttttttgagatggagtctcacttgtcacccaggctagagtgcagtggcgcgatctcagctcactgcaaccttttcctcctagttcaagcgattctcccgcctcagccttctgagtagcagggactacaggcacctgtcacatgctcggctaatttttgttattttcagtagagacagcatttcatcatgttggccaggcggtctcgaagtcctggcctcaggtgatctgcccgccttggcttcccaaggtgctgggatataggcatgagccaccacgcccagcctaatctattaatgttatttcaggataatagaagaacaatacagaaggttataaaggaaaactggatcagagggggtcacgaaacagtcacagatttacctacatttacaaaaagctgtagtttgccctcagagggctgaatgaagacgcttctgaattccaaactaaatttacctttggtttatttcttttaaacactcatcatctaagctttctgttactccaattcaggggacacaattcccagattcagagctttctgatataacacagagtaagcaggcccatctgtcagaaaaggagtgatctgctgaatccgcagctgattttatgcacgttaaagcagcacagaactaggagacactgactttctgtctcctgcccccacgtgctcagtcatcgtaacaggcctaagacatccaccaagcatttcaaatgtcgtcactgtctgtctcctccaacagaatgaccagaccccactacatacggcacagagtggatggttagaatgcctcccaacagtggactttccagctgagtgccatgaactggccctactgggagcctggcagcacaaggtccagtatccatactgagcagagaggcacggcagcacctgccctctttgtctccagaacttcttttccccagcgtgggatcttgagccttccagaaatactgtgtgaggattcagctgggcgggggccagggttgggggtggtcacagcttttatttccatactatacaaataatggagtgttggagcacctagaaatggagcttaagcctgaaaaccttttcaaaaagagggccacccataacgagaaccttagtaagcctttttgaatggtaaaataactttccaagaggttttgaaatttgctacactgttacttcattatctaaggataaccagaacacatttactttataatgaggttaagacattgcaacatgtctggctatggaaccaatttaggactagaacttagtaggagccacagagcatgacaagcatatcccacaagatgcaatgtgtcaaagaacctgccaaagaaaatcgcatttagaaagcaactgctattttgaatgccttagctggaccgcatgtttgtcccaataatatgctgtccatgaaaggaatattaatatgcgcagaaatttcacaagccctcacaaaaaatggaaaatgaaaatgctttaacggtggccaagctcaggttactgggagtctcaggacagggtgctgggctggcgccctgggctgtggggattatgaacctacttcggggtctgctgcacttctgcccaccagcggtagtcggtgtggtgacaagcagcagtatctgacaccagagcagcaccagggccgggtgggtggtgatcatggacgagcccgcaagttcaagctgtccagggtgtagaaactgccgccacagccatcactgcgaacagcctagtggcagctgctgtgattctccggaacattcctagaaacaaagttaagggaaatgtctttgctttcatctcggtccagtgccacatggctacgcgaagattttacataaaatgaaacaggctgagtcgtctcccatacttacgtattcagaacacctggcatttagaaattctgatttttctaagcagaaacagatatcctacttttttttttttttttgagataggttttgctcttgttgcccaggttggagtgcagtggcgcaatcttggctcactgcaaactcaccttccggtttcaagctgttctcctgcctcagcctcccaagtagctaggattacagggcctgccaccacgcccagctaatatttgtatttttagtatagagggggtttcaccatgtggccaggctggtcttgaactcctgagctcgtgatccacccgcctcagcctcccaaagtgtgggattaaggcgtgagccgccgtgcctggccaatatcccacttatttaatggactggtaagaaagctagcattcctcctctctcactgtcgacctccacattggtcggcaatgccaaccctccaggagctccaagccaagagctgcgaaagtctgaacacagctcctggagaaggatcagggaacactcagcgcctcgaatcactgcactcgggccacagcggggcccccacaggctgagccacagctacacaggcaggaacagcactcggcacctgccaaactcaacagctccgggcttgctaaggactgagggacagaaatgctgaaggaggccaggtgagaaagcaggaccccctgcggtccaggctctgtgtgccctctgcaggctcctgacacctgacagccaagtgcctctgtgcccggccatggagcatcctgggcctaggcaggccaagcggtcagcctcccccacacaatgctggcacctcagcaacacactcagctagattctaccggcaaatttctccaagcatccttctcagggctccaggaatcatgacttcattctatcctctcctttggataaaaaggtcaaaggcacagagacatgcacaggctgcaaagcccagcagggagaggcagcaagcttgggaaacagagaaaggcccagctggccaaggccaccctctcccccagatctgggctcctggcatcactgttgggatcaaaattttatttctgatttaaatttcaggccgggtgtgtggctcacgcctataatcacagcactttgggaggccaaggtgggcagatcacttgaggtaggagttcgagaccagcctgaccaacatggtaaaaccctgtctccactaaaaatacaaaattggccgagtgtggtggcgggtgcctgtaatcccaggtatttgggaggcgggagcacagaattgcttgaacccaggaggcaggggcagcagtggccaagatcgtgccactgcactctgcctgggcaatggagcgagactctatctcaaaaaaaaaaaaaaaaaaaaaaaaaaaatcacacatccccaaagtgaaagggtcctaaaacaggtaaaaacagagtacaggctttttaggctccacaatgccttaaactataacctgagaccaaggaagcgagctaacagaagcagcaactcagagaatgcagaccaggtcacgacgaggagttctaatgccttgtctctggctcctcaggtttcctgggatttctctacacttgcttcctggtcagcattgtcccctccagcccatctgcactggcctcatccttctgtggggccctctgttcctgcatgggccccctgagtgagaggcatgcactgccttcaaggaagatgcagccaggccacagagcacgtgcagggacagcccgggatgtaggggttttgaacaggtaatagaaacccacaatccaagctgtgttctagtggctgagtgtcaacacaggctctgaatcagactgcctggttcagatcgtggctctacttctactacctgggtgaccttggatgcaccttacctggggcctcagcttccttaggtgtagatggaattaagagcagtatctgttcgcagggctgtaataaggagcaaacaggagaaccaggtaaagggctcagcactgcacaaggcatggaggaagtactcagcccccggggtggcactgctggagcctattagggaagttcaggtggaagatgagacggactctgagggccacctctagtagatagagaggaggaggtaaggttagggttcctggggtagcgggaggaggaacaactatgatgctgggattctgaacatccctaatgatctaattaacaagaagaggccctgggagtgacagtggtgctagttcaattttaagtgcaagtctgaggtactggcaggacaagtccgtgtcgagaagctggatgccaggactacaaggaccagcaagagaaagttgtccatgaagcaacagccaaggtcacaaaggggatggacctaccaaggccaaggagagaggcagaaaacagagaaaacagtaacgagagaccatggacagcaactcgaggaacacaatcaattaagggctagacagagaagaccccacaagctactgagtgacaagagggcagctccacagaatcagctggagggcctaggatgagagagacctagaaagaaagaacacaggcagcctctgcaaggcctttttagtaaagagggcaagaggcaggctgccatggcttgagaaacaagagggaacaaaccaccatgggcaatgagaatggagtgtacacagagggagggacccctcatgaaggagcaggagggcacaggaagtgctggtttgtttttcatttaaggctggcttagtgtggctttaagtgtaaaagagcagctacaggcaggaaaggaaaggtaagacatacatgtttcgctcggtgaagtatgcaatggatttttttttttttttcagacagggtctcactctgtttgacagactggagtacagtggcacgatcacagcccactgtagctttggcctccggggctcaatgatcctcctgtctcaggttcctgagtagctgggagtataggtgtgcgccaccatgcccactaatttttgtattttctatagaaacaggatttcaacatgttgctcaggctaatctcaactcctgggctcaagcaatctgcccaccttggcttcccaaagtgcacaggattacaggtggagccaccacacctggcctgcaatggatatttttaaataagcatcaaaggcaaaattcattccagagaatccagaaggatgtggcgtcaggaagcagacataagaggggccaggaagcggcaggaggatgaggatgaacttggggacaggatagaaggtcccctgttccgctgggatttatgaggaacccagggtcccttccaggtggagggaggaacaactggacagaggctcatagaaggattcatcactctctctgcggagagcaaggcagacacctgctgggcatggtgtggcatatcagaatagcaaaagctttagaaggcatggcactcgctgcagctcattctgaagcaccactaatcccatggtgacacccgcctggtcccctccttccaagggtttccctgacttcctcatcctggaatcacctgtttttatcctcacagaaaacacatcagagaccacagtgtgctgctgggaagcagcaggacgacgtctctcagtccccttttacagggtggggctgtgcctgtcaccacgagagaacaccagcaaaggcatgcctgtcacttatccaaggccacaaaccttctttaccttccctctccttgtccccaaccagacacagaggatgtgaaggcctggaaacagaaccaaaagaaggaaaggagcctgggtccccgaattcccacatggaggaaaacctccgtgaaccaagaacaccctcaatacattgtcataaaaccaagaaacaaccttctctgtgtgaagccatggaaatgttggtttatttgttacagtagctaccattacctaacaaagaaacagtggcactgagaacgtggctgagatgagaagatgcttctcggtggaacctcccttctagggtcccgagtagtgatgagcagcagtctgagacagaaagaaggcagagcctgtggtcacaagggtggcacaggggagccaaagggactcgggggaagagaaagggaccaagtgccggagaccacgatggcagtgcaggaaaggaggcgggcaggaaggcggatgcaggctgcaccagagaaacagctacagctgcacgcagcagctccgcaagccgtgtttttgtgagctaacaaagaaatattaaaaggaacaatggaagcaggaattggaaataaagaatgctgttttcaaacaggcaggatgtgggatcgcatcccaattccaccatcgagagctcctagggcagaacctctctgggctgggcttgttcagctatgacacagagagaaccatctcttctccacgcccacagtgactggggcccatggtgggtattctgaaagtggcagcggctacactcaccacttcaacccaagaagtggcctgatgagagaaagatcgatgggcaagaaagaatgcttgggtttcattcttggttttggcacaggatcttttagaacttaagcacaaagcgggaaatacttacagagcagttctaagaattaactgggataattaaaattaaacctaccacatacccatggaaaattccattgctcccagcattataattgttagtagccctgtcctttccccaagcataacttgaatcaatgtcaactttattactatagaaaggaccactttctctctcttccagtttcctgctttgccccaaaaagtggaaccacagacgctttggaaaggacagggaagagcttcgtgcagccatcccctctgccacagaggaaggggtgagcatgcctccgtgagcgtcatgcacatctccaccacccacgaccaggactcagggaggaaggggcagcagctcctgccacctgactgggtatagtctggatggcaggcagggaagagcacaagatgtgtccttgaaaatacggtgagcaaagctggaaggccgtgttgaggctacaaggccagacagctctaattcagcacatggacaacaaacaaagctgatgtttccacctcctgggcctctggtgccatcatcttttctaaaccagtctatcttggaccaaaagagagggatgctggttaccccaaatgttgtaacaggaggacagctatctttcttggctattctgcttatcctagatggaatgtgaaatagcaaaccactgtgggatgaataccctcctctcccaacaagaggaaaagcaggaaacaaaagtcaagggtgccattctgactagttcctgaaccaggtattatttaagaagtacccacgctgaaatggacaaatttaaaggtcttcattttcggtttatgggtggaattcatagccttgtttaagcagtacgtgaatacatattaccaattttacatgctaaacacaccttacttattaaaaacacgagatgaattatttcaactcttatcttgaaaccaatcaaatacagtaatttgccacctagtgtctttcaaataaatgcagtcaaaggaaacaagaagacagaaacacactttatatatacacacacacacaacttacttgcaaatgttgggcagattaaataaggtcaaagataccagcaggaaacccacgtgccctctccaagccctccactcccaccagtaaagcgcttctcaacagacctgcactgtctcatacaggagccactatccacacagagctgtttaatttaagttaattaaaattaaataaaattataaattaagctatccaatcagaccagccaatttcaggtacagaacaccacatgtggctaaaggcaactaaattagacagtgcagacatctgtctctgctggaagtcctattggacaacacttcaacagtaacaatattttgcctcaatgtgagatggaaggagaggaaatcagcgcaataagacagtgaccacatttgagctgcacgagatcgctcggacatgtagaaggacacagaacacaccacccttatcccacaaaggcaaactagtccttagaaatgaggctgtctcctcctggcatcaaatccaaaccaactggtggcaaatattaaaatgaccaacatactaaaattgacctatcattcattaacaagccatatttctcaactttaaacttattacagtggtcagtgaagcataatccgaagatctttaaaaagaacaagaaaattatttcaataatagcaagtaaggctcaaaaactagagtccactatgaaattaaattttggccatggcctgtgcggagggtgacagcagctgaatgcagaggccatgaaaggcccctttctccaggattctgtggcgccgtgcggccgggccctaccggcatcctgccgcctgcctgtactctcagctgctctcttgggtgccggaactcttctctgcaaaaagctactacttctctccctcagaaatcctgcctctgcctgcccacccatttcgtctgtcactgcctactgttcttcttcataggaaatatcaagacttgtgatactgacgcactgactggaagtccgtgcaggcaagagccaggatgctcaactgaacttggcacaaccagagcctgctagctggaggcgggccacgccaagagtatcctcaaatggaccaaggctgaaaatgctatctttactctaagatatgtatgcaaaatgtgtacaaaaatccagtaagagaaaggagctttgatacaaaagcaccctgctcccatccctttttaaggcaactacttgttatcatttctgttttagttctggtagttacctccaaaattctaactgctgtgctgctatcccttgcagcagacctcagttactgcatgtgctcctctcccttactcccggagaccagccccacctcctcatcatggaatgctgtccagtctcccatttggcccatgtggaccagagcattcaggggtttatgtcacccatattactcatgcaaggccaatcacataggcctacttgaggggctgagaacacgcctgctagaggtcatcttcggtcatgtgaaaacagcccaccagagaacaaaactaacaaggaagcagagatgagactgggcgtggtgggtgacacctataacctcagcattttgggagcagaggcaggaggatcgcctgaagctaagagttaaagacccgcctgggcaacacagcagacttccatttctacaaaaaaattttaaaacctatccaggcatgttggtacatgcctatgtctcagctacttagaaggctgaggcaggaagaactctagagcccaggagttcgaggctgagtgagcctcgcactgcacttcatgccactgcacttcagcctaggcgacaaagtgagacctatctttaaaataaaatttaaaaattatataaatgaaaagaagaaagcagagctgagtgcataaatatacaatgcagaccacagaattacaacactagatgcagtcctaccaactaccttgcctgcactttccaggagcttaaaccaacacattctttctcttactctagtttaactggggttttatccctgcaactgaaagactgttgaatacaatcaccacatcataatttgcatgatttatagacttcagacaactttagacatcacccattaactctaccgtaataaagtgagatttagctcatttatactacctcctaacaatctgaattacatgtttagttctattggagacctctgaagcctctatattttggtctgtcaacttcagatgatgtaaccatataacccaacaatgctaggtgaagattttagttccccttccactccccacctctatctctacctctacttgccaaattaacttggttagttttccttttatattcatcagaaccgaagacatttcattctgttctgaaaccataattaagtcagtaagtcttcagtgtttcagtcatacatgatttcaaaaatgaaagctcgggccgggtgcggtggctcacacctgtaatcccagcacttgggaggccgaggcgggtggatcacctgaggtcaggagttcgagaccagcctcaacatgagaaaccctgtctctactaaaaatacaaaaaattagccaggcgtggtggtgcatgcccgaatcccagctactcgggaggctgaggcaggagaattgcttgaacctgggaggcagaggtgcggtgagccgagatggcaccattgcactccaggatgggcaacaagagtgaaactctgttcaaaaaaaaaaagaaagaaagaaagaaagaaagaaagctcaagcagtatttacattatactatctgaatctagttcccaagagagccaaggatcctagaaggatggcatctctttcttaggtctttgatcgtgactcctaagccgcttaaaggagaacctttttaatatcaagggctccaacagatcaactgctgaacaatcaagccacattttggtttgcctcatatttggacctgacttaatgctgtttgctgttactagaaattagaattgcctttctattttcttgagagagaaagacgtgcctatcccctagaactaggcttctagctatttagtcatttatttaaagaaagcattctcattacaaacgatcgttcttcttggaaaacacactgtcctaatttggacggctgctttccatgcttgctgcacagctggcatcttatgactttcttgggttcactgtcttgtcattttctttctctagagacatggtctcgatctcgcccaggctggagtgcagtggatgatcatggctcactacagcttgacctcctgggctcaggctcatgccactactcctggtatttttttttatttttttatttttgtggagatggggtctcttgctatgttgtccaggcggtctcaagctcaagcgatcaccccgcctcagcctcccaaagtgctgggatttcaggtggagctaccatgcccaaccttcaccgtccttgatcatttgtaaaagtaacaaaaacatctggcctccaaatttaacacaggaggaggaagctctcaggtttacttttttttttttttggtttttttttaataagaggcagggtatcattctgtagcccaggctggagtgcaataatagtccctgcagcctcgaactcctgagctcaagagatcctcccacctcagcctcccaagtagtgggactacaggcatgtgcccaccatatctagctagtttttgattttctttgtagagatggggtctcgatatgttgctcaggctggtcccaagctcctggcttcaagtgatccttttacttgacctcccaaagtgttgggattacaggcataagccactgtgattggcccatcttaacatttttggctcttgtcttgttttgttttgtttttttgaggcagggtcttactctatagcgaggctggagtgcagtggcatgaacacatctcactagagacttaacctcctgggctcagcgatcctccagcctcagtctcctgagtagctgggaccacatgcacaccactatccccgctagtttgtttgtacagatggggtcctaccatgttgctgaggctggtctcaaactccttgctcaagcaatcctcctgccttggcctctcaaagtgcttggatttcaggcatgagccatacacctggtcctcttaactatttttaactgtacagttcagtagcattaagtacattcatatgttatacaaccatcaccaccattcatttctagaataactctcttcatcttgtaaaaaaactcccctcccctgcagcccctggcaaccaccattctactttctatatctatgaattactactccaggtccctcatgtaagtggaatcacatagtatttgtccttttgtgactggctatttcatttagcataatgtccttaagggtcacccatgttgtagcatgtgtcagaatgtctttttttaaggctgaataatattccactgtaaatatacaccagattttgcttatccattatccatcgagggacacttcagttggttccacattttagctatcgtgaataatgctgctagaatgctggcatgcaaatatcttttcaccaccctgctttccattcttttgggtatataccaagagtggaactgctgggtcacatggtatcaggtgtactcttacagcaacaaatatttcaactggcacactgggcaaggcagagtttctaccgggcagcacagctcctacactctgaagtgtatagtgcagaatggggaacgagacactccaggaagactaatgtgattcacctacagacttgaagatgtggatcagacacattagcagtgtgcctagttcctggcaatagaaagatgttgctgctcactcatttccaccttcagctgttttgtaacaatgtcttctaaaagaaaccaaccagttgtaatagaaaccttccaagaaacaaaaaagatgacagtgaattaggtgctactataaagcacttacgccaagtatacatgaaaagatatatggtaaatataaagtaaaatataggtagagtacattaaccgctaaagtgaaatgcagagcgccgtcgccgtggacaagtcacttggtctctctgtgtatcaccttcctcactgaggatgaaatggcaggtagcattttttaagctttgtgaactgtacaccattacacaaatacaagctgatcatctgtcacagaatttaatgtatcatcaattttagccagctgcttcaatgcgacacagggaaagccatggctgcctgctgaacctgcaaaccaaaaggtgcccagcaggcttactgggcttatctccttgacaacacagggcatctccactgatgacaaaccaagtgaaggctgcatgaagtcacagcacttagcagaagcagcacatttgcagaagcagctctaactcagtgaatgctcagaatctgcaaaggtggagagggacccatctaggcagcaagcacttacgagtgcctcatcactgtcttggggagcttccaaacaatttatgagggaagacaggatttgatactacacgtatttatggaggcaggctgccctgcagggagaagacttttattactgacagcgtgtaaaactgccacacatggtgacaatctgagactcacttttactggcttctcttgggtttcaacttccctgcgtcagcgtgcccctactgcctgcccccaggacagccaccccactgccctgccctgcctaggcgagccactgctgtagcatctctactgaggacaagagacagaacatgacagaacttaagacaggtatgaaccaagagccatagataatgcaggacggattagaaaattacactgaacagacttctttacccaactcagaagtgaagcaagaccaggtattattccagacttactactgtgaaacatcacgtgacttcccaaaaggcatgggttagttataggctcagatagaagcataccttgaaaatgtttcttctggcaaattctttatttgtttcccttcactgtgttctctagcgttgaagtactgtccccatctcttaacctattaattactgtacaggagattaatacggagagaaggagagctcctgaatacgagaaagaacaatatcttcagttgactgggaatcagaaccctcaaaatggccagaattcccgatatccacagttgaacagtgctcacggagcctaaaataaacataatacataagtcacagctgaagaaaaaaggaagattaaatttccccaattgccaattttgtgaaagaaaataactcctattttactatcctaccaataaaccttctatcactgagtcccaaagtgtgctcccagaaaagcaggcattagtttcacctgggaattgctaaaaatgcaaactcttggcttggtgcgagagccacctgtaatcccaacactttggaggccgaggcgggcggatcacaaggtcaggagatcgcgaccatcctggctaacacagtaaaccccgtctctactaaaaatacaaaaaattagccgggcacagtggcacgcacctgtatcccagctactcgggaggctgaggcaggaaaattgcttgaacccgggaggcggaggttgagtgagtcgaggtagcgccactgtactccagcctgggtgacagagcaaggctccatctcaaaaaaaataaaaaggccgggtgcggtggctcacgcctgtaatcccagcactttgggagctgagatgggcgggtcacgaggtcaggagatcaagaccatcctggctaacacggtgaaacccatctctactaaaaatacaaaaaaattagccgggcgtggtggtgggcgcttgtagtccagcaactcgggaggctgaggcaggagaatggtgtgaagctggaaggcagagcttgcaggagccgagatcatgacactgtactccagcctgggcgacagagtgagactctgttccgcacacccccacaccaaaaaaaaaaaaaaaaaaaaaagcaaactctcaagaagccctacccaactgactgactcagacattctgggggtggtcccagtaatcagagcctgaacaagccgtcagattcatctgctgagccaggcgagagactcaccattgtgtttggagtgacgaacatacccgtaaaagcatgtctaccggacggagggaggaaggggccaaaatctcaaataatgtattaacactccaagggcttcatgagagtcaatgtgcatctgtggaattagacaccacaaactttctacgtaagccaaaagaaacgacagcttcctgtacaccagctatgtaactcaagggaaatcatcataatcatctcatcgtcaccttccctcatttaaaagcattttaagttcagtgtgaaccaagcaaacatttttacaacaacactgtatagctacatttttcccataacagaatcttgtcatttagatttttattacataaataataaatgctttctgtaaaagactcaaaatacaaaagtgtgaaaaaaaatcaactagcactgcagcaccctgacacaatcattaccacattttggggaccagtcttccaagcgtccctttgtatacacatacatgggatggtgtgccttttttttttctttttctgcactccatccctcccacaacagttgtaacaaatgctaagggtgtgtgtatatccctttcttaatctgccccatgttcctatagccatatccttgcccctcacccacagaggttttgttttagttgttttgaaaaatcataaacgtctctgctcttctacttaacccagtgcaatggagaactcccaaggcaactggctgaacttcctttcttccttctccctccccttcctcccttccatttcttccatttatttccttccttccttcctccctcctctctcttctttctctctctctctttctaacagagtctcactctgtgccccaggagtgagtggcgcacgaatgggctcaagtgatcctcccacctcagcctcctgagttagccaggatacaggcgcacaccaccacacccagctactttttgtatttctagtagagacagggtttcccatgttgcccaggctggtctcaaactcctgagctcaagcaatctgcctgccttggcctccaaagtgctgggattacaggcatgagccaccacacctggccagaacatttttaatcatcaaaatagcccaagctaaaatagtctaagcttataccacagtgtgttcaaccattacttttgatggtgggcactgactgtttccaatttttgtttctactgagtgtgtatacatagtaacaactctgcaaacagatgtggtgtttttcaaggcacagatgtgaagctcacaacactgccacatcttacaacaagggaacaactgacttgagctccaggattcctgcatcctggacctcgcctgtgctcaccaactctgcctcctccccagcaactctgggagaacccacagtgcttgtcatccatgcagccaatcctaacccatgtctgtgaacaccacaacggcgatttgtgttcctgtgtcatgaactgatcctccctgttgcttctgccctcagtgcgtaaacaggccttatttctgccaacttaacccattgccgactcctctcctcctctggctactgccctatttcccgttccctcttcaagtaaaaccttttcccaagtctctctcctgtcctttcaggaacacttcccattagggtttggctccctttgctcctccaaaagcactcatcagtgccctcggtgtgccaaacctgggccaagttcccaaggtgctgacagcagatgtcgccctcctgcacaaatgccttaaaaaaaatcttggctttaggaaccccacacctgcctactccccctgccccagactggctcccctcacctacctgaccttggagctgggactcagcaggctcggtattcaagtcctcctcctctccagccagtctgggtccactgtgagtggacatctcagatgctgacccctgccccacagtctctcgacaactccaggctcatacacctgatgctggcctcacctcataggcacctatggggtctcaactgctacatccagacaggctctgacctcctgctgcccccatgtctgccctaccttgtccacagccaccctgtcctcaccctgaaatcacccccaaagcctgctctctctcacatgccacatctaagccaccagcaaaccttgctggttttgctttcagctgccaagggatgctgacttgggccattccactccagtgccgggtctcacatgggtggcctgctctgccctcacctccccctcaaggctattctcaactcaggaataagaatgatccgctaaaacctacaccacatcagcgcaaaccctctcaaggctcctccacactggcctcacccaccaggcctcactcccttccctccccatggctgccccactcctccaccctcattgctgtaccctaacagcatgtccgccccccgccagggcctttgcactgctatttgctctgcctgaatgttccttccccaggtatctcctaggcttgtatctttcctttctgcaaattcactcaatgtcaccagatcaccaaagcttcttctcatcaccagctgaacaatgccactcccacccagacaccacctaactctcttccctcctggattcttctgtacggtgttcctgatcagccccatggtatagacttcactcacttgcttttctattgtctgtccccttacccgcatcccacaaaatcttcactccaagaaggcagggggtctttctttaatctgctttgatcactgatgatgcactgccagtaacaggatagtatctagcactacttctgaatgcaacatgcacctgtgtgagctacctggcaggtgctgcactaagcgtttcataaatgttgtatcacacaatttcattgcggcagatattaagtcaggtatttactatgtattcaggccttcgatctccactctctcagattacgcacagaaaagaatgggataaagcttccagggcaccattctaaaaccattgtaggcagggagaccctgaccacactaaaactgctgtcaatctcaccagaagccaagaccctgtcctgttgtctaactggtctcaagataacattccattatgaaatcagaatggggtgcagtcatgaaggcagtaacatcaatatcacatgcctctaagtttaaatcaaatgccaaaaccacggactactcgtactatacagagtagttgtttattgtgtataatcaagatgaaaaacatgtatttgctgagtccacttaaaaggcaacctcaagctgtgccaggcagctcatagattttctggcagagctgcctcaaggaggtccccaccacccttctctgtgagctacagggtgctgctacactgggggcacagtggcctgtgcctgactgggggcaggctgcttctgaactggcactgccaggccatttccttccactgcagttgtggaaacaatgattcatgtcattgatcatagaaattctgattagtgatgaataggccaggcgaggtggctcacacctgtaagccagcactttggcaggccaaggttggtggatcacttgcgcccaggagtttaaaaccagctgggcaacacagcgagacctcatctctactaaaaatacaaaaaactagccaggcgtagggtgcacacctgtggtccttgctactcaggaggctgaggtgggagaattggttgaacctggaggcagaggttgttgcagtgagattacacgactgcactctagcctgggtgacagagtagaccctgtcggaaaggaaaggaagggaaaggaaaggaaaactgctaaattacaagcagaaggtaacaaaaacaaaaatctaaccaccaaataaaacactgggttgaccagaatgcagaggcagtgtaggaggtaagggttcgggctttagagttagccttggcccgccctcaccccgcactctaaagctgtgtgctgcctgatcacctccataacctctcggagctgtgggatccccctgtaaagtaggtgggcaataccaacctgagatggcattgtgagaagaaatgaagtcgctgtcccatgactagcacggagaactgctatcaaggcacagattaggactgaaggaaggctgattccagccacccacctttcacaaggaccttaagctaccatcactatgcaacaacagccaaggctgcggggacaaacctgctgtttggctaacattgggaggatgatgtcagcttctgtcgagacagtcgcttccacttgtcttcattctccttgtggcactgctgcaggacagaatgaacatctccaacacctataagagcgtgcacaattagaaagtctgctgccaagagcgcctttccacccctacgtgtccgtctgttatacttgtcccagttcagctggaagactcaggatccaaacagatgtgatcccagcgaggacagggggacactaatgcaacccccactcatgacatgagaaatgtaggggaatcagaacgaaacacaagttcctctagggcacatacaggtgcacactttgctcaggaggatttgccatcattgttatttgtatagaatttgtaatattcacaatcagagaaaaggcacaacatgaaaatcaaatgtatattaatctttggcaaactcaaacacagccttgactaaactattctgcaggtggctcattgcctttgtggacattcattcaattctgtgttctctgcagaggcaatctactgaagagcacctgcttcccagaggtaacatggttgagcacaagtttattagtgatcatttctaaacagacatatccagagctcacgaacatgtggctgatgaactcctctccatgacacccacccacccaagcagctctgcctgcaccacctgcttgccagttgctcattttcagacctctttatgatacatgtacttttgcatgcaattatgtgatttaattaggcattaagtatttaattaaatactacaggggttcattaaatatgaatgaacaaagaaagtgctgcttcttatgagaaaagctatggctttatgaagttcaaagacaaacagctaaaaagaattgacaaaataagtgagggctagacaacagtgcagttaaaagaaaggagaagtcatttaaaaagagagatttctgcactcagccttcctcaaatgtctttgaattcttatgccactttaagaaaacaaaaccagaaatcagctcaaagaaaagaccttagccctatgtcaaaatagtggtaaataaatatacaaataaagtttttatttcaagttgagatttctatcattttaaggtttctaccatcttgaccaacactgtcaattgattttggtcctcgttttggaaaagagggcctcactatcttgaacgatctcgtgactctcagacaggagtcaggtgaactcctgtggctgtgcccactttaaagataaacaccaggctgggctggtggctcacgcctgtaatcctagcactttgggaggccaaggcaggaggatcacttgagtcaggagttcgaaacagcttggccatcatggtgaaaccccatctctactaaaaatacaaaaaaaaaatttgctgggcatggtggtgcatgcctgtaatcccagctactcgggaggtgaggcaggagaattgcttaaacccgggaggtggagcttgcaatgagccaagatcgtgccacacactccagcctgggcgacggagagagactccatctcaaaaaaaaaaaaaggatacacccaacaacacctcctgccactgcacctccccaactccaccacacccccccaccccccgctccctccccatccccctgcaccggcatctacccaggccccagaaagcccaaacctggttaaagtaacacagttaacagtgagcgttaccacatggcacttccttccatctgcacgggtaataaagtatccacgacagttccaacatacattcctcttacctgatggtactggatgagctcagtaacattgacaccaccacctctttttgggtttcaagctcttttcctgcatcagcttatttgttcctcttaatacaaagaggtcgtggactatgggctgcagagccggtatggcgtggggacaaaagggtacccttatcaggcatttcatggaaattacatttggaaaactgcctcaacatctacaaaatgctttcaagaaataaagaaaacccttacacatacttggtttaggtaagagatgaattaaggttatcaatcattataccatgtggaaggtcaaagctcttccctgaacactgatcattttgtgatgacttctaaaaaaagaaaaaaaacctagggctcctaaatttaacaccacttctgaaaaaaggtgactcaaattcaaaagtcaatttgaaaatgataaactttccaaataaccaaaacagcaacattcctggtctcaagaataatctacttgattatctgaaaagacaataaagacttccacataatacatttagtcaaagccactggattatttgcttttttaagtaaactcactctgtcattagatagataagggactttcccccaagtctattttggtctaacacaggagtcaaaataaattaactggtctactatgaccacatataaaaaatataagaaatgcctttcattggcacacaggcacactctgaccctcaatgtcatgagacataggaacactgacccctcagtgacacatacgctcacacatgagcacacacacagagcacactctgaccccctcagtgacacatacgctcacacatgagcacacacacagaggcacctctgaccccctcagtgacacatacgctcacaaatgagcacacacagaggcacactctgcccctcagtgacacgtatgcacacacatgagcacacacacagaggcacactctgacccccagtgacatgtacgcacacacaagcacacacacaggcacactctgacccctcagtgacaacacacacgtacacacacacacacgcgaggcaccctctgacccctcagtgaagggcacatgcaaccctctttgacacacacacaaacactctgacctctcagtgacacatactctctcggccctgagacatgcacacacaggaatactcactgacccttcggtggcatgcacgcatggtatactctctgaccctctcacagatgaccaagcttcccagcacaaagtactgggtgtgttgcctactgattttctgtccaaagaccctccaagtccaggaaaccaaacacctatgccttaataatctatactttggctgtgtgaatctgaagcccttgtgaggccgtggcaaacacaactggcttagctatgtaaacactgagaggtcagccaaggccctgcctcgcaacacagccggttgatgctcttctgcacacacgctgagtcgaaaagactctaagtagtagtgccatttcacatctgggagtttgcaagggtcttaggatgtgtccctgtcaaagttcaaaagcctaagattccagcaaaggagtcagggaggggtcaatagggcaatgctggaagatcagttcaaaagctcaaagaaagatttgcaactcattcataaaaccacactagctccttccacaggctggggcttgcacagctggccatctcctgggttccttatttaagctccagcaaaatcatcagcaaaacagaaagccctgaacccaagtcaaactatatctccaataccactggatgagagtcaaaatttaattcacggcaagttcgatttaagaatttttagtgttgcatcgcttcttgccttttggctaagatcaagtgaagaacttttagcgtttcatgtgaatgaacaggaacttatattcagaatctatctgtaccttaggttatcttactgtttcttgaatttttttccctggaagattacaaattgctgagagtaaagaatatgctctcttctcttttgaaacgtctctaccagtaccttcacatacacagacacacatgcagagcctgagaagcacatggctgccactacaacgttcaaagtgggtatatgaaaacgaacactgccaagcacatcacgacaccgaagcgacagtgaaaggtgtgtcccgttaccatgtgtcacagccttccttccactggccatgagccatcacagagctgaatgattttaggaattccaatgatctgttttgaatgatagcgttataagatagtaataccaagaagaaaaagatgtttggaatgattgcctctgattccctaaaacaaaaacatccatttagacctttcttttaaaattaagatacatatcaatataagcaaataaaataattcatgattcaaccttgacagcaagcacacatcaagctaacaggtgtccggatctactctaaccccacccctgccacagtgcatcccatctgtgccctcgcgcagagcaggacatgtgtaaaggttcggaggcagcaggtagaaggcacccgacggcacaggggcacacagctacgatcttcctagctctcctctgcctctttgctcttgaagaaattgaaactcaaagagaaacagtaacttgccccaaaacacagtggaggtgtcatgtaattagaataaacacatgtttccagaccccagggaatctgggaacactttccttctgcactaaattttcctaatacaatgtttattaagcattttaggtactaaaagaattttaacttttaataattataaactgtaatggactagcaagaagtattaaaacctcaacatctagcaagaaaaagctgcagagatacaaatgcataataattactaaagacaaccttatataaaactgctttctctaagaagtttaaaaactagtgctccaccacaagatttcattccaccatctgtcaacacaattaaatctttgaaatgtgcaatgaatactgacaacatatggaattttcagatacataactacttcaaacaagtcttgagatatacattaatttttaagagaagcaaaaatgcacagtatgttagcagatttccatttaaagaaaacagcaaaaatgcctaacagtagtttaaacattcacttataacctaaattacatgtaagtacacaagaagaagaaaaaaatctaaaataataaaatgcattacctgaactggcccacttcaatgtattcaaactgtttcaatacaaagccaataaaccctacaggaaggaaaataaaatttcacatcaataataggattaaaatgtaaaaaccaggttcttttcctcctgcttatctgcataaattttaaataaaattcttgacagctgataaattgactataagcataactctattctgaaatcagcctagataattgcagaacacatccaggatcccctcaacaactttactataccctgaggtgaaatctcattggaaaaacaaataataattccaagagacatcagacaatacccaaaattacaccttggggactcatctgttcacgtaatggcagatagggtggcacagattccctgaaactggtttagtaataagatacccaaagagtcgaccttcgtcccccaaccatctgagaggcgacacgtaagggctgcatgggagccattttgtgtcacactgtattccctgcagctgtcagctttcccaacctgacggggagcttcatggataaagcatggagcatatggcctggttttctcagagcctctgggcagaatgcaaaatacagcaggagctcaataaatctttatcagcatagagttcaatggtttgtctgttctatgttctattcttgttcataaaactgtcactgtactgaatcttaagaactgggagaaagggaccggttgatgaaaggcaatcagaacaaacatgaaaccagagcagtctttgttcttacagaatggaacaaatcagggctctggcttcccttggggtacccgtgcccccctgagagccgctcctctcagcccctgctgcccacagccatagaccagggcttctccccagtcagcctctagtgtcaaaggaaaggaaaagaagttcccaatgactatttcctgaggagagcaatggccatttagacggattttcttcggacaggttttgtgaaagaaagatgaaagcatcaggccacgcaaagcccaccccttgatgcctccttcattaaaagcagaccccaggccgggcgcggtgctcacgcctgtcatcccagcactttgggaggccgaggcgggcagatcacgaggtcagggatggagaccatcctggctaacacagtgaaacctcgtctctactaaaaatacaaaaaatagcctggcgtagtggtgggtgcctgtagtcccagctactcgggaggctgaggcaggagatggcgtgaacctctgaggcggagctggcagtgagccgagatcgcacccctgcactccagctgggtgacagagcgagactccatctcaaaaaaaaaacaaaaaaaaacaaacaacaacacaaaaaaaacaagcagataccaccccaatacccactgtggaaaatcagtgttgaccgaggccctcagttctcctagggaaacagaccctttcaggtgagtaacagtgctgacaggattacagatttacgtctagaaggaaatagagaagtgtaatatttctaactcacaaatattccaccccacataagaaagtagcccaagatcacggctcaaaaatgacagttaaattttgacgtgaaaaggcagtttcatctgcagtgatttaactgggacgaatcttgaggaaaatgtgcacatgaagggacaggactagccagaatctggtgcccacagcaactataggaggaaggtaagcagtcaagaggggaagcgtgcaaatgcttgtgcagagccacacagctcccacatggacccaggagcacgggtctcagttactgtcctgctaaattccattcctttttaaagaggtaatgaacctgttagatagcttgaaactgcagatgatcaattatggtaataattgataatcttttaaactaactctagattttgcaaaaatgttccccaaacaataaatcttaattgtatccacaatttaaattcaaacttattttggaggggaggcaagtggatgggacaaacctttggaatccctaacagccaaccccaggttagccttgagtccagggagctggggcaaggatgctacttgctgaggctggctatgccccaggccttctgcaccagctaggtgcatgaaaaagatagcagcagcaactgatgagggaaacatgcagaccacatttctttaaagtagatttcagttcttttagggtaatttgtactaaattaggaacaggtatgatggatgaaagataaaagtgcaaacctgatctgaatccagaagacagtaattaacccgtaactgaaccagctgcgccagaaatctaaaacctgcttctgtaactgcacacatgttgtagtcgtgtactgttttaaagctttataacaagaggttcaaacaaacgaatgtgattatgaatagcattctataaaaaagaaaaaagaaagaaagaatccataagtaagccttcaactaaaagcttcaagcaaaatacctgaaagtctcagctccagtttcctctctagcactgacacgcctgagttcacatgccacaacggcaccatttaccttatctgcacggttctttgtgacactcgtgaggtttgtcttcaacgggtagacactttctggaggacatcaaaccatctgccaaatgggaataaaagggaagcaagaatgagaatatctttaaataatctcctctgcactcagatatactcctgctcaaaccatttcacattcacacgatcagaacgtgtcagattgagaaacaacttgaaaggccactcaggtggcagcatcgccctcttcagataatgacactctatttagagtttacagctgcctgacgccatcaagtctcctcactcgcagaaggctactcaagtctgagcttttttctgctacagaaactgactactcagcccagtcttaagtgagatttgagagaaaggtgaaggtcatttaaagatcagtaatttagaagaaattacatgatttttttggaggacaagcctttaaaatattacatcaatgatatcccttctaagaaacatatatgaaattaacccaaacatgcacacactacatgcttattaataccccaaatggttacagaaagcattgaaacagacttactcctgaactccaatatatagtaagtacatcactaacatacagcctggaacatgggtattttccttgctcctgactctagtgttttaattgtagctatttaatcgctaaatttataaaaggaaaaaaagggattctattattgctactatacagattagcaactcaaatacctgttcatacttaagcaatttaagaagtcctgtatactaggcattaaaaacacaaacataaatttaagtgaaagaggccgggcgcggtggctcacgcctgtaatcccagcactttgggaggccgggacgggcgatcacgaggtcaggagatcgagaccatcctggctaacatggtgaaaccccgtctctacaaaaatacaaaaaaaagttagccaggcgtgatggcaggcgcctgtagtcccagctactcggaggctgaggcaggagaatggcatgaacccaggatgcagagcttgcagtgagctgagatgcaccactgcactccagcctgggcgacagagcaagactccgtctcaaaaaaaaaaaaacaaatttaagtgaaaagagacttctagtcataaagctgacaaaacacaaggtaatatatcaagatgcttctatggccttcacacacctctgaacaccagcactactgtgctgctatgagctgttctttcatccttgttacaggcctgaaaagtgccaccaacacatgccacaccacttacaggtcctgtgctttgaatgggtggggacattatgaactgcattctggtttgctgaccactttggcaatgagagctggctgcttctcagcccactcagtgttcctcctcctctaccccacctctgagatgtgtaagtcccaagcccatctcactcactggccacacacttcttggaggccgggctatgccttaaatcatctttgcatcaaccatatatatctcctagagttctcgaatacagcagactattagaagatgttcgctaacatttttcgtttttattcttttacaagtatttcctgcttgctctttcgtgcttccaccaacgacagcattcttgccacaactgttccccgaggtgtcgttctcctgctccgcctgcaccatgttcctcaggctggcgtcagcgaggcctgggtgaagtgggtgtacggggccatgaagcagtagtggtacaagcctggcctcaactggaggagccaaggcgctgtgctcggccttgtgacttgctggggttggaagataagcatcaaactgggaggccaagtttgtgccaaagagagtcttcaacaactacagtgaaaaaatgaggcatcaacaatgtggcgtgaacaacacttttaagaatctcccacacaaatatcaatccatctgtaaataactggatatgttagcaaagactcacagcgtgaaattcttcctgtgatcactattaatacctcatgagatattgtatgaagtgctgtttgtaccttaaataggcgtttgggtttccttgcaattctaaatgagattgagcattctaaacagaaactccgagggatggaagttaactagcgaggttgcagaggagcttctggtgtcctctgccctccacagtgaagacctcgtcctcctggggagtgaagggaaggatggcctcttggctcaatcatggactggccaaaaagtgctgcgctggaccccacaatcctcccagctgattatgccaacagcgcctcctcttaaggagtagcagcgttttgctgtcatacccgaacgtcttaacagaagaggaaagaatgaagctcttacttgttgaacacaaacagttgccatcattggttctcgactaaagcggatttcaggtatcctaggatctcttcaacacactgtagaaagacaagtgagacattaacgactcagagatgacccgttattgtacgaatcctagacagaaattgaaggtacaagatacttccatttaaattgtgtaaatagtagaggaaaatcagaggaaagttttcaatttcttatttgaacagtcagtaaaaagtcttgaaatccaagttatatacattacaaccattctttctgcatttatgtatctgttcattcactcattaattcaataaactgttatcaagtacctgtgtctattaggtatccagtcctgttcgcagggcaggaattcagaagtgtgcaaagcagctagagccctgcatctgtagagcccctgaatatgttcagtgaacacaactatgatacagcatgtgtgatttaccacaaatcagtcctagaattgtcttaaaataatctgcaaaaatgaccaataactaccttaatgttactcttctcacaagcatttttatcaacatctataacgagattacagcacccaatgtccttttcaagaatcaagaaggggctgggagtggtggctcacgccgtaatcccagcattttgggagatcgaggcaggtgcatcacttgaggtcaggagttcaagccagcctgaccaatatagtgaaaccccatctctaccaaaaatacaaaattagccaggcgggtggcgcacacctgtaatcccagctacttgagaggctgaggcaggagaatcgcttgaacagggaggcagaggttacagtgagccgagatggcgccattgcactggagttgttacctggcaacaagagcgaaagtccatctcaaaaaaaaaaaaaaaagaatcaagaaagaagaagagctaactcaaagagcgccaccattctgaatgcctagatacctaggcattcagaatgcacgcctgtttcaccactgcctggctaatcacgaactggtttccatcagctgctaaaagccacaccaattagactgaaaatgcctctctctccacttgtttaacaaaatatcctctactaaaagcaatagattcttgttggtttcaaatactcaagggccacacatttttaaaattctgaatgctcaaagtatattctaagtgtttaaggttgttcttgtcagaattgaatttgtcacaaccactttttgtttttactagctcccagcagatacccaatacatgttaactgaaaaaatacaaatagaacctgtgaatcactacttgtctaacaaaggactttaacaaatgtgtatggatgcttgatgtgcaccagaaactgaagccctggaaaaggtgagaaagcatgctgtttctgcctttcaagagctccccaagtaccagggaaccagggctctgctacaaatactaatatcaatgtaatagagtgagacttccactactgagcacaatgagggtgagggactgggtttacctcctgcctgagacaaccaaagcaaaccaaaaaacaaaacagacaaaacccagagtcctaagacactggacatgagcaatgaaggacagtgatccctgggagacgagagactaagtcaccctatggctgccccaactcgctgctttgagagagttcctaggctgtggcacaaggagggggacaggcaaccctctgaattgaagaggtgctgagaatctaaggagaccaagacagcccagttcataagacagagcaccagagaagagaaaacaagacagagagagctctggagatcggggaaggtccctctcgagtactcagcagagatatgtgtgtgagaaaactccctgaggcagggaaagaagcattggaaaggattagaaggagcagagctcagcgctcacacagggctaaaagtcactgttctcagcaggcggactggaaaacccaaactttctggttcattaggtaggtactcaggatggtcttgcctcctaagcatggtacctaattattcctaaagaggaataatagtccaaaaaaaaaattagtcctaaactaagcactgctccaacccatctgacaaattaaaagcaagacccaaaagagtaaaccatctatatgtaactcaactaacctcagaacaaagtcaagaagatctatgggaacacaaaaatatatagcatccaacaaagtaaaattcacaagttgggcatccaataaaaaattggcagccatacaaagaggcaggaaaatacaacccaaaagaggagtatcaatcaaccaatgagaaacaccaagaactgggaagttattagaagatcttgaactagcagagaaggatattaaaacagttattacaattgtgttcacaaagctaaacagaacacagggagacatttttaaaagacctaaatcaaacttctagagataaaaacaaaattgtgatatacactgaacaggggccagacacggtggctcatgcctataatcccaacactttggagaccgaggcggatgaatcacctgaggtcaggagttcaaggccagtttggccaacatgtgaaaccccatctctaataaaaatacacaaattagccaggtgtggtggcacgtgcctaagtcccagctactcgggaggctgaggcagaagaattgcttgagcctgggaggtggaggtgcagtgagctgatatcgcaccactaaactccagcctgggcaacagagtgagactgtttcaaaacaaaaaaaaaaatacgctggacaggattaacaacagattaacagattaacaacaggtagacactgtagaagaaaagatcagagaacttgaaaacacaataatagaaactatacaaacagaaaacacataaaacaatcaaacactgaaaagagcatcagtaagctatgggacaaactaagcaatcattcaggaaatcacagcccctttaagagagggaaaaaaggagggaggcgggcagaaaaaaaatctttgaagaaataatggcctagctgggtgcagtggctcacgccttaatcccagcactttgggaggcccaggcgggcagatcacgaggtcaggagattgagacctcctggctaacacagtgaaacctcgtctctactaaaaatacaaaaaattagccaggcgtgtggcaggcgcctgtagtcccagctactcaggaggctgaggcaggagaatggcgtgaaccaggaggcagagcttgcagtgagccaagatagtgtcactgcactccaacgcaggcgacaagcgagacactgtctcaaaaaaaaaaaaaagaaagaaagaaagaaagaatggcctaaaatttccaaactttaaaaatactatgaagccacagacccaacctcaataaacccaggcacagaaacacaagatataaaaaaactacatcagggcatatcattatcaaatcacccaaaacaacagtataaagtctgtcacccatgctggagtgcaatggcatgatcatggctctttgcagctcaacctcccaaggctcaagcaatcctcccacctcagccccgagtagctgggaccacaacgcatgccactgcggccaactatttttgtttttctttttgtagagacagtttcccggttgcagataaagtcttaaaccagacaaaacatataaaatggaacagtaaggagttacatgaaaatcgtctataatataatgcaaaagaaaaatccaatgcataatacatttcaattatgataaaaatgagtatggaataaataaggattagaagacaagaaaaaacattacctgtcaaaatgtggaattattattttttattcctagtgttgctatttagaaaaagaaaatgattctttttaattctaaagtctctgtgcctttaaatcctggaactaggtaaactcacagaagtcgaagaaaacctgctcatacccgtcgccacatcaagctcacctctccagctacacttgtgtcagacctcaacacccagccccgcacacatgcagaggcctatgcatgttggtgcaggggtctgatgccttcacctaagcaaggtcacagataaggctcaatagtttgtatatctcaagctggcctgacaatctaagcatctggatatctttccagctgcctcagaactgctgtgtggagaaagagatctgaaaccttgccatgctgtgagtcagtgagggagattcctcaaaacagcaggggccaagtgcaaacaagaacctgtgaaagcttctaccctacatatccccctctaaagaccacggataaaaactcaacaattaagcaggtgaggcttccaaagtacaaacaaaagatatgcgagaaagctaaaatgggcctctgtcttgaaacagcaaaaaagatgaacttagaaaacaaaaaaggagaggtgagtaaatctacctttaactgtaaagacacaggccagagaaaagatgcttaattatccagttattcttatgccaaatgtaaaaattttcagagatgagctattatctttatgtacctttaaaaatatatacatacacacacaaccatatggctgatttcagaatataaagatcaactaacatcaatcttcattaaattgtgacttattaataatttactttattatttggataaggcagcatttgatacattcactgactgtaactgaaaaacagcctttctatatatgacagtcataataataaggttaaaaaaaaacccacatacaaaaaagaaatcttactatttaaagaatcccagttagatgatttttatttcagtataatctcacgttcaatttaaaacatatagtattttccattttgctaaaatgtgttatacatggagactgctgccactaaaaactacttattaagcacagtggtttagggcaaagagagggagatctgaaaaatggctgggcgtggtggctgacacctgtgatcccagcactctaggaggctgaggtgggtgatcacaaggtcaggagttcgagactagcctggccaatgtggtgaaaccccatctccacaaaaatacaaaaaattagccaggcatggtggcaggtgcctgtaatcccagctactccggggctgaggtaggagaatcgcttgaaaccaggaggcaaaggttgcagtgggccgagattggccgatgcacgtcagcctgggcgacagagcaagactccacctcaaaaaacaagggatgctccaaaatggccgaataggaacagctccagtctacagctcccagtgagatcgacacagagacaggtgatttctgcatttccaactgaggtacctagttcatctcactgggacttgctgacagtgggtgcagcccacggagggcaagccgaagcagggcggggtgttgcctcacctggaagcacaaggggtcgggggacttccctttccaagccaaaggaagccatgagtgactgtactgaaggagcagtacactcctgcccaaatactgcacttttcccacagtcttcacaaccacagaccaggagattctctcctgtgcctggctcagcgggtcccacgcccatggggccttgtcactgctagcgcagcactctgaaatcgacctgggatgcaggagcttggctgggggagggtgtccaccactgctgaggctagagtaggtggttctatgctcacagtgtaaacaaagcacagggaagctcgaactgggcagagcccactgcagctcagcaaggcctactgcctctctaattccacctctgggggaagggcacatctgaacaaaaggcagcagacagcttctccagattaaacatacgtgcctgacagctctgaagagagcagtggttctcccggtacggcattcaactccgataatgaacagactgcctcaagtgggtccctgacccccatgtagcctgactggggacacctcccagtaggggccaacaaacacctcatacaggcagacaccttcgtgctctggacgatgtttccagaggaaggatcaggcagcaatatttgctgttctgcagcctctgctgggatgcccaggcaaacagggcctggagtggacctccagcaaactccaacagacctgcagcgaggggcctgtctgttagaaggaaaactaacaaacagaaaggaatagcatcaacatcaaaaaaaggacacccacaccaaaaccccatccgtaggtcaccaacatcaaagaccaaaggtgataaaaccacaatgatggggagaaaccatagcagaaaggctgaaaattccaaaaaccaaacacctcttctcctccaaaggatcacaactcctcaccagcaagggaacaaaactggatgagaatgagtttgatgaattgacagaagtaggcttcagaaggtcggtaataacaaactttccgagctaaaggagcatgttctaacccatcacaaggaagctaaaaaccttgaaaaaaagttagactaatggctagaataaccagtgtagagaagagcttaaatgacctgatggagctaaaaccacagaacgagaattttgtgaagtatacacaagcttcgacagccgattcaatcagcagaagaaaggatatcagtgattgaagatcaaattaatgaaataaagcgagaagacaaattagagaaaaaagagtgaaaagaaatgaaccaagcctccaagaaatatgggactatgtaaaagaccaaatctacgtttgattggtgtacctgaaagtgatggggagaatagaaccaattagaaaacactcttcaggatattatccaggagaacttccccaacctagcaaggcagacaacattcaaattcaggaaatacagagaacaccacaaagatactcctcgagaagagcaacccaagacacataatcatcagatccaccaagattgaaatgaaggaaagggcagccagagaaaaggtcgggttacccacaaagggaagcccatcagactaacagcagatctctctgcagaatcctacaagccagaaaagagtgggagccaatattcaacattctttaaaaaaagtatttcaacccagaatttcatatccagccaaactaagcttcataagtgaacgagaaataaaatctttacagacaagcaaatgcagagattttgtcaccaccaggcctgccttacaagagctccgaaggaagcactaaacatggaaaggaacaaccagtaccagccactgcaaaaacatgccaattgtaaagactactgacgctatgaagaaactgcatcagttaacgggcaaaataaccaataggatcataatgacaggatcaaattcacacatagcaatattaaccttaaatgtaaatggctaaatgccccaattaaaagacacagactggcaaattggataaagagtcaagacccatggtgtgctgtattcaggagacccatctcacatgcaaagacactcattggctcaaaataagggatggaggaagatctaacaagcaaatggaaagcaaaaaaaaagcagggattgcaatctagtctctgataaaacagactttaaatcaacaaagttcaaaggagacaaagaaggccatacataatggtaaagggatcaattcaacaagaagagctaactatcctaaatatacacgccccaatacaggagcacccagattcatgaagcaagttcttagagacctacaaagagactccacccggtaatagtgggagactttaacaccccactgtcaatattaggcagatcaatgagcagaaaattaacaaggatatccaggacttgaactcagcactggaccaagcggacctaataacatctacagaactctgcaccccaaatcaacagaacatacattcttctcagcaccacatgcacttattctaaaactgaccacatagttggaagtaaaacactcctcagcaaatgtaaagaacagaaatcacaacaaactgtctgtcagaccacagtgcaatcaaattagaactcaggttgagaatctcactcaaaaccacacaactacatggaaactgaacaacctgctcttgaatactactgggtaaataacgaaatgaaggcagaaataaaaattttcttggaaaccaatgagacgaagacacaacataccagaatctctgggacacatttaaagcagtgtgtagagggaaattatagcactaaatgcccacaagagaaagcagaaaagatctaaaattaacaccctaacacacaattaaaagaactagaaaagcaagagcaaacaaattcaaaagctagcagaagacaaaaataactaagatcagagcagaactgaaggagatagagacacgaaaaaaaaccctccaaaaaaatcaatgaatccaggtgctggttttttgaaaagatcaataaaataggtagaccgcagcaagactaataaagaagaaaagagagaagaatcaaatagactcaataaaaacgataaggggatatcaccaccgatcccacagaaatacaaactaccatcagagaatactataaacactctacccaaataaactagaaaatctagaagaaatggataaattcctggacacatacacctcccaagactaaaccagaaaaaagctgaatctctgaatagactgataacaggttctaacttgaggcaatagttaatagcctactaaccaaaaaaagtccaggatggattcacagccgattctaccagaggtacaaagaggagatggtaccattccttctgaaactattccaatcaaagaaaaagagagaatcctccctaactcattttatgaggccagcatcatcctgataccaagcctggcagagacacaacaaaaaaagagaattttaggccaatatccctgatgaacatcgtgtgaaaatcctcaataaaatactggcaaactgaatccagcagcacatcaaaaagcttaccaccacaatcaagtcagcttcatccctggaatgcaaggctggttcaacatacgcaaataataaacgtaatccatcacataaacagaaccaacaacaaaaaccatatgattatctcaaagatgcagaaaaggcctttgacaaaattcaacagcctttcatgctaaaaactctcaataactaggtatcgatggaacgtatctcaacatagtaagagctatttatgacaaacccacagtaatatcatactgaatgggcaaaaactggaagcattcccttcgaaaaccggcacaagacaggatgccctctctcaccactcctattcaacatagtattggaagttctggccagcgcaacaggcaagagaaagcaataaagggtattcaaataggaagagaggaagtaaaactgtcccgtttgcagatgacatgattgtatatttagaaaaccctattggttcagctcaaaatctcctaagctgattagcaacttcagcaaagtctcaggatacaaaatcaatgtgcaaaaatcacagcattcctatacaccaataacagacaaacagagagccaaatcatgagtgaactcccatcacaaatgctactaagggaatgaaacacctaggaagacaacttacaagggatgtgaaggcctcttcaaggagaactacaaaccactgctcaaggaaataagagaggacacaaacaaatgaaaaacattccatgttcatggataggacgaatcaatatcgtgaaaatggccttgctgccaaagtaatttatagattcaatgctatccccccatcaagctatcactgactttcttcacgaattggaaaaaactattttaaacttcatatggaaccaaaaaagagcctgcatagccaaacaatcctgggctagaagaacaaagctggaggcatcacactacctgacttcaaactatatacaacactacagtaaccaaaactgcatggtactggtaccaaaacagatatatagaccatggaacagaacagaggcctcagaaataccaccacacatctacaatcatctgatctttgaaaacctgacacacataagcaatggggaaaagattccctatttaataaatggtgttgggaaactggctagccacatgcagaaaactgaaactggaccccttccttataccttacacaaaatcaactcaagatggatcaaagacttaaacataagacctaggaccataaaaatcctagagaaaacctgggccataacattcaggacataggcataggcaaagacttcatgtctaaaacccaaaagcaatggcaacaaaagccaaaattgacaaacgggatctaattaaactaaagagttctgcatagcaaaagaaactatcatcagagtgaacaggcaacctacagaatgggataaatttttgcaatctacccatctgacaaaagattaacatccagaatctacaaagaacttaacaaatttacgaaaaaaaagcaaacaaccccatcaaaaaatggacaaaggatatgaacagcacttcgcaaaagaagacatttatgcagccaacagacatacgaaaaaatgctcatcaccctggtcattagagaaatgcagatcaaaatcacaatgagataccatctcacgccagttagatggcgatcgttaaaaagtcacgaaacaacagatgctggagaggttgtggaaaaataggacacttttacactgttggtgggagtgtaaattagttcaactattgtggaagacagtctgcgattcctcaaaggtctagaactagaaataccatttgacccagcaatcccattactgggatatacccaaaggattataaatcattctacgataaagacacatgcacatgtatgtttatgtggcactagtcacaatagcaaagacttggaaccaacccgaatgtccatcaatgatagatggattaagaaaatgtggcacatatacaccatggaatactatacagccataaaaaaggagagttcatgtcctttgcaggcacatggatgatgctggaaaccatcattctcagcaaacttcacaagatcagaaaaccaaacaccgcatgttctcactcacaagtggaaattgaacaatagaacacatgggcacagggaggagaacatcacacaccggggcccatggggagtgaggggctgggggagggataacattaggagaaatacctaatgtaggtgatgggttgatgggtgcacaaaccatcatggcacgtgtatacctatgtaacaaaactgcacattctgcacatgtaaccagaacttaaagtataataaataaataaacaaatataaataaaactgaaattagccaccaaaaaaagaaaaagaaaatctacgagacttttaactcaggctctgccgctgactttctggagataagtcagagactatctgtgtcagagaatatgactgtcaaccccagctctgttactcctcaggcacaaaagagcaagtcacacctcccgccccgcccccttacccgtctgttttcccctttccacttgaaaaggtcaagttaagaaataaaggactctacaaacacattttgaacccactgattttccaaactaaactgggtctaagctaatacatgataacagacaaaaatgaatacaaatagaaacttccccctaaacttcatggctaaggcagagtcagacttgggtctgtgacgcaagcacgtggggcagggaggagtctcccggaggcaccctggagaaccaggcccatcctagatgaactcagcccagaagacgcacatcaagtgtgccagccacaacccaagagaaaaaacaagacacaaaccttcccaatgtcctgcagtgtggccagctctagtatctggaaagaacatccaaggctgagcggagaaaccctccaaacttttccgtgctgttctgaagtccagcgtgaccttgggaaggtgaaggagagaacacacggttactggccctgtcacgattcataatgtacaaccaaagacacaaacatcgacggctgcagcagatgcctccactgtgcgcgccgtacactcaccttgcagggtgtgtctgcgtgtttgttgtcagcactggaaaaatttttggaaagaaattcctttcagatagctatacaaaaactactctttcaaaggctttcagttacactggcgctactggaagaaataattcctaactttctttcataatgagaaaaaaggttaaatgtccatcataatcagtatctggtatgtggtatatcaaaaaatagaaaatactagtcctattccttatacactaggatccctgggagaaatcactgtcaaattcacatagggtggttcaatttggatacaataaaatattaaatcaggtgtaagatgtgttaagattctaaggatttcatgtaattaaattatacagcaattctattttacagactcagagaatgggtcagaccaaagacatgcataacaagaaaggtaaggcgagactgactaggaaaataaatattgtaaaacactgcctcagaaaagaaggtgctcagtgaacataaatctaagaacccttgtgaagagaagctttctctgggcgaagtcagaagcaggcaagagacagacacagaaactgaaatgtgagtggatctaaataccatgactacgctagtcaacctgggtgtgccctaaggccagcaaaggaaagaaaaatccagcagtgacaccactgagggtccaaggaacgaggtgatgtgtgatgtcatgtgagatgaagagcccagggaagaaagggttctcctccaatatgcacagcatctgacctctcctggacaacaggtaagtgggagggaaaagaaggcatggaattctggaagagaagttcaccatgggaagttctagctctcaaagaagggaaaagaggtcatgagatggaattaagatgaaaaagcttccaggtcttcagaagagctgcaaaagttctgtggagactgaaaccaaagcaagaaaccagggaagacaaaaggaatcagaggagtgcaggaagggccaacaagaaatggggagtggagacgctgagcaactcagcagaaggaaccaaggaaaccagagcaatactcaaagatccagcaagacacgccaggcactccaaacgcacttcagctgagaactgcgcagcaggagctgaccgcggggatgacagagcaaaggaaacaggagtccaagatgcagggaggccagaattacagcagaacatgctggagttcagggtattcaggaaggaaaatataaacagatagcaagcactaggagcatggaaaggtgccctgaaattcaagatgatatggttgaaaacaggtggaaaagaagtatcttctctacggcatttttcaacatgccgtcttcgctttgggagctgacatgagaaccatgcagcttaaagagaccccaaaccttgtaaaatagaagactttcatatcttccaaaattatcaaacatccttcagaaaataagccacatacgttgataaatgattttcaggggaaaaaaaacccataagaagtaactattagtaacaaaaacgaggaatacctgaggattcatttatcaagaaatgtgcaagagctatgtgaaataatcttaagttttttttaaaatcctttaaatttcatgtgcttctgaggtaatttaaaaagttctgacaaataggaaagcatcccacattctggacagggtgacttaacatctgaggtataagtttccctaaatcaatctacaagtagaagttgattctattgttcacatcccaaaatcaataagaagaatatccagaaaattctaaagaacaacaggggaactgatcccctcataaataccataagctacaataattaagaagtatacttgtagccgggtgcagttgctcacacctgtaatccagcactttgggaggccaaggagggaggattacttaagccaggagcttgagaccagccaggcaacttagggagaccctgtctctacaaaaaatgtaaaaattagctgggtgtggtggacatgccggtagtcccaggtactcaggagctgaggtgggaggatcacttgagccctgagctgcagggaggcatggttgcaccactgcactccaacctggggacagagcaagactctgttaaaaaagaaaaaaaaaaaacaaggatgcttctaatagatgagcagacagatagattgaataacaaaataataaatgaaactactgaaactagagaactatgagaatgtaagtaactcagccaattagtgcagaaaaattcttctgtaaacattattggggacaaccaaaaacaaaattaaattagacacatacttcatatctaacaaattgcagatgaacagaaaattttaaagtaaaaaaaaaaatgaactaaaaaactaaaacatccctagacagaaaggctggctcttggggtatctggtgaacagtttcttacgctgacataaactttccctagctgataacaagtggccaccatgcccagactatttgaaacacatggtttatgccgaacacctgcttttcttctgtagtctggaattgtggctcatgttaggcagagggtacctgcaggaccagcatgttgctgttttttgtgtgagcctcacgggagggaaggaagcctgtacacggatccctccagactccacagggccacttccccctataacctggctgcacatcctagctctgtcactgtaatcaatctagctgtgagtacaaacaatatgaaaatccaaaacacctgtatgatagaagctatcataacaaagctgaaagacaaacaaacttgaaaaaactaaatgtaactcatatctcaaagggctatacatcctacaaatcataagaaaaacatcaactatccattagacgtaagtatgtgtgatatatatttttaaaagatgcagaggcccataccttgtagttagcgtgtgtagctttcagacatcatgcagtttgaggtatgaaggaagatgatagaaactccccagtgatgaggattacttgttgtaacaggacctgaggtatcagattgtctagaagctttaaaaatatgcacacaaagataaacttttagatcaaaataacttgccaagttttaaagagattactggaaatcagattttttaaagtattctagtatgaaaatattcaagtatttcctctgaccttttgattactagaagtaatgagaaattgactaacaaacataagtagagcctaagtactttttaaatacaaaataagaagagcagtgtgcacagttgttttgttatgattgcttgtttgctttgtgaaaatcagttagagaatcataggagcagctgattcaaggaccactggccaattccagaactctctgagcctaagattccttagtggccaacaacttcatgagcacaccaagtaatcaaaagggatgatgtaaaaatgttttaaagacggcaaaggcacaaacattatcattaaaccgaactaaatattaaagtgccaagcactatatacaactattctacttcagtttgaagactttgacttggagtccttagtttatttaattcatcagaaagatgatagtaatatactgataatttacacttgtaaaggctgaggcttttcaacaggtcaatcttcctcctgtactacagtcatccttagaaaagagcatcttttaaaacgcttgaggccgggtgcagtggctcacacctgtatcccagcactttggcaggccaaggcaggcggatcacttgaggtcaggagttcgagaccgcctggccaacatggtgaaactccacttctactaaaaatacaaaaattagccaggtgcatagcatgtgcctgtaatcccagctactcaggaggctgaggcaggagaattgcttgaaccgggaggcggaggttgcagtgagatgagatcgtgccatggtactccagcctgggtgaagagactccatctcaaaaaaaaccttgaatgtgttggtcaaggatacaaaatttcatttataacaggaggaatgagttcaagagatctactgtatagcatggtgactgcagttaatagcaagtaccatatgcaagaaaatcactgaaagagtagattttaagtgttctcaccacaaaacatgatacgtgaggtgatgcacaggttaattagccattccacaatgcatatgtatttcttctttttttttttttttgagacggagtctcgctctatcgcccaggctagagtgcagtggcagaactcagctcactgcaacctccacctgccagattcaagcaattctcctgcctcagcctccaagtagctgggacgactggcgcgagccaccatgcccggcttttttttttttttttttttttggggtatttttagtagagacaggatttcaccatgctggccagtttggccttgaaccccgacctcgtgatccgcccacctcagcctcccaaagtgctgggattacaggtgtgagcaccacgcctggccaatgtacacatatttcaaacatcatgttgtatattacagatatataaattttgtcaattaaaaataaataaataggccgggtacagtgactcatgcctgtaatccagcactttgagaggctgaggtggacggatcacgaggtcaggagatcaagaccatcctggcaacaaggtgaaaccccgtctccactaataaaaaatacaaaaaattagccaggtgtggtgtgcacacctgtagtcccagctactcaggaggctgaggcaggagaattgcttgaacccagaggcagagcttgcactgagccgagattgcaccactgcactccagcctgggtgacagaggagactctgtctcaaaaaaataaataaataaaataaataaataaataaatagccttgattaaatgctatatacacaaaacaaatgggagaaccatcactggcccctgggtgccaagagcagcgtgagaatgggtctggagggagactgtacagacaggtggccaggcgtcccagatacagaggcagcagcagtcacttcatgctttgccaggctcctctcctgcccctgccactgccaccgagagcagtatggatgggaattcaataaactgcagtcacacctaaatcctagcccttctgttctgaccttttcatgggtaaaaaaaggtcctccaaacttgtgaatggtttaagtcctccaactcagatgactttatccccactttctctcgcctttagctcttccaaatgtaatattccatttccaatcagaatttttgacatatcagaatcagttttttcactcactacactattcctaagcatctacaccacttcccttactgaaaatcaggaggcctctccagccatacctgcaaccagggaagcataggagagtgatgctccatgctagggctggaagcctggagctgtaggggctgcatgtcagccagtggcacttagaaatgcttcagaccaaaaggtggtcgtgtacatcagtcattagtttctaatatcttgaaccgcacctggagaaactttctctcatttactgatgtgtattatatttatttctctaaaacaccaagttacttaaatcctatgttctacatgacagatgctgcactcatgtccctcccttccccacgctgtttcctacctgcacggcctcactgcctttcttgggactcaacggtacagatgcttgttctcctggttctttctcttcccctttcgtcggatgggacttagagaaggggggtttgttagagaaggcaaggctgctaaaatagaaaaacaaaaacaaaaaacaaaaaaacaaaaacatgtgatggaagtataaaaaactgaaaattagaatatttggttttaccatttattaaaaagagctaacccatgtcatcattttgttcttggaccctgatatgtacagttcagacactgtacacattttatttactttacccacacaatgatacatggtagggactggcccacaacttcctaacaggtgcacagaaatgagttgaagatggaaggagccctcagggagcccccaggcccatgccctccaacagcaacaaccagggcattctatgttggccatgacgccatgacatgaaaggggtacaaagcagattttttttttcttttttgagacagggtctcactcgtcacccaggatggggtgcaatcaatttcattgtagcctcaacctcctgggctcaagcaatcctcccacctcagcctccagagagatgggaccacaggcacacgccacatcacccagctaattttttaatttcttgaggagaaggatctcacactatgatgcccaggctggtctcgaactccaagctccagtgatcctccctctcagcctcccaaagtgctggaattacaggcatgagccaccgtgcccaacccaaagcacattttaaactcctgtttctaaaagaggaaacaggctcagagatgaagtaacttattcaggtcacagctggttaccagcaaagctagaagtcaacaaatccagatgtattcataaagctcaactatctccaatacacaacacatgagagcatatagaacatcgagactcccaatgcttaggaggcagccatcatggagcagagtgaaggcaagatgactgacatgtggaattgaggcctagctctgctacttactcactccctgatcttagaaaagtgcttgttatggtttcaattctatagtcccccaaatttatacactgaaacttaattaccagggtgatggtattaggagtggggcctttgggaggtgactgggtcatgagggcagacccctcatgaatgagattagcaccatatataagaggccccacagagcttcctcaccccctcaccacatgagggcaaggcgaagtcctggatcttggacttcccaacctccagaagtgtgagaagtaaattctgttgttgagccacccaggctatggtattttgttatggcaacccatgctgactaagacagtcaccttaaccataataggatgaatggctacaatcgggtgcatggactggaaggcatcagggaagaatgcagacagtaaatgaaaggttagccgggcatggtggctcacgcctgtaatcccagcacttgggaggccgaggcaggcggatcatgaagtcaggagatcgagaccaccctggctaacagttgaaacccatctctactaaaaaaaaaaaaaaaaaaaattagccaggcatggtgacatggcctgtagtcccagccactcgggaggctgaggcaggagaatcgcttgaacccgggaggagaagttccgtcacaatttaaaaaaaaaagaaaaacagagaggctgctacactgaaaacctgcttggtagaaggcaccagtcacaagctcactgactgtatgagcccatccacagtaagtccagaagacgtagagtcacagagacagaaggcaggttagtggctgcctgcagctggagcatggaggttttgggtaaagagtacagagttcctttatgggttctaaaactgattctgtgatggctgtacaactctgtgggcatactaaagagaatgaattatatactttaaatggggaattatatgaattatctcaagaatgctgtttcctggctgggagcggtagctcacgccttaatcccagcactttgggaggccgaggcgggctaatcacgaggtcacaagttcgagaccgcctggccaacatggtgaaaccccgtctctactaaaaatacaaaaagttagctgggtgtgtggcaggcgcctgtaatcccaactactcgggaggctgaggcaggagaatcacttgaactgggaggcagaagttgcagtgagctgagatcgcgccaacccactccagcctgggcgacagctgagactctgtctcaaaaaaaaaaaaaaatcaaaaaattagctgggcatggtgggtagcctgtagtcccaactactgagaaggctgaggcagaaggatcacttgagcctgggagatgaggccgcagtgagctatgatcatgacactgcactccaagctgggcaacagaatgacacctatctcaaaaaaattaaattaaattttttaaaaaatgctgtttccaaaacaaaaggctgtgcagtaatccaaatgagatagtatatcagtctggaccagaagtggcagagaatataagtatgcatatgtacatgtattatgtgtccatgtacaggtgcatgcatatgtgcagaggtcccaaactttttggcaccagggaccggttctgtggaagacaatttttccacaaaccaggttggcgggggatggtttcgggatgaaactgttccacctcaaatcatcatcaggcattagttctcataaggagcatgcaacctagatccctcaaatgtgcagttcacaatagggttcatctctgatatggtttggctctgtgtccccacccaaatctcatgctgaattgtaatctccatgtcggaggtggggcctggtgggaggtgattggatcatgggggtagtttctaatggttggcaccatccccctggtgctcctttgtgtagcaactccccctacaggcactctcctttctcctcctctctccctctcaatctttctttttctctctctctctctgtctctctctctctcccttctctctttttcctgtgggccatgtgaagatgtgcctacttccccttcaccttctgcatgactgcaagtttcctgaggccttcccagaaacagaagcctgtacagcctgcagaacgtgagccaattaaacctcttttctttatatgtctcaggtatgtctttacagaagtgtgaaacgaactcatacacgctcctatgagaatctaatgccaccactggcctgagaggagataagctcagatggtaatgcttgctcacttcttcctgtgcagcctggttttttttttttttgtttgttttgtttttgagacagagtctcgctctgtcgcccaggctggagtgcaatggcacatctcggctcactgcaagctccgcctcccaggttcacgccgttctcctgcatcagcctccaggtagctgggactatgggcgcccgccaccacacccggctaatttttttttgtattttagtagagacggggtttcaccgtgtgagccggaatggtctcgatctcctgaccttgtgatcactggtctcggcctcccaaagttctggaattacaggcgtgagccaccacgcacggcctcagtccggtttttaacagaggttggggacccctgcatatgtgcatgtatatgtgcatgtcatgtatgtgaatacaaaggtacacactttcttctcgcaaaatatttagtaggggaaacaaagacttggtgagtggaaatgaagacttgtggtgacctgtttctagcttgataagacaaaagtggggtaaatggggcaggggcagatgtggggaggaggacagaaagctgagctcatacaccgtgtctgacatatccacaaatcagctatatgtaagtgtcacggggcagctggctcattgaactgcagctccagagacaggtcctctgaggtccctcatctagacactgaagacggagaacagccccgactctcaggctgccctgcccaatactggagccactacccacataagttatttaaatttaaatttaatgaaaattaaaccgaatcggggttcagttcttcagtcaactagctgcatttcaagggctcaacagctatatgtgtttagtggctactgtcttgcctgcatagctatggagcactgccatggttatagaaaattctgccactctctagaacagcactgcccagagactacaaagagagaagacggcctaggacagagcctagaaagcatgtgctgggggcaggaaggactgaacccagtgactggggagtggcaagtgggtaagggaacacccagaggccctctgaaagccaactgaagaggacactcaagatgggggtagcagcctgcaggatcaaagagggaaaggcaggcaggaccagagcagtgcccagagatgtaaagacatgatctggcgggaaacgctgctatggagtgtggcaacagaaaccaccagcaggggttaaggaaggaggctgaagtagtagacagggtccaggccaagagagccaaagaagccttgcaaacaaggtcacctcagagcagtgggaagctctgtgggctgaggctgggactctccagagatgtttgcgagaagggagaagactgatggcagctaaaggagaatgggaagttagtagggagatttttaaggtagaagacaaggcaaagagagagtaatcagatataaacagtaagtgaactggtcttcttaggctgggcgtggtggctcatgcccgtaatcccaacactttgggaggccgaagcgatagatcacttcaggtcaggagtttgagaccaacctgaccaacatggtgaaaccccgtcctactaaaactacaaaaaaattagctgggtgtggtggtgcatgcctgtaatcccagctgaatctgcctcgagaggctgaggcagaagaatcgtttgaacccaggaggcagaagttgcatgagctgagatcacaccattgcactccagcccaggcaacaagaatgaaactccatctcaaaaaaaaaaaaaaaaaaagtatgtgaactggtctatcttaaatccattgtacaaatagtaacatttgttttgaagttgattttattgcttcacagaaaagcaaaactgtccctgagatggcagaacattctacaaccatggaaatgctccataactatgctagccaggacagtagccttaaccaagatttaaggagacagcaatgaggtacttggccaggaacatcaattctgagcttcttggctaatgctggaaacctaaaactaaagctaggtatttccctcttagggataacgtgactgatgatactaaaagagctataaaacacatggtcacatttttttcttcttttggaagagtctgactctgtcacccaggctggagtgcagcggcacaatcaaggcttactgcaactccgcctcccaggttcaagcaactctcttgcctcagcctcccaagtagctgggattacggcacgcaccaccatgcccatctaattttttttttgagacggagtctcgctctgtcaccaggctggagtgcagtggcacgatctcggctcactgcaagctccgcctcccggattcacgcattctcctgcctcagcctcccgagcagctgggactacaggcgcccgccaccatgctcaataatttttttgtatttttagtagagacggggtttcactgtgttagccaggatggtcttatctcttgacctcgtgatccgcccacctcggcctcccaaagtgctgggattacaggcttagccaccacgcccggcccaacccatctaattttttgtatttttagtagagagggggtttgtgatgttgcccaggctggtctcgaactcttggcctcaagtgatccacttgcctcagtccccaaagtgctggaataacaggcacgagccactgcacccatccacatggtcacattttgtgttaaatttagtgtcacaatctgagcaattttgttcatttaaagcaaaaagagaataagaagggacagattactaaacaaaggtagtctggaaacccatagtcattaaggct

SEQ ID NO: 5085 - DNA, 46410 bp, Homo sapiens
tatgaagatccttgggattatattgggcctgtctggataattaaggataatctccctctcatctcaggttcagttgattagcaaccctgcttccatctgtaaccttaatcccccccttccatgtaatgtaacatgttcacaggttccagggattgggacatggacatcttggggggtcattattgtacctactacaatttttaaggttgctttatgactgcaaaagaaaactcacatggtttaaagaaaagcacacttacagtttatttaagaatttaaggttggtttgatcactggtgatgtaatcaaagccccaggcaggccttcttcttcttccactccaccatattcagatgcctcctttcatctccaggcttgtctcctcatgattgcaaaagcaccatccaaagcagaaggaaggtggcaaaggagccttctcctccatgctgctttttgattaggaaggagaactctgacttgctctgtggttccatggcagagaggaaggtcaggcagcccagctatgttgacaactcaagctaaatttgctgctagaaatcaggaaatcatggatggtggtggaagggggagatgcgtagggcctggtgtgcccagggcagagcagcaggtggccaagagcctgtcccagaaatgccagttcctgggtgggatcacgctaaggtgggtcatcagtatataggagtggtgttcagggcagccagaatcagagatcagcctatagctgggatcaaagatccatctgtggtagggtcaggggtcagcatgtggctggggccagcctgcaaccaggatcatgagtaagtcataacatgggtcgggactcagttcctggcttgagtcagagctgttctgtggctgaggacagaggtggactgtggccaggatcagaagtcagtctgtggctggatcagggtcattctgtgttggagtcagatatcataatggagttgggatcaatcagtttagtcttctctgtctgtcttctctctgcatctctgcttctctctgtctcattctcctttgctgtaaacacctgttggagctcagcaacttgggtccatggggaagagggaagttgagtctgggcaaggtcctataagcccggtatggaagaacataagggaaaaagagaaaaatgtcaggaatataaagatattcctagaaaaatgtcaggaatataaatatatgtatgtatgatgagaaatgaatgatataaaacgcaaatacgcaaacactgactctgcatgtaaacaacacacagaagtggcacaaacagaacaaacacaagtgggttgaatgatgggattgggacaattttttgtcctggattactgttctccattctgccctttttgtaataaagtcaaattaaatttagaatgtcattatttcctcaattatgttttataccctcacctcccacaaaatccacagacatattcagtgtaatattaggataatgttagcagactaggcatggtggctcacatctgtaatcctagcactttgggagccgaggtggatggattgcttgaaccctaggagtctgggactagcctaggcaacatagtgttccctgtctctacaaaaaattaaaaaacaaattagccaggcttagtggtgtgtgcaccgtggtcacagctacttgagaggctgaagtgggagaatcacatgagcccaggtgttcaagctgcagtgagccgggattgggccactgcgctccagcctgggtgacagagaaagaccctgctcaaaaaaaaaaaaaaaagaagaagaagaagaatgttagcaaatacttttaaggcattactatttgcaggcatagttctttttttttgagacagagtcccacttgttgcccaggctgagtgcagtggcacaatctccgcttgctgcaacctctgcctcctgggttcaggcaattctctgcctcatcctcccgagtagctgggattacaggcacccgccaccatgtctggctgattttgtatttttaatagagacagggtttcaccatgttggccaggctggtctcaaacgcctactcaggcaatctgcccaccttggcctcccatagtgctgggattacaggcgtgagccacttgcccagccgcaggcatagttctaaggacctcacaggtactaacatatttaattctcacatagctacatgaggcagatattataatgattcccattttacagataacgaatcaagcacgagaggttacacgctggcctggcgccacacagcatatctaatggacattaggctctttttctggtgctgggggaatttctggaaaatgcagagatggaagagaggtgggatcggggcaggcgggtggggaatctcccaggccaagttttctgggcacggcctggacctggagctgctggatggagcaggtgctgatgctgatgtggtcaccagagggcagcagggaccagggagctacttcctcttcacaccccctccacccggggcggtgcccctgacttgtcaataaacgtcgggaaacaggtgggatttggtggaagaactgacacggtcccgccaccatcacaggcaagtaagcttgagagcagcctggtgtcacctggcctccacccaccacgtcatctgctgctcacccaccactgtggcgtgcagagtactgctcttgtgtgccttttaccaaggaggaaatttagcccagagtgggcaaacacttttcccatggtcacacagcttggaattggaaaggctggactaaccaggcagggtgagcgcagagcccttgttcctctgagtctctgttctgagctggaccagggaagatgatgagcccatggtatatacagggcggttagctaggactctggtttgagcctggctatgccactcggtaacagcacatcgtgggcaagtcccatgcagcctcatcggtgccgggaggatccagtgacgtcaggcctccctcgtggtgggagctcaaacacttgctggttttttgttttttcggtgttttgctttttgttttttaattaataactttcgtgggaaaataaagtcagaaaggttgttcaaccggatgttcacggagatactacgccttcaaaaacagcgctcatttcgtgatcgcccacacagtgccagatgctggggcggggatgggatttccgtggtttttcttcactttcctctttatatcttcaggctttctctgaataggaaaaggtctcacgtgctgatagagtaatcagaaaaatgcaataagccactttttgtaaaaaaaaaaaaaaattcagatgcactcactgccttcctcccccctttccccctcccctcatcccccacaattctgtgtaaaggcagggctgagggagtacccccaaatcaacatctctgaaagctccccgcaggggcccaggccactcagcccactctggcgctgctacccaggggcgtcccctcctgcctctggtccagccccggaggctgaaactcccgcagccggcatctcactgggcctatgacctggacttttcctacttcctgcagggtgggggccagcctgagttgggcccacctgatcaccaggtcttctcatccctctgtagcttcccaaagcccagccagttcagtaatagttgcgaggccaacaacttggatttcttttgcctaagatcctttgttgggctcccagtcccattcatctctagcagtcaaatatattttctatttgctgcctaatttttaaattagatttctcgagacaatgctcaggcaaagtggattcgagccgacatctgcgtaggtgtcaggatgacaaagctgatatatcacggcggctgggagctcttaggtcagacccgggttcaaatcctggcccaggatttcctagctgtgtggttctaggctaatcctcaacctctctggacctgtttcctatctgtaaaattgggataatcattgagcctcccaactagagctgtttggagacgtaaagacacagtggctggacggcacttagcatattgcttggccctaaacagataactattttttttaaaattatattttattataaagagcttttggaggcaagaagtccagaaggctagttaggctctgccattctctgggtgactttgggcaagtcccttttcctctctaaaactgttttccatctgtaaactgtgtgatttgggcagctaaagggattgattttggcttagaacaagttttttttgtttttttttttttttcctgagacagggtctcactctgtcatccaagctgggtgcaatggcacaatctcagctcactgcaacctccgcgtcccaggttgaagcaattctacaactcagcctcccaagtagctgagattacaggcacccaccaccacacccggctaatttttattttttggtagagatagggtttcaccatattggccaggctggtcttgaactcctcactcaagtgatacacccgcctcagcctcccaaattgctgggattacagccatgagccatctgcctggcgcaaggaggtgtttctaacaaacatcaggctgcatgtgaggtagagagctcccatcatttccagtgtagtatgtaggctcctagagcaggaaggaatctaaaatggccaacccctcaagtgtgaaatcagggcagctactcagagaagcaaaagtgatacagacatagggcttcaggttcccagccttcccatctaaggcccacaccatccctctgcctgcctcggattgaagcgcagatcactacagagagcctgggtgatggagacactgtctggattccactatgatctgttgctaactagctgtgtgaccttggcagtgtatcatcagccactgttggtgtctgttcctgtcttcttggtgtgccagagtctctcaacacctccaactctcagttgaagaatttttttttcctggagtagctggaagtgctggagaattaatgctcctggaagcagctctagccaatgacagatgggagctggtggacaaataccccagctccctctcctttgcaggcaaactgggcatgtgccatgcatggtcttccagagatccccggcaggtaagcatcagttaccatgctggtaatctgttgaataactcacccttttgtcagaggtttatttaaactggagcttgaagaggggctgggtaaaatgaggctgagacttactgggctgcattcctgggaggttgggcattcttagtcatagaatgagacaggaggtcgtcaccgatacaagtcataaagacctgctgataaaacaggttgcagtaaagaagatggctctaacccaccaaaaccaagatggcacaagagtgacctctggttgtcctcactgctacactcccaacagcgccatgacagtttaaaatgccatggcaacatcaggaagttaccctatatggtctaaaagggaggcataataatcaccccttgtttggaatataattaatcaataaccataaaaataggcagccagcaaccctagggctgctctgtctacggagtagccattcttttattcctttactttcctcattaacttctttcactgactctatggactcgctctgaattctttcttgcatgagattcaagaaccctttttggggtctgcatctggacccctttcaggtaacactttcttggtttgtgtccttcccgcctcagttccccactaccttagcagggtttcccgggattacttcctaaatcaactattgaatccttgtatggggaacccaaacccagacggcaagtttcttaacctcttgcatcctgttcctctggatgggtgaattccaggagttaacagagacacagcactcacagcagtgtctgaggtatgtttggttaatacataaaaaataaagagacaaagaaactttatttatacaaactccaccccttctgttccactctcctcagcaaacacagataacaggtgatgaaactaaacacacagacgagcattactcaacccaaggttcccgccttccctagcacctgaggtctggccaacatgcagggtaactggtgccttatgcctgctgtctggattgcccggcccacagggggctgagcatatttattctgggggttccatgcatacgaggagcccccagccatacagctggcatgggtgtttggcagcaaattgtccctgctttagtcacagcaatttttcatgtccttgttgctccccttaactgaacaccccttgacagccgggattctgcctccagcatcaaccaaggaagctctgttaaatgaatgagcacctctaggcaatgaccaccctccctgaagttcatttctcatcgatttcccaaggccgcccaagtcattcccttgatggctgtgttagtttcaggctcggcttctagttcagtgagacagaggcaggtgggcctccatgtgggccatgatcggtgggcaaaacatgccttgggcagttacaacagggacagtctgctgcagaagctgtgggggagcagccaacaactcgttcacaagtcgaggtgcccaagggcctcagttttcctgcagggcctgccgtggggcacggcgacccagtgccctctactctcatgggatgtggcgagccagcccaatgctgggcggggtccagtctctgcagcccagtgttaggccaacgtcagtgggccaatcaccttcataccatggttcttcaagtcttttggaaatctgccagcctggctgcctccaggaggtggcatttcccaggcatggataagccctagtcctcatctgcagactcagcacaagaggacatgcacctaagagaccctcatgtatgtgggtcccacggagacaaagttccgattttgggggtctggcttgagctctgagcattgccaggggcaggatggaaggatgataggatttactcttctctgagatgcccgagggtgccagggaggccggacacagactggccccagtggaaccccacctggagaggggtctggggccctcaggggggttgtagggggcgagacctgtctccacagcagcagccacagcaaggactggccatgacaggggtctggccaccacctcctggccatgacactgtttcaggtggccgcacaggtggcaggtaagggctgagtagcaatgccactgcccaggctgtccacaagggggtctgtggcctgctcctggggaagtggggctttggcatgtcctctaccttttcccccggctccagacccaggtgctctggggagctgttgggagatgtgagctctgcggactgcgaggtggctccctgtccagtccaaaggtgaacaggggacagggactggggcagggtccccagggcagccaggaatgaggtcttggaaaggctatacccctcttccccactgctagccccaaacccacatttctctggggacacagcactgtggcaagcaggcttgagaaggccttgtaaccagcctctcctgggggacccaagcccaccccgcactggcctgggtgccaccctgctccaccgcatgtacaaactcctgatagccactgtgggggccgagacgggggctgcagctgccccatgctggaggacatttcggcggaggatcgctcccaggtttctggctcaggttggggcacagtggttggctcagagagctgggggacaagggcatctcgggttctacttcctccaggtgtctggccagcagtgggtctggacccagcctctgggacacggtgactggctcagggagttgctgaagctgcggtaagcagggttgcctcgatgacgaggggcgtctctgtgcaagtcaggttgtctggactctgggtcgggctggcagaggacttggctccaggtggagaggctgctccttgccccagggaggtgcctccttgggcctgcacttgggaactcatcccagggcatgtgagcactcgtacttcccgaaggtggaagaggcatgactcccccatgtcctgctggcaaaagcccccattctcctctccgagcaggtccggaacaggctctctgttagccgggccacaatgccctcccttccctcctggaagtcatcctgctgctctcaggcgatgcacagaagctccctttttcttcctctacctcctcctcctcccacactccaccggggcctcaaacaactccacacatcgcaccacgctgatgctctctggcagaggactgtcttgctgatctccactgggcaccatgctgattttccagagccctggaaagcatctctttggcagccttgtgaggatcttcatcccttttcatgttgtgctccagaaaaagggcaagagcttggtaagacaattcttccagtgtctgcaaaagcaaaggttggtcaggttcagtttcgacacttgaaaaactcctattcattcttcaaagcccagcctgaaatcacctgtcctgatggctgtctacttcagacatgccttctaacgttataatcagtaattgatcatctatgttgctagaatgagaaatccctgagggtagggtctgtgtctttgggatttcgggacccagcacatgtcctgggcaccaaatacaagctcagatctgttgagtaagaaaaagtcttatggatgatgataattaaaagcaacaccattatcccaagccatgaccaattagaaagatatggaagccgggtgcggtggctcacgcctgtaatcccagcactttaggaggctgagggggaggatcgcttgagctcaggagtttgagaacagcctgggcaacagagcccaagccgttcaaacatctctacaagaattaaaaaaaaggaaaattagctgggcatgttggtgtatgatgtagtcccagctacttagaaggctgaggctagagaatcacttgagcccacgagtttgagctgcagtgaatcactgcactccagcctgagggacacagcaagaccctgcgtccaaaaaaaaaaaaaaaaaaaaagatgcgggatcctagggttgaagcagggtcctggaccccctttgtttctggagtatggaaaggtccagcaggccccagggaagaagctaaggaggccacagtgcggggcaacacagcgagagcttgtctttacaaaaactttttttggtattattttttttagacaagagtctcactctgtcgcccaggctggagtgcagtggcacaatctgcgctcactcaacctctgcctcccgggttcaagtgattctcatgcctcagcctcctgagtagctggaatacaggcaaaaaccttttaaaatagccaggcgtggtaatgcacatctgtagtatcagctctcgggaggctaagatgggaggatcacttgagctcaggagtttgaaggtgcagtgagcttgatcgcaccactgcacaccagcctgggccacagagtgagatcctgtatattaaaaaaaggaggggagtgttcaggatagtggctatttgccgacaagtatacaattaggtcaagatttaacaacaggcacggctgctctggttgttaactataacagcactcccaaggggtatcacatgtacctgacacaccagtgaaactcagggggcttggccagcagtccacgtttccagaaacccctcctcctgccgtcccttgaaggctaatgtcacagggcaattaccgaatgcagggagagaaggcagacatggagctaggggcttgcctctccaattctatcaccttcccaatgctgcaggctgtgacctaagttcagatacatacgggcacttggctggttcctggcctcgggccgcttctcccactgtgacccctaaaatacagagacagccaatgaaagagcagagtggcttgcagcccggcctggagtacggcaatgctcaggaaggggtacaagcctcgacatcacaagatcagaagtccaacaggtcacttacgctttctgagcctcagattcctgggaattaatacattgtcctaatatttacagggactgtggtcgatggcaaaagtggccacagaggagtgtctgaatctcctcccatcccttgaatctacactggccctgggacttgcttgggcccataaatgtgatggaagtgatatcatgccagtgctgcgcctaggcctcaagaagccttgggactcccacccttgaaaactgagccactctgtaaacaagcctgggccggcctgctggagagtagaggcacatggctcaggcacctgcactgtcccaggtaaaagtcagccaactaggctggtgcagtggctcacgcctgtaatcccagcactttgggaggctgaggtgggtggatcatctatattaggagttccagaccagcctgaccaacatgaagaaaccccatctctattaaaaatcaaaattagcctggcgtggtggcacatgcctgtaatcccagctacttgggaggctgaggaagaaaattgcttgaacccaggaggcagaggttgcagtgagccaagatcacgccattgcctcctgggcaataagagcaaaactccgtctcagaaaaagaaaaaaaaaaaaaaagccaatgtcagacacggagggaggctacggggacgggtcagctcaattcagatctgcccagcccgcccagcccagcctcccccgccaccctcactgctgagcccagccccaaatgccagcctgagaagcataagctaaataaagttgttgtaaccctctacatttcggggtcatttgttacaagcaaacactaactgatacataaatggcacttggtatttgcaagaggctggaatatgcatttatatgtattgtctcaataaattccaatatctgtcctaccaggtaaacactgttatacccacaagaggaaactgaggctcagagaattaagcaacttgctcaagtccacactgccatgagtggcagagtcaggattcaaagccaacaccactagattccagagtccctggaaaagaaggaccctcagaccttctcttctagacaggacctataatccccctttctcctacctaggaactctcatcttgctcaggcaaaccccacccactcacccacaggaccatcgccttgggaagctgactccacccctggcttaggggtgggatacatttcaggccaatgagaacccggagggatttgctagtgcttcgggggcagtttcctatgcttaagaagaagacacagaaagccgtcaccctctccttcctccactccttctggcctctagccctggtactggcacctccccaggaatgacacagtgatgatgacccaagggtcattctcccaaggggagggaaaaaaacagaaaccaaccccagagaagcccaccccaggctgggattgccaaggggaagggcgggaaagctctggtctgctaatgacctcattcggcttctgcctctgtctcccctgcaaccctcctgctgtctatttgccattccagaagccagtgaaggtccttaacagcccaggtgttctgaacacacttcttcatgtacacagtcccacatgtcctcatccacgcctactcctacctgagcacctggattattatagccacgaggcggctgcgggctgggttgggaatctgatcccaccatctttcttaatcctgaaaaacaaaaggaaaaggtgttgatctctgaattattgacaggtgacgctcctcccataaaagtggtcgttatcaccaatacttatttggcatcagagatcaggtgattagtttctggaggtcaaaccactgactcatcattctaacctggtgacatggattcattgctaaccctattctacagatgaggagagtgaggcccaaggaggtggagtgacagctgtaggtggcagagccaggttcacactcccgcattctgttacccagcacagagttcctgagaggccacctatgtcctcagtgggaatgagaccccaggggattaggaaagactcaaactcagagagaggattctaggttcccctcaacaatccctttttcagagcagctgagggcaaagaccagggaatggcctgggatggcctgggaagctgggggacctacggagaaacacaaccttctctcttcctggcctgcctggggccatggtgcatcatcactgggaggtaaggtcctcgaccgcttctgaattagcctctgcccatggtttcaataaataaacacatatttattgagaccttctatgtttgactcactgtgcctggccctgaggccacaacagtgaacgagacaaaatgcctgccttggtgaaactgaccttcaagagggaaagatggatgataaatggagacagaatgcttatatgaggccaggcatggcggctcacgcctgtaatcccagcactttgggaggcaaggcaggtgtatcacctgaggtcagaagttcgagaccagcctggccaatatggtgaacaccgtctctactaaaaatgcaaaacttagccaggcatggtggcaggcgcctgcaatccagctactcaggaggctgaggcaggagaatcgcttgaacccggaaggcggaggttgcagtagctgagatcgcgccactgcactccagcctgggggacaacatgagactccatctcaaagaaaaaaaaaaaaaacgaaagaaatgcttatatgaggtcattcattcatggtaataagtgcatgaataaagataaaggggtagaagttcaagatcagcctgggctacataagtgacagcagtctctacaaaatgtaagaaaattggccaggcacagtggctcatgcctgtacccagcacttgggagaacgaggtgggtggatcacttgaggtcaggagttcaagaccatcctggccacatggtgaaaccccatctctactaaaaatacaaaaattagctgggtgtcgtggcacacgctgtaatcccagctagtcgggaggctaaggcaggagaatcgcttgaacccgggaggcaggattgcagtgagtcgagatcgcaccactgcactctagcttggtttttgagactccactcgtcccaaaaaataaaataaaattaaattaaaataagaaaattagccaggtgtggtggcagcgcctgttgtcccagctgctctggaagttgaaatgggaggatctctttagcccaggaatggaggctgcagtgagccgtaaccgcgccactgcacttcagcctggctaacagagtgagccctgtctaaaaaacagaacaaaacaagaaaccaaagacaaagaacagcaaagaggctgcatgctgggatatagtgatggggagtgggaagaggtacaggtgatggggaaactgaggccagagcaaggcgatcagtccaaggttgctcggaggcatcagtgacaagatatggaggggatttgcattccctgcctacctagtgtgtgctgggccaagagtgggcactttcatcaatctgttaataatccttagccacctctaatcctgacttagtgaggttgagcttgctagtccctttcagagatgggaggactgaggctctgagacaccatgattccaagggctggcaagagcctctggaaacgaggctccttccaccacctcccagccactcgccactcatctcctccctcgcctttactgtgatttggcctcttctggctgatgaaatatgttctcaccatcactgtcatctgcaaagcaggaaccccaggctcaggggtttcagcaacttgtcggccgccagctaccagctccaaggccaggattcaaacccaggtctcctgactccatcagggcaatcgtcgcaattcctctggctcctaccacatgcccccaaatgcccccagttgcccaggcacccagtgtttaaggggatgtgggatgactccatcttgcttatccctggccagctcattctccccagtcgggcccccctcaaattttccctccttggagagccttatcctggtcccccttgcaaaaagaccccagaagatctctggcctccaccctggtctagtgcattcagagagtgggtcactatgaaaaccacctgtttgtgattgatatgtattttcagtctccccagtaggatgccggtttagaaatgtggagtcctggttgggtgcagtggctcacacctgtaatcccagcactttgggggctgaggcaggcagatcatgaggtcaggagttcgagaccagcctgaccaacatggtgaaccccatctctaccaaaaatacaaaaaattagccgggcatagtggcatgcgcctgtaatccagctactctggaggctgaggcagaagaattgcttgaacccgggaggcggaggttactttaggcaagattgtgccactatactccagcctgggtgacagagtgagactccgtctcaaaaaaaaaaaaaaaaaaaaaaagaaaaaagtggggtccttgtcgatatgttctcagctctctctcaaggtgtgtagtagctgctcagtaaatacgtattattgactgagaggactgcaaggggcagactagaggggcaagtccctgccaccctgcactccagagggactgctcggcagactgggcccaggactcacttggtgatgctgacatagcacaacaggcagacggccaggatacaatgcaggaaacgctgacgcccagcaggaggtgctgctcgaagggctccctgtaggcggaagtgggaggggaagccatgagctgaggtcagccatggtacagcctgggctccacttccaggactggagacccagggtcaggaccctcgtccgagaccctccacgatctgaccgccaccacccctccacctcatctccccaccactctccctcttgcacattgagtcctcgtcacccggccacctcattgccccctgctcctccaaagctcagtgccacctccagatcttaaactgctgctctttctttccggaagcacagaagtcaaatgcaccaacttaggagccggatggtccttgctgtgtgacacaggacaagtcccttatcttctctgtgcctccgcatcctcatcgtactatggggttaatgacagaattgatcgtgcagggctgttgcgaggatgacatgatgatcaatagataatgcactcagaacagagtggcctgtccacatcattagctgccatcatccaacacggttgacttctccttgttcactttcatcgtcacattctccaaaaagttttcccgacaccctccctaccgttgccccctgcccatcgctccatccccttcctctgcttttatttcttcccagcactcactgtcatccagatccatgtgatttctttctttctttatatgtttctttttgtctctccctccagaatgtcagctccacaagagtggggatttctatctgctttttcatcgccgattccccagtgtctagcacagggctagccatgtaggaggaactcagcaatatttgctgaaataatgaatgagggtcccatacattgttatctgtttcatacaagctagtcccttccccatgccaatggcagatgagaatcaattcaaaactttcccaagcacctggtctgtgctgggttctggagatacagccatggagaccctgcctatggagctcacagcccaggcaggagacacgtggctcaactgatatccacagtgcaggatgagcaatgctgagagggcgtgcggtggcagggtcagggtactgccagctgccactgcacctaccacgttgaagaatctctttcattgagttttcacgacagcccttactcctcccattatacagatggggaaactgagcagtcttcttcactcaacagctttttcctctctcccttgtcagggagccatgcccacctaaggcttgagccaatcacgattatcctgttcctttttccaggcatttgagttcccagcttccttgcaatgagcaagtaataacagtaaccatgtaacatgtaacagtcttggccaagagatgtaaggggaattttgctagggaagcttctagaaagatgtttgcttcctgattaaaaagagatgcacaaggtacactctctcgtagcagcctttcctttccttcctgctttatgaagacagtgtgcaacggccaacctgagggcatgggtggcaagtctaaggatacaatgccccatgtgaaggatggcagaagggaagacagcagaagggaagagatatcacttggctgcttacaaaacccagtaggtccatttgtaagacttcattttatgtgagataatcaatatttcactgcgaaagacctgtgggatacctcactgaaaagagttgtttctgggatgtaggttccagtgagaaagttcccagcctcctttgtggctatgtgtagtcatgtgaccattttcaccatagaatttgagaggaagtgatgcggcccacttccgggctgtctgctttcaagaagcagagtgatctccataatcacgcctcttctgctggctggatacagacaatggtggggccctaggcagggattcttcacttggggttgatggaccaacatggctgcaggtagaattcaggggttgagaacttggatgggaaagaaattacatctttactttccctaacctctcacacctagctctccttccattaagaatggaggaaggggccaggaacactggctcccacttgtaatcccgcactttgggaagccaagatgggaagatcactggagcccaggaggtcaaaagcagcctggcaacatagtgataccctgtctctatttattttaaaattttaaaaataaaataaaatacattttaaaaaaagaatggagggaagagaccccagtaatgacagcatcagtgatcctgtcccagcaaaacaaaactcacagctattctcatatcacatcacaatttcagtatcataaagattatttatgcttatctactttgaaattacagtatttatgcgagctacccctagaacttttatttatagatcttaataaagaagcacatatatctctagattaaaaatgtgtttaaatttttataactgcatttcaatacaattagtttcctctgtagttctatttattttattttattcattgtatttatttatttttagagatgggctcttgctctgtcacccaggtgggagtaagtggtacgatcacggctcactgcagcctcaaactcctgggctcaagtgatcctcccactcagccttcccagtacctgggactacaggtgcatgccaccatgcctggctaatttttgtcagatgggggtttcactatattgcccaggctgggattttatgtatttaaaaatattctgaatgaggtccataggcttcaccaggctgccaaaggaaaccaggacacaaaagtaggtaaaatctttgtcctggagaatgatggcaccacaagatggaaagaacctcactccccagattctacagggagggaaaccacctacaaaccagcaacattcacgttagcttgttacgtgagcagaaatatattcctatagtgttaagccatggaaattgtgggcttgtgtgttactgcagctagcctgcctacctggcagatacaccacggcaggtgtatctaatggcaggattgccattgaggcatcctatgatataaaagcccagagactcagccaggggaagtgtctggccacagggaagaatggagagtggagattaccattgcttaggcctcttgatactcacagttgtgccattggtgctggggctccactcactccaggtggtgttatagcactgagcccaggccctcaccgtgccctgtaggaaatcccagacttcagggtgctggctgcgatgcggagggagggttcaggtaggtcacgttatagattctgaactggtagagaaaagggagatgttagggcaccagcgggggcgaggggcaccagtgcccaccctggttgctgtcgttagctgaccccaccatgttaagagccaccagcctgggtatttggttgttcgtcctgttcaggccattgcttgccaccctgtaactgtgaccaggctagagcaacatgcgtcaggctcctcgactaattagctgtatttacttaggcaagttgtttaacctttctgagttttcgtgagataattcaatctcatctgaaaacaagggtaagagtccctactaccacttcctggctgtgtgaccttaagtaagtgactaacctctctggacctcaatgtcctcatctgcaaaatgaagataataaaagtgcctatccccttcccgcagggttgtggtgataaggaaatgggttaatatacgtaagtatttcaaatgggtttggtatacaaaaagcactgggtgatctttctaaaggactggcagggtcgaggcactctctctgtccttcatgggcttcctagtgtctccatggtcaagtccaaactcactggctagaatccaatgctctgcccaacctagcctctactgagaagtgacttccaagatctattttaagtaaacaagggaagatgcagatgtgtatgtgttctctgcttctttttatgtttttgtttgtttgtttgttttttaaagagagatggggctgggcatggtggctcatgcctgtaacccagcactttgggaggccgaagtgggtggatcacttgaggtgaggagttcaagaccagctggccaacatggtgaaactctgtctctactaaaaatacaaaaattagctgggtgtggtgcgggcacctgtaatcccagctactcaggaggctgaggcagaagaatcatttgaacctggaggcagagattgtggtaagctgagatcatgccactgcactccagcctgggtgacagaggacgacttcgtctcgaaaaaaaaaaaaaaaaaagagagagagagagatggcacagtgatactgcagacaaacctaagatggccccgatgatccccactttgaatcacatctttgtgtctctggtcttctcgagtgtgggcaggacctgctacttgtttctaacccacagaatatggtaaggtgatgggatatatagaggatttcatggatgtgattatattacagaagactgtaattcctacttgctaggcaagtctctctgccttgatggctttgcaaagggcacatgggaaggattcagggttaactacaaccaacagccagcacgaaactgaggctctcagttcaacagccgccagggactgaatgtcaccaatattgtatgagcttagaagtgacccttccccaattgacctcagatgaaactgcagccccatcccacaccttgattatagcctcacgagactctaaacagagaacctggctaagctatgtccagactcccaaccacagaaactatgagataataaagggtgttgtttaaagctgtgaagctggtagtaccattattatgcagcaatagaaaactagacagcgatgactgaacacacacatttgcttgtatagacataagctctctctaaaggatcacatgccctctgcctgccctaaccttgcctccctttcccttctggcaagagacagacacagtggtcagtctctgggaagaaaaacaggaggctggagtcgggagagaaacatgtttcattctaagtccttttgtaccatttgtatttttattttgtgtaactattacttttaccctcaaaaaagctttaaaaagtgatacatgaacgctatattcatgactgaccctgatggcaatgagcaacctgagttctcatcctgtcacccctctccctgcgagatccagggctatgcactccctctcctcttcctcagcccccggcagtttcttcctggttactggcagctccatttcgcttgtggttggaagcacatttggggaaacctggtgcaaagtgagccaaggggaggtttttcacaagaaagaagcaaagttccaaaagattgctggagcaactacagagagttcagagttttcctattacagagggagctgagggtggggtgtgagttgtggggagactggggaaggagagaaaattctcactctcttttgtctttctttctaaacatgagcaaacaagaagcaacgctagatgtaagttaccgaagaaatcttacaccctggaagggagctgggaactgggaaagttttactaagaaacaaaagagaaatctgagcttccaaagaactacttgcggtttgtctttttttaacaagaaggacaggtgtttgggagaccatctctgagagaaatgtccatgggagaaaaagagcacaggcttgggagttcaaatactgggtgcaaatctcagatctgggctggtgcggtggctcaagcctgtaatcccagcaccttgggaggctgagccagggggatcacttaagccaggagatccagaccagcccggacaacatggcgagaccctgtcgctactaaaaatcaaaaaattagcctggcgtggtggcctgtgcctgtagtcccagctacctgggaggcagagtgggagaatcacctgatcccaggaagtcaaggatgcagtgagccatgatcacgcccctcattccagcctgggtgatagagtgagactctgtctcaacaacaacaacaacaacaaaaatcagccctgccatttccagctgtgtgaccctgagcaatgtgcctggcacatagtaggcaataaaatatggaaaccattatgaggcaggcattcagggctctaactaaacttttggcttgtttggtgctttatcgctacacatattcccacatcccccaaccccataatcctcaaacatccatgaattttcacacccataaaccttttatcatgcagttccctctgcctggtctaccttcccttctttccccatctagaaaactcctatgcatccttcaatgcccaagccaaaactcccctccactatggaaccttgcctagaaattatctaggggaatgaatgagtagctctagcccaaaattctatagtaagttcctaatgtttctttctggaatttatcccactcagtatggccacagttggtgcctgcagtgctgtggcagatgcaggtggacacccgcccagcttttagccatcgggtttaggtgcccactgcttaggacagaactccactgcctgcaactccagggcaaccctcattagtctaagccaattgtgccaatcccatcacctggcctatcattcatcaaggggagcatgtggccaagctctggccaatcactaaattctttatgttcagctctgttctgggaagggagagatggggtatctcagttgccactgttccacccacaagagaagctggattcattcttctgcctcagacctggtatctggaggcctgtggcatccctgagcaccaacaacccctaagccatagcccaggcatgctgaccaatccaatcccatgactggcatctggtgcacgtcttaaacctggctggcattttagccagcacagtcctgcttcctcttccccagttcccctggggaagccactcctgccttattttcagttcatctggtttggatggagctgagccacctgcagccctagaggcaggtatgtgactcctccctggacaagcagggccctccaccgcaccctctctccacccacagccagtgattggttcagaggctggcacagcatcgaagccggccactgagcagcagccttaggactcttattagaaccgtcaagaaaaaaaacccttttccactgtggctttgggatgtaggcctggagcaactagtaggcatatctgccactacatggggaagagcctgcctaaaaacgaagccagtacagaataaagcagggcgcagagctggacggttcctagaagctggatccagccatgcctgaaggcagatctagaaatatgaaaatattaataacatatctttggactctgaaggtggtacctttctcttccccccagcccatccttggactctctgtaggtcttgcacaggcctggggcatgagaaggagatttattgaccaaacaaacttgccccactctctagcatctgtgcactccttccccccatgccccccgctttctgacctctgctgtgtgagccaactgccccattcctgctctttccccatacctggcccagtgcaaaggggaaaccagacctgagagatataaatcgacacccctggcttggccagattgagagaagcagtgacagacaccagcatgggagcttaaggtggcgggtgcctgctccctgagagcaaccaggcccagcctgggcccctgggatgcacagagccggccctcacaaacctcaaggacaaatgacagaccagtgtgtgggacagcgggcagatggggatctctgtggcctggggcctcaagagaaagggcacatggcttttaggacacatgtgggccaaacaggggagctcatcgtatcacacaccttgtactgtcatagccctgtgggcgggtgctcttgtcactcctgtgtacagatgaggaaactgaggcacaaagaggttatgggatatgcccaacatcacacagctgcgagtggcacagcaggcattggaatgcagccctgtgggaccccaggtcccatatgtccaagagtgtccctccaatgggaatgtgaggaaggtggattcagggtggggaaacatgggtgcaggaaatgacctccccgcacaccagcagaaaaatagggggactcagccacccactgtgacggcccctgccattactgacctgatagtttcctgtaaatcctctcgccctttttaaagtgtcaatacatgtacttaagaaggaactccactggccaggtgcggtggctcacacctgtatcccagcactttgggaggccgaggcgagtggatcatctgaggtcaggagtttgagaccgcctggccaacgcagtgaaaccccatctctactaaatatacaaaaattagctgggcacgtggcaggtgcctgtagtcccggctgctcaggaggctgaggcaggagaatcgctagaaccaggaggcggaggttgcagtgagccaagatcacgccactgtgttccaccctgggtgacaggtgagactctgtctcaaaacaaacaacaacaaaaactccaccaacactactgtgaagggatgtcaggaccagcttccatggggaacaaccaacaaactgatcttgttttcttgggaaatctaagcctggggtgtggcctctgctctcttcattaagaggaattagtaaacgagtcagtgtatggggacttcctccttaacccgttggcctcaaaagggaactgacacgggtcactgctcttgagtcagtattattctcttcaataatagggttattcaagtgagctgtcaatgtgcacctacgatcacttgtgtcccccaaactgggaaacacagatgtggcccacagccctactttacagaggaggagcggcatgcagagataactccccttctctgatgtgaggggtgggggccaggaagcaaagggacttgcctagggcagagccaggtgagaagccaggtctctagctctgggatttgctatccagccccagggcttgcctcccaggctcctggctccagggactggcctctgctggtcacccaccctgttccccagaggtcacagaaaaacgtcaaagcatgcccctcacatctgccgggtcgttttcactccaaatgttgactgcataggtgagatgattataaggtaattgtcagggggatacgggttgctccaggtcagcagcagagtgtcggagacattgtgtgaactgtcaggtttcctggggccctgggtttcactgcgggagaagcggcctctattgaggatctatgcagtgactcccccatcacccagcccagccccggcctacaaaccacagcaccacccagatttttggtcgacaaaacctccatagcatacttctggagcaccacacagttcagagccatagcaaagaagattataataacaataatgttgctaaaattctacatagactttagtgtttattaattaccctttttttcttcttttttgagacagggtcccactctgtgcccaggctggagtgcagtggcacaatcccagctcactgcagcctcaatagcccagggccaagtgatctgcctgcgctgggctcccaaagtgctgggattccaggcatgagccaccgccctggtctttactaaccacctttctacagtgaaggcaaagtgtatgagccaaagtaaccaaacttcagccttttaaaaaatctttttatttttatttatttttatttttttgagacgtatctcactctgtcgcccaggctggagggcagtagcatgatctaagctcactgcaacctcttctcctgggttcaagccattctcctacctcagcctcccaagtagctgggattacaggccctgccaccatgccagactaattttttgtatttttagtagagacggggttttaccatgtgtccaggctggtctcgaactcctgacctccggtgatccgctgggctcggcctcccaaaggctgggattataggcatgaaccaccacacccggcctcaaacttcagcttttacagctgctccttcacacctttggccacatctctgtactttatgatgatttactgagtatttttcttattttgattcatctgttttaaaacttggtctcctttgaagcaatcatatccatgagacccaggtttttattcctgtgatgcatgtcatatcatgcatcactggaatacaacgcatgtttaaactcctgtcaccacagcccagcaagctcaagggggattcctgcagggactccgggtccagaagaaggtcagccttccacggtcaagaccatccaaagccgcagcagctgaccagtgacacagaatggaaggaatgttcccagttcggttttcaatcagcagcaggcatgccttcagcaagcacacctcatctcaatacgccttcctgggcacttaagttcaggggtggaaacactgggctgaagggggcttggtggtctactgcgaccagctccgtttcaaaggtgggaggatgaggcccaggcaggggcaggaatcccatcagatttgggaaaatacaggcggcttcctctgctgttgctatgaccccacctcctcccctgcccaccccaccctcagcccaggcagctggggaacacacccagccacccctgccgcactccgccctgctcaccatgctcgctgggcttaaggagcccttccacagcagctgctgcccagcccacaggtccagtgtatagttatccgcctgaccacgtcatccatgagcaggtggcacacgcaccccgcgcctccgttgttctcaggacacacgtgtgggctctgcagacacaggggctgggttaggctggtcacctgtaggctggtgggccccacagctgtgtccgggacatgcctccaggaaccgcatcagactcttccagctcccgatcacggatgtgaggacagatctgggggcttgggagcggccagggtgtgctggggagccgactagggttgcctctcttgctggccacagcctcttaccacatgcaccaaggatgtcctcacacctgcctagctgccggccctggtcctgggacttagcttgttcctgaaagccatgaaagggaagaaccggtggcactaattaatttagaacaacataagctctgcatcgcaagtttggccatcgtaagataattccaatgttccaccttaacagccaacccacatctcacggctaggccaggggtctgcaaactttttctgtaacaggccagatagttaatattttggattcaaaggccacacaatttccttttttttttttttttttggttatttgtataaatttaggggtacgagttttttgttttttgtttttgtttttttttcctgagacaaagtctcactgtacccaggctagagtacagtgatgtgatctcggctcactgcaacctccacctcctgggctaagcaattctcccgcctcagcctccctagtagctgggattacaggtgtgcgccactacaccagttaattgttgtatttttagtagagatggagcttcaccatgttggccaggccggtccgaactcctgacctcaagtgatctgcccacctcggcctcccaaagggctgggattacagcgcgagccaccacagtgcccggccttacaagtgcaattttgatggcaagcctcagatctttctcactggatatgctgcctagtggtgaagtctggggttctggtgggtccgtcacccaatggtgtacactatgcccattaagtaacttctcttccttcacccctctcccaccctcccagtcttcaatgtctgttattccatggtacatggaataatgcccatgtgtacacattattaactcttacttataagtgagaacatgcagtatttgactttccatttctgaattatttcattaagataaaggaggaggccgggctcagtggctcatgcctgtaatcccagcactttgggcgctgaggcgggtggatcacctgagttcaggagttcgagaccagcttggccaacatgataaaaccggtctctactaaaaatacgaaaaattagccgggtgtggtggcaggcaccattatcccaactactcgggaggctgagacaggagaatcgcttgaacccgggaggcagaggttgagtgagccgagattgtgccactgcactccagcctgggcaacaagagcgaaactctgtctaaagaaaacaaacaaacaaacaaacaaacaaaaaaaaacataaaggagggccatgcagttctgttacaactacagcagccagtgtgttccaataaaactttatttacaaaaacaagcatgggccggatttggctcacgggccatagtttgccaatccctggactaagccaatggaaaaaagcacagcccatctaccttagaataatcatggaataccacctttactggtgaaccctcatgctggtgtgccgtatatccccagtctgccccgtaactgtgtgtcttgtgtacgtgatatgtcctgggcaccagtgtaacgaagcatcctgtgcaccatggagtagcccagggaacacctgactcctatgccatgtgtcctggtccatccaccatcacagaggactccactctcacaccgtactcctcaatcaagggtctagtccagtggttctcaaagtgtggtctgggcccacaggtaaaactcttttcatcataatacagggacgttatttgccttttcactctctctcatggcgtacagtggaattttctagaggctacatgacctgtgatcatgtaattgatctgaaatttgttgaatgcgggcttgcatgttgttgggacttaaaatttctccattttgggccggtacagcggctcacgcttgtaatcccagcactttgggaggcggaggcaggaggatcactgagcccaggagtttgagagcagcctgggcaacacagtgagacctccatttcagtaagaaaaaaatttttaattgttttaattttttaaaaattacaccatttcttcattgcaagttctattaggtaaacatagaatgatgtgttacctacaccaaagccctttgggtcctcactcattttaagtgtgaaaaagggtcctgagaccaaaaagtgtgagaactgctggtctagtccagtttccagccgtatccatgtgccacgtggaccaacactcccaccatgcgctccactgtatctacataacatgtccctggagatgggacctcccctctaacaccatataaacagcagcaaacatactcagcatcctgcactccagcgcaccacctggacccagctcactcttggggcaaacctttgggcacaacctccccaaacctccagctccagcgcaggcttactcggagagcagaaaaccagctggtacaacaggcggagctcggtgctgcaattggtgggaccattcatcttcactcgcaagtagagatgctcatgtagtcggagacgcaggtgggctcctgcaagaccttctgttccctggggagacacaggagcagcctgagcggcccaggaactcaatgcgtgaggggacttgcacccaaacaggaccaaggggaatagcacaaaagcacagtgcaggcaaagttgaggccagcgcccacagagctggggccaggaccagggctgctggagcttcccagctagtgtgggatgactgtggaagctgaagaaatacccatgggtgcgggggccattagacaagaacgaccaagtgcacctttatctcacacaaacttgacaacttgttcttggccaaattaaagggaaatatgtagcagtttaaggagtgccattccatcacaccaagcctctgccctcgagctagggaagtgccacttccccatttgcccactatctgcgcccctctttgtctccaccccttttgccctctctgtgctcaggaggctgataccacagtcttcatcaccgggtacccttggccttagtttccggttgggtttggccaatgggagagaggagatggatgggctggaggagacacggggtccttctcctttcagcgccctcctagcttgtcagtggccatggcaggactggaatggcaggatgtacactgagtttgctaaaccacctgagcatgagaccactcaggcgcctcatgctcccatgctcagtgccacgcccatctcagctgacaacaacttgcataagggcttacatgttaaggagctgtcttagatagcaaataaatattccaagcttatctcatgtccaaactaactcctgattcccgcccctccccaaagtaccttctcttctggcatccttctgcattcagaaatgacaaccgcgtccttcccagtagtttaggtcagaaatcttggagtcatcctgccacttctctttctctgtctttcacctcaattccaatctgtcctcaaatctacctcccaagggatccggagcctctcatctcctccactccagacctccctccagacctcctggcttcaccctcttcctttctccacacggcatcctgaagagtcctttggaacataatggatgataggatcctctgctcaaacactgcaaggtcttttttgattcagccactctgtcaccttgctaccttcactgctccctcctgctgctcactctcctccaccacattccctcctgtgctcaacctcccgccaggctcagtgcagggcctctctgccaagaatgagccttccccagacatctcacggttcccgcttcctccaagtcagctcaatgaggccttccctgacttccctactttcactgcaatcccccccactccacccagcttccccaaccccctcttatgctgttctgtgtttttccccatcaccttctctttttttttgacagggtctcactttctcacgcaggctggagggagtggcgcgatcacagttcactgcagccttgacctcctgagttcaagggatcctccccctcggcctcctgagtagctggggctacaggcgtgcactgccacacctggctaatatttattatttgtagagacaaggtctccctatgttgcccaagctgacctcgaactcctgggctaagcgatcctcctgcctcggcctcctgaagtgctgggattacaggtgtgagccactgcaccggctcccatcactttctaacaatctttagaatttactgataatcagggccacttgtcttggctgtcccctcccactgcagtgtaatctccataaggccaggtgacatactgcaggacctggcacgccattaatagccaacaaatgaatgattgagaagtggtgacttaccagagctgccacctgcagcaggaccaggcagctcacagggaacaggagcccagagcaaagccacccattgggagatgccaaggcacctgcagagagagaggaagcaggttagtgctgacctgtgttccagcagagctcatcttattcaatatgcaaccctcccctgccctggccatttatttgttgtttgtttgcttgtttgtttgtttttccgagacagagtctcgctctgtctccaaggcggagtgcagcggtgcaatctcagctcactgcaacctccacctcccgggttcaagcgattttctgcctcagcctcccgagtagctgggattacaggtgcccaccaccacacctggctaattttgtatttttagtagagacggggtttcaccatgttggccaggctggtcttgaacttcgacctcatgatctgcccctctggtcttctcgaagtgctgggattacaggcctgagccacgcggctgcccagccatgccctggccatttgtgtctctgccgacaacaggtcctccacgtcacagagctctctctataatcatgaaacaacacccagacccacaaagtccagagggtgactacacaacaactgtcctgggagatgcttctggatgtggccttccttggacaaccctctcacatgtttctctgattatttcctgaggtttaaatacctgctctgtcactgactagatggaaccttgagcaagctgtgcttccatgcctcagtttccttatctataaagtgggactaaaatagccccatctgattgaggtgttgtggggattaaatgagctaacacagacagagcccccaacagtgaccggaacactttaaagtctcaagtaacgttacaagtcagcttagtccattaggctgctataacaaaaataccttagagcaggtaatttacaaagaacagaaacgtattctctattgggtgcaatggtgtgcatctctagtcccagctactcgggaaggtggggtggacacttggagtccaggggtttgagaccagcctagggaatatagtgagacctcatggtgaattttgaaaaattgttttaaattttattattcaggccagacacagtagctcacacctgtattccagcactttggggagccaaggtgggtggatcacctgaggtcaggagttcgagatcacctggccaacatggagaaaccccgtctgtactaaaaatacaaaaactagccgagtgtggggcgggcacctgtaattccagctactctggaggctgaggcaggagaatcgcttgaactgggtaggcagaggttgcagtgagtcgagatcgcgtcattgtactccagcctgggcgacaaagcaagactccatctcaaaataaataaataataaataaataaattttctaatgcatagtctggagactgggaagtccaagatcacgacactaggagatccagatctggtgagagcccatcctcacggacgatgccatgctgctgtgtcttcatatgacagaaggggcaaacacacttcttcagcccgttcataagggcactaaccccattcatgaccaaccacagagccctcatgattaatcacttctccaaaggccccatctcttaatatgactacaatgggatgaagtttcaaatatgaatttgggggaacacattcagcccatagcaccagctattatcattaagaaaaaagttcagaagccaggtgtggtggctcacacctgtaatcccagcactttgggaggctaagggggaggatggcttgagcccaggagttcaagaccagcctgggcaacagagtgagaccttactctacaaaaattaaacaaaatcagccaggcacggtggtgcatgcctgtaatcctagctcttgggaggttgaggtgggaagatcgtttgagcctgggatgtcaaggctgcagtaagccagaccgtaccactgcactccagcaagaccctgtcataaaaaaaaaagaaaagaaaagaaacagaaagtttgggaggctgaggtgggcggatcacgaggtcaggagtttgagaccagccggccaacatagtgaaaccctgtctctactaaaaatacaaaaattagccgagtgtggtgggcacacctgtagtcccagctacacgggaggccgaggtgggagaattgcttgaacccaggggcggaggttgcagcgagccgagaccatgccattgcactccagcctgggtgacagagtggactctgtctcaaaaaaaaaaaaaaaggaaaagaaaaaaatgctaagaagcagaatctccggagtcaagtgtgtacttttccccagcactcctggtacataacgtcaaataccctccaaaagtgtgtactggggccgggcgtggtggctcacatctgtaatcccagcactttaggagtcacaaccagcctggccaacatggtgaaacctgtctctaccaaaaatacaaaaaaaaatagccgggcggtagtggcgcgtgcctgtagtcccagctactcaggaggctgaggcaggaaatcgcttgagcctaggaggtggaggttgtggtgagccgagatggcaccactgcactctagctgggcgacacagtgagaccctgttgcaaaaagagaaaaaaaaaaaaaagaaaaagaaaaaagaaaacagcacgcgctgggttatattccctgcaacatttcaagtgcccatccttccttcccgcttgggtctctctcctgggatcttattcaaaaaagcagctcccaggctttgtctgctagtgagtagttctttgccattaacagcatttctcttttggtgctctggctgtgttctgtggcacaggaatggttccaaggctaacctcacaggcttgcagcaaacaggaacggggtgttgcctctgaagcactgtgtgcagtgtctggggcatcataagaacttaaggccactcaggagctctaggcccctgctggatgctctccgagtgacttgggcacacttgaaggcctccccccagcagggctccacctccctctccacctgggcccagcacccatgcatcctacgctgccacctacacttcttcttcttttttgttttttaacattttattttattttatttcatttatttttttgagacagagtttcactcttgttgcccaggctggagtgcaatggcgcgactcggctcactgcaacctccgcctcccaggttcaagcgattctcctgcctcagccttctagtagctgggattacaggcatgggccacacacccaactaattttgtatttttagtagagcagggtttctccatgctggtcaggctggtcttgaactcccgaccccaggtgatccgcctcctcagcctcccaaagtgctgggattacaggcgtgagccactgagcccggctgccacctcacttcttaaacacaccaaactcagtcccacctccatgccttttctctctctgtcccctcacctggagggaccttcccttcctccctttccttttttttttttttttttttgagacaggtttactctgttacccaagctagagtgtagtggcacaacctcgactccctgcaacctcccctcccgggctcaagcaatcttcccacctcagcctcctgagtagctgggaccacagatggcaccatgaggcctggctaagtgtttgtatttttgatagagatggggtctcattatgttcccaggctggtctcgaactcctgagttcaagcgatctgcccaccttggtctcccaaagtctgggattacaggcgtgagccactgtacccggcccttcctcccttacgcgtgcttttccctcttcccctaatttatgatggtgcaaaatcaatgggtgttcagtagaagcagtacttgagcacccatacgaccattctgtttttcactctcagtattccataaactacacaagctatcaacactttataacaaaacaggctttgtgttagatgactttgcccaactgtaggctaatcaagtgttccgagctaagttaagctataacgttcagtaggttaggagtatgaagtacattctgacttaataatattttcaacttatgatgagtttatggggacaaaaccccatcattagaaacatctgtgtatgagacacataaacacactcacatatctccataatgaataaattacccaatacctcagtgtgcatgtcagaaaaacaaggacattctctgcataatcacaatacaccatcgaaatcaggaaattaacagtgatgcatcaccactatctcatccacggcccctattatgttttgctaattgcctcaataatgccctttatacgtccaggatgcaatccaagatattcatcacatttgattatcatgccttcctagtgaccaggtcttggcttctaaatactatctgtactgaaaggaaccagagcgccttagagaaatagctgattccaggagaaggaaaataccagataggcttggaattcttgtgccagacaataaggaagtactcagcagctagcctacctggacaaaacaggcacattttgagcatcaaaatgaatattatggtatccacttgtacccttggagttaaagtccaggagtctgtattgacatagatcaataaatggaggaggccggtgcagtgtggtgtgtgcctgtaatcccaacttcttgggaggctgaggcaggaggatggttgagcctgggagttggaggctgcagtgagctatgatcgcaccaccgcactccagcctggcaacagagtcagacttcatctctaataaataaataaacagggaagaagggaaagctctttttactatgacagcctcaaagtaactccctgcaaaacttgtattgtatattaactaatagtgaaaatacatatcaatgaacgttacaatacagaaacctggcagacaccaccttcacaagtgatctaaactcaccaacaagaatgggacaaatccccaacatcacctccctgaaacattcctgagaagagcacagcatgtcttttcctgggttcctgccaaggatgcatacatcattggaaacgtcagacaaatgtacaccaagggccagtctatatacaagaactggccgctgtcctcacgaagtgccgggggtgcaaaggacaagccagcgtgggacatctgtccctttttaattgtctgtcatcctgacagccagggtctgtcccattcactgccgagtccccagtatcacaacggtgcctggcacataggacgtgttcagtaactgtttgttgattaaattcattttgacatgatgtggggcccctaactggctcagcatgaggctgcaaagctctctctaggggaggctctgtatcggctcaaaggttgaactcgtcttccttgctgagagttacaaaagtaaatctcaagtaaaggaggggcgggaatggggtggtgggttcctgacactgatttccttggcagtcctagtaacttttactctcacaactacacagatgcccacagtatcctgtggcagagtggcaaaggtgtcactttagcctcaattatgaataaagagaaacagagaggccaagacgctgtccaaagtcacacagcagaagactttcatggtaaagtcctccagggaaacaggggatcaacaaccctgtcaagattcactaaaacatcccagcatggcgtcaggattgatatcctaatctgttgtggaaggcacgcccagacttacgcatgcccatgtgcacacacacgtgccgagctagcttctcagggatgtgtgggtgctacatttcaggagagatcacagatgcagtggagaagaggcttccctgaacatcagaggcaaaaagaacaaagatgcaggtgagtaaaagattaaaaagataagtgccaggttatcgcgttcaagtacacggcaagaggagatgatttcagttcccattctaaatcaagagactcctggctgggcgcggtggctcacgcctgtaatcccgcacttcgggaggctgaggcaggcagatcatgaggtcaggagatcgagaccatcctggcaacatggtgaaactcagtctctactaaaaatacaaaaaattagctgggcgtggtggcagtgcctgtagtcccagctactcaggaggctgaggcaggagaatggcttgaacccgggaggggagcttgcagtgagccaagattgagccactgcactccagcctgggtgacagagcaagatgtctcagaaaaaaaaaaaagagattcctgaagtggtggagttggaaggggtctcagcgtcacctgccaagctcaactgccaacctggacaaggatgtcctgcgaacaccccacttctacatgctgctaggcagtttcagcccatatgccaccacagatggagcaatcactctcaggctcagttaagcagagccattggaaacagcctccttatgttgagtcaaggctttgtgtgacaaaatccctgcttgcccagcacttaccttgtacttgacactttgctaggtgctttagagtattacctcaccgaatccacacaagaatcctgaaaggtaggctgttatcccaactgtcagctaaggaaactgaggccagagaggccaaataacccatccaccaggtcccacagctggaaaaggtcagagctagaatcagaacccacgtttgtttgcttccgagcccaccgtggattcagtataccagttccttcaatctcatctcctaaaactgcaggctgaacccaataagatgaataaaatgagccgggcagagttggccatcctgcttgtcaatttcaaacaacagttccgaagtgtaggataagaaaatctgactgagcagcagaaaagtcctgaggattttatcatctcaaaatctccaaaagccaatggtgaagcagcaacttaaaaaaaaaaaaagagtcacccgggtcatattaacagaggtatccatttatagactgttacatctcacaacagcagaatataattctcctcaggttcatgtggaataatcaccaagacagaccacattctgggacataaaaaaccttaagagattgaaaacattagaaatcacacaacatatgctcttaggccacaatggttcaaattagaagtcactagcaggaagaaagccagaaaatttccaagtatttggagattaaaaacacacttccgaataacatatggatcaaagaagaaatcacaagagaaactaaaaaatttttaactaaataaaaatgaaaatatagcctatcaaaatcggtgagacgtagcaaaacagtgcttagagggaaatttatattattgaatgtatatcttagaaagaaagttctaaaacaataatctgtttccatctagagtactagaaacagaaaagcaatatatgtctaaaacaacagaagaaaaaaatacaaaattggagcatacatcaatgaaattaaaaatagaaaattaacgaggaaaatcaatgaaatcaaaaattggttcttcgaaaagatcaatgaaattgataaactctacctaggcgaatcaaaaaaatgagagagaaggcactaattaataataatgtgataggcctggctctgtgtccccacccaaatctcaccttgaattgtaatatgaattgtaatcccacgtgttgggggaaggacctcatgggaggtgattagattacgggagcagttcccccatctgttttcgtgacagtgagtgagttctcctgagatctgatggttttataaagggctttcccccctttccttggcgtgtctccttcctgacgtcatgtgaaaaaggatgtctttgcttcctttccgccatgataatatgtttcctgaagcctccccagccctgcagaactgtgagtcaacctctttcctttataaattacccagtcttgggcatgtccttagagcagcatgagaacaactaatactattgtaaattaaagaaaagttattagaggtggcacatgcctgtagccccactactgggaaggctgaggcaggaggatcacttgagcccaggaggttaaggctgcagtggctgtgttcatgccactgaactccagcctgggcaacagagaaagatcctgtctcaaaaaaaaaaaataaaatttttaaattaaaaaaaagtggcactatataatgattcgggagttaatctccaagaagatgtaaataacaatccttaatgtgtaggcaactaacaacaaagggtcaaatatgtaaggcaaaaactgagagcagcaaggagaaatagagaaatctgtgtgattattcgaataatactattattggataataatagtattattactattacttcaactcttttggtatcgacagatccagcaggcagaaatcagtaaggacacagttgacttgaacagtgctgtcatcaactggatctaagtgcagtgtgcaaccacaacttggcatccctttggaaggaatactctgtcatgtatgacaacaaccaacacagagagggcctgataatcccaggaggcctagaagtctttacctggaaagctctgccctcctatactgggcagcctcaccattcacttaaacaacagagtttaccacatgccaagttttcttttacatcttttacatacaagaatgcatttataatctatgaaataggtaatattattttctccattttcagatgaggaaaccaaggcacaaaaggctgagtgatttgtctgaggttgcacagctgtgacagtcatgggtcttaaatccacactcaagctccaaagctttggttcttaactactatctgtctagaagtcagagaccttatgttttggggatcaatgacctatctgagcatctaatgtaaaccccaaaccctgtttctgcaaggtgcatacacttaattctgcattccattttaggggttcacagaatccctgaagccaagtgaggacctcaggtcaaaggcctgtcctctaagcagtgggcagcttttgagggtcttgagcaggggagtggcaaatttttgagaagtctggggggatgtgggcagttagcagttgtgcagatgaggctcaccctgcctcttctccacatcacagccagagccattttaaaatcaaaatgagaccagggccagctcacacatccaatgccccctggctcctaaagggcttcttccaggggccacagatccccagggggttcacagctcattagagaagcatctctgacttagataaaatccaagccctagagtgaaaaaagccagttcccagagtacacaccccgtgactcctttatgtaacatacttgaaatcacataaccatggaaatggaaaacacatcagtgggtgcaggggctgagggggtgggtcaggaagggagttggatgtggctataaaaggagaatttgaccatccttgtgatgatagaactgtgctggatcctggctgcatacacaaacctatgccgtataaaattgcatagcactaaaccacacatgcgtacgcaaacacaaaaatgagtacaagtaatcgggaaatcccaataaggtcagtagcttatatcagtgtcagtatcccagctgtgatctgtattacagatttctacaatcttgccctcggggggaacagcatagaagcaggggtcttctgtgatttctttttctttttcttttcttttttttttttttgagatggagtctcactcgttgcccaggctggagtgcagtggtgtgatctcggctcactgcaacctctacctcctagctcaagtgattctcctgcctcagcctccccagtagctgggactacaggcaagccaccatcccaactaatttttgtatttttagtagagatggggtttcatcatactgaccaggctggttcgaactcctgatctcaagtgatctgcccgcctcagcctccaaaagtgctgggattatagcatgagccaccacgcccggcttctctatgatttcttccagctgtgtgtaaatctttaatatctgaaaataaaaagtttaatttaagaaaatgaagaaaagagccaattcccctgctttccctctaacattcccctcctatcccctctccctcttctgcaatcctccattggcctcaccctgggatacactcccagctctcccttttccaagcatttgcaccagaaacacttcagagccttctctgacccccctcaactaatgcgggccctccctgtgacttcttatcacagcacctgtttatgtctgtcccagtacttatcactatctctaatcagattaatgaggttacatgatgaatgtttattttatttcaagatgcagatagcaaagatagctttgactgcaaaatgtttcaacttccctagatttttttttttttttttgagacggaggtttgctctgttccccaactggagagcagtggcgtgatgtcggctcactgcaacctccacctcccgggttcaagcgatcttgtgtctcagcctctcgagtagctggaattacaggtgtgtgccaccacacccaactattttttgtgtttttagtagagacagggtttccccatgttggccaggctggtcttaaaccctgacctcaagtgatccacccgccttggcctccaaagtgctgggattacaggcatgagcactgtgtctggcctagattaaaatatgccataagaaaaagacagaactcaagtgtgttgtccatttttgcattgctataaagaaatatctgagactgagtaatttacaaagaaaagagtttaattggcttatggctctgcaggctgtacaggaagcatagcacccgtatctacttgcttctggggaggcctcagggagcttttattcacggggaaggcaagaggggagcaggcgtcatggtgacagccagggcaagagagaggagggaggtgccgcacacttctaaacaaccagtcttgtgagaactcactcactatggcaaggacagaaccaaaccatgagggacccgtcccatgacccaacatctcccaccaggacccacctccaacactggggatcacatttcaacaaggatttagagaggatgacatcccaactatatcagcaagcaaaagactagaaaaaggtagcatctacattatgaacggttaatggccttaatatatgaagagttcttacaaatcaataagcaaacatccctttaagaaaaataggcaaagaacataaatggttcacaaaagacatattctccatcagatgtgaaatagccacctcaatatactgctagtttttcaagttgggagtatataggtaacctcaaatttaaattatgtatttgtctataaatgcattgtttgcctccctctagagaccacaagccccatgagggcagagctttatgtctgctgtgctcactgctttatcccagtgcctgaaacagtgcctgacacaggcatagcatgtgtacaataaacatatattaaagaatgaatggtttaaaagtcagcaataataggctgggcacagtggctcacgcctgtaatccagcactttgggaggccgaggcaggtggatcacctgaggtcaggagttcaccaacatgtgaaaccccatctctacaaaaatacaaaaattagccgggcatgatggtgggtgcctgtatcccagctactcgggaggctgagaggctgaggcaggagaatcgcttgaacccaagaggcgaggctgcaatgagttgagatcacaccattgcactccagcccgggcaatagagcaaagtctgtctcaaaaaaaaaaaaattcagcaataataaattcaacaatctttttttttttttttttgagatggagcctagctttgtcaccagtctggagtgcagtggcacgatatcagctcatgcaacctccgcgtgggttcaagtgattctcctgcctcagcctcctgagtagctgggacacaggagcacgccatcacacctggctaatttttgtatttttagtagaaacgggatttcacatgttggccaggatggtctcgatctcttgacctcctgatccgcctgcctcagcctccctagtgctgggattacaggcatgagctaccgcacctggcctcaataatcatttttaaacagaaccaggtcccaagcttttgtccatagttaactgtatatgcagtacttattttgtgccggccctgttctaagtacttacaatatattaatcaatttggttctcccaacgaccctatgggtaggtgccattaacattcccattttactgatgagaagactgaggcacaaaaaggctaagcacttgctggtggtcacagaaccataacctaggcattgtcactccaaaatccacgtgttaaggactgtggttgctgacccttgaaatgcagtccccaaaaccctggaactttgtccgggagccccactggcctgagacccattggcctgagacccagagacagcaagtgacaaggcaaggtcacagagttaggaagcagcaaagtcagtgaaggccgcagccaggaaatgagcaaagcatgggcctgggaaaacacgcccgccaccaggagaacacacttgactcacttttttaaaaaactcgggggagattaagtgattaagccttgaaatgtcagaagccagcagcagccggaagcgacccagcaggactcttcccgaacccacagcgggtggcaggggggcagggggcgaggactgggggcgcacagggggcggtacaggccttctgctcttcttccctctgggcagaaacctggcttggaggaggggctggttctgcagacaggatgcaagcacctctgtgacagtggcatgtggagaggaatccagggacagcaggggcctcgggtgggggctggggctttgggccgctgacccctgaaactccacgacagaaactggcctgaaacctcagctcctgtggcgaatcagttagtcatgctacttataagaaaccagcccagagcttcctctggcttctgggaagctgggctgggctggcaggaagctaggcatgcacttcttcctgggacagtaacctaccagaactggggtttccagaaatggcagccacgtcggtggccccactgggatagtaaggcagccaggccagggccccagaatggcccgggatctgcctggttggctccgtccccagcccaccagtgggagggaggggaggcaacagactggctctgcagccaccaggaacacaaatcggcccctccaccaacagcacccaccagcctccctgtgggcctgctgtggctcaaccatcctacccacttgctcaagtacctcacttattctccttctcttttttgctttagagacagggttcattctgtggctagaatgcagtcgcaccgtcacggctcagtgcagccttgaactcctggctcaagtgatcctcctgccttagcctcccaagtagttgtgactacaggcacacaccacatgctcgaataatttttaaatttttgtagagatggggatctctctctgtggcccaagctgagtgctatggcacaatcatagctcactgcaacctcaaactcctggcctcaagcaaacccctgcctcggccttccaacatgctacaggcatgagctgccgtgtccagccatctcctcattattcttgctgtgggtgttttccaagtactgcctatgtgctggctattacagatgcaacaggccattcattcattcattcctttcttcttttaacaaatatttgagcaaggaagaagtgccagagcgttttgagcaaagaagtgacatgatgagactttaaaaaagacctctcttgttgggtggtgggggcacgggtagaagtgggtagcagtgaggaggctaccacactggcccagagagaggtgccagggctcacaccaggctgcggagatggggaggttgagaaggggctgattctagatctgtgttgaagacagagcccacaggatttgctgacaggatggatgctgtgggcgggagagagaacaggaaggctaataggagtcaagaatgattccacagccattggcctttccaagatggcggcctgtgggggtagcccgtgtgacaagccagcctgctgggcaagcgcaggacttcagattagcagaggaggctgttagcaggcgctcagggaagaccctccctctcctagagggtcaggtttctttatcggggatgcaccagagttctctcggggaggggcccacatacagcaggcactcaataagtgagcatgtgtattttattttattcttattttaacagtatacagtgtttccttggtgccagacactggcctaggtgctttaagccctccctatgaataagtataattattaaacccattttatgattctgaaggttctttttttttttttgagaagagtctcactgtgtagtccaggctggagtgcaatggtgggatctcagttcactgcaactctgtctcccaggttcaagtagttctcctgcctcagtctcccgagtagctgggactacagtgcccacaacaacgcccagctaatttttttgtatttttagcagacacagggttttgcctgttggccaagctggtctcaaactcctgacctcaggtgatccacccacctcagcctcccaagtgctgggattacaggcgtgagccactgcgtctggcagattctgaaggttcttatgaagggcggggtgagggagggaatgagggaagacccagcgaataggcaggcaggagggaggcacggcccacttcccaccctacaagcggggcccttggctggagcaagggggagaaggacggctgggatggcagctggaaggttggcaggccagggacaacaccgtctgccaagccatgcagtagactcaaactctgtctctagggcagtggggagccagtgaaggctcttaagcagggaggagcgggctgagctgagagctggcgaagagggggcaggtttgagcctgtttgggagaggaggcagcagggacttggtggcgcttggtggggaaagcaggctggggagagcggggaagagggaaagtggcctcaggctggggtggtggggaggatcccagggacccttcccacgaggagagccgagaagagaagcagatttgctggggaagaccacgcgctccggcgcactgtgacactttgagtccacacagtcaacaggcaactccatccgggatcctggaagccaggccttcttcagaagattccagaggcccaaaggaggaaacagagcctgaggaaactgtgtccagagccacctacccaggaacagcagccagcctggcctccatctttctgcaacctgttatctgctttatttctctgcaatctttgtggcatattgcacactcgggccttatgtgtttggtgtcatatcccctactgcaaggccagctcacacaaggccagtgtcgatcccgctcacagcctctccccagagcctagcacggtgcctggcacacagcaggtgctccatgaatatttgctgatggaagaacgacaggatgaattcccctggctgtgagcagggaggcctggttggtcatcccaattttccacctctccctgctgggcaaacactagcaaatcctggcttggagtcccctaaatgtcctaatgcaggcacagatctcagccacctcggggccctgacctccagagagctgttatcgactatcactcactgtcctgagcagcggacaatggcctcttggcgccagggtgtgattagattttgactgtcttagtgacagctatggctcctagctggcctccttcttgagtctgcagaggtcactgtgactggccacgtgtcccctcttccttcagccatgagaggccagccctgggcccttctgcccttggtttcgcccctccccaactgggtgcaactttgctcacagccttggcattggttgtaccagtctcactaacaaaaaaaagcacttgaaggctgggcgggtggctcctacctgtaatcacagccatttgggaggctgaggcaggtagatcacttgagccaggagttcaagaccagcctgggtaacatggcaagaccccgtctctaccaaaaatacaaaaaaaattgccaggcatggtggcacatgcctgtagtcccagctactaagggagatgagcaggaggatggcttgagcccacgaggtcgcagctgcagtgaactgtgatcatgccactgactccagcctgggcaacagagtgagaccctatctctaaaaaaaaaaaaagaagcccttggcctcactcactcacttaaccatggacccaatccaa

SEQ ID NO: 5086 - DNA, 100000 bp, Homo sapiens
cctgctctagctgagtattttacaatcattgcaaagcactagcatccataaaaaatgctatcttggcatccataaaaatggtattcatggctgggcgtggcagctcacgcctgtaatccagcactttgggaggccgaggtgggcggatcacgaggtcaggaggtcaagaccatctggtaacacggtgaaatcctgcctctactaaaaatgcaaaaaaaaaaaaaaaaaaaaaaaatagccgggcatggtggtgggtgcctgtagtcccagctactcgggaagctgaggcagaagatggcgtgaacccgggaggcggagcttgcagtgagctgagatcacgccactgcactccagctgggcgacagagcgagacttcatctcaaaaaaaagaaaaaaaaaggtattcataaggtcctcgagggatgatgaaatgagtaacttgacaaatctttggggcttgggaaagtctacttacatcacttggggcagggcatgacatagcatatatttgggatacacatgcctgacagccagtcttcatttgaggaatctgggatcaatacatgatccaaatcttggtactgtgggtctgcatttggatttccatgtggatttcatttcggccagggctggagttactgtccctgttatgatggtggtgctggtgacctatggggcatcctaacttccttcccaggcagatgtcccgctgcattggccaacatgtggctccaaaactagacttaaaaaagcataaagatgttccctcattgatggggacaatctgagccatttgtgttttgaaactaattactagcccacctatcaagagctatagtgtgctcctgaatatgtggtcagaatctgttacagttatcacagctattgtccttttcccttgaacaatgctgtagcaaaggcagaaacacccatcttccaatatgtttcccagggcccattacattaactggtgtccacaactttgcctctgtattccaatcattcagctgcagaatcctgaagcatccatcacattttgaggtcccaccaacatattcttccttttctcattttattatggcataaattcattgcaaaagctatgacagaagtgactgtccctgtttatattgctataagggaaatgagtgggtcaaggaccatttgcacaaacagaaagatgaaactgcaaatttattagaaagtataaaaattaaaaaacaaaaccaagcctaaccaaacacaaaaagcaacgacacacaacctttccagtttacattaactttgagcgtcacacatattaaccacttagttgcattttttaaaaatgtcaatttcaaggtagagggagctgagtaggtaataggccagtcatcacagtgtaactaatttaatgctaaaataaaacacggatctatttgagaaaaaaagagatgagactattttctggttggcgtagatttaggcaatgtataaaaagcttcctggttggaatgagttaaaaaatattgctggccactaatgtgccatcttggttggaaaacaaaccccctcccccccaaaaaaaccctgccgctttggtgtcctatttattatttttaaaaacattcattaaaaaaatcaaatctataataaaaatgtccctgtttgtttaaaaaagcattagtaggcatcccttatctactaaaaccatttgtttttcctaagatgctggaagcagaaaagcgagtgagattaactcactgcgcaattaattaaaattagaattcttcctctaaacaacttccagagcaccagaaagaagaaggggccccatcaaagggagaaataagcccttctgactcacaggagatgaaatgttcagccagagttctaacacattctggcttcatcaaaagttctttattggattactcagaaaataactcaagtgctattttaaaaatgaagatacaggcagctaggttcctttccgtttttctttctttctttctttcttttttttttaaacaaaacaaaataccagtggctagcttttctgtaacatcctttggatttggttaaaaaagaaagaaaagtctacagaacaggatcactgaatgccactttagccccacttcctgcggctctgttttaattagcgtcaaacaggttactgaacatttcttcagctgcggaaagaattctgaatgggtgacagctgcccggagtggctctacctggttccattttacccctcatcgtcagtgtggtttcttgccaaacaacacctaacgttttaccccttattcctgcagggagcgggccctgtggctgactggacacagagaaaaaaaagaaaaactagcacaaacatagagctatacacggagggagagaggagtccctctttctgcttccttcaagaacttgataaatataacctcaaagtgcaacaatgcacaaatgtctggcacacaggttagtctggagtgacttttatcacggggctcagcggggcaagggtgtgatctccttttgcatctttctttggacctgttaaaggaaaaacaaaaaaagagacagctttcctatacacatataaatagtcccttaatagaagggaaaaaacaaacacactgtttcaaatgcatttctaaaagatttaaaatagatcaaatggaaaatcttgactccaaattgtctcttgcccatgtgtctcagaggagaaactatgggatgttgggagaggcctgaccctgaccctaactctaactagaggtgctggtattggaccttgggaagaggagcgtgcacagtgcagggagccaggagagcttgctggaggtattgacatggctctcacctgtgatagaaaccagtgtcctcaagtccaaatgcacaggtaaaaagactttgcaagtgttaagggaactttggaggccagtgttgaggctgcatgaatgagcaaacaggctgggtgtgggccacagggacatacagccaggtcagactttgggccaactcaagtaggtcctcattccttggctacgggcaggtcagctgggagggtgacagtccagaaaccagtaagtggctgtagagccagggcaggtgtagggtcttggcagcctgcattttaggagctagaacttggataaactcatgggaggggctccctgcctattttaggatgaggctgatgattatgctgctgaggaaagctctcagaatgagcattcttgggcaaatttctaaagccagaattatacagggtagatggtttcagagtccttcacaaaaccaaaataacgttgcgactgctaagggtgttactcacgtccaaagttttctttggccactgactctgctgaactgggggcacaaataggattgtgcaaagcaggttttgatgctcaaatggaatttttttgggggggtgacatccagtgatggcctcctggttagatcatctaacccaaatccccaaatgctataaggtactacccagcagagagaattgggtccagcgtctcctgcacttctgagcatccaatatagacagaaacattgctctctcccagcctatttcaatactgttttatatgctgtctctccaaagaaacagaataatgtgaaaaatgagggtgtgatctcgggtcccaagggaagagtgaccgacagaaaagacgcacaacagatcatgtcaactgagacgccagaaaaacatctctgaagctgggggaggaggggaatgcagagatagttaatatcccaaactgtaacttgagacaccctacaggtgcttaaagagcttcccatgagcacaaattgttagaatggcaacaagtcagagagattaacccatatggactttggaataactgggacttatacttcttcagtgccctggctggctcagagtccctgggctcagcagtgccctcctgggggccaggctgccccgggctgtgctggtgtcttccacgctcaggaggctgctggctgcctgggagctggcactgttggcactccggaccgggagcggtaggggggcaggtcggcttggttcagagattccgtgtcagaagatagggcggtggaggaaggtcataccacgcaggcctgtgatggggacagcaggggggcagggcaatggagacaggaagagaagagaacacattagggccaagataagccaacttcagccatttctgagacagtgtttccagtgcgaaatgagatttttccctccaagtacaaagacaataattcaaggaccaggaaccacatcggaacagaaaaggccagtgtgttctggctggttgtgttgaccggacggtgccaaaaccacatcctctgggtagaaccagaatgaggtcgcccacaagtccctcggctcaacctgggtggtttggcattgccactctgctccatcagccaaaaccctgtggccaagaggctgggctggtatcttgactgggcctctgatgggaacatggaatggcatttctattgaaagccaactcttcctggctatgaactggggtgagaggacatcctccaacacctcggtctgtatcggcagaaggggcttaaaaggaatgaatttaacagaaaagaattttattttctagctctcatttactgaaggcttctcatgagccaggcactttgccatgcccttacattccttaccttatttaatgctcacaagaatgctgggaggtgggcattacttcatgcctgttgctctggtgaggaaactgaggcacagggacattcaatgtctggcccagctcagaaataactggtaaacagcaatgctgggatttgaacccacgcattctgtttccagatcagcaattttaaccttaccctatgctgggtggtccaaatgaagaggttatgagtgggactttattaggtgaggaaggtcctgaattcttacacttatttgcaaagagatccttaagcccatcctctcccctgacctctgaaactttattcaccttctatgaggaaggaaaacgaagttcaataatgtaagagctgccatggaagagggtccaaggaagagcccagtcaccatcagacacggccagcaaaatgtctaatgccatacacggcagagcttgaggaagagggatgctgtcaggaaacgggcccactgcttgcttcaactacagaactctgcttcctggctttatacaactgggagttcttgtacaattccatttgcaatgtggtactgcttaaaaaagcttgaaaggctcctttccacctcctttattttatagatgaagccaagcaaagttaaggaactcactgttctctcattcattcacttcttcatttatccattcatttgacagatattaaccaaaccttcacatgtactgggcactgctctgcagtagcaggtgaggctcagagctagtctgtggccgaacatggaccagcgtgacattcccaggaggagcaggccaggatcctaactgtatgttctcagacaagtcatttaacatcccagagcctcagtttcctcatctgtagaatttggaaattcctgatttgtgcaactatcaccataatccagttttggaacattcctatcagtttcctcctcagcgaggtgctaagaggattaaatgaggtgatacatgtagagaattttgcgaggaccggcaaatgtcagatgctgccactgcctatagcagctgaagccaggctcttggcaagactaagaacctcagtgtgtgcacctattcccctccccgcaatggatgacctctcccgcctcatctcttccatccagcacacacctctggtccagcaaggcctcggagtaggagggtgggggcctacttccgacgcattctgctccgcctggctggccacatactggatgccattattgagttgtaggtgacgttgcagtggtgggggtggtccaggaccaccaggcgggacagcagcaagggtgctgcagccggtgcacgggcagcgtcatgaggttgttccgcttccgctggtggtcaagaccagtgccagcagggccaccaccagcacaaaaatgacggagctgccgatgatggataggtgatgctggggtaatacacaagttggttctctgaagtcacaaacacctgcccacgccgggttctgagaaacccaagagaggagagaaaagagagaaggttaccagtttggctatctttgtgtttcaacatcagccccagaacttgcatgcgaatgttcacagtagccctattacaatagccaaaaagtggaaaccgcccaaatgtccaccaaccgatgaacggataaacaaacgtggtacatccacccaaaggaatattattcagccataaaaagttaataaatactgatcatgctactgcatggatggacctcaaaaacatgatgcagtgaactaagccagacacaaagatcacatattgtaagattctgtatatacaaaatttccaggaaaggcaattttacagagcagaaagtagattagtggttgcctggagtgggaaagagaatggggattaacagtcaatggtatgaggaatcttgttggggtgacgggaatgtcccgaaactggtttatggtgatggttcacaaattggtaaatttcccccccgcaaaatcactgaactgtaaacttaaaatgggcaattttaagtactgcaaataatatctcaattaagttgttttaaaaagtatcatatgctatcagggaacaggagtgagagttcttgtagcagaaatccgttctttagtagaaatgtataaccacctcaggaacacaggtagtacctctggggtcctcatacctgcaaatcatttatttcagccaggcttcacatggagcttttgggatggagagccagcacagcccaggctaacagcagaactcctgggctcaaatcccagcccctcaaaacttgcttgctgtgtgccctttggaagtttaccctctctgggctgcaaaatggagatgtaatagtgcccagttcttggggcttctgtagcctgaaatgagtcaatactcatcaggcccctgaacatagctatacgttatgctctgtagtgcatgtgttcggtacatacaagtacatgattcattatttatttatttatttatttattatttgagacagggtctcgctctgtcacccaggctggagtgcagtggcacaatctcgggcactcaacctccgcctcctgggttcaagcaattctctcacctcagcctcccaagtagcgggactacaggtgtgtgccaccatgctcagctacttttagtgttttagagatggggtttaaccatgttggccaggctggtctcgaactcttgacctcaagtgatccaactgcctcggctcccaaagtgctgggattacaggcgtgagccactgtgcctggccaagtacatgctttattcacatctctctgcctcataacaactccatggggtaggtggtgtgattctcctttttttttaagatgaagaaaatgaagctcagagaagtcagttcccctgaccaaggccacacagttggaggtaaggagttgtgcgtgagttgagtccaggggtctgacttcagaacctggccccacgttctgctctacatcacccgaataagacctgccaggcaatctgcaggcacttcctcggagttccagggtgaaggtctggtacacatcccacccctgcaggttgctatcataatagcctctctccacacatgctaaggagccatacttcaagcacccaggtaaggagcttcccagtcgcaggacacacctggctaccactgtaaggtccaggcaggtggaggaaaccaggggtccggctggggacccctcatctttacagagagctgccactacctactgtcatggcctagctggagaataatctaaatgcagctcaagtgagtaaacttggtggccaagaccctgtccttgtttgcctgtgaggcagtgaggaggtttcagtgggtccacaggggtcaaaatgtagccatgaatagcagcagtggcagcgactacaggtgactcatgtcctctgtcctggcatcggctaaggctttactccatccctcatcactaggtgtgcgtctgttttgttcactgctgtatccccaagagtaggatggtgcctggcacatagtaggcactcaataaatacctgccactcaatgggaaaaaatctgtttattcacatgccctagtaaaatgagtgctgttgttattgctatttttagataagcaaattgactcagagaggtgaattattttgtctaacatcacctaagaaggagcagaggaacaggactagaatctagatgtttctccttcaaaaaaccacaaacctgcgaaaacattgacttctcttcttttctgatataaacattttctgattccccaaatgatcccaattgagacaaatgaggaccttccccttcaaggtccggctctgtgtgttaatttgtctctccgccacacccaaacacagactaaaagctacaaagattctccaagtccgtggtggtcactcttcaatgattcattgcacagaaagaagcaaataggggcccagcagaaaaacagaatcatctgcactacaattaagggagggaggcaattttggattttttctggagacaattagctgtattcaaggattctactggagttttgtctgttctcagtgagacaattagaagctgggtggggcttgtgtatgtgtatgtttcagaattctggcttaaactaaaataacttctttattttttatctagcagggagagctgtagagttaggagccttgggggaatcctggagccactgctctagctgtttgagctcaagtgagtcacttaactcttagaagcctcaccctcctcgtctggaaatggtggtggtcctgggtaaacaacagtatccgtgtctccctggactatccagatgtagagtataacatatacacaagtgctgagcacagtgcctggcaagggtttgcctcagtctgctagttctttcttgtaacaaccaccactacaacaaaataataattattattatataatatataatatataattatataataatgataaaatagacataacataaaatttaccactgaaccattttaaagtgcacagttcagtggcgcttaacattcatacacattattaacgttccacatgttatagtgcatccatcaccactatccagctccagaatttttcatcatccctcataatgaacactagattttagtgttgctgttcttaccattatcctcaccaacttctcgcactgggggtagaaagctgggggagccacctctgggggatggggctggggagaagatatgacagactgagttccattccagtgagatgtattttttttattttttattcctttttaatgttaatatgtattttttgagacaaggtatcactctgttgcccaagctggagtgcagtggcggatcttggttcaacagcttcaacctcctgggctcgagccaccttcccgtctcagtggctggactacaagggtgcgtcacacaacctagctaatgtttgcatattttgtaaagacggagctccctatgttgcccaggctggtcttgaactcctgggctcaagtaatctatccatctctccttccaaagtgttgggattacaggcgtgagtcaccactcctggccagtgaaatgtattcttaaaggaggaaagtgggtaaactgtcacacagaaaacaaatggtccagagattttaaacgctgacttctgtgtaaacacgtgaggttttaagaatacaagtgggagccctttaaaagcatgggatataaaatgcctgtggaacttaatgggctcacttatgtctccgaaagcaggtctcttcagacctctcttcactttggcaggcgagacgcagcgatcacatttgcctgagaattatgatgttgcataactcagtggtgcctgctctcgtttttgctgtgtgtaaaatgtctcttgtgttaattcattaactaggcccacttttcttaagagcttaatgagcctgctggcaaattactaatatcagagttgcctaggacctaagttccaagtgcataatccatggataagaagtttccatttattctggctgtccctcaagctaatgcccttgtgctccactgtcaagatcttgaattcttgtcctgtacgtgccgcttcgactgtactaattccaggcaatctggtactacctagaaactgctgttctatcaagactgccagtagctccacagctgcctgtggagagcaggctgtgttttgtacaactccaggggtgctcttcacctcaaagtcattacatattgtttagttatcacgacagccttctagcagatggcagccaagtgtcttgaggaggagtactttaactaattcactcagaggtgctgtctggaccagcaaaggcactcaagcagctgacattgtgacttggtgttctttcacttccaaaaaaatcccctcctccagatgcaaattaaattcctaccggataccatttttcgcctatcagattggcagaagcaaagtttgagctcatatctgctggccaggtctcaggcaaacaggtatattcgtgcctggtatatatgcaggcatggtagtgggagggtaagtcagtaccaacccagggtggtggaggagctaataatatatattatataaaaatgtgcatattctttgagattggccaggcatggtgactcatatctgtaaaccagctctttgggaggtgaaagtaggggggatggcttgagtccaggagctcgagaccagccgggcaacatagggagaccctgtctctgcaaaaaataaaaatgtaataatttagtaaattgctgggcgtagtggcatgtgcctgtagtcccagctactcaggaggctaagaaggaagattcttgaacccaggagtttgaggctgcagcgagctatgaccatgccactatgctccagccgagtgacagagcgagaccctgtctctaaaaaaccaacaaacaaaatgagcattcatgaagcatggttcataacagcaagatatatcagaaacaatccaaatgtttatcagttgcagccggctaaataaattatggtgtatccgtacaatcttgtacctatttttaaaattagggaactctacatatactgatatggaaccatgagaaggatatataaataaggggaaaaaagcaaattcagtagagaatgtatagaatatatctggaaagacacaatataaccagtaacactggggcttccaggaaggggaatagatgcttgtggagagggagatttactttttattgtttactcttcctactttgtagcatttgttctgtattatctattaaaaaaataagcactctgtcttttcctttaagacttgcccaggctgatggtgcatctcagtttctttatttttatttttagcataaggtcttgctatgctgcccaggctggtcttgaactcttaggctcaagcgatcctgcacctaagcctctgagtagctgggattgcagcatgtgccactgcacctggctcagttccttattgtttcctgtccttctctccctgtaggtgcttcttggggttcaggcctcactgttcatgctcacttggagaccccttactgactcatgagtccctgaggacagcttccaatgccccagcctgacctcttttttttttttgagatggagtctcactctgtctcccaggctggaggcagtggcacaatcttggctactgcacgatcttggctcactgcaacctccacctcctggttcaagtgattctcctgcctcagcctcacgagtaactgggattataagcgcatgacaccaccatgcctggctaattttatatacttagtagagatggggtttcactatgatggccaggcagtcttgaactcctgacctcaagtgatccacccacctcagcatcccaaagtgctgggatacaggtgtgagccaccgtgcctggcccagcctgacctcctaagtccagaattcctgtttggaatattcattgcccttcaaactgactcttcctcatccctttgaaaaactcctacctgcaatttttttagaagtattttttttcagtttgttcttcctccagattatatattttaaagttagatttattgaggtacaccttaggcataataaaatttgccctttaaaaatgtgccttagatgaattctgacaaaatgaaacagtcacatgtcctcttccacaatcaagatatagccctttccatccccacgaaaggtattttgtgcttcttgtggtcaatcttctcccctcatccaagcctctggaaaccaggggtctgttttctgtccaaatagattcacttttttccggaagccatataagtggaatcctacagtatgcagtatcctacagtatgtaaaaacaaattttacatagtcctttgcatcaattctttcttaatggtttgtgttttttatattctattccattgacttctttcactcagcacactgcttttgagattcatccatgtttctttgagtgttaaatttcattcctttttgtccctgagtagtattcagttgcatggatgtatcacaatttgatccccagatgagggagggtactgggctgttcccagtttcaggaatgctggtctttgtgctacatatattttcatatttcttgggcatacatagggctgagagatttctgggtcatatggaagcatatgtttaactttagaagaaattgtcccactgttctccaaagttgctatagcattcccatccccaccagcagcaatgtatgaaactgtcagtcatcctgtgtcctcaccagcattagtaataccagtctttttaattttagccatcttaataggtatttagtggtatcttatgataccacttaaaacctcttattgaggttttaattagcatttcctaatgactaatgatggagcatctgttcatgtactgatttgccacagcttatcttctttaatgaagtgtttattcaatcttttgcccatttttaaattggtttgacattattattggatagtaagagcattttaatgttctgtgacatagtattttatcacaaatgtgttttgcaaatattttctcctagtcttggcttatcttttcattttctttacagtgtcttaaaaagagctttttggtattttctttttaagactagtcaatgaagaaaacgtttcaaaacaaatttttatatagtcatttgcatcattccttcttaatggtttgtgtttttctatattcgattcaaggaatcttcccctaaatcttgtttagaagaagtcttatagctttagcttctacatttatgtctatgatccacagcaattaatttttgtttatggtgcaaggtaaaggtcaaggttcttttcatctccccatttagcttccaatttttctaacaccatttgttgaaaagcctatcctctcttattgaattaccttgcacctttgttgaaaatcaattgaccatacaagtctgagtctattcttagactatctatttgtatgattgagctatacaactatctttatgccaataagggtgttgttaactacagcttatagttaagtctcgaaatgaggtagtgtgtcttgcacgcctttttcccccttccaaaataactttatttctgattataaaaatccatgttcattatttaaaaaaaaataatatagaaaattcaaggcagacaaaatgtcccctcctctcccctaaacctattaggattctactagactggtttacagtttggtatagaccatgagctggcaaacttttactgtcaaggaccagatataaatattttatgctttgtgagctacacaagtagataaaagctgtcatggacaatatgtaatgaatgaatgtggccgtgtcccagacaaactttatttacaaaaacaggtagcaggtcgatttggcccactggccatagtttgctgtctacccacagcatagatctttgaaaactgcccctatgcttgtacacacacgtacttttcttcatgttatatggatacttcagcatgtggcatctttccttggctcccacacctttgtgaaagaacagccacatagtatcccactataggataaactacagtttatttagccaaacctctattgaagtacctttaggttgctccccattttgctattacaaacaatgctacaataccattcaggcagacagtgagggtcatgaggggggggccagtgatctttggtcactgatgcaattatttctttggatgaattcctagatgctgatgtttacctggccatctggtctgccaggtttgaaaacttggggttgtcttgaacatttcctttttctctgtccacatcaagcaaccaagtatggtcaatttctactgtgctgtgttctccagcctcttaacctcacgtccattctcatggccacatccaggcccaggccaggaagaaacctccgtgagagtcttgccacctgtagcctcttcggactctagtctttttgcaatatcccacaagtctgaacattacccaggactgtgttgctgtgtaattcttgtagaattcttagatcaaggaacctcagtggctcacatcaccctgtttggcctgtcgttcacagacagcatgttccctgtgattaatttcccagcatcaacccccagaagggcatggggaaaagtccaggttggaatgaggaacaccatttgccttgtgacatgtcctcattcctgatttgaactaaaaatgatactaataatactaacaaccatcaccaccatgcatatttactttgaactcaaaacaagagtaaacataatatcatcaccataattatcctggcagctcttaccctattctcataatatctgatgtgttttacacattctaacacttttaatccttgcaccatctgtattgagtgagtagtgtccctccaaaggtatgtccacccagaacctcagaatgtgaccttatttggaaaagggtctttgcagatataattaaggtaagagtttcaagatgagctcattctgaattgagagagctttagatccaatgatgagtgtctttatgagagacagagaaggagatgacacgaaacagacaagggcaaaggccatgcgaagttgaaggcagaaactggaatcatgcagcccaaccaagccaaggaacaccaagaattgccagcggccccagaagctaggaatgaggcatgaacagactctccctcagagcctccagaaagaacaaaccctgccagtaccttcaatttgacttctggcctccagaactgtgagagaataaatttctgttgtttcaaagccaagtttgtgtcatttgttatggcagccctagcaaacgaatacaccctcctatgaagtagaccgtttccaggtgaggaaatgggaacacaggttaaggaacttgcccaaatactccctatacctgagaattattaatagctattatcagagctagctagtagagaaaccaagaggaacccaggaagctagttccagcatctgtactcttagcccaaagctttatttcattttacatatgtggctacttaccattaagttctcggtgggcaaagaccaggcttgctccttcttggaaccccactcgggctcaccacaatctgggaaatacaacaggtactccacagtgttttttgatattggtaactaactctgaaacatgtcaacatggtaattcacaatttcttcacttacagacagagtcaaactacaggaaagcaaacatttcaagaagaaaatgaggataacctagatgctgagcaggagcactgaacctctttcttctactcttcctttgatatacacaatttcccttcttctttcaacaatcctgtgaagtgtgccattttattaacagagaggttaagtaacttacagaaggcatagagcaaacaagtggtacaactagtctttgggtgcaggagtctgaagtcagaatccttgcgctatcctgaatacttctctctgctccctcctctcctctgtcccatttatcctgacatctgtcacctcactgtactgttcttgcaatggggtccctttccagtaacttcaatgatactcaatcttagagtctgatcaatatactggaagtgtcttctgtgggatggcaagaggatttcatgaaaaagagtaccttggtcaaacaggtgtgacaacgactggattagacaagtaaaccccttcccccctccttttttgtagctgtttggagggaaggtacagagatcaaacttctagattcaaacctcagccgtgtcactcactagctgtatggactaggaaaagttacttgcctctctgtgtctcaaaatcctcacctttaaaatgggataatagaacccaccccctaggttattttttggataaaaagggaaaatatgtatagaaatgtttaaagtggtgtctggcaaaagtagcatttgacaaaacttttagttattatcaatagctattattacaagacttgtcgagcctttactaggcaaatgtccactgtgactcttcatgaaaggatgtgattatttcctaacctcagtgctaggctgagatggacagaacatacaccatattccaaatatgtgcattccaacattctagaagatatcttctcacaaatcagaaaggggaatccctggcctttgggcagctgttggaggaagctctgggttgcagctgccgatggaagaagatgaagctgagagacactatcttagccccatcctctcttctcgtgatacagtgaggcccaggtcccaggccacatagttaaggttcggcatcatcatcactgatggccaagcactgggagcagctcctgagcataagtgagagatgccactgtgggggctgtatgacactctgccgcgtcttacatttgtcaaaactgagcatgcaggagctgatgctgcagaaattcacaaggagtccaaaggctgccctgttctgttcttgggatctgcgagtttgtcacggccccttgcataatcagttcatcggtgcactcctgcctgtgaaactttattacccggggaaatgctgagtgtgcacacttggagcttagagtgcagaaaactttctgagtaatttaggggaacgggctgatacagaatcactgtaacagggctcccaagggggagctttatccaccatgaacaaattcatggcttcttgagatttagatctgaacacaacgaccctgacccaacaagctccagcatcttggagggcagggctgtcgttttgcacacactgggttcttgttctccagacactgggctcttgggctccagtcccatgcaggcaggatgagcatgcccgaaaggggagcacaagacatatccgatgccaaacgggctctgcacaccagcctcaaccaatccccagtcctggtgcctgtgcttcataatctccctttcccagccactgtcccttccacctgcctccactctggctccccgtagtgtcttttccaatggctgcagggtgctccttctaaaaacattcatctgttcatgtcactcctcagctcaaaccttccagtggcttctcatgtactcagaataaagtccaaagtccttaacatggcctccggccctgaataatctcatccccgttgctactctgacttccactcctgctcctccctggcgctgctgcagacccgttggcctccttgatgtggttctggaacacacccagcatgcacctctacagggcccttgccgtctgcttagcacgaccttccagggcatccgcatcactcacaatccattcaagactctactcctttctggcccaccgacatcactctccatccccccacccactcgtctaccttcacagcactgttactgcctgtcattgtacattctatttgtatttaatgtctctctttcctactggaatagaactccctgagggcagaactgaattctgcttgctcaccctgaatccccaaagctccaaatagtaaaaatttgctgggagaagccggcagagtgtcctaactctgtggccctgtgaagtcttggcttgtgcatctttcctatgagactccatgcctcatggccatcattccattcagcctcacaggtgagaaaaagaagactgagagaagtgagtcatttgccccaggtcacacagccaggaagtgattgagctgagacacgagcccaggtcttctggccaacacccagagatgacacatggtatgagggcaggtcccactcaaccagttttccggtgatctgttttggggaagggaaaaccacccttgtggctgaaatattcacactgttttgatgggcactggctgagctcaagatttatagagaaaacacatgttcactgtacaaaacagtctcatccttctagaatcttccttctcacaaatgaggtgggatcaatgtaacccttcccagaatcatctagagatccaccaactcgcaggaccaaaagtgtggggccagtgcaggagactcctctcccaaagtggccaagatggtgccttgacatagtcactccaggccaacccgcagactggacctgggtctgcccccactcacagcccttccaggacttcttatttgccaaggtcaagtcccacgccctcatcatgaaggtcaaagctcttcacccccactttctccccatctcctctctctcactgcctccttctctagccagccacgcctagaacaacttgcctgacagtgcctaaatcctgtcaacgctgggccccacagccttctggtttaaaagaggcaactgaagcatttaatgaagggacagcgggattaaaattgggactgtaaaatcaggatgaacaattgtacctgccacaaagtttagatgaacactgaagactgttttaaatttgagccgagtgagcgactgtgagcttgcttctgtagtttccttttacctggacgaagagtctgacccttccactagattaaaacgggccttgggagtgctgaatggcagagaagagaaaacgctgctgaagggaggcagggagaacagttgggattcacaggggcacagagcctccaagctgtgatgcatggaggggagtctggctgggtccacaattcattcgtccacttggagagcccagatcctgctgggccctgtgctcaggtgcggggagcaggcctgaccccaatggcactcccagggtggagcggccctgggggtcccatttcactcctgcatgcctcctaccatggcctctgccacatggcagccacactttctcaagcctggaagcatcaagggattgtctgggccactgtaaacaagggcatccccacatccaccctgactttcctgtctaaaaaaagcatcccatggggctgagcgcctttgcggatccctattccaagcacatcacccatcccaatttagatgcggattgaaaagtttaatttaaagggcagaccagcaaatgactgaatcaaaagagagccatgaaaacccgctgaaccattaccatggcaactcaagttgctaaaattaactgaaaagagggtgatggaaaactggagctgcgcaacctcagaccggccacagcaggggccatcctggccccaagcagagggaaatgagagaggagacccatctgccaggatgctgggaaccaggaccattgaggctgggagacaagtgcccgaggattaaattcaaaatgagagggagggaaagcaaggggaggggagtggaagaggaacagggagggagagagggagggagcgagggggagagaaagagagggtgggggagagagagacagagagagaagaaagttctaaactgaagaccgaatgaagtgacacttccctggaaattttcagtcattcttattccaaaagactgcagaggttttctattgcctaaccactgccatcctttgggcaaatgggagcagggagtctccctgaaagctgcatccatcctttcaataagtgctactgaacagccaactggtatcaatggcccctaatttctagctgttcaccccagagagtttcttagaatggaggaaagcccccagcagtcccagagcttttgaagcctgctaagagctgctgtacaccctcagaatttgatctctgtgtctgatgagaagggcccagtgataagccagggagtcgggtggctaatggcctctttgctaagacacagctcagggcagttgcagaactggttggagggtaaggcatttaattggctgtttaagatagaaagggcttttttttttttttgagacagggtctcactctgttgcccaggctagagtgcatggcattttttaagtaggaattcagattgccactaaaactcagtgagagggtaattggggctagggcccaggtggcctttttagaactctgctcaattgtgtcattgcttcagaaatgcaacagaagaatgcagtgaaaatgaggggtaggagttctttgctacctctcctactgcagccacaaaagcagcagaagccaatgagagacagcacgggaagggggtgggacttggtaagagctcatgcacctgcaccgggatcaatctaatcattctacccatccaaagggaaaccttgaggcatctgtctcctctgcatcgagtggcttcgccagatccagattcctatatatgaatcctgggctgctcctgcaggccacatctggaaatgactatccatgcctctggaatttgtgaataaggaaggctctaaagaactactatttctattgcttactgtagctatttacctgagtgtttggtggaagccgcaaaattaaatgcttagcagacattctttgaactcaatggtagttggtttctggtccagtaataaggcttggccaattacaatacaatagtttattgagctgccgagtcagcagccagagcgaatactgctaactcaagcaggatgcagggagcggagagctttgatcagtttgtgagtgtggtgtaatcacacacaaatagcattgcagggaaaagcaaccctaaaaactggagagagaaaaatctacttcaggcaggccattgttgcaaataaaactcacttgtgggagttgggaaagcaagtatcatcattaaatagcaattacaatcctgggcagggaccccaggcagtcactggagctgcaggcctcagtgttaaacctggttccttccttccttttccattcatgtccaactcaggggcaggtcctgctgattctgcttccataatatggacaagttaccatcatctgttgcatggattaccatgtgaacctctacttggtctcccatttctgatcttgcccctctccaatccattttccacacagcacctagaaagctcgttttagaaataaataagaccatggtatgtttcctgctttatattcccaccaagcattgctcacttactggaaatacaaactcctagcaatggtttagacatatgatctctacaagaggcccttgctcttctacaacctgcctgttagcatcctgtgttctagctcaggggtcagtccagcctctgtctgctttcatagataaagttttattggtacacagccattcccattcattatgtatatctatggctgctttcatgctacaatggcagagttgcatagttgagacagtgactctaggcccatcaagcctaaaatacaaactgacccaagaagggctaatgttaattccttgaggaaccaatactacaatgaaccatgagcttagagatgcacagcttttattcagcttatagtcctttgggaagttactctaatacacaaaatgcggcaatcagcatgaggtaactataactgtgtagaaaataaatggagaaatgaagaaatcaaggaagaaatcaagcacacccctctccgctatccctccattagctcttttgctttttgttatctgtagaagtaagctactgaaatgtcctacaggaaatggcaaacttggtctcaatcttggctatgaaatacctgaacagttaaaatctatctgttcttgccaccaccacctccctgggtggttgagcaatactgcctgcctggcaatcctgtcttctgagaggtacttggatgtctcatatttatacttcttgaaatgaagcttggtggagcatttgaatgttctttaagacaaggtgctggaggctctattccaacaccgtgggcctcctgggcagtgggtcactgaacccggttgttccataatagatgaataactaagggtctcgggctgtggaggattcaaagttactcattcaattctataaagaggaaataaaaccaagtatccctgggccgctttagaatccctgttgaaagccctcgaaacacctaagaagactggagagctcagacaagcattttaaacattaatggggctgtgtttaaaacaagaagtgaagaaatcaaagtcttctgttgccaacagagggcccaagctggcctccttaggaagggaataaaaggacctacaccgtctgatgtgatacaaagatgaatcccacggagggcaggagcagaatgaattcactcattcatcctacatttcctagcacctactaagggccagccaggtgccagaagattctgagccactgttatggggcatgagttattggggaatggatggggactctgggaacctcaggattaccatggctaagattatttaaaatatattttttgaataggaaaatatgcatgattcaaaattcaaaaagtaagaaaggatttgcagacaaaaataagtcgtttcatgtatctctctcctagccatgggcttcccctccccagaggcaacccttggcaccatttattttgttcagtttcttttttgtgaagccttccaggaatagtacaggcatatatagcacatatctatggttttaacatgcatggttacaccctgatttttttacttaattaagacatcaatacatacttttaaccaattaccattttgtctatttaataaatacctatacagactttctatatgctaggttctccttttttaaaatttaattttttatttggagataagttagacatacacaagagttgcaaaaatagtacagtttggccaggcatggtggttcacaccttaatcccagcactttgggaggccgaggcaggtggatcacgaggtcagtagttcgagaccgcctgaccaacatggtgaaaccctgtctctactaaaaatacaaaaattagccaggcatgtggcatgcgcctgtaatcccagctactcaggaggctgaggcaagagaattgcttgaaccgggaggcgaaggttgcagtgagccgagatcacaccattgcactccagcctgggtgacaggcgagactcagtctcaaaaaaaaaaaaaaaaaaaaaaaagtacagtttctgcaaatcctcatctaggttcccctagtgatgatccctttcctaaccacagaacaactgctaaaactgattaaccttggaacaactgtattaactaagttaatagaattgattcaaattttgccaggacccacatggcattgatctcctctaatcggtgacagtttctcagtctttccttgttcttctgactttaatactgtgaagaggatcgagaagttattttgtagaatgtccctcaatttggtttttctgatgtagtttcacaattgtgagaatatatattattgaaaagagtatcagagctattcagtgtatcccatcaggggatacctgaaatgcattcactgatgatgttaactttgtcactttatctgccaggattcttcactgcaaagttactatttctgtctttgtagtcaataatattttgggggagattctttgaaactatgcaaatatcctgtttctgcttaaactttccccactaattttagcattcatcatggactttgcctgctgcctgcagcaaatattactgtttgttctcatggtgttttttcccccctatttccttgattccttctacatttcaataattcaatttttctataaggaagatttgctttctccaatttatttattaattatttatttactcagatggacttgttatttaagctactctctgagttataaaacccaatattatttgaatggttccctccaaaatacaagtactgccaatgtaatggtactgaagggtgaggcatttaaggcgatcaggccaggaaggctctctcctcaggaatgggattggggcacttacggaaggggatcatgcaatgtttggctagctgcccttcggccacctggggacacagtgattgtcatcgtagaggatgcagcaatagggtagtatcttagaagcagagagcagccctcgctagatggcgaacctgctcgcgccttgatcttgaacttcccaggctccagaactgtgtgaaacaaattctgttctttatagatgattcagtctcaggtattttgtcacaccagcacaaaacaaaggcttattatttattttgttgctcaggttgtttcacctttggccacggggaacactttcaggtggctcccgcatcctttcaatgcacctccatgttcttatttttttgttgtttggtttggggctacttgtttactttctgggagaagatgcttcgggctcatcttgtatttcccagcccaggcctagaatcaactctaactcttcttaatagctgcatagtgagtgtgccatttgtgggatgtagaaatgatttatttataaccaggatctatctatttccaaacttttctattatatcttttatgataaaaatcctcgtaggtgggctgtttcatacataagcagttgttaaagtaaacctaagcatttacaaagacctaggaggccctctctgagcagcccccgtgttctctcctgccctcgctccagatgttctattcccttccccagtgtggtggacaacctctgaggcactcctccaatgcctgccttttgagattcatgcccttttgtgatccctttcccgtgagtttggttggacttatttctcacttttttttttgagacatgatctcactgtggatacaagccttcaatagcccttcacactccaacacccaggctggagtgcagtggcacaatcatggcttctgcagcttcagccttccagccttaggtgatcctcctgcctcagcctcctgagtagctggaccccaggtgcatgccaccatgccggctaattttaaaaattatttttagagacagggttccttatgctgcccaggctgatcttgaactccctctgtttcccaaagtgttgggtttatggtgggaaaaaccacacccagccatttctcatttctaattaatgaaagatgatggaaatagatgtcacttccaataccaggttatcaaaggactgtggtttccgttccatcttagctactgctcttgatcattttctcgtttgcttgctctaagaaccatgatgtgagctgccctatgagaagtccacgtgcccaggaacagagggaggcctccagcaaacagatagccagtgaggactgaggctctcattccagcaacccacaaggaacggaaaccccctagttgaaacttcagtgagaccacagttccagcagacagaagaagtgcaatcacatgagagatcctaagccagaaaactcgtgtacaaaaagtagaatcagggtcgggtgcagtggttcatgcctgtaatcccgcactttgggaggccaaggtgggtgtatcacgaggtcaagagtttgagaccagcctggcaacatggtgaaaacccgtctctactaaaaatacagaaattacccgggcttggtggcggggcgcctgtaatccagctactcgtgaggctgaggcaggagaattgcttgaacccaggaggagaggttgaagtgagccaagatcgcactactgtactctagcctgggtgacagagcaggatccatctcaaaaaaaaaaaaaaaaaagtaaaatcaacaagtcttgctagtgacagggcttacaggtaaatcattctagaggtgcttccttcctaggactgacgctctcttgacctcgttaagagcctgatgctctcttggccaacatgacctcctgttcacatctggccagccttcagattcaaatggccactaagccactttctccttgacttctcccctgagttccctaactagaataaccacgctctgcctctgcctcccactgtgctttacctgacccatgtcatggcacacttactctctcccacgttgtagagttacggacatagctagtcttccgtaaagcaaacataaacttgtcaagggctggattctcctctcagtcatgtttataacccatccctctcactgtaagcacttagctcagccttgcacatatatattagtattctaaaatatctgtaaagctatatgtagtaataagccttaaatgatgggttcaggaccaacaggcagccccagcacctacgcatacagtattaactcttagaagcattattatcaccactcgatatttcaagaatgaattttgcttctctaacaaggatgtaattttctcgactcttcatgattttcctctccaattttgaatttctaagttgagaagaaataagaaataactccagaccaaaagttgagggcctctgcttaattctgctattttcatacatcaagtgcttcttctggtgatacttccacccagagaacaaggagacaccgctgttaacaccaacggaaaatctgtactggagacccagggagcagaacttccaggcaggagcataaacaagattcatgtcaattaatattctactcatcgctttgagcatttgctggccaccctatcattgccggcaaagctcctcttgtaacagtatctattccaattgcactaattgaacacacaaatgagggagataaagggagactcagctaattgtttttttcattggcttccgaggagaaaaacccataatcagtcataattacaaacttccctgtggtctcagcagcacaggccccaaatggagctattctgaggcatcttgcttgatggcaacaacagctcttaaacccttttttgatctgtaaagactttgggggaataacaggagatgtgtggaccttcttgcttccttctgcttacatccctcaacttcacaccttcagctaaagaactgtcatctgtggcatctccaccattatcaattctctctgtggataaaagtccttcaaagcccttcatcagggacaccaagacaatgacagggctgtgtgaagccggtgactgtcctctccttggaattcacttttcaagacgcagaggggagcacgaaaagagccacaatactggcttttcctctaggaagagaaagctgtaagctgccttggggcattcataatgatgacagtaaatgtggggtaagctcagctaaaggcaggaatcccccggccccacggagaacacagaaggctttgttgccttaatctgtcctaaattcgtaggtttctgttaccattaagaataaggaaaaccaaaatgaacagaacatggcgctggagtcccagctgagcttggaaactataaatttagtttcctcttagtttcaagtcacttataaatgaagaggaggaagaacctgggaaccgaggggaagatgggggctgtgcattagggcgggggcaagaataggcggctccagcctgtgtcataggtgctcaagggacttctgcagaacaagtgccaatgtgacaacccaagtgacttctggcaggagacaggaatgtccaaatactgaaatgatagcttaggaaaactttgcaaattaagaaccagaggaaaactgaaaccattaaagaagaaactccaggccggcactgtggccacgcctgtaatcccagcactctgggaagccgaggcaggtggattacctgaagtcaggattcaagaccagcctggccaacatagtgaaaccctgtctctactaaaaatacaaaaaattgcagggcgtggtggtgggtgcctgtaatctcagctactcaggaggctgaggcagcagaacgcttaaacccgggaggtggaggttgcaatgagcagccattgcactccaacctggatgaaagagcaagacttcatctcaaaaaaaaaaaaagaaagagagagaaactccaatgacatcagaaaaacccaacatgccaaagaagagcacgagttgtctaagtgtaggagggacatgggggagaagaaggaccaagcctggaactgtttggccactggttggctcgtttttccactttggccaactacttaccttctttgtacctcagtttcctggtctctttatgctgccccggattagcaggaagagatggcttggacctgacccccttgctatgccatatttatgacaaggggtacccaggatgttctgcccagagcctccgattttcctctgacatgcacattgtaaaatgttctgtctcacttcaccaagtttgcccataaatacattcagcccccaaattgctttaacacagaagaaggaaattgcttcacttggcaaaaggttctccccgggtcagctaatggcagctggtatgtacgtctgtgatggattttttttttttttaaactaaaagccattgtgcttatgagaattggaaaagtgccgttgaaccagcattcactggggcccatcctggcccctctgtgagctgtaactgccttcagaaatcacacactattccagaaagtaacagctgacctcaaaagtgtgcttcccaaaccaaagaaagtcactagctgagatgttgtgacctaacagtgaagggcaagggtggagaagccttctggggttatgcatttggaaatgagaagctcagacaaatgctccatgttaaataaaaacaagaccccgtaatcattacagtgagggacaatctacactctttaactctttgctgtggagattctagaaagttctttgcaagtatccaaatatcatccatgtgccgcctggggaaattttccaagatgtccaacactcgcactccggctcttaccacagtgagcaaaattaaagactgcctttgttgggccaggttttcctacctgttggatggggcccatggacattaaaaaggagttgagacgatgatgcactgacatccaacacagaccacgactctggaggctgacagacccatgtctgaatcctggctctacgatttattggctttgcactgtggcaagttacttaaactcctgagcctgttttcctcatctgtaaaatgaaggatagagcatgcatctcatgaggtgtttgtgaagatcagacatggtcgttataaagtatgtagacagggctggacgcgggggctcacacctgtaatctcagcacttttggaggctgagatggaggatcgcttgaggccaggagttcaaggtcacggtgaactatgattgcactaccgtactcagcctgggcaacacagtgagacactgtctctataaaaaatttaaaaatttgctgggcaggtggcatgctcctgtaaacctagctactcaggaggctaaggagggaggatcgcttgagccaggagtttgaggtcacagtgtgctatgacggcaccattgcactccagcctgggcgacgagcaagactctgtctcttaagacaaataaaaacacataattaaataagtatgtagcacgtgcctggcaaacagtctaaggggtcattaaatatttgcagctgctgctgccagtgccacatcacatccccctccgccgtgtccttcttcctagctccctgtcagggtctgactttacgacttaggtgcccctgggacatctatctgtagtatgaaggtgaccttggaaaaacaaggagatgcatgaattccatctacagcctaaactggggacttacaataatttccttcttttttcaagttgaagaaaaatgaaaagtggggacttacaataatttccttctttttctcaagtggagaaaaatgatagtgaatgagtggcacacagcacacagatctcaggatctgtggttcaatctccctctgccatttgctacgcaagtgactctgaacaagttcctcaagtctcaaactcggtgactaggaagatgaaagatgcatgtcaagtggtcagcatctctggcctgtaggatggctcaaccgtgagaggtgctgttactattattattgggtattcctgctatagtccaatcctacatcctgcattatagataaagatgtcccctgccaggcgcggtggctcacacctgaataccagcactttgggaggctgaggcgggtggatcacctgaggtcaggagtttgagacagcatggccaacatagtagccttctctactaaaaatacaaaaattagctgggcgtggtgtgcacaccttttattctggctactctggaggctgaggcagaattgcttgaacctgggagtggaggttgcagtgggctgagatcctgccattgcactacagcctgggcgagaagagtgaactccgtcttaaaaaaaaaaaaaaaaaagatgtccccaggaagtacccaaggaggggtcttgacacaaggtggaaatgaaacaaagtggcatttgcataaggctgagctgtgcttattgccataaaaatctattccaaggtattgctgttcaggtcacacctggacaatgatgcatgtatgcctaaggtccaaggaagctagaaatctgaaaattaaaggaagagttgagaaaaacacatccgcgactgcctcctttccagcaactgcctcttttatattttggggtgctatttgttggaaagactttgctaatagtttgaggagactacaacacaacacaaggcaggcttgccggctaagccagctagaagtttaattaaatacaattgcttgctgtgtgttcctttcccaatggtttcatgcatattcatcgttgtaattatggaagtgaaaaaatccacgcctaattatccgtgctccccatctttcacatgcctagaatttttgcataatgactgttgaaattaattcaagttagttaattttacactttgtcctttcaaaacttaattgaaaattaatttaaaagtacaaaaaaccccacaaaaacccacaacaaaaaaatcccactaccaggcattatggcaatctggtttttcagacttacaatgggcactaaaaatgtgatgtgattacttctaacttgatgcagtgttgtacttgtcaagctataataaaaggccagtcccataaatgtctcagaactacatctctattttttctaccatacagcaacaaagacttgtattgagtggggagggctgtagtggtccagctgtcttctggttgctggtttatcatgttgtccttcagaaattacatctcagccttcaaagaagaccagcatgtggtttccattgtcactccatcacacttctaccttaaataactctactggtccccattttcaggacccaactgcaatctggcatgcaagaaactcactttcatgctcagcaaaccaacagaaaacatttctttctccccctctgttactgcacctgttcccatcaggtcttttatttgagttactcccactaatcctgttttggggatccctctgcgcgggaccaggaaggagacattgatcatgtgtctaccatgtcctgcactgagcttcagcataagcaagagtttcatttaatttcatcacctaagagttcctgacatataaatcttcattatttcttgactggctgattgatagaagaacacttactgcaagcccatgggttgacaccatcggccccactttgagagagaaggaaaggcaagttcagagaaattaagtatgctctaagttcacacagccagcaagtggcagagcgggcatttggtgccaacactgtcttccccaccccatcaccatgttgcctctccatccttttcctgatggcctgccatcttggcagttagattttagcttttgccagctgtggtatcttggccatgcctttcttgaccctgagtcctaaaacggattgttatggactgaatgtatgtatccccctcaattcatatgttgaggtcctacccccagtgtgatggtggttaagatgaagcctttgggaggttagggagtaatgaggtctgagagtgggacccccatgctaggattagcgccccagtgaagagggaacaccggagtgctgctgaggaggacgccatgaaaagctggctgtctataagccaggagggcccttactaggactgaattggcgggccttgatcttggactttcagcctccaaaactgaaaatttctgttgttaagccacctggtctgtttttttaatttttaatttattattttttttagatggagtctgctgtgtcacccaggctgaaatgcagtggcacgatcttggctcactacacatccgccttctggttcaagtgattctcctgcctcagactcccaagtagctaggactacaggtgcatgcaccacacccagctaatttttgtatttttagtagagatggggtttcaccatgttggccggctgttcttgaactcctgacctcaagagatctgcccacctcagcctcctaaagtgctgagttacaggcatgagccaccacacctggctccagtctatggtattttgttatggcagcctagcagactgtgagatcattccacagttttattagatgaccttggttactcactttattcatttggactgactcagggttaagctgtgagaatataaaggaaaatataagagaaaaatcactcaagagggagaagacaactctttatgacacaaaggaagctggacgggctactgttagaggttgaggcctgtgacatgctaagcagcggctgtcaatccacctggaatgagccagaagcgtgtgcgcgcacgcgtgcgtgcgtggtggtgtgtgtgtgtgtgtgtgtgtagaaccaagcttcctgctactcctaacattatataacagggaccctcattgagagatgtcttcgatgtaccacagaggagatgaatgaatcaacttgtattgagtagatgaggaggagaaagaggggaaagcaaattaacatagcacaaagacattgatttctttttaagcccatagaagtatctctataaaggtgactttcgtgatctgagccttcaacaatttcagaagaaacaatccatctctaagaggctcctaagattcgggagtctcttaagaccctaggagcaaattctttaacagatcctttagtgctctggctccaggaatatgaaaggtattttaagaaataaggtgctgtgccgggcgcagtggctcacgcctgtaatcccagctctttggtaggccaaggtgggcggacacgaggttaggagatcgagaccatcctggctaataaggtgaaaccccgtctctactaaaatataaaaaattagccgggcgaggtggcaggcgcctgtagtcccagctacttgggaggtgaggcaggagaatggggtgaaccccggaggcggagcttgcagtgagccaagatcgcgcattccattccagcctgggcgacagagtgagactccatctccaaaaaaaaacaaaacaagaataaggtgctgtgcctgtggatacatttttcctccaaatgtgtaaacagaggctttcatccagataagcccataaatgttgatgttgatcacaaacctaaatgaagtgttcagacacgccataaagcctctggatccaatttgcacatcaggagaatacactgtaaggtacctggagctctaagcaggtgccaggaggtagccttgcaaatagatggaagtccagagctaggtgttgccaagagctgtcaggtgagagtgaagaaggctggctctagaagcagaaccaccctgctcatgcagaggcaggagtgggatgggggggaagcaaaccaggcacggaactgagctggaggtctgcagtggctcttggctctcaggatgttggtcctgctggctgacacagaaaggtacctcagcatgctgcttggtaaagacagcacattagtggacagtatatcttttacgagagaggatgccatttatgttgatgagaaagtgtgtgtgtgtgtgtgtatttctaaccattcaaaagaaggtgtagagggctatatatagcaaaatgttaataatggctatgattggatggaaaattatatgcaatgtgaagggggtattatttttctatattttctgagttaatgatctttattgaattaagacctctccttcatctcaggtcaatcatctgctcttcagaaaagcattgatgaccttcatgcttatgacagatccccttattcatgttcacctaaatctagttatcttctttcatcatagcacatgctagagttatacatttactacaatcttctgtttgtttggtttttttagagacagggtctccctctgttgcccaggctggggtgcagcagtacaaacatactcactgcagccttgaacttctgggatggagcaatcctcttgcctcagcctcctgagtactgggactacaggtgtgtgccaccacgcccagttaatttctttttttttttttttaagaatggggacttgctctgttgcccaggctggtcttgaacagctggcctcaagccatcctccgcttagcttccaaaagcgttgggattacaagcatgagccactatacctggtctatagtctttattcagtgtatgcctccctcaggaaacttggtgctccataaggacaggaaccatgggggtatagtttcgctttgttttggtggacaactttgttcccagcacctaataatagtaagatgaaggtaacagtaatgagatcaacagcagagcagcaggagcagaaatggcagcagtgcagctaacacttgcttagtacctgctaggtgtcagaccccaaggacttcgttatgaggcagtatggtcaacagccccattttcctgaaggggaaaccacagcacagaaagactgtgtcccagcacaacctcacacagttatcaacccgggcagttggactctcgaatccatgcttggactgtgatgctacactgcccttttacccagcacttaacttcacacacagaggcacctctaaatatgtattaaataaaagattgatcacacattcctttttacaatcctgaaaaagtctctccgtgtttggatgaggggaaatacaaaatcactcctctgggaatgaggcagcagaagaaagaggtcgttctgaaaaaacagagttttctggaaagaagtgttctttttcagacagagtgcttgactctgaagaaaaatgccccatacatggttcacacaagtcctaatgtttttatttttctgaatgcagaagggcgtagggaatgatggggttcagtggcattctctttagaattctacagccgggactctgggctcaagtttctatcacttgataaagtcaagagttgtgttccttttaaatgaccaatgaaagtgaagcaatctctcatttgaaaccttcccaagctccagtaagagagccaggtcctagagaatggatagggagctaccaccagggttaagatatgcaagagccttgtatgtcgcatgagggatttgggtaaaaccatgtaggcattactgatcctccctcaaaaaagcaggcagaagtggttatatttgcatggacttagcagaacatgactgatgcagagctgaagagccccacgtgcattgttagctagaaatatttaacggattaggacgcgtgtaccagcagacagacctgatttaagtttttcacatgatatgaattctccagggtaaacccaacatgctggcatcattccaggttaaagcaggagataaaactggaagaattcaactgctccattcatttcaaacccagaaagcgaggctctccttatagcttattgtttcagattagcgtatgtaatgttagtgccacactgaataccgatgagatggggcctcacttcataagcatttgatatgtttaaactgctaccccatttcaaagcctatggaaatcatcgcacatgacaacttgtcctacaaacggaatgcaaaagcgtgacttcaccggctgcaggtgagcttctctctttctctctcaccttctagtcatttttaaatgtggaggaaaaaaatgtgcttttccaactcccttgtgtcttagagtaagaaaagaacacattttctaccatttccaccatttctggctcatgccaaagatattagataactcagtaaagccagatgtatcctattcctgcagagctcagaaacagacccagctactaggcagctgtgaaatagagcagcagtctgtcagatttaattaggccagctttttggatggggtatgcttttttttttttttgtcttttggggaggcattttggcaaaaagttgggatgggctgactgtggcttagtatgtccttgaatcagtgatgcttgactgatgggaggtagcagggggtaacttccctttctttacgtgcagatgcaaacacaagtaaatatagacccagaggtatctgaattttatgcacatatggggaattaaagtggcatgtctctggctctcctgtctttcctgcttcaatgccaaattcaccatgtcacgctgggtcaagtgtcttgggtgactgaggaggggagccacagagggatttagaatatattttccttaagaacagtgactcaaagtcaggccatgaacaaatatacacaggcacaagtcgatgcatcgaagggctgttttgcagccctttagtctggcttttagaattatgagtccttctccctattttaaaatgttcaattcctattcagctgttctttctatactctgagccttatcatgaaaagctacttgaatgttcaaaaggaattagacggtgggacttcaggggccaacacagagaatcagttggaacaacataaatggccaataacaggggatgagctggaccctgccaatgttataaacagtggttaggtgtaactagaatggtggtgttcacagtgtgcttctgtccataagaaataggttttcatggacttatgtgcaatgccaacatagtacgatgcttctgaaaaatgcacaactttccctgctggctcaacatcttcctcatcctaccactattcatctaaatactcctactgttactactaatgatggtaatgatgatgatgaagatgatgatagcgccgtggctaacatttaccaagggctttctagaagctgatgtctttatgaaatgttctaatggattaccaacctcatttcctcttttaaaaagctctataacagaagtatggtcctcatcccactttgcacatggtaagactgaggtacagagaggtttaggaactttcccaaggttattggaagaaatgcaagcccagtgatgagctgtctgactccagagcccattctgttaatattttagactactgccttctccgcctaattgtcaggtctgaacaggcagggaccacatcgtcttagtatcaccgtattgttgtaaataaaattgtgcttgacacacagcaaatctccaaaatctagtattgtggactgaatgaatgagtcaaggatgacagagttttagagaactggaatccctgaacattgcttattttttcagatgggacaaagctattgtcttcattgtgtcctactggtaggggtatggttgagttctaagacaagtggattcacactgggtttctggcaggattgtgaattacagttgggcaaccatgaacccatggagaataggactgtatctaatcacaagactccaagtcctgggagtaaaccatatgcccagtggtggcaccaggcttgccaacgacatctccacacaggaaacctgagataggacctggaggatatggtggtcactaggtggtgaaaatgttcctgaatttctctccttccagatacacaataggattacacttccctggcccttagaagttctgatctggctaggtgatgggctttggccagtgaaatgtgagtggcctgctccctgggtaactaagatgagagacgcctgccctactaatccatcacggacctacaagcaagtgggaaacaaacctctattgtttgaaactgctgagacttgggcctgtaagttacaaagcaccacctagcatataccaactcagggggctaaggtacacagacaaaacatccggccctgcacctaaggagcctgtattctggcaaagcaaaaaaccatgcacaaatgaaacaaaaggggaagggaactgtaatatgtaagcagctaaatgccagatgtgatactaagaacttatgtaataataatctcatgtgttatctcacctctcaatgtccccatttgtaaactgggataatgacagtattcccagtttataaattcctatttggtgagaacattgagaagtaaaatacattcccaagatgtctcagctagtaagtggcagagctaagatctgaatccaaatctgtagacctccaaagcctcaagccctttccactacactcggtggcttttcaggacaaggaaattactcaaagctgcatgagaccagtgctggctatagccccaaaggctgctaagacaaggataaaggaatgaggagggtaaaggtgtcagggcgaatttttgaaagaagtgggtttcattcaaatcaattattaaaactaagtggtgctcttaacaggagagctgggaggggcatgcgcaacatctagcacacagaggcagtaggcacaaaggtagatgaggaataaggtgactggcggacagaaaagatgcaaagcacacatctcagcgtgcaaagctttaaataacaggctgggtgtttcgatcttctaaccgcagtgggctcctcagcaggtgtgggaagtgataaaagccggttgatgtaaaattgttctggcgactgtatgcaggatgagctacagcagaaagagggaggagactcagggtggccagataagctattttggtggccagacaaaaggaaagtaggcctgattaggagagaagctgtggaaaggaaaaggcaggaaagtaataatcaccttcatgaattagctctcactagttgccatattttgggctaagcaatttgtatacattggctcacagaatttcccaacactctcgaggatgcagcattacccccattttacagatgaggaaactggggccggagagattccgtgattttcccacaatgatacagcaaatataatactgagttaatagcaatgtatgataggtgctaaaagcatatcctaggtcttctttaatgttacaacatagacatactattattcccattttacagaagagaaaatggaggatcagggaagtggagtaacttctctgagttgcacccagctagtaagtagcaaggtccagatttgaactccgttgagtttggtccaaagtccatgctctgaattgctatactcacgagcatgtgcatttggcccctgaggcttggctggtttggccggggagcaagtggcaagatctcatctcaggaaaggagtctccatattcaccctaaaaggttccagggagacaactccggtaacacattctgcatttggagttttaatggaaggtgtcacaattcatgccctggacctaatccaggttgcctaggagtgtgaggaaaaagagaatgaattcttatcctgcacatatgccagatatatgcatgtggctttgcttgaagagcagggcagcattataacttaccccacaaagcggccttgtgatgctttgtgtggacccaaacccatttagatggcacttctgccttctcctctagtttgtggtagaccaaaagctcagaattgggtttttcaaaaaaccactcatcctgcagttacctgcagagaaaaaagcaggtcacaggcttctgaaatgttcccacagcatctgtgcttccatcattaaggtggatcaagattgggagacaagtgggggtgcagtggtcttctgcatgcccagatcatctgttgcaggctagagatgcttgaaagaggtttttgtttgatagctcacgtttaaagtgcaagtaggtcacagaccaattgttcctaccagcgcattcttgaaattccacttttatttctatcaagtaacatgtgcacacaatttaaagagtcaaatagttgtaagaggcttgataaaagcgatgcattctttgaccctcatcttccagaagtagtcattttctactattttggttagctctttgaaagcttactgccttatctctaaatagcatgcttgtatgctactttgtgattctttatttgaggaattatctattgtcttcccactctaaaaggtgaggatttagttctagtttataccatctctgccactgccacacatatgcccattttcaagccccttagttagacagtaatacagataatcactgtttttattatcttgatcaagaaaatgctacagatgaacaacacagtatactatgatttgaacacttttcttcctgggaaaacaaaagtttccccctccccattttttagcattccatatatttctcaataattcaaacacaaagtctttcccagattcataaactcttctcaacgaattcaaatacattaagtattctatcaatttcttctttgtgcgtgcggtgtgtgtgtgtgtgtgtgtgtgtatatatatatatatatatagagagagagagagagaagagagagagagagagagagagagagagagagagagagagacagggtcttgctctgtcaccaggctagagtgcagtggcgcgctcatagctcaccacagcctcaaactcctgggttcagcaatcctccaatctcagcctctggagtagctgggattgtaagcgagcaccaccacgccagctataataatttttaatttttctgtagatatggggtctcagtatgttgttcaggctgtcttgtattcctggcatcaagtgatcctctttcctcagcctcccaaagtgttgggattaaggcctgagtgagccaccatactacttggcctatcaagttcttcctatagaaatctctcccacaccttcggatccaccactgtctggacaaagggctcccaggcctgatacacagccgcaccctgtgatggcccttcagtgtcattccagaggctccttttcactctctaaggttggtccccaatttcccatatcctgtgtctttctttttcttggtttactcccttggttttggtgaccgtatttattagcagcttcttgaaaggactgtatgagagtaactttttaatcattttgaaaatgtctttatagtacagaacttgagttgaaacgatttgtttcagaactgtcttccatgtccaatgttattgagaagactgacaccattttgattcttgaacctttgtaaaaaccttactttcatttatgtatttatttttgtaatgccctctctagaaacttgtaggatctttttttgcccaatgttctgaaatttcataatgatgtgtttggtgtggtttactgtcattcccaatctgagcattaggtgggctcttttctgtctgaaaaccactgttctttggttcaggagcattttcttcaatttctcattttttttctctcttctctctagaattcctacgatttgatatatatctcctaacccggtcttcagtttttcttattttcaatttccttgtgtttttcaccttctgggatataccttcaaatttatgacctaactttttccattattatgtttttttgagacaaggtctcactctgttgcccaggctggaatgcagtggtgcaatcataactcacgcagactttaactcctgggatcaagcaatcctcccacctcagccaactgagtagctaggatacaggcatgtgccgccacacccaactaatatattttttaaattgtttgtgaagatgggtctcactatgttgcccacactagtcttgatttcctgaccttaaacaatcccaactttttaagttaaatttctatgagtcctttcctgtttagtcctttaaaagaggggaggcatcttattttatttcaaggattctgtatcttcagtcatcttttaggtttttctgttttaagtttcttctcttgatatagcctgtttccctccaaaatgcttttctcctctttctcctcctcctccctcccccctccccctagatgtgtgagtgttctgtctttcatattcaaggtttctgtcagtgtcaaatgtctggtgatccttggctgacactcatttttaagtgtgggacactaaaaactatgtggcacatatacaccatggaatactatgcagccataaaaaaggatgagttcatgcctttgtagggacatggatgaagctggaagtcatcattctcagcaaactatcgcaagaaaaaaaaccaaacaccacatgttctcactcataggtgggaactgaacaatgagaacatttgacacaggaaatggaacatcacacagtggggcctgttgtggggtgggggaaggggggaggaaagcattaggagatatacctaatgtaaatgacgagttaatgggtgcagcacaccaactggcacatgtatacatatgtaacaaacctgcatgttgtgcacatgtaccctagaacttaagtataataataataaaaaaaaagtaaattcgtggttacgtaggcctagggtgtagatggggtgcagggggtgatagctaaaggacaagggttttttttttcttcttcattttttgagtggagtctcgctctgtcacccaagctggagtgcagtggcacaatctcggctcactgcaactccgcctctcgggttcaagcaattctcctgcctcagcctctcatgtagctgggatcactgtgtgccaccacgcccagctaatttttgtatttttagtagagacggggtttcaccatgtggccaggctggtcttgaactcctcacctcaagtgattcactcacctcagcctcccaaatgttgggattacaggtgtgagccactgcatccagcctaggggttttctttttgaggtgaaaaaatgttctgaagtttatagtgatgatgcttgcaaattctgcaagtagacaatgcaggatggttgcaaattctataaatatgtttaatgtgatgatggttgcaaattctatgaaaacccaaattgtacaatttcaatgagtgaaagcatgctatgtgaatgtcttaataaagctttattttaaaaaatggaaaaaaaaaaaaagctcttggttgtgggcttcaccattagatgatcagttgggccacttcattgacatccaatctcttaaactggtgagttttcccaaagaagcttttataaactcctgcttagaaggaatatgagcctggctggctgtgttctgggacctgcttgaggaaaagggctagtagtttcaatgttcattatgttgacttatgctaaatccctgtttcagaaacggacccccattctcagctgtgcttcatatctggtattccagagacctgtctaccctcagcagagagtaagctccagtcttctgcctgggtgtgagaggggcagtcgctggctgtgtagcatagggaaggaatatgaaagtgtcatagcttcctaacgaaatttcaacaatcttcccatttttagcccatctcttctgtttccagagttatctcaagttgccaattccaggccttctggaagtatatctggttgcctcttggttctcctgagtgccagcttagaatccattttctgagttcactaatccagtcatagctcacccatttgttctccagcttccacattttttttttttttttttttttttgctggttttcctctccttttctttgtccctgtggattaccctttaaaaaaccattcttttagaggaaggaaacagaggtaaatgtgagtattcagttaccactttaaactacaagttttgaaggtaggtagtcatatcatttactcccctcaatattgaaggcacctggacttcccaggtaagtgatactaatggaattctgcgtgccctgtctgcggtgaccaatctcttctcgatgtggtgcacttttcaacatagaaagcatgctgggcaatagtaagaaaataggggttaattctagctctgattcctactcatcgttatccttggatcatttgtagtctcaggataaaaaccaccaacctatgtactttcagggttcttagtagatcaaacaggataatgactgtgaaagcacttcaaaaagcacaaagtactacagaaacacaggctttgctattacttaaaaacctcactttcatctcttgaaattcaatctaacgttatttggcctgtcttcaggagacagaggcttgtctccagtaatcatataaatcatccttgtgcattcaaaagaaatgtcctgtagtcacacagacatatgacttgggatagtgtttctcacctaccaacactgtccttgttgctaaaaccagccggtaccacagcatctaaaacaaacaccccagaatccaagattttattgcggagaagggataagtcagatgaaactcttttggggggtccatttcacaatgtgtctgcttctcagctgagctgtatgtccaccttgactaaagttgaaatacggaaaaaagagtggttaatatatccaaacagtggatatatgatagccactgaaaagaatggggtggcagtgctctatgtagtgccatgaaagatgttttgtaggattccgtcctataataaaacaacataaccctatatatgtgtaggtatttttctatctacacatctaatatttgtattatataggcacatagatacacgacatgcatatatagaaaagtctggttgattttcaccaaatcatgctggtcacttctggggaactgaaaacaacttttgctttttacttatatagttctaagcagtttgctctttctcataatatgcataggttacttctgatcataaaaaggaaagactaaatgtaaattaaaagagtaaaaaaaaccctaggatctgagaaaaaagtaaaggtaataggaagccaaggaaagatggatataggagaagaggctaagaaagggccagaattagcaggagttgggggcaggtcacacacatctgctagagacgtgcaagcagggtatctcctcccagctggtaatcacaaatggatcccctgtgggccatggcaaccacctgacatttatgcaagctccactatcaacttaaggggaggaataactcattttttaaaaacttgtaatttccatacagcaaaatgcacacatcttgagtatacaggctatgacttctgaaaatgcatatgcccacgtaacccacaggggggctcattttaaacaaaatctcatagccatagcaagtgcatgaatctgtaggagatgagctcactcagccacgatcagtcacaggaatagtggtgagtatgggattcataccccatccgtctcactaattctgaatctggacctgcctgtagtgctatctagtcttctgactgcatttcccagagatctcctgattccttgtactcctatttgggtttctcctagctcagtaactcacatgtctcttggcaatgaacatggtaacccagaccacacatgcaatcagtctggcaagaatgtactggcctgaaaagatttttggatgtgaccaactctctcaaataagccagctaccattgtcaatttcccctttcaaaatgggagcgttagctcctgtgactcactgcaagagaagactattttatagacattgccggcaactgctataccgtagtttctctgggctagcataataatcatgatatctcatatttactgagtgctattacatgtcaagcattatactctaagtaccttacatgattgatctgtataacaccacatgagataggtaccaccattatttccacttcatagatggggaactcaggcacagagatggagtaacttgctcgaggtcatagaattaaaaagtgatagtgtgaggaatgggaacccagcagttggtgactccagggtctgtttttatctgcaaggctatactatactttctctcattagggaaggacaggcagaccagggttttaaagtgtcacctcctgtctccctggctagagcttctttgcctctgtggcctctaatatataaaaatgtcaagtccatctttcttctaaaaaaggtaaatatacagtcatctctaggtattgctagggtcacaaaggcgtctcttagctcttctagacataaagccaacagagcataatgcataacagtgctttatagccagaggttttttcttgttatttcttctctgaggagttggctgataaatcagacttcaccagtagagaagatgtgtgttttcaagggtgactttcagaagcagagtgaagggcgagcaataatgtggtaagagaggcatccttcagaaccagtggcaatctcacctcgagaggccaattaatccatgtggggaataatgaactcgacagtgagggagcccaggtacaggctatctccccacttttcaagacagacactggagcactctttccagctctcatttatcagtctcagtggtgaacacaagcatcttgtgccactgcattcctcaaactgcatttattgtctagaggcacatggtgatcggacagggaagactagcccaagttcatctgaacagctgtggttcctataccctaaattctagcatctaaagatttttaccttttatggaatcccctttgtctccttctaaaagtactattgatctttttattgcattaaagttactggtgctttaagacttggtccatctcatttgagtacctggaaacactctagggagaacaaaggtgaaagatctgggcaaaggtcagtaaaatttctacccaactacaggccagaggacagcttcagttttgtctctccaacatcatgggctgaataaacagaggaatggttctataattctagcgcagagacttccagttctagtaatatgcgagctatatatgcaaaccatctcccctactggggaaaaaacctaattctagagtaaatatattttttaagattcttaatatcatcaaaaaagtaaaaaaaaggaaaaggtaagcattggaaaattgaggcaaattttcttccaagggcaatggtgagctagaccaacttgagtttagttttgccaaaaattgagaggaacattaagtcaagatccagggccaaagtggagagtcaaaggagaccctctgttatgcttggactccaaagtgctaatttttaaggtgaggatgagcagaaataaaccttctccagatcagaggactgtggagaaggctgtctttgcaacaaattaacaagggagatgtggaaggatttattcaccatggatggccttctcatggattgtatacttggccttgcattactcagatggtccagggaacctcaaaaacttggtttgaaatggtccgaactggtagtactcctaggaacctgtcagaagccaacctaaatctctctggagaaaggatcttttatcacagtcttcaatgaatttccaaaaataatttttcaaagacaatgagtaaatacagtcaaaaatactaagtactggaggatccaggataccatgagtagaccagtaaaacagcagatatcagaaatagacatgtaaagacttcagatattaaaattatcagacctaatataaacatattactaaatttcatgaacatattagtaaattattaagaaataaaagcaaacttgaatatgtccatctgcagggaagagtaaactattaaaaaatgatggaagactggaccagtggctcacatttgcaatcccagcactttgggaggccaaggtgggtggatcacctgactcgggagtttgagaccagactgaccaacatggagaaaccctgtctctattaaaaatacaaattagctgggtgtggtagcgcatgcctgtaatcccagctactcgggaggctgaggcagagaatcacttgaacccggaaggtggaggttgcggtgagccgagatgtgccactgcattcaggctgggcaacaagagcgaaactccatctcgggaaaaaaaaaaaaaaaaagatgaaaatatttggaaaaagaaccaaatagaacatctagaagtgaaaaatactgtagctaaaattaaaactcaatggacccacttaaccgtagattagacacagatgaaaaaagaataaatgaatgaatgatagctcaagaagaattattcagaacgcagcagaaagagacacaaaaagagaaatatggacgagaggttaacagatatggattgaggtgatctaaaggaaattcaaattatgtgcagaatcacctttggagcttattaaaacatggattctggggctctaataccactctttgattcttcagactaggttgagtcccaggaacatgcaatattagcaggtgtggtgtccactatactttgagaagtattagagtagtgacatctaggtggtaaagttcagaagttaatttttcttcttgtccaaactagactaagtttttcacccttcactgactgcaaccttttcatcagcatagctggacagagtgtgcaatatttctccacgtaatatggtcaacatgttttacttaatccaatagaggtttagataggaaaatcaaaacatattttgaaaaccagtatttctactttccaaagcaaaaaatcttttacaaagcaagtaatcacaccctagttctgctttgataggttgaaatttattacctttgcttaaattaaggtttgtaaaagtacatgctgctttttttcattcacaccagcttgtgaagtgtctcccaaaagttaactaacaccgtgtgtctaggctggatcacttaagctctctgggtctcccaccttcccaccatcccaccgtctacgtccaccatctacagtgcctgggaccctgtaagtactcaaaaactagaagccattattcataatgataaattcaattttgtattgtggtcccaactggataggcccccttcttgtttcctcaccctttaaattccttgtgcttcttcaaagacaacaacttcttgacacaactgtcttagctagctccttggtttaatgcttaatatcaggctctgcatgtgtttaacaaaaaccaaaagttgcattattaaactgagacacacagcccccagtcattccaggaatgccttcccaaagaacagaagacaatagatgaagggggatgtctgtggtttgtcatcatggtcttctctgcagacggtagcatgcactattaggggtctgcaagagcttcaacagggaactgaaggtgagtgcaacattccacaatccctactccaggggaagtgaacaaggggcttgtggaatttcagatccaagaggaggagcaaatctcccaggcctgcaaatgctctaataagcagccaacgttgcaagattggagcccactcactccctgtcttcttgaaggggaaatcaaatgaggagagaaaaaaatagtttgttgaaatgatgccaaaattttgagccaagaggaccgaattctgaaggtactcaaaggtactgtacttctacctatatttctctactttctaagtctctatactaccttctttttttttgcgggggcaggtggaggggagagtggtcttcttgctctgacaaacctaacacctcttggtgataagcactatgtagtttcaagcctcatatattctatctggaaaggctgattcacaaacaacctcacaccctggacacaattccatcctggggatcatttccaagaagaggaatgcggagtcacctcctatttaaagctgatcaatttctttaccttcattctctcacttcaatgatttattactggctacttccaccactcctgtctagataagctcctccttctgttatctgcaggctcagatcagtgtcaaggccaaagtcagagagggagggaaggcaaataagatgcttcctagcagctaaggtcactcagtctgactttttatttctgatgctttggtcaattgtgagataaggatgtgcatatgtgtattgaacagagagagaaacagtgagaagagaaagtgtgagagacagagacagaaacagagagagagaggagacggttgacaactgcttccatcctctcatccccactcagggccttctaactaacaatttaatgacacttacatttcaaaatgttatccaaccattagtaattgaggaccttttcagaaacaatgttgggctgcttctcaggagagaaggaaagctgtaattagaaatacggcagtgtattcaaagaggccaatttaattagtcgattttaatttaatttaggtagggtctatataagacagctcatatccaccccacagcaggagatgccagaggcgtttcggaggctccatgtgaaaacctagggtgctgttcccagggacggtctggactttggagtctgaaggcctaagcttgagcccctgccctaggagcttggccttggaaaagacacttcacctgactctgtttcctcatctgcaaaatgtgataataaagctacctacatttcaaaggctgataacaggattactgggaggtgatgctttccagcacttaattagctcagggctcaggacacagtaatttgtggaaaaatagctgcaaaagacagagaacaataagcaggggtagtgaggaaggcttattttttcaccttagtcctgaattcttagaatttttttttttttttaccatgtgtaggtattacttttgtaatgaaagcaactagttattttaaagactagccagagttttgaagtggtgccagcagttaatacatttattgggagaggtcagcatctgatcgttaaaaagttaacattgagccacacacggggacagagtcaccaatctctgcccgagatcagctacccaaggccacactgaatttcaggaggtatatatccctagctgagttcctgatgtgttctttctgcaatgtgtgcccctgccccatcttgttactggtagctccgtccttccatttctttaggccaaaaaccttggtgccatccttacgattctctcacactctacatcaaatccacaagcaattccaatggtctctactttccaacatggcccgcactgaccgttcttaccacaccaattggcacacgctggccttggccaccaccgcaccccacccccaacctccacctaccccttattacagccagagtctcccatctgctcctcatgtccaccactaccctctgcagtctattctcaacacagcagccagatgatcctgcaaaatatgagccacatgagggtactcctccactcaaaactgtccatgcgctccgtgtccccagagtagaggcaaaagtcccttcaatgcctcataaggcttcactgtctggcacacgctcctgtcttcagctgtccccagctcccgccactctcctcgcaggcctccttgagcacctcctacttacttctacatgtacagtgcctctagactatacgtccatgaagacagggattgggctcattgtattcactgctgtacatccagtctctaagacagaatctgccacagggcaacactcaacaagtgtatgttgagtaaatggcccaacagaaaggtgttctaagaaagccacacagcagttgtgacctctgcaactcaggtcctctgggccacaagcagaagagagtgaaaggcagacaaatcccagctgaagaagagctgctgacttaggatggaagagaccttcaacaatgctgaggatgaggaaaaatgatagtgtaccgaggcaggtaggaaccccctggaaccggatgcagaactgaatgtggcactttgggaagaaaactgacacagcatctaccctgatcgtgcgttgggctggccattttacatatgttgttttttgtttgttttgattatttattttttgagacagggttttgctctgttgtctaggctagagtgcggtggtgtgatcacggcttatatggcctcgatctgggttcaagcaagcctccgacctcagcctcccaagtagctaggacacaggcaagcacaggctaccatgtccggctaattttttatttttttgtacagatgggggctccctgtgttgcccaggctggcatcaaactcctgggttcaagccatcctcctgcctcacctcccaaagtgctggaattataggcatgagccaccgagctcagctacatccgttgtttattcactccctgcagtggcctaaaaaggcaagtattatcccattttacagatgaggaggtgcttaggtctgcacaactagggaactgaagaactggattcaaactcaactttatttggccactgccccagtggttctcacaaggtgttttagtagcaatgaacttctgagctgagaccttgtaaaaaatacaggtttctgggctctaaccttttttttctgagacagagtctcacttgttacccaggctggagtgcagtggcacaatcttggctcactgcaaccaccacctcctggttcaagtgattctcctacctcagcctctcaagtagctggaattacaggcacctgctacactcccagctaatttttgtatttttagtagagatggggtttcaccatgttagccaggctgtctctaactcctgacctcaagtgatccatccgcctcagcctctcaaagtgctgggattcaggcatgagccaccatacctggcctatctgggctctaccttttcattcggaatctccaggatgcagaacaagaatgtgtacttagtgaacaccctgggattcccatgtcagccagagattctgtctccctgcttcattgttgttcaagtcagggaaaagattaaattacagagacagtcctgctctgttgagaattcaatgcagttcacaattaaggacggcttctgatagcaaagcagacagcccatactctgggtaacaaggcatgcttttacttctatgacctcaagacactacaatcaaattggtggacaaatcaaggtaggcaagtgtcaggaatacaagttctccacataagtgatggaaaagcagtataaattacatgctatggatgttcaaaggcaggagggatggagggtctctggcacagaagtgaaaatcagctcatgattcatcaggtaggtggtatttagtcttgaaggatggaaacaactttagcaagtggagatggagacagaatatttcatgtgagggaattagcgctggtcagtggaaggagagaaactgcaagatctttttgggtaatgataacaatccagttttgatggggcatagaggtggggtatatgtccactggactcaaatgcaggctctgaatgccatggtgaggagcttactcaaaaggggcatttggaaggggtttgagtggagaggtaacaactgagaaaaacaaatatgacactgagtgtaggatggatttggcgtagacggaatgaggaggtgggaagaccactgggcagatgaaccatggaggtcaaagaagtgggcaggttccaggagagaaccctcagcagttgggctggcggcggggaggggaacagtggaaactgaaatcctggggtggagaggaggttgaagaaactctcactgggaggccttaattttctccatagagttggaggcaagggcttctgcaggatgagactgagggattgagaacaagtggtataaaactgtggtagcatcaaaaaactgaaaatagggaaaaatggtggtgaggagcaggactaacttgcagctcccactcagaaggacagaacagcatgtagaaactcacatctgaactttagctccaaaaaccaccacaggaacacagcaggaaagccacaagatttcacaaatctttgaaggaagtggcttgccactgcaaactccatgagacagccaaaaaacaaaaatctgaattcagacaaaagacataatctcttaggagctctatggcactgcctatggcctggaaacccaaatacttatccaggcgaccttaggttgtatcagctgatgctctcttgaaagatcacctccttgctggagtccaaccaatcgggagcacaagcagcatttgtgaaaaccagggactatacaaaattacaaccaaggacagagtccacttcactcccctgctacctccaccgagcaggtgctggtatccacggctgagagacgtgaagatggatcacattacaggactcttgactctctgcaggcactccctagcaccagcctggagtccagtagctccactgggtggcagacccagaagagcaataacaatcatgcagtctggctctcaggaagccccatccctagggaagagggagagcaccacatcaagggaccaccctgtgggacaaaagaatctgaacagcacccttgaacccccaatccttcctctgacagagtctacccaaatgagaaggaaccagaaaacaattctggtaatatgacaaagcaaggttctttatcatccacaaaagatcacactagccaccagcaatggatccaaatcaagaagaaatcactaaactgccagaaaaagatctaagagctcaattgtttagctactcatggaggcaccagagaaaggtgaaaaccaatttaaagaatttaaaaagtaatataggatatgaatgaaaaaagtctccttagaagtaaatatcatcaagaaaaacaattacaacttctggaaataaaagacacactcagagaaatgcaaaataaactgaaattttcaacaatagaatcaaacaagtagaggaaagaacttcagagctcgaagacaagctttcaaattaacccaatctgacaaagacaaagaaaaaagaaaaaaaaaattgaacaagcccccaagaagtttgggattatgttaaaccaccaaacctaagagtaattggtattcctagtaagaagagaaatccagaattttggaaaacgtatttgagggaataactgaggaaaactccctggccttgctagagacctagacattgaaagagaagaagctcaaagaacacctgggaattcatcacaaaaagataatcacctagacacatagtcaacaggttatctgaagtcaagtgaaggaaataatcttaacagctgtgaggcaaaagcatcaggtaacctataaaggaaaactatcagattaacggcggatttctcagcagaaaccctgcaagctagaagggagtggtccagctttagcctgattaaacaaaacaattatcagccaagaatcctgtacccagtgaaactagctccataaatgaaggaaagatagtcttttttagacaaagaaatgctgagacaattcacactaccaagccagcacttacaacaactgctaaaaggagttctaaattttgaaaaaaaaaaccttgaaatacaccaaaatagaacttccaaaaagcataaatcccacagggcctataaacagtaacacaatgaaaaaaagaaccccacaaggtattcaggcaacaactagcacgaggacagaataggacctcacatctcaatactaacattgaaagtaaatggcctaagtactccattaaaagagaaagaatatcagaatggataagaattcaccaacagcagacaagtatctgcgtcttcaagagactcacctaacacataaggactcacataaacttaaggtaaaggggtggaaaagacagtctatgcaaatggacaacaaaagcgagcaggagtagctatagacaaaacaactttaaagcaacaatagttaaaaaagacaaagagggacattatataatggtaaaaggatagtccaacaggaaaatatcacaattctaaatatatatgtactaacaatggagctcctagtttgtaaaacaattacctctagacctaagaaatgagatagacagcaacacaataataggggggacttcaatactccactgatagcactagacaagtcaagacagaaagtcagcaaagaacaatggacttaaactataccctagagcaactaaacttaacagatatgtacagaacatctacccaacaactgcagatatacattctattcatcagtgcatggaacattctctaagacgaccatataataggccacaaaacaagtctcaacaaatttctgaaaactgaaattatatcaggattctctcagaccaaagcagaataaaattggaaattgactccaaaaggaacccttaaaccatgcaaatacatagaaattaaataatctgctcctgaatgatctctgggtcaacaagaaatcaagatggaaattaaaattccttgaactgaacaataatagtgatacaacctaccaaaactctgggatacaacgaaagcagtgctaagaggaaagttcatagcattaaatacctcattgaaaagtctgaaagagcacaaatagacaatctaaggtcacacctaaaggaactaggaaacaaaaacaaagcaaacccaagcccagcagaagaaatgaaagaacaaagatcagagagaactaaatgaaattgaaacaaaaaaaattacagaagataaatgagacaaaaggtggtctttgaaaagataaacaaaatcaatagaccattagtgaggttaaccaaaaaaaagaagaagctccaaataggttcaattaagaatgaaatgggagatatttctagttctagatccttgggaattgccacactgtcttccacaatggttgaaccagtttacagtcccatcaacagcgtaaaatgttcgtatttctccacatcctctccagcacctgttgtttcctgactttttaatgtcgccattctttttttcttttcttttctttttttttgagacggagtctcgctctgtcccaggctggagtggagtagcacgatctcagctcactgcaagctctgcctcctgggttcatgcattctcctgtctcagcctcctgagtagctgggactacaggcacctgccaccacgcccactaatttttttgtatttttagtagagacagggtttcatcatgttagccaggatggtctcatctcctgacctcgtgatccgcctgcctcagcctcccaaagtactgggatttcaggcgtagccactgcgcctggcctaatgatcgccattctaactggtgtgagatggtatctcattgggttttgatttgcatttctctgatggccagtgatgacaagcattttttcatgtgtctgtggctgcatgaatgtcttcttttgagaagtgtctgtttatatactttgcccactttttgaggggttgtttgtttttttcttgtaaatttgtctgagttctttgtagcttctggatattaccctttgacagatgagtagattgcaaaaattttctcccattctgtaggttgcttgttcatctgatggtagtttcttttgctgtgcagaagctctttagtttaattagatcccacttgtaattttggcttttgttgccattgcttttggtgttttagacataaagtccttgcccatgctatggcctgaatggcattgtctaggttttcttctggggtttttatggttttaggtctaaatttaagtctttaatccatcttgaattaatttttgtgtaaggtgtaaggaagggatccatttcagctttctccatatggctacccagttttcccagcaccatttattaaatagggaatctttccccattgcttgtttttgtcaggtttgtcaaagatcagatggttgcagatgtgtatattatttctgagggctctgttctgttccattggtctgtatctctgttttggtaccagttcatgctgttttggttactgtagccttgtagtgtagtttgaagtcaggcagcatgatgctccagctttgctcttttggcttaggattgtcttggcaatgcaggttcttttttagttcctatgaactttaattctgtgaagaaagtcattggtagcttgatggggatggcattaaatcataaattaccttgggcagtatggccattttcacgatattgattctcaaagatctagatcagaaccagaaataccatttgacccagccatcccattactgggtatatacccaaaggatttaaatcatgctgctataaagacacatgcaaatgtatgtttattgtggcattattcacaaagcaaagacttggaaccaacccaaatgtccatcaatgatagactggattaagaaaatgtgcatatatacaccatggaatactatgcagccataaaaaaggatgagttcatgtcctttgagggacatggatgaagctggaaaccatcattctcagcaaactatcgcagggacaaaaaacaaatactgcatgttctcactcataggtgggaattgaacaatgataatacttggacacagaaggggaatatcacacacctgggcctgttgtggggtggggggaggggggagggatagcttaggagatatacctaatgtaaatgacgagttaatgggtgcagcacaccaacatggcactgtatacatatgtaacaaacctgcacattgtgcacatgtaccctagaacttaaagcatataataataaaaaagaatgaaatgggagatattataggtgataccacagaaatacaaaagccattcaaggctattatgaatacccttacacacacaaagtagaaaagctagaggagatgataaatttttggaaatatacaaccctcctagattaaaccaggaagaaaaaggaactctaacagactaataacaagcagcccaattgaaatgataattaaaaaattgccaaccaaaaaatccaggcacggacagattcacagttgaattctatcagacattcaaggaagaattagtacaatcccactgaaactattacaaatgatagagaaatagagaattctccctaaatctttcttgaagccagtatcaccctaacaccaaaaccaggaaaggacataaccaaaaaataaaattcagaccaatatccctgatgaacatagatgcaaaaatcctcaacaaaatgatagctaactaatccaacagcatatcaaaaagataatccaaccatgatcaagtgagtttcataccagggtgcagggctggtttaatatacgcaagtcaagaaatgtgatacatcacataaacaaaatcaaaacaaaaatcatatgatcatctcaatagatgcagaaaaagcatttgacaaaaatccatatcccttttttattaaaaccctcagcaaaatcggcatagaagggacataccttaatgtataaaagccatttatgacaaacccacagccaacattatactaaatggggaatagttgaagcagtccccccgagaactggaacaagacaaggatgcccgccacttctattcaacatagtctggaagtcctagccagagcaatcaaacaagagaacgaaataaagggcatccaaattgtaaagaggaggtcaaactgttgctcttcacttatgatatgatcatatacctaaaaaacccaaagactctggatcttctagagtctcctagatctgacaaataaattcagtaaagtttcagatacaaaatcaatgtgcacaaatcagaagtactgctatacaccaacagcgaccaagctagaatcaaatcaagaactcaactccttttgcaatagctgcaaaacaaacaaacaaaaaacaccttaggaatatacctaaccaagaacatgaaagacctctacaaggaaaactacaaaaactgctgaaagaaatcacagattacacaaacaaatggaaacacaccctatgcttgtggagggtagaatattgtaaaaatgactatattgcaaaagcaatctccaaattcaatctaattccatcaatatattatcataattcttcaaagaactagaaaaaacaatcctaaatttcatgggaaccaaaaaagagctctcatagccaaagaaagaccaagcaaaaagaacaaacctggagcatcacattatccaacttcaaattatactataaggctatagtcaccaaaacagcatggactggtagaaaaacaggcacatagaccaatggaacagaatagggaacccagaaatgaagcaaatacttgcagtcaactgacctttgacaaagcaaacaacaacataaagtggggaaagaaacaacaacataaagtggggaaagcacattctattcaacaaatggtgttgggataaatgacaagcctcatgtaaaagaatgaaactggatcctcatctctcaccttatacaaaaataactcaagatggatcaaagacttaaatctaagacctgaaaccataaaaagtctagaagatacatcagaaaaacccttccagacatgggcttaggcaaagacttcatgaccaagaacccaaagcaaatgcaacaaaaacagataaacagtgggacttaattaaatgaaaaagcttctgctagcaaaagaaacaatcagcagagtaaacacacaacccaacagaatgggagaaaatcttgcaaactatgcattcaacaaaggactaatatcgagaatctacaagggactcaaacaattagcaagaaaaaaacaaataatctcatcaaatagtgggctaaggacacaaatagacaattccaaaagaagataaacgtcacgcctataatcccagcactttgggaggccaagacaggtgatcacgaagtcaagagatcgataccatcctggccaacatggtgaaaccctgtctctactaaaatacaaaaattagctgggcatggtggcatgtgcctgttgtcccacctactcgggagctgacgcaggagaatcgcttcaactcaggaggcggaggtttcagtgagccaagatcgcgccctgcactccaacctggcaacagagggagactccgtctcaaaaaaaaaaaaaaaagaaatatacaaatggccaacaaacgtatgacaaattgctcaacatcactaatgatcagggagtgcagatcaaaaccacaatgtgattccaccttactcttgcaagaatggccatcattaaacatcaaaagataataaatgttggcatgaatgtggtgaacagggaacacttttatatcgcggtaggaatgtaaactagtacaaccactatggaaaacaatatggagattccttaaagaataaaagtagatctatcatttgatccagcaatttcattactgggtatctacccagaggaaagaagtcattatataaaaaatacacttgcacatacatgtttatagcagcacaatttgcattgaaaaaatatggaaccagcccaaatgcccataaatcaacaagtggataaagaaaatgcagatatatatgtgtgtgtgtatatatatgtatatatacgtatatacatacatatatactatatacatatatacgtatatatgtatatatatgtgtgtatatatgtacatatatgtgttatatatgtatatatatatatacacacacatacacaccatggaatattgttcagccataaaaggaacaaaataatggcatatgcaacaacctggatggagttcaataccattattttagtgaagtaactcagggatggaaaaccaaacatcatatgttctcacttacaagtgggagcaagctatgaggaggcaaaggcgtgagaatgatataatgcactctggggatccagagaggaagggtgggaggagggtgagggataaaagactgcacattgggtacagtgtacattgctcggtgataggtgtaccagaatttcagaaattaccgctaaagaacttatccatggaaccaacagcacctgttccccaaaaacctattgaattaaaaaatttaaaaaatacaaaaacctaaaatagatttacccccatgatccaacaatctcactgctgaggatatattcaaaggaaaggaatcaggataccgaaaagatgcctgcactcccatgcttatgcagctctattagccaagaacgaaatcaacataagtgcccatcaatggatgaatagataaagaaaatgtggtatgtatcataatggaatactatttagccacagaaagaatgaaattctgtcatttgcagtaacaaagacaggaactagaactggaagacattaggttaagtgaaataagccaggcacagaaacacaatattacatgttctcacttacatgtgggagctaaacaaaattgatctcacagagggaagagtagaatgatggttaccagaagctgggaagggtggcaggggtgaggctgggataaagcagtttggttaataggtacaaacgtaaagttaaacagaaggaataagtcctagtattcacagcgcagtagggtgactacagttaacaataatcatatatttcaaaacagctagaagagtgatttggcatgttcccagcagaaataaatgataaatgtttgaggtggtggatatcccattaccctggtttgatcattatgcattgtatgcatttgtcaaaatatcacatgtaccccaaaacactacaatcattatgtatcaataaaaaagctcacagatcaataagaaggatttgtttgccccaggaggagcaggggtccagctaatgctccacaactgtagtctgcactcacccaatcagaaataagacaactcttctgggagagtaaaaaagcagggtgactcctataatggaatacagtcattcctcatatgtcattctgcacagccatgcttcaacctcaatgtgaaaccttttaaacgtgttcagctcaaagcatgatgtgggctgtgttctgtctgaagtccatctcaggcagtcctgaaagtcatcttaatttgatgaattagagagctgagaaatcacaacattggaagtctgatttctccatgctaccattgttaaggggaacccaacttttccagggcaatttatctcctcaccaccgattttggtcgatactccctggctaatgttgaagtcactggttcagacttcggctctaacacacacacaactgttgctaaaaagtgaaatgagtgacatttctgctttgcttgctttgtggaggctaccctattgatcacaactgggatttacttaaacattcctagcagaaaaataactcctgattctatctccttctgaaaatgccaacaaatatgctgaggcagtaaaaaaaaaaaaaaaaaaaaaagaagaaagaaaaaaacggaataaaatcattatccatcccctctacaaccatgttgttttgttaatattataactttaattatttctcggttcttgacagttcacgttgttggtctaaccctcaccccgtattgattctcctcctgtaaaaacaagcatcagggaggcaccaaaaattgcatgctcaagcttagtgctatgccaggggttatatcatgcatattaaatctggacagcatttaggctaaagcaatcttagctttatatcttgttggtttttaaagaaaatgttaatgaaatatacattacttatggcagacagcatcccagtggggtccatttcaattagtatagtttgttcaaataaaaagcaaattcagctctcctcatttgtcaccgggctgccctgcaacctgaaggcagggccagaagagaaagtagagagaatatcgatgagcgttttcagaccaactcgggagtctaagaaagaggaggggattctgaccaattcattcccacccacagtgactctgaacttctcttctatgagaatgacaaagattttagttggtgcaccttccagacactgcatccatgtgtcaaggtggcaaattaccagaaagtcaagcattctggctttgtgatgatgttcttaggtctgttgtaggcctatgtcttgataccgtgctagcttcccagggctgctgtaacaaagtgccatgaactgcgtggcatgaaacaatagaaatgtattctggaggcccaaagtctgcaatcaagctgtcagcagggcgtgtccctctgaaggccctaggaaagagtccttccttgtctcttcctcgctgctggtggttttggctatcttgggtgctccttggcttgtagatgcatctggtaatgattctactctttactccattggatcaattgtgtttagctctcaatctctgtttctgtcttcacgtggtcctgtagtctgtgtccaaaattccttcttcttacagggacatgagacatattggatttagggccaccctaatccagtatgacctcatcgtgatggttaattttatgtgtcaacttagctaggcatggtaatcagcttttagtccaccaccagtccagatgcagctgtgaagatatttcttcaatgagattaacatctctgagttcaagcaaatagtgtgggcgggcctcatccaatcagttaaggctttcagagaaaagactgaggttcccgggaaaagaaggaattctgcttccagactccttctgactcaagactgcaacatctactcttctcttggtctccagcttgctgacctgcctgcagattttggactagctagccccgaacaactgcatgaaccaattccttaaaataaataatatcattctatctacatcctattctattaattccattttcctgaagaatgttgacctaaaaccatcttaacttgattacatctgcaaaaactatatccaaataaggtcacatacaaggtgctgggtggttatgaatttatggagaacattattcaacccagtacagatatggtaactagagcctcgctattcaaatggtgcttggatcagcagcagcggcatctcctgggaattgacagacatgcattctctctggccccatcctggacctactgaatcagaatcttcatttaacagatccccagatgatttgtgtgtacattacaatttgagaagtactgggctagaagacatgtttccaaccatttacagtatttataataaaaggcttgaagtctagacattgtaaagtcagatagctctaaagtaaagggtcaaagaggaagaattaagaaacaaagtagaaatacagggaaatttgaaataagtcatctctcttattaatcaatatacaccttaccaatagtgaaaataaataaatatttgtcaaacaaatggacaaaagaatacatgaatgaaatgggctcttgtaacagaggttttctaacaaactggcttctatttacaaggaaagcctttaggcaaagagaaaaatttcatttccaccctccagagtccaggtcacctttcccccttccatgtctcctgagaggcactgccatgccgatgtgattaccttgtgacagtgtctcacttgaatactctgtcttgctctaggctcccactgtaactcatgttgacatggagcaatgtttcatttccaatccatatgtatgaatttttaatgaactgtgtcaaagaaatcaaatatttccccctgcatcccactctatggaatcagattttgaccttctgccaaacaactataaatcatgttcagcgaaagagcaggaaccaggggctactgcacatagattagccagtcaatttccctctgtcacccttcacctaagctgtctaggatgggagaggagggaggagaggagaggatggaatagagaaggaaggaaggaaggaaggaagggagggagggagggagggagggagggagggaggaacaagccagtcagcctagaaaagaaatataaacagtaggcactcaacggttactaaaatattaagccataaaaatgagatcacttattttttgaaacctgggtgatcatcttgttaactgaatctttggatcattaattccctgcttctgtaatttggtcttatatttcttcatgtaaatgacttaaaactggggggtgggagggggaggtgagaagtttgaaaaagtagaatgaaataaataatttcctttttcaagagcactttcctagaatttccaatgaactatgcaaaacaagcaggaccttcctaaataaaggctcaatcaacacttagaagggagctgcaattagatacatttcttgcctagcagtgcaagaatgattttttaaaatgataatatcctatgttggcattacgtgatgaaaaaaaggttctatcaaattgcttgtgggggtgtaaacagatatccattggataacaagttagtaatataagtgtaatgggccctaaaggtgttcatacctcatataatcttacggtaatctatcctaaggaagtaattcaaaagacgaaagcaaaaaaaaaaaggttaaagccatcacaacttcgtctacaacaatgtattgacaaaatctaaatgttcatcaaagatgtgtggctaagtaaaataagatgcacccatttaatagaatatcatacaaccattagaatgcttactaagagtttataacaacatgggaaaatatttattaatataagtgggaaaaaagtaggatgtaaaactgaataaaaagtatcacggttgcaagaacaaaaagcctccatgcctaggcatggaaaaggatatgggaggaaatacgccaactgctaatagtgattatttaggaagcaggaaatgtgggtaaaattttccctgttctatattttccaaacatcctgtaatagtatatgtacttttataatgggaacataagattttattgtgcttttgaaaagcaagtcgttgtataagtaaaattctaaaagatatctctttcaacaaacaatagcaactgggtcatgctaattcaaggtgaagcacatttgtaaatatcaaattttctaatctaacatccagatcgggacatagaagaatctggcgggctgcctgctcgcaaagcttctatctctgtccaaaacctgcacttaagaagttaaaggaagagtcagagctgtcagctttaagccagtagattctagatgattcaaatagctgtcatagacactccatttgctaaagctcactcactggaaggggtctgccacacagggctgaagaacagacacacggatggacagacatggattatatcggacctgctgcttgccagcaatcatccccactcacagcattttcctttcttggcaagtttgtaacttaaaagctaccaactctcgcttttttaccctgttcaagcaaaaaattttgaagcaaccatctgtgcctggaaatgagcagcaatctaagaccatatgcaagtgcaggggcaggggacaattccatttgagtgatgagtttattgataaatgttctaagtggctgactcttgttcattttaaataaagcaacacttgggtattttaaataggtgaaacagcatcagcagcaggcgcttgtgatgagcaaacccaacgcccatgtgcttcacataagacatcttaacaattttctcaccatggaagcttgtatgagatgcacagggacagagcgtggctgagattcccagggccaaccatgatatcagctcctgtgtgacctagaggatcacccagggcagtggtaagaggcggaaaatggctccttctagaaagatgtcttaattcagttctgtcaccgatttcctctctcccactggaagctctaggtctctattttcttaatccagtcaggcaggacatagatcaaacagtgaaaactgaagccactcagcactagggacaaagatgaaaacgggagcaaaattgagtggctcattcagtgctctaaaccagtgaacttccaccatttgagacactattcccccatatatgtatatttccattatatacatgatcccgtcaatctatatatcaaatctaaagctttctttcttcctgcccttcttcccctccccttttccctttctctctcccttttccctcctccctccctcccttccttccctaaacaatcaccttgcacacatccctctttggaagactttctaaacactcaagtgggttatcaaatgggtgcaggagtgaaggggtgggaaaggcaggcatttcctacctttacagtcttgcagagggaaaccatcctgaaaaggatttccacataggttggtaggtatcttacatcaccattctccgaaatctatttacctacactgggcacttactatacccagtcacacatcatatgcagggaagtaaggctaggcttcattaatgtggatccataagctaattcaaaccaggctgggctaagccacacctcggtgctgtgtattaagaaaatgggtctgctgaataatcagagtggagaaagtggcagcagtcagggggatgtttaatgctggaagggaatagactcttttcaggctccatttatagccaagcaatccatctaccaatacaggcaagttcttatccagacattaaagcaggcaactgcctgtgttggaaatcaaccaaactgcttatcttcagccttccataattccagaccttttgctgatccgccctggcttccgcctaatgcgtttgcattgctttttctgctcccacttttagcccctagagtttaccctatatcaaacacccatgaagacacacaggcaaggcagtgagcagatctttgttttaactgttggggaaggaagaagctgtttggtctcttgggtctgtatttggcctgctgaacatcacgctgctgagcccttgtggataggatccagatataacgacaaccctgtttccccctttgctttgaaatattccagaaagggagactgtcatgagaaggggatgggggaagctgcaaagtagccaatgcattttaaaaatggagactccataccaaattgggcatttccattgcaaatcagcattcactgggcccaccattagccaagctcaggatcctggctaattaagtcagtctcagtgggaagctatagacttagggaccacggcttagctccagtctgagaagctcacggctaggctctgcttcattcttcatgcaatgtctagcaaatcaaagctaatgtgaggagcacaccacagctgactgggcctcccctcagtcatgtgcactcaaagcccagggcaccactgatcacatgtcatttccctgcattaacattctgtctgggttctagcttcacactcaacaagttattgcaagctataaatcaggagacgaaggacagggtggtgtgccaagacatgttctcaacatggtgcacagtgacagaaaccatcttaataatgcgatctttagagactcaaggaagtcggacatgctgtcatttctcccttgatgaggaatcctgccagggagaagtgactgatacccaattcttcaaaaatgcatctttctaaaaatgtagatgaaacttacaaaaatagcttgatgctcctccaactcaactttttccccagcaccctgcccccaccgtggcttaaaaatacacgccaggaatttatatttggttcaaagttgcttagcacatcgaggctaaatacagctatacaccaattttgcttccaaaattacttacttgtaaatgtataaaaccgttaacggaagatttatagttttacttcagttctttcattactgatttgcagagatctctctaggggtgttatttttggatatttctaagtctgcggactgcacaactctcgatagatgttaactcatctcagagagcctcatcgtaactgaattatgcatctcattcatttaaacatttaatgaaccccatgaagcattaagtacagcagggcacacaaagctgactaaggcaagggcttgtgtctcaagaacttacacttgttctcagtcatcttgtaagctgggagatgtgttgatacagtgctaaatttagtggcaaaataaaacttccctggtctgaagcccaggttgtatatgtctacaatgtatcttaccgctcttctgtaagaggaatttgccgggactgaagtggagttggccttgaagattgttgtactccatccatccatccatccatccatccatcccaaaatgaatcaaagaatgtagactccacaagggtagggatttttatctgtttcccccacatttataaacactctacagatatgtatttagaaatatatctacaggtatgtatttataaatacatcatatattatatgatggcctgtctgctatttgtaaaagtttgtatctcaccctgctagcaggaagagttgccagagcctgatttctacttggaacaaaatcactctgaagttccatttcctcattagaaaatggggatagtattatagatgccataggattcctgggaggaatcaaaggggtatataagaaatgtactttacacacagtgcctggtaccctaaagctcttgactaatgtggatatcttcccctctctgctacaggaaagggaaatcagaaagaatgggaagccctcactgtcacagaaggagagacgggcattctgagagcttcaagatcctgcttctggccaggcgcggggctcacgcctgtaatcccagcactttgggaggctgaggtgggcagatcacctgaggtcggcgttcaagaccagcctggccaacatggtgaaaccctatttctactgaaaatacagaattagctgggtgtggttgcaggtgcctgtaatcccaactactcgggagggtgaggcaggaaatcacttgaacctgggaggcggaggttgcagtgagcccagattgcgccattgcactccgcctgggcaacaagagcgaaactccgtccctccccacgccaaaaaaaagatcctgtttcatttcgagttctcactaagtcattgtgtgactttgagctggtcactaacgcgttttcagcccgatttcttctatgtgaaaatactttttaaaactgaaaaccaatatgaaagggtaaagatacctatgaaaagaaccagacagcattattttattcaaagatcctctctgacaagcaagttcctgggttgaacgatgggccaaaaattttttaagggaaaaaactgacccctgagacctcattaaaagaaagataaactcccaggaaccatattttattttttgctgcaaggctaatatgggttaagaggaaaaaataactgctgggataagcattcatgtatcttataattaatatttcaaggaggatttggtgcaacaggggtcgctaagctgccattcactcccacgggcttatctcctctggctgggaaatcacgctggctttctgtgagcgtgattttcccccaggatcactgggccacgtccctcgaggctggcccacacaaagggcagaggggactgagaacaagatgcggtgcctgcaatacgtcccacaaaacagcaagctggaattttatcacgttcactcaccaggacgttcattcaccacacagattcaggtttattctttgcatctcaggcaagaaagggaagggagatgcttttctttctgtcagactgtggcttatctgcctcgctcacagccgtaaggccacggatttataaattttcctgcaacggtcttatcaaccactagcaatgtgcgcaacgtgggactgagtgttttcaagggggtcccaacaaaagccctgcggctctgtgttctgatgagttgccggaggactcactactgggcagggaacataagactcaggcttgggatgaaggagaggaaggaaccgtcctggccctccagggtaggggtggttattctgtgggcaaggtcataggcctttgccaccttgattcttgttccctgagttctcctttttttttgagggctcgctctgttgccaggctggagtgcagtggcatgatctgggcttactgcagcctcaactcccaagctcaagcaatcctcccacctcagcttcccatgtagctgggactacaggagcagtcaccacatctggcttttttttttttttttttttttttagtttctgtaaagacggtgtttactatgttgaccaggctggtcttgaactcctggcctcaagtgatccttctgccttggttcccctgggattacagcagtgagccaccgcatctggctcctttttctttttagagacaggtctgactctgttgctcaggctggagtccagtggcgtgctcacggctcaccgcagaataacctcccgagctcaggtgatcctcccacctcggcttctccagtagctgggactacaggaaacaccaccatacccagcaagttttttaaaatttttatatagatgggggtctcactatttgcccaggctggtctcaaattcctgggctcaagcgatgcttcggccttcgtgtcctaatgctgggattacagccatgaacgaccacacccggccaagttctttttcaatggaattgtaacatgtatcactgtcactatctccttatctcactgttcttcttcttcctcatttctatcaaatctgagtaacagttcagcccttcctttaatttccacaatttaagaaagcagccaaacgtacaaaattacaattagaaaaactggtgttctcttgcacagtagggcagctatagtaataataatgtattgtatatttcaaaatagctagacctttctgaatgtagtcaccaaaaaaatgacacacatataaggtgatggatgtgccaattaccctgatttgatcattacacaagtatacatggattacaacacattgtaccctgtaaatatgtacaattattacgtatcaataaaaaaaataaaagacagttgtagtaagaagaggctatcattttaacagcattaattcatcatttattcattccacaaagtcttcagtgagcatctgtcacaccacaggcactgctccgctgatgggatatgatgatatacagaacagaaattcctgccctcacagaatttacatggagtgggcagagacagagagtagatataataaaaagttatagggtatattgtttgggagagataataaatgctgtggcaaaaaaaaaaaaaaaaaagcccagaacatggtaagtggaacaagagggagcggggttggtgatgggttgcaattttaaacagggggtggggatggggatgggttctccttgagagggtggcacctgataaagagctgaaggtggacccttgggtatatgaagacaggtgttctaagtgaacagaacagcaagtgcaaagatcctggggtgagagagtcttggtgcatttgaggaagagcaagggggctttttccttaaaattcaatgaaactcaaaggaattacccccggacagtgacgtgcctggaactctcacagctgaggcagctctcataaccatgtgctgaggctatcttcatagactatcccactggaatgttttttcaacatcaggtccaaccaaatagtataataagtacagaaactaacatagtgggtcagggccagcataaaacaaaagaagggaatagaatgtattaaaaaatacctgcgtcagtgtgctgaatgtagaatgcttcctatctgtatatttgtgatataaaagtagttcttattgtaggttggggtccaaatgcttaacagctactaaccaacaggttaccttctactgagtccccaacttgcctccttgtgcagtgccttctgctcccagaacctggaagcatctacccgtgacagatctagattcctttaatctaagctcaaaaagaggctcagagagaaaaagatgtttcctcaaccaccagacctgcctgtctcagcaacaactgaaatggagacactccgctccctccaaaagacagacacccgcttcccacccaggggctacatcttcctgtgatggtcccaatggctcctactccactagattttaagacactcaaaacagagacccgcaaaatagtaggggctcccttcccttatcatacccccaatccacagagtggagtttaactcatgggcagtttgctggaaaataactccctgcctaaccaatgttcatctgttctctgggccaagaaccccatggttcatttgggactttaaaactgactaaataaaaagaaattttaaaaatcaacaaaagtgcaacagaaccactcaaagctgcaatgtgggaaactcttcaattaactccctctcaagtttttctcttctgacaaaccaagtttttctggcatcccccagaggtctccctttatctggacaactcattttgagttttggactacatcctgcactaagcaggaaattattaatgttcccgtttaaaggcatgaggggcagagatcctctatgatggtttcgggggtgcaggaaactgtatacaatctggagacccatcagccccttacagcattactgggagcattctgaatggggtcctctctttccagcagagaccaaaagattgcccttaatagaattgtttaaattgcctaaaattgctgcttctatccaggctgaaaattacagcccttacgctgtttcccatcctctccccagggttactcagtccccagaggagatctgtactaacaacatcatcaacaaaacctgaatgtactttgtgtgggaaaaatatttgcagcttttcaaccagatccgaaaaggcagtgactgacatacacacgtctcccaaatgaattcagattttcctttttttttggcatgacaaaacaaattaccagcttatttatgttgccttctgaaatgttacaaatcaaatgctaaaaatctctgaaaccatatctgctgaagatgatgaatgctgatcttccttctttgtcattttctgccagctgggtgggtccatgaggaggggaggggatgatgaagaagttattgttgccaaataatgccacatcaggtgtgagtgttgagacagtcatttccttaccttaactcccctctaagagaaggctgtgtggggtaaacaaacaaaacccaatctgtgtatatttcaaggacgtagatcttctgaaaactctgtttactgcagtgagacagcactgccttgggagacccaacttctttcagctcatgctacaatggcaaatgggtggacctgatccaagtggccctgtactgccccatccatgttctgcaaggcacctggccctacccagggtcctgctgggcagagctggctatacgaacaaacttggctttgagtttgcagtgacaatgtgtatgtgcaaacagctcttcagttggggatcgtgcactccaaaggaatcacaagctgctttggattcaatcttgaagcctcaaccaagactgcaactactggcggtcttttttatcccttcaggtgcttagctgttgatgaggttatacaattccactcagtacgttcttctcaacgaaagcaaaggacttctgacacatcgcaaggctctcctcgaatcagcagagtcaatctcttgtatggagtctctaaaaactgctccctgggtgatctaatgtgcaactaggattgagaaccactaaagaaatggcgaggcagaacacgactcactaagaacataatttcccagctcaaagctctttcctccacagagccctgcaggtggccaatgctactattgctggctcagcttcttaaaggcagggggaaggcaggcccaggacttttaggaccaagactaggctccaacagaggattttctagataggcgcatcccactctagtttcattgaaaaaaatcttgctgcgcacctactatgagccaggcgggtacccctgggaataaaggggtgaacaagaggcccctgctgtatcctaaagtgatggataactatgttcttgaacaggctaagtgctttgcattctctcattgtctcatttaatccttaccactagtctgtgaatacgtattattatccttattttacagaggaagaaactaaggctcagaaacattaagccattgctcaaggtcacacagctgggaaataacacaagtctgacttgttccaggcacggaggcagcgtggggagaaaacagggagcaaagatgagctggggaacagacgcggaagtcaataaactatgacttcagcgggctctctccaaacaaagttttagatgaaattctttaaacaagaggaagaaaataatttggaatttctggcaacattttgaggcagagcttcaaaggacccgataaataatgaatgtcactgaaaggccacagagcagaggggcagaatcacatgctcgcctgccaagagctgctgaagaaagaaaatacttgacagcgtgatctgtgggttgttaacagatctgaaaatctttctaggtcagcagatttcctagacagctgtgatccactctggggagctgtcagccattgattaattcctaatcaatgagaaagcaaatgatggcaaatgaaccagctgaactggaaagattgtgggtctggggtaaaaggccatcctcttcccagcagaattcaagtaagggcaagggtgagagggtggaaaacagggaaatggggaagaggaggagctgcccaggaaagaggacaggaagggagagagagaagcagacagacagatggactgggcctaaagcagcatgagctcctgggagagggacttgtggtagaggccaggggagactgcctggggtccctggtggttggtttgtccatgatggaaaattttgtctcaaatgaggctgtcattaggagcacatggatgtccctctgacataagttccaagaaaattaaccaataggaactgaatgaaagacatgaaacagattcctaattaagttacctgactccagactgactgcagctgcaggtctgaaatgggtttgcatgggaggctacaggcagtatggaatgggggaaaataacggggttttggtcaattaagttcaggaaacacaggttagacaacaacaaacaatttcttttcccacgacttctctaaacctctgttgtgatttctaagattgggaaagtgcctcccaaattcagtgaccacaggcggagctgcttgtggatttagggttctaaggaacatgctttaggaaagtacttgggtacaaagggaataagtggggtccaagagcccctaggctgtgccacctggggctagtcatctcttggacactaacagtgggtcaccatttacctgtcctggctcacccgcagctgggtacatcagtggtggtagtatcatgggcacattcttcaaatttaagtcccccagtgtttaaaggtgtgacttactttcagtcggtgtggcattctctgagctcaaaattgggatctttaagaatgccagaatgcgagagaacattctggatgaactcatctctttacaaaaaaagaacagaggccgaggaagtcaagcagtttatgccaaagtctctgggacaactcagtgttgagacacaactggaacccgaggcttctggccttcagtctgggatgaaggtgcctctcaactcccccacaccccactgaaggcacaattccaaccaatgtttaaaaacttagaagaaagtatccttgaactgttggagaggtggtaaattctactttcccatggcccgcctacctctgttagtctatcgatgacacttgcacatgatttatcctgttaaaaaaaaacattaacaacaaagcaagctagagaaaccccctaatggcaggaatttaaacatttgcccaccactagacaaataaatatgcacatagctgcattcctcccttctcctttgttcaagaagcagaaaaaataaggccaaaagagagcacttgggaaatgggtcactgggattgcaaaaagggatgttcacttagccattcaaaatgtgtcttgctaattaagaacatgtacttggtaacagggtctactttatgacaaatttacagacagatccagaaatagatcaaccaaggtaatccagagacagcctcaatgtcctaagagagggaggggtgccaactgacccagcaaaaggtctgggaaagagagatacccccaactgtgttcaattaaaagttctctcccacagcaaccagagccagccgtgctcagacagaaacttatatggaatttactcatcttgcttgacaataatctccggtcctcctgggctcaagtgctttctgcagcaatgttaggtggcatttattcactcctgaagttacattcaacaaatatttgctgcaggaggacctgttctgagaagtggggataccacatcacaactcagagttcctatgcccatggagcacatcctggtcaagcacccccactatgctggcatctctcggcgtcctccaagaacccgaagccattaagtgttactaacccctttgttgagatcctgaggctcagagtgagaaaataacttgccacaaatccatggtaaatggcagatcaggagtggaacccaggtgagcaggacctcagagtattcatccacaaaccttaatcatcctgcctcaattaagaaaggagactgcttgattgtacccttgactgaaagcttcctctcctctttgttggaggtccccaagagcaccccaattgtgaagatttgctaagaggactcacagactcagcatatacttgtactcacaggcacaatgtattagagcaaaaggttacagagcaaaatagcatggaaaaaggtgcatggagtaaagtctgggggaaaccaggtgcaagctgtcagcgtcccaactatttatcctaaaacagacctgctatttcaacttttttctgcacaccttctgttagaaaagctgatctgtgcaaatggccaaagggagttggaagcagacaaagccaaagtatagatgaaaccctccctgaaagaagaatggatgaatttgtaaaacagactatatgaggatttttttggtgggagtgaatagggacacgggtaggggctgggtgatttcattataaagaggtttggaaaggggaaagcactggcaccagcatcagaggacctaaggctctgttgacttaaggtcaattcctatcgctaacgagctgtgtgactgtggccaagtcacttaaccctctggttttctcatctgtaaaatgagacgaaagctgaattagataaacctctaatggttttctgtctctgatagcatctggttttataactgactagagattttctttaaaatggaagattccctggtgaatttagaaaatgactcaattccacacagctttcaggagcacgtgtacacaaagtgagactcatctatggattctttagctaaaggaaaaggaaagtgtgtgttgggggaaagagagcatttctcagccaagtggccaatttgcggtttcagttcccttaggagggtttggaaattcagcattccttggttctaccagtttttacctcactcaggaaaagggagtggatgggctggtttgggaagctggtggtggtcacagaagtcactgcagacactttgggtaattttctccaagtcatccagctaaagtgttggggtcaagtctatgaagctctctggtgccccagctcatgatctagcatttccttgtagtggtactaagagacaagacaatagtaccagtgggctgggaggaactgtttattttccttccttttattctattgattgattgtaaatctagcctgcttggtagaattcatgctagcgccagggtctctactacagacactgatgttaactggcactagacaggactggggattttgaccaatatacatttatcaagctcaatggggaggtggaagactaaaaacaattcaaagtgggatcccgccctcacggaacttagcatcattaaggagggagcggagtgccatggaaagaccatgggctttggaaagagacctgagttactacagcccagcccaattgtttactagctatgtggccctgggcaagaaacttaacattgtagccttagtttccttcttcgtaaaatggcggtaacagagtccaactgttagggctgaattatctatatgaaggtcttggcacagtggccagcagtgcctctcttctgtattcgatgaaatggcaccccctgaagttttgcgatgtgcacccctggcccatcttactacacaatacgtgtattgtgtagtaagtgctcaatacacagtagctgctattatgactgtctctaatgtaccatgtgggtacatcagagctgggatagaattcaggtcattcccagatatgagcatgatcactgaaacagcaccatgtgaattacaatttgaacaattggaaacctctggcctggctgactggtgagggcgttctagacagacagaaaagtgtgcctgaaaggtgggaaaccaaggttgttcagaggtgcctatgggtgcatgtggtgaacagatcagacctcggagaactttcctgtccagtaagagattcagctttatgctactggcaatgaggggctattgtgtgtttgaaacagacagcaagacaagcaggactgggctttcagtgacaaggactggaggtcaggaaggtcattagaaagctactgcaaaagcaggaggtagagagaaggccagaatttgggcatgggattcagcttcaacaagggatctttctttctttctttcctttttaattttttatttattttttttttgaaacagagtcttgctctgttgcccaggctggagtgcagtggctcaatcttgctcacggcaacctctgcctcctgggttcacaccattctcctgcctcagcctcccaagtactgggactacaggcgcccgccaccacgcccggctaattttttttgtatttttagtagagtggggtttcactgtgttagccaggatggtcttgccttttttatttttttttaaagagacaggtctcgctctaccacccacgctggagtgcactggtacaattataacacacggcagccgggactcctgggtgcaagtgatcctcccacctcagcctcctgggtagctgggactacagcgtgtggtaccacgcctggctaatttttaatttttttgtagagatgaggtctcactttgtgccctggctgttctcaaactcctggccccaagtgatcctgctgcctcagcctcccaaatgttgagattacacgtgtgagccactgtgcctgccttcaacagggaatctttaaagagtatattcatgcctcatttatggaacaaatattgttctcagttctcagataccggtgtccagacagacacagccactaggaggcaacatggttcttccctagagatgggacaccacacagccccaggtaaacgataccccctgcagcctggtggatagttcaagaaagctgttttggggatgaaaaaggacaccccaccttccacctcatcctaccacactccctattccaccgttcagcctgccctggcctggtgaatgccaaagcaatgctgtaagagagacccagggctttagcctcaattcagccacattcatgagtcatgagtcatgaggaacatgagtcatgaggaacagcatgaggaacacattcatgagtcatgaggaacagacgcagagcctcaatggggccccaatcagcaagggatgcacctgccccagcacttctggaagctctggcactgtgttcagtgcctcataccctggtcaccaagccccaggagatggttttctacccaattaccaactgagacaacgtggcaggacactacagcgctgggagccacagaccctggccaccagcccagaagcagctcacagctctgacattttcaacaggtagataggagcagcgaacagattcaaactcccttcatcctcatctctcaccagctggacgacactgctgtgcagggacagcgtctcagacacgacggtgcttcttgaatcatttgtctttctggggccttccaagttgggttattttgtccatcctttctagcgactgcatactgatactttctttcccctttttctcttgcttcctgccacttaactttatccaggatggtctttgcatttgttgtgcccacaactctccaaccgctatcttttgtagattttatctgacagatttcattttaccttctgcacaggcatctgaccatccctgacgtctgatgtcttctcccctcccaggcctgagtgcctgatcattccctcaagatcttgcagaaaggccatcttccctggctactcccaaatggagttcaaagctcccctttttgctaccttggtactcaacagaactcatcatgtgggcatgagtctgtccctcttcttagtaaggagtttccagacgctgtggccaggtgttctctctttatcatcccagtgtgcgacaggggcctggttcatcatacgtatcaacacagttggctaaatggatggatgcacaaggtaactgaatgaaggaccatttcactaacttcatttgtctctcctagagcagctgccaccacatctgttacaaaaccttcaaactgaaatgttacttcaattcctttccaacactttctgctacccaagccaggggatgcctccttcacagagctggtcatctgtgggtagcagaagacagtgaatgcaccatgtccctcagacctttgaagatatagcttgggagtcttgctggggtaagtggtcctggctccattccctggctgcttcatgttcccaagggtcatacaaagacccaagtctgagactgcagaaaaccccaagacggccctatctccttctccttggctgtcactcgattcccacccaaacctcctccaactccatgactctaaacacaggatagactgaagcatcccttctagttctactggtaaatataactgtcagaagatttttccaaaagcaggcagtggagaaaaatcataaaggcagcaaagtcctcgttagggaatagaaaagttggatttgccacaaatgaaccgagatgcccctacagtcaccccagaaaatacaccctgagtgtatcgagaagtcatctgagcactcgcagatgtctccttcccgcttccagacccctaaagtgacagggaggggttaaaacacaaagatcacagggttgagaaccaaggagaggaccatcactgggctcttttctaaaatccctatgctagatatataacatttatttaataagaaaaacagaaacatgaaaacaatctggccaggtgtggtggctcacgcctgtaatcccagcattttgggaggcgaggtgggcagatcactgaggtcaggagttcaagaccagcctggccaacatggtgaaacccgtctctactaacaatacaaccattagccgaggctggtggtgggtgcctataatctcactactcgcaaggctgaggcaggagaatcgcttaaacctgggaggtggaggttgcagtgaccaggattgcaccactgcactccagcctgggcaacacagtgaaactctgtctcaaaagaataaaaataaaaataaaaaacaactaatggaaaaaaggaaaagaaataaaggcccaggcataaagactcaagctggtggctcacccttgtaataccacagggcatatgcaaagtcaggattgctttgcagtgatgtaagaggtcagaatcacaggagtctggcaactgcagtgtcagtacatcataccacagccccatgaggagatattctgaaacactgattgttttaggaattgtaataacttgagaatgtgtacatgatactatgtgtagggggttgaactgtgtccctcaaagttatgtccatgttctaacccctggtgcctgtgaatatgactttatttggaaaatgggtctctgcagatgtaattgagttaaggaactttagatgagatcatcttgcatttagacttaccctaagtcaaatgactggtgtccttttaaaagtaaatagaggggccgggtgtggtggtcatgcctgtaatcccagcactttgggaggccgaggcgggtggatcacaaagtcaggagttgagaccatcctggctaacatggtgaaaccctgtctctactaaaaatacaaaaaaattgctgggtgtggtggtgggtgcctgtagtcctagctactcgggaggctgaggcaggagaaggcatgaaccagggaggcggagcttgcagtgagccgagatcatgccactgcactccagctggatgacagagcaagactccgtctcaaaaaaaaaaaaaaaaaaaaaaaaaaaaaaagtaatatgggggccagtcatggtggctaacgcctgtaatccagcactttgggggccaaggtggtgggtcactcgaggttaggagttggagaccagcctgactaacacggtgaaaccctgttctactaaaaatacaaaaattagctgcacgtggcagtatgcatctgtagtctcagctatcaggaggctgaggagagagaatcacttgaagctgggaggcggaggttgcagtgagccaaaccacgccactgtactccagcctgggtgacaaagcaagattccatctcaatcaatcaataaataaaataaaataaaataaaataaaataaaataaaataaaataaaataaagtagaggaaatttgggacacagagacaagaaatcttgggactccggggagaatgccaggtgaagacgaagcagagattgcagggatgcgtctacaagccaagaaatgccaaggattgctggaagcgccagaacctaggagaaaggtatgcagtgaattttccctcagggtccgcagaaggaacaaccctgctgatgccttgatttggacttctcttctgaactgtacgagaataactgtctgttttttaagccaccaaagctgtagtaatttatgcagcctgaggaaaccaatatacaatatctatgatatgtagaagcagcttatatagctctttacaggataatttcaattatatggtagaaaaggatggacaatgggtgtatattactcctataaagagagaaaaggttatgagaaaatacaaaaagtttgccatctcttatcactgatggattatctaaaagcaaagccttgctgcatgtagcagttcttactttcatcggacatttgatattcaaaataatccagggaggtaatgcacagggtgacattattctgattttatgggtgacaacttgagttggagtgtgatcagaggctgagcagtgactgagtctgaataagaatttaggtcttggtgcttctcaccagcaccattcatttggctatttacctggtgttatgggctgaattttgttctctcctaaattccttgttgaagtcctaacctccaacacttttttttttcttttttttattgatcattcttggggtttctcgcagagggagatttagcagggtcacaggacaatagtggagggaaggtcagcaataaacaagtgaacaaaggtctctggttttcctaggcagaggaccctgcagccttccgcgtgtttgtgtccctgggtacttgagattagggagtggcgatgactcttaaccagcatgcgccttcaagcatctgtttaacaaagcacatcttgcaccacccttaatccattcaaccctagtggacacagcacatgtttcagagagcacagggttgggggtaaggtcacagattaacagatcccaaggcagaagaatttttcttagtacagaacaaaatgaaaagtctcccatgtctcctctttctacacagacacggcaaccatccgatttctcaatcttttccccacttttccccctttctattccacaaaaccgccattgtcatcatggcctgttctcaatgagctgttgagacacctcccagacggggtggtggccgggcagagaggctcctcacttcccagtaggggtgccgggcagaggcacccctcacctcccggatggggcggctggccgggcggggggctgacccccccacctccctcccggacggggcggctggccgggtgggaggctgacccccccacctcctcccggacggggcagctggccgggcggggggctgacccccccacctccctcccagatgggcagctggccgggcggggggctgacccccccacctccctcccggacggggcggctggcgggcggggggctgacacccacctccctcccggacggggtggctgccgggcggagacgctctcacttctcagacggggtggctgccgggcggaggggcttctcacttctcagacggggcgttgccaggcagagacgctcctcacatcccagacggggcggcagggcagaggcgctcccacatctcagacgatgggcggccaggcagagacgctcctcacttcctagatgggatggcgccgggcagagacactcctcactttccagactgggcagccaggcagagaggctcctcacacccagacgatgggcggccaggcagagacactcctcacttcccagacggggtggcggccggcagaggctgcaatctcggcactttggggggccaaggcaggcagctgggaggtggaggtgtagcgagccgagatcacgccactgcactccagcctgggcaccattgagcactgagtgacgcaactctgtctgccatcccggcacctcgggaggccgaggctggcggatcactcgcggtaggagctggagaccagcccagccaacacagcgaaaccccgtctccaccaaaaaaatacaaaaccagtcaggcgtggtggcgcgcgcctgcaatcgcaggcacttggcaggctgaggcggagaatcaggcagggaggttgcagtgagccgagatggcagcagtacagtccagcttcgctcggcatcagagggagaccgtggcaagagagggagggggagggggagggggagggggaagggagagggagagggagcctccaacactttagaatgcgactgcatttggaggcaaggttttcgagaagtgattaagctaaaatgaggtttttgttttgttttgtttgtagggtgggcctaatctaatgtgaagacatagcaaggagatgccatctacaagccaaaaaaaaggggtgtgggagaaaccagacctgctgacaccttgtgcttggacttccggcctccagaacagtgacagatgcatttccgttatttaagccacccagtctgtggtattttgttagcagccacagcaactaatacacttaggaaggctggaacacacagtctccatacctgtttctctttttccttggcattctccctgggctcaaacaggaagtgggaaaatacataatttccaggtacaggacctcctgcccaatgaggttatttctgagctaacaacagccaagacttttggcaagtctattttggaagaaggtccgccctgaaccgtggagaaagagagtggtcaaagccacattcactgatgtgccagcttcttctggtttctcattcaaggccaccacgggaaagaggtagaggagccaggccttgggtttcctttctggccagggagttctttgtgacttttaagcaggggaacaaggctgccggagacagcgcgttgtgcctggggaacaggttcacaggctcacagagagattgggttcagatgctggttctgatcactcctaggtgaccccaggcaaaatgctttcccgactgagactcaatgtcctcatctgtaaagtgaagttaaccccacccgcctcactggtgatatgcatctgcaatgttaagcacttagcatagtgcctaccacatagtacgtgtttaataatgtttgttatgtatattaatgaaaaggttcaccaatttggctcctttttcaaatgtactaaatcccattggggtggtttgcctcttttcccctgggttccatgagcctgggagctgatttttgcgtgactgcacagtgctttcagatttccaattgttttttccttcaatatttaaaatcaagagctttcacacagaaattccaacctctggctcctttagataacctggaagagtagtaatgcagaaagcgccctcctgcttgaaaatgcctggctgcagctgggttgggggttccctttggtgtggcacgtgccctccaatgagtgtgagtctcacttcaccggctgcacgggtgcaccactgcccctcccacctggcttcttttagacgtttgtgcttaagactaagtcaggaggcgggggcgggaaccagacagtgggttcagcatgcactgtggatcaagtaaccaatcctcttccactcagactaaagggctaagaggtgctgaaggttgaggacatccagactcatgaggagccaggtttaaggctggtaggtgaacagttgtcctagtaagaattcaacccaaaatttcaccagcagctactaaacggaatatgatgacaaatcacaaacacacagcagactacagagtaggaacaaacaggcacatggatattcttgtgtctatgtcttcttcagctacttaatacagctgggatgtgtgaatgagggagactgcagtctaccctttcatcagagtaaaccatcagagaggtcagaaactaaggagtgactctagtgtgtcactgcattcagagttcccaaatggaggtccacagaggctgctaaggatgggcaccatctgtccggaaaccccaccatggctggatggcttccccaaaagtgaagaagggggaggcgactggaagcaagcaatgtggtttatttttccttagaaaatggaacaagttagcctgcacatcctgtctgagattcgggaaaggtcccaattgtatggttaaggaaaaaaaagaaaacaacctctgatactgcaattcacagagcagatcgatattgcagcttaaatgggaatttattgccttcagaaatgcagtgaggctatgcactgtgttttagcctgccttccacccaactattctgctgacttcctgtaccctggctgctccagccagctacctcttcaggtaatggagagtgctccattcagagccgcttgtctgctcgggccgggggcacctggctcactccacgtgttgccatagaaactactatttgaacatgcccttcatctatatgggttagcgtacatcccttcttcacccatccctgctccctttactgactgattccctactcccacccccaccaaattctcctattctggctacgcctagaccaacgacccagtaagcatgtactaaagttgatcagatgcactacaagatcaaccccagacctcaggacagggatggggctgtgggtttccattcaggcagctgtctccatttcccggagggatgcatccgcttccacatcctccccagccttccaagacgcacataaaattcgatccctgctttctctttacttttatctctgctgtgtgctctggggagtttttacaaacaaacgaacatgaacttcaaggtatggagagtgtaaatcactgcaaactctcccaagctccaaatgctacaaagctacttagccaaggaccaaagaaaaactcgataggtgattatcttattaaataaacattatcctgcctttgcattgcttcctagttgacagagcattttcaatatattactgccatcgaatccccatgacagcccatacaggaagcagggctagtaccaccatatctccattttggatggaaccattttttaaaatacagacacacacgcacacccccaacggagagagagagagagagagagagagagagagagagagagagagagagagagaaagccaacagcacccagaattaaaaccagctaggattttgtcacatttccattaattatttttacattagtagtacctttcggataaggcaaagaaggatgctttatctacttcaattgcatgcctgctcacccctcgtgctcctaggtaattattttcttcagtttgttttgcaacctgaagtctatttttaatactttcatagacacatttctatctatgataaataaataatattggttccatatgcttttaaagtgtacacaacgtcaggcacggtggctcacgtctgtaatcccgcacttagggaggccgaagtgggcagatcgctcgatcccaggagttcaggaccagcctggcaacgtggagagaccccatctctacaaaaaattagctgggcatggtggcgcacacctgagtcccagctactcaggagactgaggtgggaggatcgcttgagcccgggaagtagaggcgcagtgaaccgtgatagtgccactacaccctagcctgggtgacatagtgaaaccctgtccaaaaattgatgtgctgcatggtattccatcacaggatttgtcaaatcccctacagacagcatttagatggtttgttaatttttcatcattaccaacaatgaggatatgaatgagcgttgcgcatcctcttctacacaggccaaggtattctctggtgtgagaagggtcctgccatttggtttactttgccctgcctactagaagaagtgcacatcccctcataggctcatggttcccagatttccccttctgcaaactgcccaggtaagtcttcgttaagaacaaacatgccatttcagaggtaacaaacacagctttccaagacaaaacaaatcatttcccttgtcctgctctcactgctgactgttcttttcatggctgccagaaggaatatttacttttccctagcatgtgcttagcccaataagagatatgtcattttccagagcatctccaagcatgtaaggctgactattcttgactcagccttcagggctgccacagaagaaccaatcagtgcccagctctaccccacagcacattcacttcggctggattcctgttgccaagccttccaggggaagagaggtgccccctattctttccatactaggttcttcccaacatccattctcaaagggcactccccgctatcccttcaccctcgtctcctggagataatttaaacacaggccacagacagacaggacaccaactgccttcttgctgccctcccgaaactggcagggtttggtggtttatggggagcgcacaggtttggactcatcagctgtgtgactacgggtaagttacttacccgctctggcctcagatatctttcctgttaagatgagggttgttgtaagaattagagaaaatatacagaagcgactgaaaaacatcaggtgctcaattcatggcaaccaacagcaagccaggaggccttgttaaaaatcaatacagcaaacaaggatctgctctgtggagacagagaagttacaagtggtccaaactctttaacagtgagacctgaatggggagacaaaatgaagacacacacaaccaaagttgggatcatctataattgacggatgaattatgcggactggaactgaagtctcatggagaaggcaggatgttaagttgggtctgcccccactcccaggggacatttggcaagtcttagagacattgttagttgtcacaacttagggaccagggtgctactagtatctaatgatagacctcagagatgctggctaacattctataatgcaacaaagagtttgccagtccaaagaccagcagtatcaagctaaaggaaccctgagtagggccacaaagagagaagagcatccaggcaggctggcagcacagggatagcagggagtagaagtgagagttgcattttcctggattataaggacatttatctggcttaagccaaggccaccagctagggcataatgggtggagaagaaagggtaggcaaggtgtgtataggtaaacagtcaggttccctattacatagggttacatgttaccctattactgtgctctctgcacaggcaggactcacagaatcagagaagttaactagaaaacaccatccagaccaagggtcttaaactttctaccaccacaaatcttcatgtccacctacccctcaaaccccccaagcatcacatgttctgacaactgccatcttctaaccagaggcattttccaagtaagatgtgtaagggcagcttggtagcaaaatctgtcacaaaatgcagctattaaatactaattaatatgattcccattttttactaatcataaacaatgtcactgccaaaccaagcctctgacctccatgagataatgggtgttgctatgaagttgagtgagtccagtcaaaggcaaagacatcaggcacttctaattaatactgaaaatagtctagagccacctccaccaatatgtttgtcaagaccttactttgggactctttgatttggtcaactactttattgcacaaaagataaaagagactatcaataaaaactaactgatctattccgcatcatgtgccaggcactgtgctaggcacgacacacattatctcatttaatcctcccaccacccaaggaagtaggtactattagcaatcccatttacttgcctttcagaaatgttaggtcacaaagttaagaaaggtgagagtcaggatttgaacccagatctctctgaatccaggcccatgttcttgcccacaaggcaatagatggttcccttgcagaggacagcctgctggttcactgccagccttggacccaactccctgatcttcaagcactcagggtgatgcacctcaatgcaacagattaaagggcccctgagttacgtatggcccagtaaattccacccttaagagtggtttgacttttaaaaaaactgaacactttcctcttatctcatgttaaaaaataatggcacagctgaactagagacgtctgtgaatacagacaaaacagttacccatcacagaagcaataaatatgtaaatggttacccattcctctgctcactctgccttcatctctgcagcaggaagagcggcagcaacggcgtttttcaagaagtggtttaggattatgtggtggaattacatttatctattcaaaatataaggcttgctaattaggtcataatggtactcatctatcattgaatttggagcatatactgtattgatctacaatgttgtccacgggcacaatgtgcttataataccagcttagctgtgccgagctgttctcatgaaacttcaacctcctggaaaccaattaagtcatccaggctgactgcagatgagtggcatgttgctattacactgtttccattagactgctagacttgaatgcttcaccttcagaatctttcccctggattttgtccagagttccaaattgcagaggatctgctaattctgatgagaggttacagataaaatgaactcatgaattatgtcattagaagttggttgggtaaaaactgaacttgtaggtatgtgaattgagcctacatctgaaaaggtgttcaggcaggcaaaggatattaaatgttctggctaccccagcagtgtcagagatgtcccttatttacatacacaaacagtgacagaatggtcccatcacaaaccatttcctggtcaacctcagttcaggttgctggccagtgacaaatgaggcttagcatgctgagttatgttccatggacctcttcctaatatctatgctgaattctggccctgccagatttgctagttgtagggctttgggtaactgtgttaggctgttcttgcattgctataaagaatacctgagtctgggtaatttataaacaagaggtttaggctgggtgcggtggctcatgctgtaatcccagcactttgggaggctgaggcaggtggatcactcgaggccaggagtttgaacccacttggccaacatggcaaaaccctgcctctactaaaaatacaaaaattagccagcgtggtggcacacacctgtaatcccagctactcaggaggctgaggcacaagaattgcttgactcaggagacaggggtaaccgtgagctaagatcgcgccactgtactccagcctgggtgctaagactctgtctcaaaaaaaaaaaaaagaggattagttggctcacagttctgcaggcttacaagaggcatggtgcaggcatctactcagcttctgggtgggcctcgggaaactttcatcatggcagaaggtgaaggaggagcaggcatgtcacatggtgaaagcagaagcaagtagacagagtctggcgggaggtgccacacacttttaaacaaccatatctcaagagaactcatatcatagagacagcaccaagccatgaaggatccgcccccatgatccaaacacctcccacaggccccacctccagcactggggattacaattcaacgtgagatttgggcagggacaaaaaccaaactgtatcagtaacttactttacttctctgtacactggcctcaattgtgaaatggaaaaacaggatctaccttgtggggttgttgtgaagtctacctaagacagtgtatatgaacatctggtgcacagtgggcactcaggcttttatgcctcaacttaatccttctgagatggccagcatgccccctgcagcacacattcatgaaggccaatcggcatagagcacaggaccagtgtacacagattcatgtgcacagatgaactgggttatatagaaggaatatcttatctgaaggaataatgctagcaggtccttcagagctagagtgttggtagtgttgatccacgaatgtaactccaagaaataattccttggttgggtacttttggaaaatgccaaatactgtactcccacttagggatttattttttcttcttctttttttgagatggagtctcactctgttcctgggctggagtgcagtggtgctatctcggctcactgcaacctctgcctcccgggttcaacgattctcctgcctcagcctcctgagtagctgggattacaggtgtgcaccaccacaccaactaatttttggatttttagtagagacggtgtttcaccatgttggccaggctggtgtgaactcctggcctcaagtgatccgcccgcctcggcttcccaaagtgctggggttacagctgagccaccgtgcccaaccccacttacggatttctaaagcatccaagacttgtagtagtccaaaacaaagaaatctgtttgacttcattttacctggggtttttcatgctttttaaatactgttttgggagatgggtaggtgatgccatgaaggagtttatcattttaaacactcagataatgagaagactcagaatgggaacagaaggcaggaagaaggaaagcaaggtcagaatgttgccacccctcaaggcttaggggccagaaataacaactctccagaatcttcccaaacccagccatggggaaagggcaaaaagccagcaatcaatctttcaagaatcaaaatgcacaaactggaatgcagaggcacgacttttcccagacatttccctggacttctggctttgatcgaaagaccagagacaagccacagcaaaactctgtgcttattaaaccgtgtgtttaaatgtttatacagaaaagttgagaggctgcatctccaggctgagtcaaaagaaggtggaagctagttatcccaagtatccaccaaacatcactcttcttttgctgcacctacaacagtgaggagaggagggaaagagagaggggaaacagggaaaatggagaaaagaagggtgctgagagtgagaactggggacataagagtaaccaggagagaaacctagaggcaggggagctggaagagtcattagtgtttcaccccctttaataccctcatggtaccaggcagatgatacctcctgtccccagagagccggcagcacccaccaccaacttgccaattctgagctattcttcctgcgcagatcaaaagacagacttcccagcaagaggggaggttctcaaaagcaagttaaacatactgcaactgaatgagcccaagagggaatgaatgattccatttctcaatgaggtccgtacagatgcccaatgtggctgcagctaccttcagctgaaaggctgggctcaggcttgcaaaactacactgctgccttctccatgagatgtgaagggggcctacaagagttccctcgaacaaaatgccatatctcatttcccacacaccactgttaagatgatatgtaaaattccctctcaagcttgagagctctggatgaagaaaccacttccttcagacatgcaaatgctgcagacctatggagtgagaatctatgattaagcagcctaagacatgacaggaaaaataagatcaggaaactcgatttttacaggaactgataaaagtgcttattaatatcattagtgcttattaaacctaatgacaacagacactgcatattaaggagactatcagtaacactttacacatcttaaattgcaatcattaggagtgtacaatgcatttcaatgtatccccctgctttctggaagttctccggatctcccttttcagtttccataagatgctgatattatgatttttgccttgtggaggtaacatgcagacaaacaagattttttccccagtgtctggttgcccatccaaatgctgatgtccttctgattttatctccattcctgttatacttgatccaaaattatctgggtgctatgcatgcatgtgtgtgtatgtgtgtgtatacatacatgttatatatatatatactggaaatctgaaagagggaagaaggaacaaagccagatttttctcagctttcagttctttaactagaacagacatttaagaacccacacccaagcagaactggaccattttatccttcgtgtagaaaatgggccgggcgcggtggctcatgcctgtaataccaacactttgggaggctaggcaggcggatcacaaggtcaggagatcaagaccatcctggctaacacggtgaaacccgtttctactaaaaatacaaaaacaaaattagccaggcgtggtggcaggcgcctgtggtccagctactcgggaggctgaggcaggagaatggcgtgaacccaggaggcggagcttgcaggagctgagacacagcctaggtgacagagcaagactccgtctcaaaaaaaaaaaaaaaaagaaaagaaaaagaaaacggacttgggctgggcatggtggctcatgcctgtaatcctagcctttgggaggctgaggcaggaggactgcttcagcccaggagtttgagaccaacctggaaacagagcaagaccttgtctcagttttttccaaaagaaaagaaaagaaaagaaaagaaaaaaaagaaaagaaaggaaaagaaaatggactcaggctgggcatgatggctgacacctgtatcccagcattctgggaggctgagacaggaggactgcttgagcccaggagttcgagaccacctggacaacatagcaaggccccatctcaactaaaaaaaagaaaaaagaaaatggacaatggacttggccttcttaggccataaggaagatgaatcatcactgcaggagatgccagaaatgcaaaaggagagctaagtaagtttaagtttccagataaaaggtaaacaaaggtaaaattaatgagcacataccatgggccaaacactagacaagaggctgttttaatcagtatctctttatcctctcaaaataaaaaccccaaaacactataaaactcattctattatccccaaaggggggaactgaggctggggagaggaagtcacttgcccagggtcacgtggctgggaagcacagagctgaggaccaaactcaaacctgctgactaacgtggtgctcttccctctgtataacggccccgcatgagtacgttacttatgagtgcgttaaaacaagccaaaaaccccacatggcttaaaccgctgcattcacttgacaagcactatgtaaggtcctctcctatcgggacttaaggcgctcaaaagtgatgtatggataggaagaaaaaacgcaacatcacctgaaacccaattaaaaatccatgtgcttctgagtcctgaacaatttctctatcacaaaatatttacttggctttgtgacctttgacaaaccacccaacctttgtgtgccccagttttctcatctataaatggggaaataatgacacctactccttctgggttgttgtgtgatttaacaaattttaatataaagcactaagaacagtgttgggcacacagtcaacactgtgtaagtttagccacgtgcattattgctcttattagataatcacacatcattgaagcatgtgtacacacacacacgtcacacgttttctttttctcttctctcacacaaaaacgggttattgagacacattttcaacaagagacagtggacttggcaaaggagcctcttaatgcagcctcctttattttccgtttccgctctcctttataaataggtttggcaaactgatgcttaatagcttaatatcgggtcatattaatctcaccctgtctgaacttcaaagggacacactgttctgactgctaatgaatgaattttagttgtaagtttccaagggatcagagctggaaaaaaaaaaaaatcccagctatttaaaaagacaaacatctccttggtgctcttttaaagctatttgggttttacagagcatcgccccaagcaggggaaatccaacagccttagcctggccagcacaaggtcccacagagctagatggcactagaacatgctcgaaacaaagaccacccagcacctaagctcctctggcctttgcccagcccaccccaggccccaggtgggttcaatgaggcaagatgtgtgatataactatacaaactggaataaaccatgcaaatgttagaaactataaataggagtcaaggaacaatattacatgcttggacaaaatacacccaggtattcttttctggatttcaaaaggcaatcatcacaataattcagtacttaatgctactgagccatacacttaaaaatggctaagaagtaggttttctgttatgtatatttcaccataatttttttaaaaggcaaagcatccccataataggaatagtatagtgttttcattcctaagaaataaatacaataatgtagtcagttccatctcttactctggtataatgtattctagccccaaagcaacaaaaaagtagttatttacaaactggctcgttccaggacactgccaggcagctcatacctctgttcatttcgaaaactcactttatataaataccaacctccctatccttgagaaggctccgaagcaggttattccatagagagaaagctcttatgccccaaaccagctttgagatgcgtctgctgctgcctgggcctcaccatctccaattcatttgcgtggaaaggcaagacagctcgtttaagcacagatactggtggtggggtgagagctgggagaacagggaaagcctctcaaggcatgagc

SEQ ID NO: 5087 - DNA, 30914 bp, Homo sapiens
  misc_feature 5714, 5715, 5716, 5717, 5718, 5719, 5720, 5721, 5722, 5723,5724, 5725, 5726, 5727, 5728, 5729, 5730, 5731, 5732, 5733,5734, 5735, 5736, 5737, 5738, 5739, 5740, 5741, 5742, 5743,5744, 5745, 5746, 5747, 5748, 5749, 5750, 5751, 5752: n = A,T,C or G
  misc_feature 5753, 5754, 5755, 5756, 5757, 5758, 5759, 5760, 5761, 5762,5763, 5764, 5765, 5766, 5767, 5768, 5769, 5770, 5771, 5772,5773, 5774, 5775, 5776, 5777, 5778, 5779, 5780, 5781, 5782,6596, 6597, 6598, 6599, 6600, 6601, 6602, 6603, 6604: n = A,T,C or G
  misc_feature 6605, 6606, 6607, 6608, 6609, 6610, 6611, 6612, 6613, 6614,10586, 10587, 10588, 10589, 10590, 10591, 10592, 10593,10594, 10595, 10596, 10597, 10598, 10599, 10600, 10601,10602, 10603, 10604, 10605, 21019, 21020, 21021, 21022,21023: n = A,T,C or G
  misc_feature 21024, 21025, 21026, 21027, 21028, 21029, 21030, 21031, 21032,21033, 21034, 21035, 21036, 21037, 21038, 21039, 21040,21041, 21042, 21043, 21044, 21045, 21046, 21047, 21048,21049, 21050, 21051, 21052, 21053, 21054, 21055, 21056: n = A,T,C or G
  misc_feature 21057, 21058, 21059, 21060, 21061, 21062, 21063, 21064, 21065,21066, 21067, 21068, 21069, 21070, 21071, 21072, 21073,21074, 21075, 21076, 21077, 21078, 21079, 21080, 21081,21082, 21083, 21084, 21085, 21086, 21087, 21088, 21089: n = A,T,C or G
  misc_feature 21090, 21091, 21092, 21093, 21094, 21095, 21096, 21097, 21098,21099, 21100, 21101, 21102, 21103, 21104, 21105, 21106,21107, 21108, 21109, 21110, 21111, 21112, 21113, 21114,21115, 21116, 21117, 21118, 21119, 21120, 21121, 21122: n = A,T,C or G
atgtggtggctcatacctgtaatcccaatactttgggaggctgagacaggaggatcactgagtcctggagttcgagaccagcctaggcaacatagaccacatctctaaaaaaaaaagcttgaaaattagccagtcatagtggctcaggcctatagtcccagctacttgggaagctgagggtgtggacggcttgagcccggggagtcaaagccgcagggagcttggatcacaccacttactcctgcctgggcaacagagcaagaccctgtctcaaaaaaaataaaaaataaggccggcacggtggctcacgcctgtaatcccagcactttgggagactgaggtgggtggatcattgaggtcaagagttcaagatcagcctggccaacacggtgaaaccccgtttcttctacaaaacaaaaattaactgggcatggtggcaggcgcctgtaatcccagctacttgggagtttgagcaggagaattgcttggacctgggaggcagagattgcagtgagccaagatcatgccactcactccagcctgggcaacagggtgagactccatctccaaaataataataataataacaatgaaaaataaattatgagttcacaccaatattttccactcaaattcaggactgcagaggtctggggtttgtatgtctgttttaatcagttttattaagatacaatttacatacaataatttacctcttttaaatgtacaaattgatgagtattgacaaatgtataaccatctccacaaggcaatgtagaaaattttcatcaccccttaaagtccttttacacttttttttgagactcctcagtagtaaccactgctaaatttatcagagaactgcacacctggattgtattttgaagaacttccttccaacccaattgcttttaataatttttttatgataaatttttacccaaatgttatagaatttatttacaaagaaatttcgtaagttgtatttctcctactggtgtggattatgctaaggaaacaggtctggagtcatgaaatccttaggtgtctaatttttctaactgtaagtttctgtgctactgcagatctcagttactgtctctggtggtgggtgtgtgctgggaagagtcagaggtaaggcactagtccatttccttccaggacagttgagaaagaaggaatgaactccagtcatcacaaatccactgttgatgattcctctggccaggtctcccctttaatccttagggagaagcaacactgagaaaagataacttcttcttttttttttttttttggacggagccttcctctgtcgcccaggctggagtgcagtggcgcgatctgggctcactgcagctccgcctcccgggttcacacaattcttctgcctcagcctcccgagtagctgggactcaggtgcccgccacctcgcccggccaatgtttttgaattttttagtagagacggggtttatcgtgttagccaggatggtcttgatctcctgaccttgtgatccacccgcctcggcctccaaagtgctgggattacaggcgtgagccaccacgcccggccaaaagacaacttctttagtgtaatcccccatccctgagagtagaagaggcagaaggccaaaaagtcgaccacacatgttgcagctcctcatcccagcaagatttctgtgctgccctggtgttaccctgcagatgccccttttcccagttttctactggattattggtctttctcttaatgatttgtaaaagctcaaatattatgaaacttcatacaatatctgagacctgggctcaaaatacagtcatgcttcactaacagtggaggtcactgtttgaacagcatagagtgtactcacacaaacctagatggctagcctgctacacgcctagggtgtgtgggatagtctattcttcctagggataaacctgtcagcatgctactgaacactaggcaattgtagcacaatggtaagtatttgtgtatctaaagtgtctaaacatagaaaaggtacagtaaaaacacggtattatagttttttgggaccccatttatatttggtccatgaatgactgaaatgttattatgcaacacatcatggtgttttctcctagttattcttttttttttttttttttttttttttttttttgaaatggagtcttgcttgtcgcccaggctggaatgcagtggcgcgatcttggctcactgcaacctccacctcccagttcaagcaattctcatgcctcagcctccccagtagcagggactacaggtatgtgccacacaccaactaatttttgtatttttagtagagacggggtttcaccgtgttggacaggctgtctcaaactcccaacctcaggtgatccacctgccccatgggattacagacgtgagccacgcgcccggcccctagttattctttggatttagtttatgatttctaaatgtaatttttaatgtttcatctaattaaatgatttatctaattaaatttaacaatcctttatgttttctggttgtgagtcatacctataaaagtcctccccacttcaagattatttttaaatcccctgcaattcttctagctcttctgtgactacatctatcagaattaattttgttgtaaagaatgagtaggagtccaacttttttaatgtgattctcaagtttttacaatatgttgaataatccatttttccccattgatttaagatgccatatttatcctatactaagttcctgtacatatttaaactacatctggactttccgttccattgttctacttgttcaatcacatacaaatatgttgtagagacagggtttcgccaagttgcccaggctagtcttgaactcctgggctcaagcaaccttctgccttggcctcccagggtattgggattataggcgtgagccaccacacccaccctattgttgccattgttctagttgctgtgatagaggaaatgttgggaggtggtgtatctgcacctctgtgtcctgtgtcatatccctgggccttccctctgacccagcagcatctgaggtctactcactttgcactgatagtgtcttgcttcaattgcacaatacacatgttcacttttgtcctggggtgtttgcagtgcctggggtgagacactgaggtaagcctgcttggaataccacatgctagtctagaagtgggggaggtgtcgctttctggggtgatcctcaaccagtgacgttggacaccagtggataaatgcctctcactatcaatcctcaagtggacaatactgagagaggctcttgggctcttcagaagattccagtgggctcatgtccagctgcccaccacaggctcaactcagcaaaacaccctggtactggtttttcccatggcgcattgggcctgcttctagggccacctcctacataaatgatgtgcatagaaggccttatttcaggctctgctttcggtctggtccaggataaaacaagcgaccagaagtccctagaaagcagcctcagggaacaaattaccccctagggatggatggcaacaaggactcccttgctggtgataggtaggcagtagaacccttagaacgccacagctccacaattcctaagaccttcccctgccatgtggaataggtttagaaagaaatgaggcactagtggacgccagcattccagcacttgaaaggtttgggcaatgctaattatgtggattgtgaagttaattggcttctcttagctgccttagaagattgcaaggagaaaatgagaggctacggttcagggcaagctgtgaaaccctgatgacaggtttaagccactctcatttatcacagccagctggaaggctgtgctgaaagccaattccagatctgatcgaaagggtgggccaaccatggaggagatggagtgagcacatctagcagttcgctctgctaacttctgacactgacagggacggggtaggccttgggatgtggacatttgaaataagaaactcccaatgcccgcgagcgctcttgagaaggagaacagcccctcttattaaagacctcacatgaggcaggcgcttcacaatattttttaaattattgtggtaagttataataacataaaattttttaccattttaaccaattttaggtgtgtaattcaatggtattaaaacattcattcatattgccgggcgcaatagctcatgcctgtaatcccagcactttgggagccaaggcaggccaatcatttgaggtcaggagtttgagaccagcctggccaacatggtgaacctcatctttactaaaaatacaaaaattagctgggcatggtggtgggtgcctgtaatccagctacttgggaggctgaggcacaagaatcgcttgaacccgggaggcagaggttgcatgagccgaaatcgtgcccctgcactccagcctgggcaacagagagagactctgtctcaaaaacaacaacaacaaaactcatattattgtgcaaccatcaccaccttccatcttttttcagaacttttttgtctttccaaactgaaacgctgtatctgttagccagtcactcctcgtttcccctgcccccatcccccaggaaccaccattctatttgcttcactacattttgcttgtttctttaagatccatccttgtctcccctatagcttaataaccagggtcgggtctcagtaagcctgacagggtaaaggcagttcctgatgtgagtggcaattgctgagccacacaaagatgcagcatctgcggacgcactcttccaggagccagaggagcccacagcagcgtgggtctagcgtgctgaggtggtgagcgtggatataagactagatcaggaaatggagggccaggcgggtggctcacgcctgtaatcccagcactttgggagtccgaggtgggcggatcacttgagtcaggagttgaagaccagcctggccaacatggcaaaaccctgtctctactacaaaatacaaaattagccgggcatggtggcacacgcctataatgccagctacttgagaggctgaggcggagaatcgctttaatccgggaggcggaggttgcagtgagccaaggtcgtaccatggcatccaacctgggcgacagagccagactccgtctccaaaacaaaggaaatggaggtttagttcatgtcaaggacacctggaactggccctaaacatgcatgatgggtctccttgaagcttgatcccacaggactctacagctgagtggtccaatacaggatccacagcaaaccagaggcatgctacattctgagggaaatagggtagttgtacttgttaaaatgataggattttggattgctgggttaaataaaatatattattccaattcatttcacctgtttctcttcttttctcctttccttccttccttccttttcctttttcttttcttttcttcttttctcttttcttttttaacacagggtctcacctcctggttgcccaggctggagtgctgtggtgcgatcttggccactgcaacctctgcctcccagatttaagcgattctcgtgcctcagcctcctaagtagaggaattacaagtgcccgccactgtgcccagctaatttttttgatttttagtacagacgggtttcaccatgttggccaagctggtcttgaactcctgacctgaagtgatnnnnnnnnnnnnnnnnnnnnnnnnnnnnnnnnnnnnnnnnnnnnnnnnnnnnnnnnnnnnnnnnnnnnnaagtgcccatgtggctgacattatatttctattgggacagtgctgaccagtggaaaagacatggagatgccagacaggtgtgagcagaatattgaagagtcagaaggctcagagaaggtgcatgttcggatgaatttattcttggagaccctttatttactaaagcgattcagggccggcacggtggctcaggcttgtagttccagcactttgggaggccgaggcaggcagatcattgaggtcaggagttcaagaccagcctggccaccatagtgaaaccccatctctactaaaatacaaaaattagctgggcgtggtagcgggcacctgtaatcccagctactcgggaggtcgggcatgagaatcgcttgaactgggaagatggagattgaagtgagccaagatcgcgctacgaactccagcctgggcaacagagtgagactccatctcaaaaaaaaaaagagagagacaaagagaatataaaaggccacgtgaagacagaggcagaagttgaagggaggcaaccacaagaatgtctggagccccagaagctggaagaggcaaggagggtcctccccacaacttttggaggagcatggctctacagaaatggttgctctaagccaccaacttgtggtcatttgtggcacagccctaggggactaaaacattctccctcccccacaactcaactctgtgggctctctcctggcagcacatcaaggcacacctttggcattagctaaatctggagggctagctaaatctgaacatcaatgaatatcaatatcttttttttttttttttttttttnnnnnnnnnnnnnnnnnnnatgaagtcttgctcttgtcgcccaggctgtagtgcagtggcacgatcttggctactgcaacctctgcctcccgggctcaagtgattctcctgcctcagcctcccgagtagctggactacacacacacaccaccacacctggctaatttttgtatttttagtagagatggggttttgccatgttggccaggctggtctcgaactcctgacctcaagtaatccacctgcctcgcctcaagtttgctttttgttcatggaaatcagcttcataaaaagcatcttaccctgagtgtagtttgtttctgtaaatttcagaagttgagttcagaatagacatatccagatttatagaatcacaggcttctgaaatataaaagggaaaataatttacttaggatatgtgaccagaaggctgtttttaaaaatcctatttctagtagctgggtggcctgacagaaccaggtattactaattttttcctggactgtgttaaataatttattcttgaaaatgttagctgggcatatgcctcatgcctgtaatcccaacactttgggaggccgaggcaggaagattggttgagccaggagttcaagaccagcttgggcaatatagcaagatacttgtctctatccaaaaaaaaaaaaaaattagtcagacatggtggtgcacacctgtagtcccagctactcaggaggctaagtgggacgactgcttcagcccaagaggtagagggtgcagtgagctgagattgtgccactgactctagcctgggcaacagagtgagagtctcaaaaaaaaggagaaaggcaggaaagaaaaaaagaaagagaaaaagaaagagagagagagagaaagaaaagaaagaaagaagaaagaagaaagaaagaaagagaaagaaagaaaaagaaaaaataaagagagacagaaagagaaagaagaaagagagagagggagggagggagagagggaaggaaggaaggaaggaaatgtttgagagtgatcctgtatcctcctctctgggttttttttctatgacattcccccaccacatcttccctcttcctcaccctccatctcctgatgagatttttttaggagctggggtgctggttgcattggttccttgcagtgtgcctgcattgctcccatccaccccattaacgggctcctgagcccctgaatataatgacatcagagggaccacctgtctcatttcaccagtacctcttatccaacctgtggctcaccttgctctcttggtgccacctcctggaacacgggggtggcatatgtagctcctgggagtgtttggcctctgggcaaaagataaggaataggaattattgggcaattatgtgaatttctaagcgcatgagggcagtggaatagactctgcagaacatgctcacatcttgggctgtggaaacacacggcctggatcccacttctggcacagattcctcctcttaaaatgagaatgacataaattgggggttggtggcgtttgtgttagaaaaggtcggtaattgctcagcaatgcgtctggaatgtggccatgtaggctgggactgttccattgtcagctatgatagggtttgactgtgtcctcacccaaatcacatcttgaattgtagtccccataatcccacatctcatgggagggaccaggtggagataattaaatcatgggggtggtttctgtctactcttctagtgacagtgagttagttctcacaagatctgatggttttataaggggtttccccttcccttggctctcattcttctctctcctaccgccttgggaagaaggatgtgtttcttccccttccaccatgattgtaagtctcccgaggcctcccaagccctgcggaactgtggtcaattaaacctctttcctttataaactaccccatctcaggtatgtccttatagtagctgagaatggactaatacatcagccgaggcgctgggtcttgtttactgcaaagcaatatgaatgcctgctttgagaggtgaccgtgaaagactgtgaaacacagtgtggatcattctgacagatgtgaaaaatctccaagatacgttgttacatgaaaaaaaaacaaaatcatggtgtgaaagtcatacctacaatatgctacaatcactaccatttgtttattatacacacagaattctgtggaaggatttaaaaaactggttattacccctagaaagtgggactgggcatcaatgacattgaactctatcccttttgctccaccccccactcccgtatgtctgtacaaccttacaaaataaaaagacaaaaacctgaaaccacccaaaacacgcaacaaagttctcttacttcttgtttttcaaggatatttgcatagattccaacttccatggctgtgtctccacggtcctgggcacattatttctcatagcttttcctacgtaaataggtaggaatcatcaaattaaacaattcagccacatttttctcatctcctcggccaaggagcagaattccctcaaagttctaaacagagagtgacttgctccaatggcccaaactgttgtctaacaaaggaaaactatagctcaacagggagtctagacaccgctcctccaagccaggggctgttctgatttattttccggccttcagaggaacatgctttgcctatcagattatgcctgaactagccagacttatttctttccttcgctgaagagaatagtctgtggaagctttgtaatatcttcaagagagtgtaatggcctattgaattctttttttttaagatggagtctcgctctgtcgcctgggctggaggcagtggcactatcgtgatctcggctcaccgcaacctccgcatcctggtttcaagcgatttcctgcctcagcctcccgagtagctgggattacagttgtgcaccaccatgcccagctatttttgtatttttttgagacggagtcttgctctgttgcccaggctggagtgccatggtgaatctccgctcaccgcaacctccgcatcctggtttcaagcgattctcctgcctcagcctctgaatagctgggattacaggcatgtgccacaatgcctggctaattttttgtatttttatagaggcggggcttcaccatgttagccaggctggtctcaaactccagacttcaggtgataaagtgctgggactacaggcatgagccactgtgcccggccagcctcactgaattctatttagctccagccagtaatcaaaaatattaatgccacttttgcaagaacctggactttttaaagaaggagaaacatgtttttaagacatatgagatgtgggccagggtgcagtggctcaccctgtaatcccagtgctttgggaagctgaggtgggaggatcacttgaagccaggaattcagaccaccctggggaacatagtgagaccttgtctctaaaaagaattttgtaattaaaaaaaaacaaaaaactgtaatcccagcactttgggaggctgaggcaggaggatggtttgagtcaggagttcaagactagcctgggaaacatggtgaaacctacaaaaaaaaaaaaaattagcaggcatggtggtgcgcgcctgtggtcccaactactcaggtagctgaggcaggaggaggctgggaggtcaaggctgcagtgagccatgattgcaccaccgcactccagccttgggtgaggaagtgagatcctgtctcaaaaaaaaaaaaaaaaaaaaaaatgtcaggcgcggtggctaccagccccagcactttgggaggccgcggtgggcggatcacgaggtcagaagttcaagacagcctggccaacatagtgaaaccccatctctactaaaaatacaaaaattagcctagcgggtggtgggcgcctgtaatcccagctactcaggatgctgaggcaggagaaacgcttgaactgggaggcaaaggttgcagtgagnnnnnnnnnnnnnnnnnnnnaaaaaaaaaaaaaaaaaaaaaaattagccaggagttgtggtgcatacctgtattcccagctactagggaggctaggtgggaggttacagtgagctatggtggcaccactgcactccagcctgggcaacacagtaagccccatctctaaaaaaaagaaatgaaataaaataaaatcttaaagatgcatcagattataacttgtgacctctgtgttcaagttttatgtcaactgagtccctgacttctctgagtgtgactctctggagatggttctcaattggttctcttgccagttctgacaatatctccaggcccattccacaactcagaacactgaggctcagaagcaacagcctgaggggcttgtccacagccctcagcttgctgatgggggccagtgctgagacccaaactgtcttttgtgtaaacttcatatccttctgcactcgtgtaccaaatgaaaaaaccactttgaaggcttaaccagggtggccataagacgtgaggaatgaaaagcagtaactgggctgagtgcagtggctcatgctgtaatcccagcactttgggaggctgaggtgggaggatcgcctgagtccaggagttcagaccagcctaggcaacacagtgagaccccgtctctaaaaaacatttttttaaaaaagcttaactgaggcttctaataacattgacaagttttctgctggatgtagcacttaaggtgggaagagagaaatgatgcttttttgtttctgtttttgtttttttgagtctggtgtgtttaaaaagttttttaaaaaatcttatagtagaatagattatacttctacattgaaaatctagaagcatagaaatgtagaaataaaaaatatgtatatattaggttggtgcaaaagtaactgtggccgggcgtaatggctcacatctgtaatcccagcactttgggaggctgaggcgagcagtcacctgaggtcaggagttcaagaccaacctgaccaacatggtgaaaccctgtctttacaaaaatacatggtggtgggtgcctgtaatcccagctactcaggaggctgaggcaggagatcgcttgaaccagggagacagaggctgctgtgagccgagattgcaccactgcactccagctgggcaacagagcgagactccatttcaaaaaaaaaaaaaaagtaattgtgggttttgcataaaagtatggcaaaaattgcaattacttatgcaccaacctaatattttcaatacttcagccccaaacaattgtaaaccttttgaaggtgtcttttgtgctaatgggatgacgcttgttgtcctcatgcactgaacctcccctacgtatgtggcagatctagagtcactcaaggcaagctctcgcttgaggcacttgcagtcaggagcagccgcaccacttgcagcgcccagtgcaaatgaacactgttcacaggccttaaacttgtgtttaattaagaacacaagttcttggccggcacagtggctcacgcctataatcccaacactgtgggaggccgaggtgggaggattgttgagcccaagtgttcgagaccagcctgggcaacatagtgaggccccgtctccatttaaatagaataaaaaaagaagagagagagagagaaaaaaaggaacacaagttcttaaagtcagaccgagtacatctttcacaagcagtcatacgaggaaaagggcctcttgtttaaaaacataataatttcacacccacgttcctagcattattaaacaatagacaaaaggtggaagcaaccgggtacccatgggggataaatggataaacaaagtgtggcgtatttatgtacaatgggcattcttcagtcttatcaaggaaggaaattctgacacatatgacaacatggatgaacctgaggacattaatcgaagtgaaataagccagttatgaaaggataaatgcttccacttccagaggtgcctagaggagtcaaactaatggagatagaaagcagaatggtggttggcagagccgggggaagaggggatggggagctagtgtgtaatggggacagagtttcagtttgggaagtgaaaaagttctggacatggatggtggagaagggtgcatgacaatgggaacgtgcttaagccaccgaactatgcatttaagcaggttaaagtggcccatttagtgttatgtatattttccaccattaacaatttttaaaagagcgtacaaaaaattatgaagaatttcaagatgcagcgggagcagtggctcacacctgtaatcccagcactttgggaaactgaggcaggtggatccctgaggctgggagttcgggaccagcctggccaacatggtgaaaccctgtctctactaaaatacaaaaaattagctgggtatggtggcggaaacctgtaatcccagcttcttgggaggtgaggcaggagaattgcttgaacccaggaggcggaagctgcagtgagccgagatcgtacactgcactccagcctggggaacaagagcaaaactctgtctcaaaaataaataaataaataataaacaaataccaaatgtggagttcttcttggcacagggccctgtgtgacagcacagctgtacgtctgtgaagccagctctgcttgccctcaaacagaaaaggctttccctggagaagaattaccctctgcatgaaccgttcaggaagtctattccattcccgcccccctttctctgttttcctcctattttcattttctccctattctatttccaatccccttttctctttctctcaccctctgtcctgctgtctgtatcccaagcccacgggaaaacgggtggtaaagcgataaaagaacttacttgttttgtatttgggcagtacccaaaaagccagaattaggattataccaccagcaacagtaataaccctggaagtagtagcttcagacagaaaggacagctgtcccgcctggaagaagaccgcatccattggtgaccatagcattttcttttccaatgacattagccagtaagtgttttagaaaaggtgatgtctcccaagttaaccaatgtactatgcaccaggttcccaaatggtcatgacatctaaaactcacgggacttattagtcaataaagttctgactgggcgtggtggctcacacctgtaatcccagcactttcggagatcaaggtgggaggttgcctgaggccaggagtttgagaccggcctgggcaacatagtgaggccctgtttctacaaataaataaataaataaaaattagccaggtgtgatggcatgtgcctatgatcccagctctcaggaggctgaggcagggtgatcgcttgagcccgggaggtggagactgcagtgagcttgattgtgccactgcactccagcctgagggacagaaccagaccctgtctctataaataattaataaataaacaaaaataggttgagctcagtggcttacacctgtaatcctagcactcgggaggccaaggcaggtagatcacctgaggtcaggagtttgagaccagcctggccaacaggtgaaaccctgtctctacccaaaatataaaaattagctgggcctggtggcgcgtgccttatttccagctacttgggaggctgaggcatgagaatcgcttgaacccaggaggcggaggtgcaatgagccgagatcgtgccattgcactccagactgggtgagtgagactccatctcaataaataaataaataaataaataaataaataaataaataaataaaataaaataaaaaaaaataataaagtttaaaaagtcatgaccaagcacatcttccacaggggccacccaaagaaagaaaagcagcacagaatttaacaggacgaataccagcaacatttctggggtcatgagcccagaaaagcctgggtgtttactgggcaaggccctgagccctggcagcatgtttcgtgtatccaaacaactgccagttgttgagttttagctgcaggccagacactgtgttaggcactcacctgtgttgccttatttatcccattggcatcactcccattttatagatgaggtgagtaggctcagggaggtgaaatgactttcctaaggtcacacagccagtgaatggaagggctggactcatagccaagtgcctgactccagcaggctgcctcacttgttagaccacactcactaataccagggcgtgggctctgttctgaggacctggctgggtgaagtggtcaatgtccaatgtgccttgtgcctttgctaacctagtttttcttttctttctttttctttttctttttttttgagacagggtctcgctctgttacgcaggctggaatgcagggcacgatgatcacagccactgcagcctcgacctctcaggctcaagcaatcctcctacctcatcctctgagtagctagaccacaggcatgcaccaccacacccggctaatttttttattttctgtagagacagggttttgccatgttacccaggctggtctcaaactcctgggctcaagtgatctgccagccacaccttccaaaatgctggaattacaggtgtgagccactgcacacgacctagttttccttcatcctcctaccttgacaaatgcaccttcagaaggacctggaaggtcaggtttgaatctgaattctcagactttccagagtttggcatcaggacgtggcagcatggacagaacccactgagtcccgggctgccccgctcccgacctgggctctgacctgcaccctaaggggccttgcagcacgtggacgccccagcccacatgtgcaaacaccatccacaccccccataaacagctccttggctcaggttcagggatgctcatacccttactgtgggccaccctcgggaggatgagtgggggagagactggtacaggccctggaaatggcttctgatctgattgggcaggggatttggtccaggtacctagagtgtggagcagaaaagtgggagtatagggttcaggtggctgctccccacggctccctgaacccctcagcctaggggaaggtgcatagcctggaggtaccagccagagcccactaaacacagggcttggccagaggcctctcttgccctgagccaagggtgtgcaggagtctggacccatcatcattagcagtggagcaataaacagccaagcaggagggatggtattagaaatcagtacaagatggccaggcacagtggctcacagctgttatcccagattttgggaggccgaggtgggcagatcgcttggggccaggagttcgagaccagtctggcaacatggtgaaaacccgtctctactgaaaatacaaaaattagccaagcgtggtggcggggcctgtagtcccagctactcaggaggctgaggcacaagaatctctagaacctgggaggcaaggttgcaatgagctgagatcacaccactgcactccagcctgggcaacagagtgacacctgaaaaaaagaaaagaaaagaaagaaggaaggaaggaaggaaagaaggaaggaaggaagagggaaggaaggaaggaagggaaagaaaggcaggcatacaagaaggaaggaaggaaggaggaaaagaaagaaaggcagacatacaaatgatgaaaaaacaaagaaaactaaaagaccggcagttctaagacagatgcaaattggaaaggcagggcagaaagttttgccacaagtcccctcctgctccagtttctaggcctttctgtggttcctttatggcagaaagcaaccccatagagtttgcatggactctaccaaagagacccttcaagtgatctgccagccacaaccttcaaagtgctgggattacaggtgtgagccactgcacacgacctagttttccttctatcctttaccttgacaaatgcaccttcagaaggacctggaaggtcaggtggccatggtgggaaatggtgggcagaggagcagctgcagtttctggaagtgagttcagacctggctgaaagaactaggttgctcttacctgttgagggcatggtgacagggtgactgtatgttgcatagttaggaatctgtttttagcttcacacctatactcttcctcttctccaggattcttcttggttaattaaattcagcaggctccctgtcatacttggaaatagctggtgatatggcaacatggtttcaaagaaagtgtaattgatgggcagcgagccattgactgagaggcaatgtaatgttattgtcggtctgtttctgtttgaatgaccataatgttcagcactggggaagtcaccgggtcggaagaatgaaagtgaacatgaaaaggataaacagactgggtgtgctcactcagaccacaatatgagtggaacccttactccactccaggctgtggaaccaagatgaacgacccccttctgagaagtcaagaagttcacggcccactgggaaaggccaatgggcatgtggccaacccgtgcagtgtgttgttagccgaggttctcagctgagtgctgagaaagccagagagtggaggcatctctctgctttgaggaattggggtgcaagcttgcccttcctagaattcacaatcttttattgttaataatgaatataattttgtcaatgatccagttctaagtatgaagctgagagtgcttttttatgtttattttttatagacatagggccttaccatgttggccaggttggcttgaactcctggcctcaagtgatcctcccaccttgaattcccaaagtgctgtggttacggcaggagccaccacacccggcccaagaagtgcttttattctcaatccttgtaaatttaagtgggtttttttaatccaaaaatatcattttcttttcaatgtatttatttattcagagcagggttttgctctttcaaccatgctggagtgaagtggcacaattatagctcactgtaactcaaactcccaggctcaagtgatcctcctgcctcagcctctgtagctgggactacagggcacactgctggctaatttttaaatgttttgtagagacagagtctcactatgttgcccggctggtctcaaactcttggcttcaagtgattttcccacctcagcctcccaaagtgccggatttcaggtgtgagccaccatgcccagccccaaaaatatcgttttctccaactgtactttatttatagaactcagctgcacaattatctttcacttcctccaaagagcaggaagtaacctgctaactagattcaagagaaattctcaacaggaaatgggtctgctacactctgttagtcatagcctattctatgacctaacagaaaaacccagctatacattttattatatatataataatgcattaataagacagtattataggaaaggaagaaaagctgttaagtatctatcagtgccaggcgtgccagtcacatgatctcatttgaccttcacgacagtcttgtagtgtggtagtatcatgcccattccacagatgaaccaactgtgcttcagagagattgagaaatttgccaaggtcacacagctagtaaatggccgagttgggactgacttcaagagtccacacttaaaacaattttttttttatttactttcttttctgttttgagacggagtctcactctgtcaccaacctggagtgcagtgccacgatctcagctcattgcaacctctacctcccaggttcagcaattctcctgcctcagcctcccaagtagctggggattacaggtgcccaccaccatgctagctaatttttgtatttttagtacagacagggtttcaccatgttggccagactggtctgaactactgacctcaagtgatctgcccccactcaacctcccaaagtgctgggattacagcgtgagccactgcagccggccctgtgttctctttaaacatttgatgagtgagcactttggaggccgaggtgggcagatcacgaggtcaggagattgagaccatcctggctaacatggtaaaccccgtctctactaaaaatacaaaaaaaaaaaaaattagccaggcgtggtggcagggcctgtagtcccacctactcgggaggctgaggcaggagaattgtgtgaacccgggaggcgagcttgcagtgagccgagatggtgccactgcactccagctgagtgacagagcaagatcatctcaaaaaaaaaatttttttttgatgagtgaatcagtgattaatgaatttgtgtttaggctcatagtttcaacccttactgggttggagacaacactatgttttaggcctcattaaaacccagtagtacaattgcttgcatggagtaggtactccgtagtgcctattgatctggctaactgaagatgatacagttttataatctaccaagatagttttattaccagactgtgtattaccctaacaaattgcaggaaggtcgtgcacaaaaaacatatgaactgatgggcttatgctgagtgcagcaggagtctgaccactagagaataccatcagctgtgttcctgccctcaatatccatcgtattccagtaccatgtttgcagggattttccccctccttcttccttttctttcacaaggaatatactcagtttatgtccaaagatcattgggattttttttttcttgaacagggtctctctctgtcacccaggctgcagtgcagtggtgcaatcacagctcactgcaccttgaactcctgggctgaggcaatcctcccaactcagcctcctgagtagttggcactaaggcacgccaccacgctcagctacatatatatattttttaactttttgtagacacacagctccacatagttcccaggctggtctcaaactcctgggctcaggtgatcctcccgcctcacctcacaaagtgctgggattacacctgtgagacagcgcacctggccaagataattggtttaacctggagtccgtagcattctctaaaaccttatgcagaaatttgtatacgtagtttttgagcatttctctggagaagatattcattgctatcattggattattaagacagttataactaaaaagctaagaatcactgagctacagcaatgtcacccagtagaactttctgtgatgtgggaatggtctacatctgtgttgtccaatgtggcagccaccagctacaggtgtggctacaaagccttgaaatgtaactgagactgtggagggaaattttttatttcatctaattttattgacttgattttaattatggcacgtgcttgtaatccaagctattcaggatgctgaggtggaggatctcttaagaacaggagtttgaggctgcaatgggctttgattgcctgtgagtacctctgcactccagcctgggtgacataggctattaaataaataaatgttggccaggagcgtggcacatgcctgtaatcccagcactttgggaggctgaggtgggtggatcacctgaggcaggagttaagaccagcctggtcaacatggtgaaaccccatctctattaaaaatacaaaattagctgggcatggtggtgcatgcctgtaatcctagctactcgggaggctgaggtggggaattgcttgaactcgaaaggcggaggttgaagtgagctgagatcgcaccactgcactcagcctgggtgacagggcgagactccatctcaaaaaaagaaaaaaagaaataaaataaaaaaaataaacaaataagtttaaacagtaccgtactggatagcatagacatagaggaccaccaagagttatcaggaagtcagggtccctacgctttgaagactccaggtataacatacattgttacctagaagccttctctcctcccacaggagtccattatcaaggtcaccttcacggtgaggcccttaatgctaggcagtaacaggcttggggtaggaaaatgggacagaaaaacaagaagtagtgagatgtggctaggcaggaagagtgctagcggatggggcccctgacactaggaagcggtgggaaaggcgtgaggctttgaagaccctctccaaggggcccaaggcttcaaaaaaaaaaaaaaaaaaaaaagcgatttttgcccacacaatgggaatcacagaataaagttctagaaaagacctccacaattattgttgagatataagacttttgcctaaagatataaactattatctgacatggtcgaaagtctttgaaagagaaggtgaaacggaatgattaagatagagaactcactgggcatggtggcttacatctgtaatcccagcattttgggaggctgagcaggcggatcacctgaggtcaggagttcgagaccagcctgaccaacatggtgaaacctgtctcaagtaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaattaaagatacttcctgttgaccaggtctaaaaataaataaaaaataaaaaaagaataaagctgcagtaacatactttccaggttcttaagtgttcacaaggatcatggagagcccctcataaaccagaaagcaccctataaattataggggctccaaggaacaggcactctacttaccgaaatcgtgaagctgaagtcacgactgtattttgaacagctggtaacttgggctttgcattgtaggggcctgattcatgggcttctgtgatgcttaggttaaaaatcgcaggttcacctttccatcctgggttcccaggtgtgtcttacgtcgaaacaatgaataggtgatctgcagtgtttgttcttatgggaacaaaacatagatacattttgacccttcataaccaccttagtcttgagtccaaacatggagaagggaattctgaaaaacaaaatgacacaagaaaaagtccttttaagatcctggccgggcaaggtggttcacgcctgtaatcccagcactttgggcggccgggcaggtggatcacttgaggccatgagtttgataccagtctgggcaacatggcaaaacctgtctctactaaaaatacaaaaattagctggcatggtggtgggcacctgtaatcccagcactcaggaggctgaggcaggagaattgcttgaactagggaggcggaggttgcagtgagcaagatcatgccactgcactccaggctgggtgacagagtgagactacctcaaaaaataaaataataataaataaaaagttcttgaagttgggtgtggtggttgacgcctataatcctagactttgggaggctgtggtgggagggtcacttgaggtcaggagttcgagaacagcctgggaacaagtgagacctcgtctctaatttttaaaaaacaaaacagaacaaaaaaaaaaaaaaacatagctgggaccaatggatggcttgggtggaagacagatttagactcttcaaaaatgttttaaaaatgcagtaaactctcctcccactctttgatctggacaattaacattttctcgtcttatataagctcaacttttttttttttttgagacagagtctcactctgttgcccagctggagcgcagtggcaccatcttgactcaccacagcctccaccttccaggctcaactgacctcctgcctcagcctcctgagtagctgaactataggcacacaccaccatgcccagctatttttgtagttttggtagagacagggtttcaccatgttgtccagggtgggggggaactctgacctcaagtgactgcctgcttcagcctcccaaagtgccgggattacaggtgtgagtcctgtgccccgccatataaactcaactttaagacaagacctaaactacctttccaaccaatagccatccctaagttttttttatctaggaatgctagagcttttgtggccagtaaacataaaaagatgctcaacttcacaagtaatgaggcaactgcaaattaaaacaacactgagattcatttttcactcatcagattggtacaaagtttaaaaatgattggccaggcatggtggccatgcctgtaatcccagcaatttgggaggctgaggcaggaaaaaccnnnnnnnnnnnnnnnnnnngatctcttgagtccaggagttcgagaccagcctgggcaaatggtgaaaccctgctctactaaaaatacaaaaattagctgggcatgatggtgcgtacctgtatggcactactaggaggctgaggtgggaggatcaattgagcttggaaggtcgaggctgcggaaagctaagtcgcaccactgcactccagcctgggcgacagagcagagactctgtctcaaagaaagaaaaaaaaaaaaaccctaaataaaatttaaaagtaaaagtgattatatccaccactggggaggggtggggaaactcacccaccgttggtgactgataggatacgatcagccttgttgggaggcaacttagcagggtctgtaacaatttaaatgtgtatgccctatgaccttgcaatttcattctagaatttcattctacagagatgctttcaagctctcatgcatccacaaaggacgtttgtacaaggatgtttattgtagcattgtttatattgcccccaaaaagcagggcaataaaaaggatggttaaacgaatcatggctgagtcttaaaataccatgcagctgttgaaaaagagagctaaggctggtgtggtagctcatgcctgtaaccccagcactttgggaggcagaggcggaggatcacgaggtcaagagttcaagaacagcctggccaacatgatgacaccccgtcttaccaaaaaacaatacaaaaattacccaggcatggtggcacgtgcctgtaatcccagctctcgggaggctgaggcaggaggatcccttgaacccaggaggcggaggttgcagtgagccagattgtgccactgtactccagcctgggcaacaagagtgaaactctgtctcaaaaacaacaaacaaaaaaagataacgaatataaagtgactgttgataacggctgcttctggataggaggggagaaggattggaggaggattgtaacagaacttttacattttatacagtaacaacaccaccttggctatcacttacggatggtttaccatatgcctggcactgtgacgaggagcgggattgtctcatttgatctgcacactagcctaccaggtaggtgcttttattagcccactcacagatgaaataaattacagtgtctcacgcctgtaatcccagcactttgggaggccaggtgggcggatcacgaggtcaggagatcgagaccatcctggctaacgatgtgaaacccctctctacaaaaaatacaaaacattagccaggcttggtggcacacgcctgtagtcccagcactcgggaggctgaggcaggagaatcacttgaacctgggaggcagaggttgcagtgagcgagattgcaccactgactccagcctgggcgacagactgagactccatctcaaaaaaaaaagaaagaaagaaagaaagaaagaaattaaggtcaaactgggtatgtcatgagctcaggcgctggctagtaactagtagaaccagaggttagaccacttcccaatgtatatttctagtgtgcttgaattatttcacaataattctgtgggtttttttattttgttttgtttttttaagaacgaggtatcactatgttgttcaggctggtctcaaactcctgagctcaagcaatcctacccattagccttccaaagtgctgcgattacaggccggaggcaccacacccagcctgtgtttggctttctagttaaaacacaacaaccataaaacaacaataacaaggaaagttagaaactttcattgtgaaaacaaatttcattatttttctcactgagtctcagaaaaaaatgctgaatcccctccctaaaatcattttattttaaatgatagataattgaaaagactgttctttgttgttcataaaagctcagaaacacttttgaatggacgcttatgttgcaatcagactgttcaccacttcagtgaaaatggtttcaataagaaagaagtaaatgaaacttaccatttgtttcattgcctcacaatccaatacagcttttctacctgaaacagaaaaggaacacgataagctcactttccacatgacacgttggcttggaggttcgagcctcagaatgataaggggggttacaagtgacagaagaaaatatgctccagaagaggagcctgttcaaatggctccacatctcccagttgaagtccaagacggggtcagaaggcatagtagaaccacagtggtgagtcatcggagaacttcctctttttcttagccaagttaaggaaatcagagggtttggatgaggttgcataatactggtttgttcgaccaatctgtcttcctctgtgagttcctataagaagaggatatttggtagattgccactccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgccaaaaggagtttggtggaagtttatttagtctttggaagcaaaccgactgtcttaagcagatacatacaaatattgtatcaaaatgcctgctttttttttttgagactggcctcactctgtcacccaggttggagtggagtctgtgatcatagctcattgcagcctcaaactcctgggctcaagtgctcgtcccacctcagctcctgagtagctgggaccacaggtgtgcaccatcaggactggctaattatttttattgtaaagacaggggtctagttgcccaggctggtgttaaactcctgagctcaagtgatcctccgcctcagcctcccaaagtgctgggattacaggtgtgagctactgtgcctggccaaaatgcctgcttttgttaaacgttgattcctagaccccactccagacttactgggtttcaagccaggacgctgatttttttttttttaaacaagggccctgagcaattcttacgcacagtgaggctgagaaatatctgtacaaggtgctgctgcctcagtgatttctgaatcaagggagcttggggacttgatattacggcaagccctccagtgccaggagatctgaagtaggagttacttagatcagcctttgaaatagaacgtgcaggctgggtgcggtggctcatgcctgtaatctagcacttcggaaggctgaggcaggcggatcacccgaggtcaggagtttgacaccagccggccaacacagcgaaatcccatcactagtaaaaatacaaaaaacttaactgggtgtggtatgcgtgcctataatcccagctacttgaggggctgaggcagaagaatcgtttgaacccggaggtggaggttgcagtgagccaagattgcaccactgcactccagcctgggtgatagagaaaactctgtctcaaaaaaaaaaaaaaaaagtcagttgaaatagaatgtgcagagccactcttgatggagtggagatcaccaaaaggatagaaaggtatgactatagggctaggtgggaagacagctggttgacacttgcaagaattgacaggtccaccaagagaggaagcaaggagtgaatggctggggcagccttgagctgggacattcatctctgtaccttaggtcccaagattaaccaaatccttccttattgactcagcgtcacctagctagcatcctctagctaggaggttgatactgaatcttgctctgtctcccaagctagagcacagtggcaccatcttggctcatgcaatctccacttaccagaatcaaactatctttccacctcagcctctctagtagctggaccacaggcacaaaccaccatacactactaggtttttaacttttttatagagatgaagttcactatattgcccaggctggttttgaactcctgggctcaagcgattctcctgcgtgtgcctccaaaagtgctaggattacaagcatgaaccaccatgcccaacccttactacaacaatttacagcactttataaaagtttggatgggtgaactgtcagatacatgtgcaaaattcctcaactttttcttttcttcacgtctgcaatgtttttcatcagcatcctgtcactttttgctaccactgctggccagctggaaaagaacagacaaccatagaatcattccccgcacccaattttctttctctctcttttttttttttttttttgagatggagtctcgctctgttgcccggctggagtgcagtggcgctatctcggctcactgcaacctccacctcctgggttcaaggattctcctgcctcaccctcccaagtaactgggattacaggtacgtgccaccacacctggtaaattgtgtatttttagtagagacgggatttcaccccattggccaggctggtctcgaatcctgacctcaggtgatctgcctgcctcggcctcccgaagttgtgggattacaggcgtggccactacccccggctccacattttcatatagacccatggaaatggtttctctatcagaccagtacaaattgcagacaagtctggcaatggaaaaaatatatattggcaacttctagtttttcaaactggagtaatagctgcagtggcgccatctcgggccactgcaacctccacagtcccaggttcccaagtagctgggattacaggcacttgccaccacgcccagctaattttttaatttttactagagatgaggtttcgccatgttgaccaggctggtctcaaattcctgattcaagtgatctacccacctcagtctcccaaagtgctgagactacaggcatgagccactgacctggcctcacacattctatttcaaaggctgatctgagtttactcctacctcagttctctggcactggagggcttgccataataacaagacttcaaggctgccttgattcagaactgacttttgaaagacactgtctcaaaaaaaaaaaaaaaagaatttttaatggtgatgtagagaacatttcatgatgtggtaagagaatcacaatatacttaagaaaagagaaaaggtattttaacagttgtaataacataaatcatttttctaaataagaaagtgcataatttgtatactagaaaaactatctggaggccgggcacagtggctcatgcctgtattctcagcactttggagactcataatgagactttgtctctaaattaaaaaaggaaaagaaaggaaaggaagaaaaaagaaagagaaaaactatctggaaggatattttctcaaaatgttaacaatagctatattggagagtagaatgttatttttattttttttattattatactttaagttctagggtacagtgcacaatgtgcaggtttgatacataggtatacatgtgccatgttggtttgctgcaccataaactcatcatttacattaggtatttctcctaatgctatcccttccctaacccccaacccccgacatgccccagtgtgtgatgttcccctccctgtatccaagtgatctcattgttaattcccacctatgagtgagaacatgtggtgtttggttttctgtccttgtgatagtttgtgagaatgatggtttccagcttcatccatgtccctgcaaaggacatgaactcatccttcttatggctgcatagtattccatggtgtatatgtgccacattttcttaatccagtctatcttgatggacatttgggtgggttccaagtctttgctattgtgaatagtgccacaataaactacgtgtgcatatgtctttacagtaacatgatttataatcctttgggtatatacccagtatgggattgctgagtcaaatgatatttctagttctagatccttgaagaatcaccacactacttccacaatggttgaactaatttacactcccaccaacagtgtaaaagcgttcctattctccacattctctccagcttttattttcttattctagctcctctttcttttttttcgagtgaaatcttgctcttgtcccccaagctagagtgcaacggcatgatcttggctcactatacctctgcctcctgggttcaagcaattctcctgcctcagcctcccaagtagctgggactaaggtgcctgccaccacgcctggctaatttttgtatttttagtagagacggggtttcacctgttggccaggctgttctcgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctgtagtatggtgcactgagtgaggacaggaggttgggacatttcccagaggcttgggttcaaaccactgaggtattgagaaagataaagtaacttttacatgaaagataaaaaacaagatctttcctcaaaagacctacctggagcccatacttgccctcaggcaacccataggcttgcacaacagtgtctatttttttttttttgagacagagtttcacttttgtcgcccaggctgggtggaatagtgtaatctcggcctactgcaacctccgcctccccgcctccccagttcaaggattttcctgcctcagcctcccaagtaactgggattacaggcatgcactaccatgcctgcttatttcttatttttaattgagatggggtttcaccatgttggccaggctggtttcgaatcctgacctcaggtgatccccctgcctcggcctcccaaagtgctaggattacaggcgtggccaccacgcctggccagtgtctatttccttaagaaaaaaatatgtgtttttttccttagaaaaaaaattataaaaatcgaaacagcatacaaaatccaaagaaaatatccaataggctgaatataattcatttccgcttgtccctgcccccaggaatgtctttagcaccccgtccctgcatacattctttgttgggtatagcatgcattgttagaagcagtttatcatgaatttcgttcatagtcatagtggcagctgttgtgtattgactaggccttgtgtgaaatgctttttctcatgatctcctgtaattctctagagggttattgtccccattatacatttggggaaaacagctaggaagtagcatggctgggattcaaaccctgtgtgggtcgggtacagcggctcaacctgtaatcccagcactttgggaggccaagacgggagaatcatttgagctcaggagttaagactcgcctggggaacatactgagaccttgtctctgctaaaaataaaaattagccggtgtggtggtgtgcgcctgtagtcccagctactcaggaaactgaagcaggaggatcacttagtctgggaggtcaagggtgcagtgagctatgacttgccactgcatgccagcctgggcactgagcgagaccctgtctcaaaaaataaaaataaagaataagtaaataaaaataaaacaacaaaacttcctcatctgtctgaagtcatagcctgggctcccaattcttttccactgtcctgtctgcccagtgcccacgatcagaactttcttgacttgaggtctcagaatccctaaataacaatgtggagtagcttgtggttggttcacttctacaggatccagaattctcctggcctctgaagtgtacacaaagtaacgccacatattccagtctcatcagtctgaagtggg

SEQ ID NO: 5088 - DNA, 42518 bp, Homo sapiens
  misc_feature 15807, 15808, 15809, 15810, 15811, 15812, 15813, 15814, 15815,15816, 15817, 15818, 15819, 15820, 15821, 15822, 15823,15824, 15825, 15826, 15827, 15828, 15829, 15830, 15831,15832, 15833, 15834, 15835, 15836, 15837, 15838, 15839: n = A,T,C or G
  misc_feature 15840, 15841, 15842, 15843, 15844, 15845, 15846, 15847, 15848,15849, 15850, 15851, 15852, 15853, 15854, 15855, 15856,15857, 15858, 15859, 15860, 15861, 15862, 15863, 15864,15865, 15866, 15867, 15868, 15869, 15870, 15871, 15872: n = A,T,C or G
  misc_feature 15873, 15874, 15875, 15876, 15877, 15878, 15879, 15880, 15881,15882, 15883, 15884, 15885, 15886, 15887, 15888, 15889,15890, 15891, 15892, 15893, 15894, 15895, 15896, 15897,15898, 15899, 15900, 15901, 15902, 15903, 15904, 15905: n = A,T,C or G
  misc_feature 15906, 15907, 15908, 15909, 15910, 15911, 15912, 15913, 15914,15915, 15916, 15917, 15918, 15919, 15920, 15921, 15922,15923, 15924, 15925, 15926, 15927, 15928, 15929, 15930,15931, 15932, 15933, 15934, 15935, 15936, 15937, 15938: n = A,T,C or G
  misc_feature 15939, 15940, 15941, 15942, 15943, 15944, 15945, 15946, 15947,15948, 15949, 15950, 15951, 15952, 15953, 15954, 15955,15956, 15957, 15958, 15959, 15960, 15961, 15962, 15963,15964, 15965: n = A,T,C or G
acctttttcctctcaaacaatttgttttttttacattgcattctgagtactgaagagcacttgaaatgtatggaagtggtttctatgctatttgataatcagtaatgttcagctgtcagatagtactttactggttgcagacccatctctcttttatattaaagcactagtgcagttataattgtgcctacttttaaaatctttcagtaaaaaagtacataatgaatacagaaatctaactgacagggatacagtaataatgaaatgctactatcacttattttaatatacaataaaagcaggcaaataccattgctttttgagtgcctttttaactttatactaatgacttaaagagctttaaaagaaagaaattggctgggcatggtggctcacacctgtaatcccagcacttgggaggccgaggtgggcggatcacctgaggtcaggagttcgagaccagcctggccaagtggtgaaaccctgtctctactaaaaatacaaaatttagccgggcatggtggcgcactctgtaatccaactacttgggaggctgaggcaggagaattgcttgaatctgggaggcagagttgcagtgagccgagatcgcaccactgcactccagcctgggcgacaagagtgagactcctccccgcccaaaaaaaaaaaaaaaagaaattactctccataacagtctatgttatcaccacatatataaaaacatgatttagatttccatttcaaagttacattacccgattacttccaataggtgctaagcaaaaacccccaatgtattattgaaccatggacttgcacctcatgttaatgtgaatatttatttccatgtccctcttaactggttttttcttgtcttccctctagtgtattgttatttcagatatgtgatatctgttttcatactcttgcctttccatcatgaagcttagttatgaacagagattcctttgtagagctcataggcagtacagagaggtaagtctgcctcagagggccttgtatcttggtgtagtttttaaatagtgcatagtgtatagtgtaagtgtacattttgttttgcacatagtttgttgccccgaatgggttttttaccaagccttttttctttcatgtatttacagtccggagcacaagattctcttctttcaaatacaatgtattcgctttactttacaacactaaatctgggctttgaatttccagtgcattggactgattgattgttgggagttagaggctgttccaaccatccttagtttgggagagtggctccttctcttgttttctaagcgtacagtcaacgggtgccatttgtggtatttaacatgttaggatgttgttccaaatgctgagttgttttatttctagatgtaattagttcactttatgtaatatcttctctcagactgactttaaaaacaaagttttatcattttcattgtatttgtatttatacagagtgttttagctttgatattctttgtattttcattcatttgttacatgagctttacagtaacatctgtataaatggtttttaaaaattaactatgtatgtgcccatgccgaagtgagcaataaaatcaatgctgtttgcactgtcacagcatcaacgtttttaaagaatattggtttgtaatgaatcgttttgaaaacatttatggttggctctatggagggtgacaacatggtcacaaaatgaaaagttcaagaacacatgccatcctgagttgatgcctctgtcatgttcagagctcagctttctgtctcctcgcagagcagggaaggtgcccgttttctccggccgtgtgactgctcagttggtagtacctgttgggggtaccgcataggtggatttctgagggggtcaggggctagtggggaagagcatcttggtcctgtcaccagtctgcaaccatctttgcttaatacatctccgctctgtagggcaggcctatgacaggggctcatatttgccagccctacttggtatgtcgagcagtaaaattctcaaaatgaaaaggagaaatcaattgtatttttttagaagctgtggattttaaggtttataattcactactgtattaatgatagtggactaaatccagctaactctatggatagaaaaggaatgaatatggtctgtgtaagtctacacagcaagggtacaacagaagggaacacctgggaaatgtgtaagtagtagcagtgtattaaagttaaagggtgagcatgcttttgtttatatgctttaatattcttttgaatatttttgttttgtttgtccctcattgctgtgtttactggttttatctaaaatttataaagttttagtacataaagatttttggccgggtgcagtggctcgcgcctgtaatcccagcactctgggaggctggatgggcggatcacgaggtcaggagttcaagactagcctggccaacatggtgaaacccctctctttactaaaaatacaaaaattagccaggtgtggtagtggacgcctgtaatcccagtacttgggaggctgaggcaggagaatcagttgaacccaggaggcagaggttgcagtgagcaaaatcacgccactgcattccgacctggacaacagagcaagactctgtctcaggaaaaaaaaaaaaaaaattaggccaggtgctgtggcttgcgcttgtaatcccagcactttgggagccaaagcaggtgaatctcttgagcctagcttgagaccagcctaggcaacatggcgaaacccatctctacaaacaatatgaaaactagctgggcgcagtggcacgtggctgatagtccagctactggaggtggggctgagatggggggattgtttgagccctgggaggccgaggctgagtgagccatgattgagccactgtactccaacctgggcaacagactgagaccttccttgctcaaaaacaattttttgttttttagtattataatagtctacaaattatccaagtttgattgactaatgatcagaagtttaacctgaagtttgtcccttcattgtaatgaaggttaacatgttacccactgcattgatttgtacttcatataccaaatgcttactatatatatatattatatatatatatatacacacaataagatatatgcaacagaacaagagcctagtaacagataaaggaggtaatcacgcaggagaagtgttactttacattcctatgttaacattcgtacaaactagacagaccagattttaaattttacttaaaaggtatctgccctaaatgtgactgtctgctgctcattcaacaaatatttactatgctcctgctacatgccaggctctgtactgctgatagccatatagctttgcatggtggttagaaagtgaacttccaaagtcatgcttcagtctgtgtctcactgtgggccaagttcaaacttaagtgctcaaagctcaatttatgtaagcaaagtcagtcatgatgggagcacatgagtaaatacccacctcagcaaggccctgaacccagacttgaatgtgtgtttgtggtctcactgtgttgtccaggctggagtgcagtagcatttcacaggcgcagtcatggtgcactgtagcctgaaactcctgggctcacgttgatccatgccagcctcccaagtggctgggactacaggtgagcaccaccacgctgtggtgcagtcgtgggattggcaagggaacctaagatgtttctcctccccacttaagtattcttaatgctttttttttggtaggagtcttgctccattgcccaggctagagtgcagtggtacaatctcactcactgcaacctccacctcccaggttcaagcgattctcatgcctcagcctcccaagtactgggattacagggtatgcgccaccatgcccggctaatttttatatttttagtagagatgggtttcactaatgttggccaggcagggcttttcattaattttaaatattgtctggttatcccttatgatagatgaggcatttagttctaataccaagcacctcactctgtaacacccccacaggactttccaaatgcatgactgtgatgaatctttcctgggctgctccacgctgatggcttgatgcacacaatccacagcacttgaatcgcactgtcctctgcttgctaagctatctggtgaagtgatctttatttgcttttgatttttcaaaaatatgttgtctcctatttttgacctttgctgagcaatcctattccttccctgaccaattctctcataaattctttctctgttgtttattcctggttactttttagcttggtaaagagcaccagttcccaccaatcacagaactagcaacttcagtcttcctaaaatattttacatttaaaaaaaaatcataataaagcatcgttaggcttgtgttaacagatctaatggtattatataatctaccactcaagagtacatctgccatgcttccggatcttttctgtatcatatttatattgcatcatatgtataaacccactcataccatgtttttttctataaaactgcgtattttgtagtctaaaactttttactcagtattttatggctatctagatctactttatcttctgcttaacattttttagaactatgttccagctcttgcgtatctagcctcatcttgtgcatttcctgtcctttccattcactgtgcttgctgaattgtcacaacacatcacaggggtctgtatgtcatttactgtgctcagacacacccagtccatcaagcctttccccgctggaagctcccgcctgcctggtggccccccttctgccagtttccattccaagagctcagcacttggaaccacagcagttgatccagtgtcttctctctaggtcagttttcactgcttcaggcctcctggcctctcatcatacataactcatccgcacagcactctctatgctctaatggaagcctctctctgccactccctggctccaagtccccatatcctcaactgctctgaagcttcctctagcttaaaagaagtgtagcttcccttttcattgatgacgccgcccccaagtgggttttttttcctcgtattcctccatccagatatgaggctggtgcactcttgcccacttgaaacccatcatcatgcctccttccccctcaagtcactaatgcgtctttgaatgacagcctggctttccaccctttatctatctactcttctcactgctatctatctatctatctatcttctgccaaccaacagaaaccataatcattttttattatttttttgagaaagagtctcacttttgttgcccaggctggagtgcagggtgcaatctcagctcactgcaacctccacctcccaagttcaagcgattctcatgcctcgctgagtgccaccatgcctagctaatttttgtatttttagtacagacagggtttcaccactctgtactaaaccagggaaaccaggtttggccaagctggtttcgaactcctgacctcagtgatccacccgcctcagcctcccaaagtgctgggattataggcatgagcctctgcaccaactgccgtaatgcatagtctctcatcgtccagccatgttatgaagtctacacatacatgtattgtcaaggttctccgaggcccacctctgataaccacccacctttcttctctcatgatcagaaataatatagtatttttttgtcctcaagtgctaattcttaattaattatttttttgacttaaagcaacaaacttcaggagctggctgctcacacaaggcttgttacttgcttagcacaaatacgactaatgattattttccccttttcaggtgtcaggtcataaattcaaagcaataagcttttagaaaacaatttttatttaaaaaatcataaaaagtactggaatgaaatacaggtaaagcatttgaaaattatttttctggcttagactgtttactggctcgattcagctctgtcctggtaaaggcctccagaaccttcacctactattatcaagtctggcctcaagggagggacttttactgtactgaaaggaagccagctgaagccgagatctgaagcgctcgcttccagttcccggaagaaaacatcatcatcattctgtgttatcatgtcctgcagctgtgaatttccttctccatcttagatctcagctccctcttcaccttatgtaatgtctgaaaaagaaggcatgtcatcccgctgttcacagcatttatccaggccctcatctattgttcccctccatcttccagctaatcaaactcctccaaaattttcaataatctagcaacagcagctttacagagacctaactaaagttaaaatcataggataaaaatgtcttgggtcatagatggttgccttattagtcttctctccattccctttacaggtataatacatttggttttctactcctaaaaatgtaaattagtcatgtgtcacttaatgatggagatatgttccaagaaatgctcattaaatgattttgttgttgtgcaaaatgtcagtgtacttacacaaacctagagagtcagtccactgcacaccggggctatatgatacagcctattgctccaaccaccaatgtacgggtcccttgctgaaagaaacattgccatgcagtgcatgacttggcttctatcttaattatacctgggcctgagatttctctctggctttaagttcttgatgttcctgtgatatggctttgccagcaatgaaaactgtttataggaagaaaaaaaacaaatattatatttaatgtttgagtccaaatgtaacatttcttaatgttcacaggcttaaaatcattttaatggaaataggaaatatactgtactatggtcaggtattatttgatcttaaatttcaatcttgaaatggggcctctaatctgtagagtgcaaacttcagttaacacaaggtttattgtcaacagactaagaagttttgccacaagggcaagtggtcaggactaagcacaacagcgtaagcaagtgccagagcccacctggtccttatagtagttctccatggagtccagttcatcctggtggcgtctctttgttcatctcgcttttctttggcatagtttcttaggtctcgtaatctttgcttttgatgtttaaaccttcttcaaacagtttcttaaatatctgtcagttatttaatcgtaaaaatgtcattgaggaatatcattttggccaactagaggtatatactgattgtatttcccaaggtttttttttttaaatactagttttattcagatgttttgacataccataaaatgtacctctttttctgagacaggttattgctctgtcacccaggctggagtgtagtggggcagtcacactcactgcagccttgacctcccaggctcaagcaattctcccaccttggctacccaaatactgggactataggcatgtgccaccacgcctggctaaatttttaattttttggagagatgcgtctcactatgttgcccaggctggtcccaagcaatccttgcacctcagcttcccaaaggctgggattacaggcgtgagccactgagtccagccttacccttttaaaataaataattcgtatgttttattatactcagttgtgcaaccatcaccactacagaacatttttaccacccaaaaagaaaccgtatactgactagtgctcattccccctgtcccatccttagcagtcaccgtctgtactttctgtctccatggatttgcatattctggacacttcctaaaaatggaatctgtaattcgtggcctttcgtatttggtttctttcactccgcatgttttcaaggttcatcatactgcagtatgtatgaatacttcattcctttttattgccaagtaacatcctactgtagaatgaatgcacactctttatccattcattaactgatggacactttgggttgtttcccctttaggctattataagtaatgctatgaacatttgtgttttttgtgtgattatatagctagagtgaaattgctgggtcatagggtaactctatatgaccttttggtaaccttctgaggactgctagattgttttccaaagcagctgcaccattttacagccccaagttctccacatcctgccaacactcgtcctctaactgtggttctgagtcgtatttccctaatgacgaaggtgtcattatcttttcatgtatcacagaggttctttacaaccttcagaaaagcagtgtcaagcgccatgtacatagggtaagaacgccaagagcagaaacatgccacacctacacatgtacacactgaggagggggagtgatcatttggggaggccaccggaaaacacactgctcaaagggttggatatgcgcacttgtcctcccttcatcagtgtaaattctggatagaaaaactggtttgacggcgacgcattcatgagctacagacaagttacttacgctctcctcaaagccttccctagaaatatgtccaagtctttagtaaactataattactaaaatattttacagatgaaattattgctagcttgggatctcaaaaggttaatcatttcacagcctgattaggatgacatgcaaatgtcatccttgtggaaaacccctcacagcacagctggacactagtcctgatttttgtggaatgcaaggtcatgttatcacactaaatttgtctctcacatgttcccaaacctcaaagtagttttactggagaagtacctgttatgtgtaggaggcagggaggaagtaagactcacattaagatgagggacacggagactgagaatggacgggaatgcacaatggagtaagaaatgaagtgtggccaagcagaactcagggccagcactataggacttcagtttagattttgattcaaatttggacaagagtcacgaacaaagaaggtggtcctgaaagataacaaagttaccttcttaacagggctggacagaaaagtcagacttaccatttcttcccgggtcctcatctcatcatttttgcacacaactgaactctataatcatcataatattttcgagcacgaacatttgctgtcgattttcttttatctttgattgggtcaacctttgcctacgaatgcagtcttgaagtcttgctaagaaagggaaaggggagggaagagaagggtaaggacaagaggaatcagattccagcgttctcatctgcctcactccccatcacgatgtcttcaggcagtatgtccgtgtggggggccagtggccccagaagcccttcagcctttggcagctttatcacctcaactgaagagcagctccaataacaccccactgcagcagagggcagcagtgatcctgggcaccctgtggaactgagggctcactccccatgccaccaggaagctgctaacaaggctggcccgatgccacctcacaaggagtaggaaaatggcacacccagactttcaagcagagcctgagtgccaggagcatttaggcaaaaactaaggaaattagacagtatctgacaaaggagtgaaataaaatggggtcatgtacataaagcctcttatgtaggtgtttcagatactagtgtttttccctccacaggaaagtaccatctgcagttcctgagatgtcttcctggaactgttcagtttacagttctcatggcttatctctactccacactcaggcaaagatttttaaatctctcctttggcagattgtttctgacctccatcctctcccttcgtaattctctaagcacaattccagtcaaaattataacggaggctgataaatcctggagctctctacttgggacctgagaagatgggagagggcaaacagcactaagttcagctgcttggcacctagatgggtccatggagccacagacagaactggattaaaatctcagctgtgtcccttgcttatcagtgagacccaggcaagttacttagtatctcaaagcttcagggttttcatttcatagaaaacatctctaatcattactatgaagactaactgaaactgtgtatataaagtacctagctcttcctcctgccattttgggtttgtgtgttttgttgttgttgagacagggtctcactctggcacccaggctgagtgcagtggcaagatcatagctcactgcagcctcgccctcccacgttcaagtgatcccccacttcagcctcccaagtagctgggaccacaggcaaatgccaccatgccaggctcatttttccacacccatatatatatttttaatgacagggtcccactatgttgctgaggctggctcaagtgatcctctcacctcagcctcccaaagtgctgggattacaggcatgggctatcattttggttaaagacctaggcaacacttccacatgcaggtgttaagaggttaagggtcttgcaactgttgcccagctagcacagataaagggaatgaatataacaaattcagaattatatacccaacttgctcttgacataccagtctcttgttatgttcatattctttcttgacaaggtagtaaggaggtcatgccttcttagggcttcttctatcttgaagggggacatgaagtaagtaggttaataatgctgttcactaaattcttaaggataagctcttctcatttaaattctatgcttaagactgacagtaacttacttcatcttggagtttcttctttgatcgatttttctacatgcttctttcttaagctgttcaacctgtgcaatttgctgtttccacattttgctagtgttgggccagaaacataaagaaacggaaactgctccagcataaggggcaggagacgtgttcacttactttcactgcaaggtaaaataagatgttcttaatctgagacgtggacagaactgtcatccaacatccctggtagatcaaagcttatgtaagtgatgtggttttgatctgaaaagaacaattctaaatgtacttataataatttgcattactcctctgattggagtagccaactactggtaaggataaaaataagctcaatagttctggattgatgccatgctggtctgggaagtccatcctaattgctcagccgcttcagtgcctgtgggtagattctctacgtcggtaaaacaagactcctcaaccttcccggtaggcaagtgcttagaagaaaaagtttctgtctaaaggatagagtaggagggccagcagtctttgggtgtaacaggaagcctggcattctcatgactttgtttcttgtaacaagactctacactcattggcactgtcaatatataggggtggacaggccatctgcttgccttggagcatccctttcattctaccaacctcccagaatagacaaaaaggcagtcaaagtgagtaagcacacgagtgaggctaacgctggagcagcagtggcagtcctggcattccttgggtgccaatatataggcctccctgaagtacttccttatgaagagttttagccctctacggaaaaccagccacatggcagtgattgggaaaaaaaaaaactttcttcggctaactggtggatgttagctttcagtgctgtgtccttggaatgttgccatgctttcaaaggttgccagttttccataaagtacaattctgtggttcttacttggaatgctttatttggctttgggaggccacctcttagactctgcgttgtggtttttctagagtaatcttccagggctgactacattctggagttcctttacgaacagcttctcctctgtatatttttccttagaagcagatataaaacagaataaaaataaaaggtctaacagttctttcaacatcatcttaaatattacatactgacaaaaacagctaacggtagttttttagttttttgctaacagtaagccaaaccaccttacttcaaatttgtaaaatctggttaatattcatttctctaagttaaatgcaccttttggcctctggcatcccttggaatttgaaaaagcactgatctttttcaagtttcagtcaccatagtcccacaccctaaatacaaccactattaatctttttttaaccattaatgtttcaatgtacttctctttttccatgtagatttaaaaaattctaggcaactatgcagtatgcttagttgtaaccatactgtactttatatcctgttttgttctgaatattttagcataagcattttccccatgatttcacttagtttctgtaaccattctttgaaaggcaatgaaaacttctgttttgggtttcttacaaccaggtctatagccaactagatgttctgtcttctcttactcttctttaattttgtcagcctagagtagtttttaagccctggtgaactgctaagtcaaataaacccttaaaaactgatgggaagttttaagtagcggaaaacactacttttctttggaaccatgtctcgtcatattttagcaacctgaatgccttataataagcaagtcctgtatcatgacatgaaatcctgccttttcctaaagagctcatgattaggccctgttggccccttcttcttttaaaaagatcatctttgtacttcccactcatctgtcaaatggcatttattacagtggagacttttacccactgtttcctcctccttctcatgtttcttagaggtccaatattctcttgaactttatgtcttcttagttccctttcaaatgctcagtaaacgcctaaaggggaaaaggtcatatattacagttattaaaaacatacacaacggcagcaccatggcttagctggttaaagcacctgtctagtaaacaggagatcctgagtttaattccaatggtgcctcaaccgagcatccaagctcttagccgcgtgcggtgaggatgagcaggtggatcacctgaggtcaggagttcaagaccagcctgaccaacatggagaaacccctctctgctaaaaatacaaaattagctgggcgtggtggcacatgcctgtaatcccagctatcgggaggctgaggcaggagaatcgcttgaacccgggaaacggaggttgaggtaagccagattatgccattgcactccagcctgggcggcaagagtgaatctccaccttgagaaaaaaaaaaaaaaatacaaaagaggaaaaaaattcacctaggatacctgccacccctaaaatataagctcattcactttttaaaaaaattcctttcagactctatatcacaaatgtatggtttcttgttttgttttttgagacagtcgcactctcgcccaggctggaggcagtggcacaaaccagctcactgcaacctccacttcccgagttcaagtgattctcctgcctcagcctcctgatagctgggactacaggtgtgcactgccatgcctggctaatttttgtatttttagtagagtggggtttcaacatgttggccaggctggtctcgaactcccgacctcaggtgatccaccttctcaccctcccaaagtgcagggccactgcacctgcctcacaaatctctacattactttacatatataattgggacataaaatgaaattttacatcatgcgttttttctgttctcaagttttgcaatcattttgatactctcctgagtggaagttacatgctgagttacaaatgagttaagatgtctgaattggttttagtttttcaccattataaatcctaccgcattataaaactactactgcaaataagtgttctaaatccatgctacatttcaaaatccacattccacagtgaaagtcttcctaggtaatcataccaatctccctgttgttgaatcccaaccacctcctccattcctgtcttgggtacttgatctcatcttctctgtaactcaagtggcctttcacgttaatccacctcaaattcccttcttctctgaagctcactctgaaaataacaactcacactgtctcctctttcttaatctactggaacaccaagctatgtccagccaggttattttttttagagtttcatgagtataattttatgctaacaaagacataagctatgtcacatagctctcttcatccactccgctcaagaatattaaatgtattttaagcctaaatcaacagcatgttcaggtagcatctggctgaggggaaatggtactggctgctgcttaatggtagtcaagagatgggaagaacctgtgcttggaattggcggacatctgtttctcttggcttgcgctgccttttctctccaagtggaactgtttgtgtttgttaactggagatggagagagcgaatgggatcttagggtggctttctacgcatggaaagtcctgcaacagagaaaagacatataacattagtcctgatagccagaatgttatgctggaaaccaaagttggttttcactaaatccaaagagatgatgagtgaatgtgctaaagggactctctcctgtaactaacttgaattggtatggtaaaccaagtaaacagacaaatgcatacaaatgtgtactgtctcaaatacttagcttctacatcaactttggatattcaacatgtggaatgcctcctatgcacaaaggactatggagagtgtcttggtgatagggggagatgcaaagagagaaaaggtaaattatctgagccacgcatctctatccttttacctatctgggtcctgagaaggtgggatgtaagcatacatatctatcttttatatatgcttataggcaaagttaatgtgttaagcattgtctaagtggtctcaattttccctacttagcaatctagccctcctaattgcacactgccaaagagatctaataaaccattccttctacaaacctttttatcccattgtctataggtgtgtctggggatctgctagttggaagagggtgactccagtgggaaaagcacttcaacatagccttaagaccaaggaagctatttggtacctttataaataaattttccgagcttattatttttttcacatgcttttaattaagtctttcacatttcaaattctaagatgtatttttaaaaactgacttgcataatctatttaaatgatagctgctcatgatgtatttttctctagaaactgaagacgcacttgaaatatattttaatttataacctgttttcacaataggataccatgtgtatgtacataaaaagggaaggaagaggttcctggatgagggtgcctagaaattagctgagtccttttaaagggaaggagaggaaataatcaagagaaggaaagagcattcttgaaggagtaaaaaacaactgaaaagttaaggaagttggatcagaaaaagactatttctgaagaaacaatggatgaccaaagtgataaaactaaatgtaaaatatgcaggattttagttggtggaagacaggataattggattgaacaatggcatatcaaacagtagaagtatctgcaaagacacggcaaaccagaaactgtgatacgagtataaagcagtgcaatcactttggtgggcaagttggcagtggtgaagaaagtaggccttatgatccagcaatcctactagatggagatatcacagaaactcttacacatttctaggctgttcattgcagaatttttatagtaatgaaaactggaaacaacatgtccagaataggggaaatagatagtgctacacgcgtgtgtgtgtggtatctgcagacgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacacacacacacacattaagtggacactgcaagaactcagtcatgtccagcagtaggggaaatggatactgctatacatataccacacaaaagtgacacactgtaagaactcagttacactgcagttaaaatgaatgagctgatctgtaaggatcaacataaatagatttctaagacaatgtcagaaaaaaacgcaagttcagaataatatatacagtatgtaaatttttaaacaacataaaacaatactatgtttagaaagtaatgcatgagctcttaaagtataaaaacaaggatcagaagaaaagatgccaacttaagacagtggttgcactgagggtggggaaaagagatctgtggggagagcagagggggttctactgttttatttcttaaacacaaaggggctaaagcaaatataattgttaacacttgcacttctagatggggaagatccaggtgtttgatattacttttgatccttttatatatttccaactatttaaaattagaatataagttattaagaacagatggaactgcctaagtagttccatggatgtcccccttctcagtctctctggggtaagtacctggccttgacttctttggccatactccacgatgccatcactgtgctgagacagtgtctcctcagttccatcctctacccctcatttccagtattttcttctttatggtcagtcttttctttaatccgatcacccagacactttttaacatctattgagaaaattcttttcaacatctttcactgatttcagcagaagtaaattcgtaggagtaggcagacctttaaaaaagcttcctttgacagtcactaataacagttttcagacgcttatgcatgtttaattatttacttttattttgagacaggatctcacctgtcacccaggctggagtgcagtggtgctagctgggctcactgtaacctctgcctactggttccagtgatcctcccatctcaaccacttgagtagctgggattacaggcatatgccacaagcctggctaatcttttattttttgtagagatggggttttgccatgttgcccaggctgtctcaaactcctgggcttaagtgatccacctgcctcagcctctcaaagtgttggaattcagttgtgagccaccacacctggcatacatgtttagttttaaaaaggtgtatatcagtgtatggatcactaagtttcaataaactttagaaaaagtcacgtagggatttaaaacattcttcaatgataccttaaaactgtaatattgtattttgtgagaatcagtgatccatccaatttataccagatctgtctttagcggcaaaggggaactataaagacatatctaaagaaaaaggcttaacataatcgtttatgttaaatgatttagttttcatcagaattcaataaaatttgataaatctgcaccaaatttagttagatcatgaaacgctgagagatcacttcctgttctcctgcttgacttacggaacattttcacagtaactattaataagacacaactaattttctatacctcactttcaattgagagattacttaaatgctcacttaacccatgggaatctcaaatagatgaaaaaacaagacttgcccaatctagttcagaaagccgctgagagagtttttcgatacatcatgtaattcttgttctgttaatctctttcttggcctctgggggaaaggtgattgcaggatgaggctgtagctctgttttcatttctgtaataaaagtgaccatttgacagaaaatagctaggtgtctattatttagtttaaaataactgtaatacgtactttaacaaatcttcattctggtcttcacagctaaatttggagatcatgcccctgcattttcaaattccttgtaaacagactgtaaacactgaagtctgcagtaatgttacctttttcctttgggaggctccttgtcctaggcccttggacctgagctggatatacttcccatttgctgcctttaggcacttggaaattaagaaaagtccatcatctagatcctattaaaaacagaaaaaaagttgattgaaaaagctacaaataagaaacatgaactttctgggagtgaggaagggaggaactgtgcacaaagctacgtgccttcaatctccgtgttttgaagtgcatttgtcaaaagaccctatgacacccagtgcaccaaaggactggagcaatgtctagaaacttgtgctcagagaacaatgtggctcaggatgccattcaaataaaaacacaggccaggtgttctctaaatatgaaattcagggattaccactatacctgagcaacaaaaaaattatcactagtacaaagtattcaatggctatcttttgtatcaatgtcaataaaggctgtccaaaattgaaacagttaaaacaagacaacacctctcaaaatatgaatataaacccttaacattttaaatttcctttttttttgagacagttttcctctgttgcctaggctggagtgcaatggcttgatccgcctcccaggtcaagcgattctcctgcctcagcctccctagtagctgggattacaggtatatgccacaaccctggctaatttttttgtgtatttttagtaaagacggtgtttcgcatgttggccaggctgtctcgaactcctgacctcgagtgatccacccgcctcagcctctcaaagtgctgggattcaggcatgagctaccgtgtccggctaaatttatttcttggtcttagagataatcttttaaaaatacttcttgtgatgaagaaacatttaatgtttgtttgtttttttgttttttgagaggggtcttactgtcacccaggctggagtgcagtggtgcagtcttgggtcactgcaacctcacctcctgggttcaagcaattctcctgactcagcctccagagtagctgggattacaggacctgccaccgcgcctggctaatttttgtattttcagtagagacagggtttcaccatctggccaggctggtcttgaactcctgacctcgtgatccacccacctcagcctctcaaagtgtgggattacaggtgtgagccaccgcacccggccatttatttaatgtttaatgatatcttaatttcacttcattatctttttctattaaagtaaaattaaataccctttagtaggctggtatggtgattcatgcctataatctcagcaatctgggaagcagaggcaggcaggtgaggcaggagtttgagaccagcctggccaacatggcaaaaccccgtctctactaaaaatattttaaaaaaaatcagccaggtgtggtggcacgtgtgcctgtagtcccagctacttgggaggcgaggcaggagaatcacttgcctgggaggtggaggttgcagtgggtgcagactgcaccacacactccagcctgggcgacacagcgacactctgtctcaaaaaaaaataaaacaaacaacttttactaaatagcaactaaaatataatcatattttaataaaacttttaaaataaagtattctagctcaatgaattatttgaaaataaacactcccctttaactgccacccaggtcaaaaacagagtattaccaactcagaaatatctctaaaacccccactatgattcccccaaaataaacattatcttatgactccattttaacacctctttttatctaatccctctcctgtttgatgcacagaatgttgagaatgtggtcacctattgttaataatgcttatttcatctctgacttttaatgcattgcttgaatgtttaaataatgaaaatgtatcactgtttatatatctccctgtgtacatacctgcctgttgtttttcttattttatttttttctttttgagacaggtcttgctctgctgcccaggctggaatgcagtggtgtggtcacagctcactgaagctcctggctcaagtgatcctcctgcctcagcctactaagtagctaagatcacaggcatgcaccacactccaggctaattttctatttttagcagagacaaggtctcactatgtttcccagggtgtctcaaactctggcactcacatgagcctcccaaagtgctgggattatgggtgtgagccccgaacccagtcctgttctttttagaaagataaggacaggatgactatataaaaaaggtttttcttttttttttttgagatgaagtcttactctgtcacccaggctggagcgcagtgggtgatcttggctcactgcaattgaaccaaatagatcaatatgttaacagtggttcatggggataatgggaatatgcatggatggttattttcttttccactctgtgttttctaaatttaaattattaaattacggacacaatatggactctgaagccagaatgtccaagttcaaatctgactctgtaattgctgtgtaaccttgccctctctacatcagcttcccaacaataaataatatagtagctactccagagttgttatgggcagtaaattattcaatacccctaaagtatcagaactgcgcctggcacaacataaacattcactatgtgttggctcttattatttcccttatatgcattcgtttttctcctatcttcctagaacaagaatgtgcaggtgtatacagagcaaattttaaggagtacgatgctttgactagtgcaatatgcttgacaattctagcagactctttaaatataggggcttccttgacaaagaataaagacttcaccaatacacatacacaacacggccttctaatcaattaccaacacacacacagacatacatacaagtgtacttctaccaactgaaagtaagcttttccacttaccccagaaaattccgtatgctctccagtagaattacggctggggagcagtgacttgaatgcaagtattcttttcctatggggcagggtgctgaggctctgaagggtggtagggtggatgtaaaggaatagctgctcggataggctcccctgcttcctagcatttggaatcccactcacagaaagggtttccgctagtaagacaaattaagtggatattacgatgcaattctaagaaataaaccattttatatacatacatacataccttataaacatgttcacatacattagaaatattttttaaacttaagacaaagcacataaaaaataattaaaccagggatatagcctcagcacacagggatctaattaaattaggatgtaatttttttttttaatttttaaaaaaagtagagatgaggtctcgctatgttgcccaggctgtctccaactcctgggctcaagtgatcctcctgcctcggcctcccaaagtgctgggattaaagtgtgaactaccatgactggccccggatgtaattttaatgttattatcataaaactgtccctgaaagttactttaaaaactggaagcaacttaaatggcttgaagaatgttatgtttgtgaattatggttcgtccacgttacaaaaccagttaggcagtaatatttttatgtattctaccatatgaaaattccagagatgataataagaaacaagaatgatttttccaggccggtgcgggagctcacgcttgtaatctcagcaatttgggaggctgaggcaggcggatcacgagtcatgagttcgagaccagcctggccaacatggtgaaaccccatctctactaaaaataattagctgggcgtggtagcaagcgcctataatcccagctacttgggaggctgaggcaggaaatcgcttgaacccaggaggcggaggttgcagtgagccgagatcatgccactgcactccgcctgggcaacagagctagactctgtctcgaaacaataaaaaaagaatgtttttccagtactatactttgttatttaccaataatatgaagaccaccaatagatgtactaatgtgtcaagactctgtcccattaaaaaaaaaaggtaagtggtgagaatttagataataaaatagtgatgcaaaaatatgcaaccaaagaccatgttaagcagaattcagataccataattaatagaaacatttacaagtaagatcatgtaagaccaaaaaggatctcatatacagcaataaaagaaaaaggctaatggcaacaacaattgccccaagaatgatcatcagcagtaaagaactaaatccattacaactcactgtcttcaacaaaggatgtcctactcttggacaaaacactagggggtacaacatatcttcatgtgatttagaacttggtgaggctaaggcttttttagacagatttcattaggacattgagcacctaggaaagaaaatattaaaggtaaaatttttaactacaaaatagtttgctgaacattatactaaaagccaagagttttgtactcaggaaacaaatttaaataatgttgaacgaaataatgttggtccaactgctcaaaataccaattattattttctttttcagacagcatttccctcttgtcgccaggctgcagtgcaatggcgtgatctcgtgcactgcaacctccaccttccaggttcaagcaattctcctgcctcagcctccagagtactgggactacaggcacccgccaccatgcctggctaattttttgtattgtgacagggtttactatgttggccaggctggtctcgaactcctacctcaggtgatccgcccacctcagcctccaaagtactgggattacaggcgtgagccactgtgacgggccataatatcaattattttaattgctatcagaaagtaagatgccattttgtaatccagaatcatttatacaatttaaagcaaagtttcatacaatgtttcattatttagctttagaaaaatagatgccagagttacgaaatgctggctgttttatggacatgtcttggtatgaatagacaccagagttagggtcttgctagtaccagaaacatggactcatggtccaggccaagcgcagtggctcatacctgtaactcagtactttgggaggccaaggcaggcagatcacttgaggttattagttcaagaccagttagccaatatggcgaaaccccatctctactaaaaatacaaaaatcagctgggcatgtgcacatacttgtaatcccagccgcttgagaggctgaggcagaggttgcagtgagccgagatgcgccaccgcactccaccctgggtgacagagcaagacctagtgtcaaaaaaaaaaaaaaaaagactatggtccatatattgaagcttaaattagatgcctgtgaatgtatatgacagtatctgacactttaaatctcaatatgaaaggaagctgccataagcccttttatcacatcaacccaaacaccttggccaggcatctctctgaatcttttttcctttgccttaattgcatactcttaaacacaattcccctctctacttataatgttaaaataagtaattcattttacataacatcttttttacatagcacttgacatcacagaacccgtttctgcaatcaccatccctccattcccaatcaatccatctgattctcctacttcaagaaacatttttgtagtatccaacttgactctggtccttccgtttctgtgcctatcccaatggcaagcatagctttttggttactggagggtgagtttgccaggaaccaaaagtaagggagaacattccaagacttgtggccatatactggtttagtaatttatgaagccacggtggacaggatggagtaggatgattgaggagggcaaggttggaggctcaaaattggggcttgaaagatatccgggtctactatgtcaagcaataggctgttggaaatctggcctgaagcctagaagaaaaattgctactgcataacgaacttattggttcaaacaatgaaaaaagtgagtcaaccaccagttcaggaaactacattaaagaataccctgaaagcgtgaccagactataagctgcatccataattctcttcccggttataaggaaccgcaaattacctaataaccttgcatacacttatttgccttggactttctgcccatatgcctgcgacttcagataagtgttcatatttaatgggtagtgggatatttggaatttcaaatcccatgtccagttagcactctattcttctcaattttaaacactcctcataccatttacatttttatagttgtatgttgaataataactgatacttcaggtttaacactcaccattacttcttagagaaaaggtgtgtgctgtgtctccaagtctaatgatttcacagtggattctgcttcatctccatcccaagaggggcccaacatctcagaagacaaggagacctggaaaagttccctccttcactcagggcccagcctgaccagagggcccttcccctgggacctggagagctgctgggtgcagaaaaaggaaaagactctcccttttgctgcttagctgtcttgctgcttatgttttgttttcactgatatatgaatggtagaaatagctgtatataagtgtcaacgattaaatgtataggagaacagcaaatactggtgactctagggtgtggggtgaagggggtgggatgctaactttgcattaaatatccttcaattgtttcacttttgcgttattttgttactttaaaattcttatggaaagaagttcatcaggccgggcatggtagctacacctgtaatcctagcactttgggaggcagacataggtggattgcctgaggtcagggttgcgaccagcctggccaacatagtgaaaccccatctctactaaaaatacaaaaaattagtggacgtggtggcaggcgcctgtaatcccagctactttggaggctgaggcgggagaactcttgaacctgggaggcagaggttgcagtgagccgagattgcaccactgcactccagcctggcaacaagagcaaaactctgtctcaaaaaaaaaaaaatttcatcttatgatggtctccctgagacacattttttacaatgtactatacctaaaaaagaaggcattgcctgtgctcttgaaccatgaagacatagcattatgctcaacctctagttagcaagaagtgcaatcaaaccgtcatgacaatacatttttgtctatgaaagaagcacaagtttaaaaactgtgaaaatgacaatgatactggctcatgaaggtcctgtaacccagcattgctatactgttggtaaatgtcagtcatggcctttttggaaaacagtctggcaacttttattattagccttaaaacatttcactgtcttactctgaatctagcctcaagatatgaggaaaaaaagaataaacattaagttcacgtttttgataatatttaaaaaaactctctactttagaggaatggcttagtaattttgaagcatccacatgaatgatgttatacagtgattacaaattattataaagaatttaacacttgaggctgggcgcaggggctcacgcctgtaatcccaccactttgggaggctgaggcggcggatcacttgaggtcaggagttcaagaccagccttgccaacacggtgaaaactcactttactaaagatacaaaaattagccagccgtggcggcgtgcacctgtagtcccagctaccaggaggctgaggcacaagaatcactcgaaaccgggaggcagaggttgcagtaagctgaattgtgccactgcacactccagcctgtgtgacacagcaagactgtgtctcaaaaaaaaattaaacaacttgagaacacttaatgttaagtttaaaaatgcaggaaacgagcctggtgagtgggtcatgcctataatcccagcactctgggaggctgcagcaggaggatcgcttgaggcaggaattcaagaccagcctggtcaatatagcaagatgccatctctgttaaaaaaaaaaaaaaaaaaaaaattagccaggtgtggtggcgcacacctgtggtcccagctacttgggctaagctcaggagttcaaggctacagtgaactctgatcacgccactgtactccaccatgaggtcagagcaagaccctgtctctttattaaaaaagcaggggtgaggggcaggcaacgaaatatatagacatatgactaaatccaaaaaagaaaaaaatagtaaaaaggactaaaaaattaacaaaatgttaacagcagttatttagttcggaatagattttttttcctgctttttctatttgcaagttttttgcaaagatgatgacgtactttgatgattaagagaaaaacagggacaggcgcggtggctcatgcctgtaatcccagcactttgggaggccaaggcaggtggatcactgagatcaggagttcgaggccagcctgaccaacatggtgaaaccccatctctactaaaatataaaaattagccgggcatggtggcgcgtgcctgtaatcccagctactcaggaggctaggcaggagaatcccttgaacctgggaagcagagtttgcagtgagtcgagatcatgccacacactccagcctgggcaacagaatgagactccgtctcaaaaaagaaaaaaaaagaaaatataaaaatgagtagatagttgatactgagatttaggtattatatgtaactcaaggttctaaaactccctcaggaaagtttaaaatatgagaagttagtagaagtttcacattagcttttttggtgccatcttggtatattacgtgtgattttaattcttagtccaaaaagcgtaactgttttcatcaaattcagagacactaagtgctacctcccaaaagaaactcttttccatgtgatttagattctttagtactttctggctcttccaaacgttctcctcgatcagattcttaaaatactgttcagtttcacctgttcagaacagataaaaacaataccaaaaaacccctagtgaatactactttttctatgtaagaggcagggaaaggtaaggacagtgaggcacccctacttgccatggtaaacagggttctagtgaaagtgcaatcagaaagaaccaaatcacctgaatgagcatgtattattcgagtaacaaagaaacaagaatattgctttaaaaacagggtcacagttgtatgagcaatgttttattttttaagtcagtggcaggtccattcaatattttttacctctccatctgtaaaggatgtctgaggtatatcaaggtgacagaaaacgtgattgttcaacataatgcaagctccaagataatcatgccttaggctgagtcaggctgtatcagggttggatgaaatttttcttaagaccatcagtctttttccaccccaccatacttgaagaatcatactttcaccagtagctataactcactagggaaataatttcaaaatacatgtaggtgaacctcccatgattcagatttacccctttggatattctcatgcccatgtctagagattcccattcaaacacccaccttcatttttttctacttccatattcaccaagcaacatttcaaaacatcaattaacatttattatgcatttactctgagctaggctgtgtgcccaactgtttcacacatctacttacttaactttcacaacaaccatgaaagaatttcagatgagaaaacagcttagagagctgccatcatatagtgagaggaagaacccagcactgaacccatggtcttcttcgaacccctccttcttcagtggtaaatgataatgctagctcaggtcccaggttgaactgccctgcacagctgatatgattagtgataataaagatttgtttcccattactgttaatggcattttgaagaacctgatcagctctaggaaatattgccaggtaagtatatattagactgcaaagatgagaagcagactgtaagaaaatgctgtccagctaaggtactgtcatataggaagcctatctgagcaacttccccagtagctcaccacatactgccgatctcccctgggatatccttcagtctttcaccaccaccagactcacataaaagtatctctcagttgcctcccctctcttcatccccactgccatatcattagccaggcactaccatccctccccttcctggagcaagcactaaactgtaaaaaactgctgctctctttacatttcaaattaatctcaattctttacttagaggttgttttctacctcttaaccctgttactaaaaagactagaaaggtcacagcatacaaatacctactggtagccttgaattaggtgagtcccacctgtcaatacttcccctagttctaattccccctttatgcttttattgtatgtagttatggctgtctccctactcaagtacaggtttgagagtatcaacatgacaagcagcttggaatcctcccagagtaccagacgcctataaaacactcaatttttgaaacaaagaaatgtccagtgtggcagactttcaattttccctcccagtttttaaacagtttagtaacaatgattaaaggtaggaaactactctaactaaagactttaagattaatttcaaatgtgactatcacaggtctcactataaaaaagtgagaatggaggatgagcctaccccaattttttgtcttaatttgtattcgaattttgtaaattgtggttgctgctgaaagtttatttttgataacttttcaacataagaacaggaatatattattccattcgtgaccaacagcattatttacttaatctcaaattattaagacgttaagttctttcactttttgcaatgacaaatatctgaaatatttaggctgtcacaaattaagtgcaggctaaagacacaaatgcaccaattcttcctgttgatgcctcagtaacatcaaatatttaccataaatagcagttctgacacacgaaattttggagaaagaaattttatgaatcataggacaataaataatttagccagaaatttatctttctagtataaattagttttaagtaatttatgagcaacatccaagttgataaagaacatgatgacagtctaagacagttccaaccagctggaacaataagaatttgaaatttacaactacggttatcaggtatactgtttagtgaatctgcttcctatgaagaaaaatacacaaaaagataaaaggcaaaagggacaatcataaaaggtaaaccaaaccaaatttccattcttaaacttacttttctcatgagatgttcactgatgcgttctgtaagatactccaacaaaccatcaaatatttccaggagattctaatagattctttatctcctttcactatattttctcctggagacagaatatagagctattaaaaatttaaccatgaaatctgaaagcttcataatcttgaaacttggatataacattgtaaaatgctatttaagaatacaggcgatacataccaacttacagctccttggagattaaaaaaaaaaagaatacaggtgaaacaattataaatattaagaacaacaatttcctgctgccgattatatttgaagaaaaaaagggggaagctttaaatatggcgtctaataattcactggatattccttccttttttggagaagcaaaataattggacttaagaaaacatgtctagtaaatttataccaaaatatattgcagctaaacagaactttaccagattggtgggaaaaagtgcaggagagaacactttcagattgtggtatcctattctaaatggtggtttgttcagaagatatagcagcagagtaacatcaaaacaacaaaaaaaaacaataaacttgttgggatacttcatcagaaattcctgaattctccaccataaccccccatatttgttaactcctcattttgatagatcataccatttttctgattaaaatcctttccctggctccctttctgaaatataaccctgcatataaaacctttttaaatctcactccatcttcagcgtctccagctacatctctaccatatccacttcatattcataacttacactcatagatcatagcacagtccctagcaagtacctactccgtaacagatttttaatataaatgattaggttgaaatgttgaatagaatgggttggcaaaaagcatggaaacttgacatatttaatgtcacctgaaatggactccaatcaacctcaggtatagatagtacttaacccttgtgacactctgattgtcctttgggagacatgcctggcattctcatgagttcacaccaatatgggaaaagcagtgtagaaatttgactttgggagaatctagccattcgtaacctcagccatgatgcaaaacaaacctaaaccagaatttgacgttttatactactactagtaacgacaacgtttgagttttttcgtttaaaacatgaaccagaaatcttggttttggacgtgtttttccggcttaaaaatacctaagtatatccaagagcatcctcaaaacttttcagtttctaggatggggagtatactgacaacctagcactaagactgccagccagaatgcagtgcttcatgctgcaggagaaactgttttacaattttcatagggtgggtgtaatctgtcaaagacagctctgcattaaagagttttacaaacatgatgtttataaccctgctatagtatgtttaacaagcacaaataccagaacttgtcctactgggtgataaagcaattacaaattgcaaaaaaaagagggaaactatgggagtagccctcaattatctccgaactgatttacccattcactcacctagaactgcattaaaaaacttaagaagaagagtattttattctcttcgcaaaaatttgttcttgtcagtatcaaattaagagattaaatcaggacttatcctgattaacatttatctccttttacaactatcaaagaataaataacagtataaatcctctttttgtgattatagtttcacattgtcaatattccctctattctaagcttgaaataacttactggaataatcattcatttctaaacataaatgaaatacacaaatacagtgatttataaatatatttggtatgcttagttttagaatacagtatagtatacttattttggagatttaattacagaaaaaaacttctgaatagataacatggttcaaaattagcaagtgcaaaaagtatacactgaaagttcttgtccctttgtcctgcaaccctgaggtccctttgttggaagcaatcagtattacgagtttcttgtatatgcttctagagagttcttcgattgcaaacaactgcaaatacttctgcacacctttgtttttacaaacactagcatacactctgcacattaccattataattgtactacatttttctcgcatcacatatgctagagatgttcccaacacggaacattgtgcacaaagagcatattcagtcatcttttacagccacaagcagtccactgtatgcagctatcatgatttatctaaccaatccctactaatggacattaggtgtttctaatttttagctatcacaaacaagtagcattagtatgctttaaaataaaaaatacggccaggtgttgcgagaagtcagggaccccaaacagagggaccggctgaagccaggcagaagaacgtggattgtgaagatttcatggacatttattagttccccaaattaatattttataacttcttatgcctgtctttactgcaatctctgaacatgaattgtaaagatttatggacacttatcacttccccaatcaatacccttgtgatttcctaggcctgtcttcacttaatctcttaatcctgtcatcttgtaaaccgaggaggatgtatgtagcctcaggaccactgataattgcgttaactgcacaaaattgtagagcatgtgtgtttgaacaatatgaaatcgggcaccttgaaaaaaagaacaggataacagcaattgttcagggaataagacagataacttaaactctgtccgttggtgagccgggcggaacagagccatatttcttttctttcaaaacaaatgggagaaatatcgctgaattctttttctcagcaaggaacatccctgggaaagagatacacgcctgggggcaggtctacagacggtcccccgggcgtggccatcttttatggtcgtagactgtagggctgaaatagacctcagtctcccatatcgctcccaggcttattaggagaagaaattcccgcctaataaattttggtcagacaggttgctctcaaaaccctgtctccgataagatgttatcaatgacaatggtgcccaaaacttcattagcaattttaatttcacccagtcaggtggtcctgtgatctcgccctgcctccatttgccttgtgatattctattacctgtgaagtacttgatgtctgtgacccacaacctattcgtatactccctccccttttgaaatccctaataaaaacttgctggtttttgcagcttgtggggcatcacggaacctacagactgtgatgtctcccccagacgcccagctttaaaatttctctcttttgtactctgtcccttatttctcaaacctgccgatgcttagataaaatagaaaagaacctacgtgactatcggggaggttccccgaaggccaggcacagtggtccaggcctgtaatcccagcaatttcacgagtgagccaggtggatcagctgagcccaggagttccagaccagcctgggcaaatggcgaaaccttgtctttacaaaaaatagaaaaaattagccaggcatggtggtgcacacctgtagcccggctacccgggaggctgaggtgagaggatcacctgagcttgggaggttgaggctgcagtagctgtgattgcaccactgcactccagcctgggcaacagagactctgaatcaaaaaataaaataaataaaacaacataacataaaaacaaaaaacacacctcaaattaccagctaggaatttacgtttcagacccagatcaattgcaaaatcaatgttcagctctcctggaaaagtttcatgtatggacctgacctctatcagttgattgtcttagctcaatcttacaatttggtcactccataagctcactcatttggttaagtaaacaatgtctacagttctaacaattattttactaaaatgcataattatgtgatagttatacatataccaacctgttatgtgagacaagtgacctgcaagtagtccaaggccagtgaatcaattactgcttgtacattgtgtgcatcacttcttgactcctaggaataactatgaggtctggggggggaaaaaatcacataattttgatccatgagaggccaagttttcatctcattgtctctgactaggctactgaatatgctcactgctataaaggctctgcccaaacagaacatgctgtaaagtacagataaagttaataaacctgaactctacacagcagaatctttactggttgagtatttattgattgaaccgatttacaatattagactggttgaatacggttgaatatttattacaccatatatatatatatagaatatagatatacatgaatatgctttacaagaagcaccatgttaaggaagataaagtggtcctaaattcaaagacagctaatagtctaataagggagccaagacatgatactttaaccctaactatgggctactttctacgaagaaaaaaaaaacacagcaggcattcaaggagcgttttatatatacacatatgtatgtttatttattatttattgagacagggtctcgctctatccccaggctggaatgcagtggcgtgatcttggctcactacaacctccactttcccggctcagcaattctcttgcctcagcctcccaagtagctgggtttataggcgtgcaccactatgctggctaatttttgtatttttagcagagatggcattttgccatattggccaggctggtatgaactcctggcctcaggtgatccacctgcctcaagtgatgagcctcccaaggtaatgggttagaggtgtgagccaccgcgcctggcccttatatgtccttttgaatagccaactagaatattggtataaagatttaaaaggtcagcacaggctggacgtggtggctcatgcctgtaacctatcactttgggaggtagacgggaggatcacttaagctgagttggtaccaccctggtttgaacatagtgagatggtgagcaagatgaaaggacatatgcgcttattaactgtcttgtaaatgaggttcatcatctacaagcatcaattcttatccctagcactggttaagtaacaaatccaataaattcccaagctccactcaattttacaacctttgaaggtacatttacagaaagatgcaactttcacaaggcagtagccatgattaggttaagccgtgattatcaggagcctcaaactgatctgctcaaggccgttattatgagtgggttccacagggtattccttaagaatacaatattataattatacaatatgtgatattaaatacaatttaatatacaatatttttttaatattgtatattaatatagaatttaatatgcaatattaaaaaaagaaacaagcaagagaaaatgaaattttataaatatcaaagaatctaactaaaggactaaaaacttttggctaagatataggcaaaattactcctgcttttagtattcttacctggtaccttttctcccaaatagactgataaagagcaataaaaacattagcatcacagtcttgaagttcatgtatttcagatgtatatgacacttaaaaagaaggttattggcaatggttacccactctgttgggaaaagggggaaagatcagtcttaaaaaccaccagaaaaaaatcacacagacatttaaaaatccaacaacctcccccccaacaaaaacagacactgaactttgcagaagataaggaattgattgttagagaatttcaaagaccctttaggcatggtttttaaaaagatgtatttaattcttgggatgatttccagagtgctgtaatttctacatagtcaaaactatactgcaaattcattgatactgttgcagcctaaaatcttaagttacttatataagccttacatgggtgttttagttaaaacatatttacaagtaaacaggaatattatgtcataaacaacagtttaatgaaatccgaggttaccagaaactcattaatggaggctgcttcgcacttgcaatagtattggcttgtgtttacccaattatcttgtgcaagtcagggtttctctggtgccggaaaaagtgggattaaacttaggctgttaagaactggtataataacaacatcaacggtaatgcatttgtagtttttcttttttattatatcgatctatatgaaagaaaatatgggaagtacatgaagccagaattatcaatactgttgacgtttcctgcgtaccacattctcctctcccctagatatgctgggatttgcaaagtttaacggtttctgtaccaaaagtaacttagcttaaaatacttttccttgaaatgcctgggaattggtaggaaagcactttcaatcggtattagaaacaaactctccactatgttctggacacgtaacgttctggaaacgaatgagagtgtattttccatgacataatccccctccccacgcccatttctcacagctggccaaaccatgacaactggttttacgcagtccttgtgaaaaggatgaaagcgtcctagacaaccaaattaattcgctcttcaaagcggtgctagacaaagcccatgactctagagggcactgaagagaaaaaagcacaacattctacaggggcatattctactattctgcaggggcataataaatcttaagaatgctgtcctttaaagaccaatacaaaagcaggtacgacctcagggcccatagtgcaagggcggaggcacacggacagcggctagacgccccacagaaagacaagtccggggacgacccttctgacgctctttttacagccaggacccaagtgtcctaccggcctcgccccagtgcctctctcttcccacagcatactgctgttccacggcctcgaagcgaagaggtggtgaagctgagagacctatccagggaacccgccagcgcgacgcggcgtctgaaggtcacgagccccgccgacagccagacccagtccgggctagcccgaggcctccctggaggtggacggtttcagtccacactactgggaccccagggagacactcaccagcatccgagcctgccatgtttcagaggcaggcgccgccggactccgacgcggccgggaaggcgacggtgtcctggaaggaccgatccacgagacccgacactggggcgcggacgcacgaaccaaagcgcggggaaggaggcgtgaaagaggacggacgttaaaagagcttctcgccgctgattggtcatcagaggagcacttcctttccaggacgtgaaacgggggcggtttgggaagtttagagaccattctccgccgaccaaaaccgtcaaaggattatcagacacgcgggtcggacggtccacatcagccggcagcccgggcggtcccggggtgcgagcagcgcacttccggtgagctatttcgttttgtatccctccgccgcgtcaacgggaaagtagtgcggaccgctctctcggtggtccggggtggtacagccacgtacaacgccaggccccgccttccccctcttttggttacagacgtgagggctctttggagagtaaacatctccgagtggcgagggtgggcggggctgggcttgggaaagggcggggtggctgcttgaggtgtggaaagaccagaagaaggtgaggtcaagagagtgcagaatgaggcatccaatggtgggtgggccctgacctgagagagtggcgcggggaggggtgaaagcgcggcgtcctggaacgccagcgggcgttgcggcctatgcgcgaggggcggggcgattaggtcataagcggctcccagcgttccctgcggcgtaggaggcggtccagactacaaaagcggctgccgaaagcggccggcacctcattcatttctaccggtctctagtagtgcagcttcggctggttcatcggtgtccttcctccgctgccgcccccgcaaggcttcgccgtcatcgaggccattccagcgacttgtcgcacgcttttctatatacttcgttccccgccaaccgcaaccattgagccatgtcgggttattcgagtgaccgagaccgcggccgggaccgagggtgagtttgggaccgagctgtcaggcctggcgggtggggggatgggagggcgggtcagggtggcggccggcggggctttgcggcttggacttggcctttccgggctatcttgggacttcctttcccgaagcttgcgccattttgatattcacgtcacagtgattggaagagatttgacggtgtagtgtctcaagcttgctttttgtgtggggattggggagctgtcggggcggctgccatttggtagcgttgagggagttgagagggagcgtattgtgcggatgaaagcgggacgcttcgaggcagagaaggaacatctgttaggtgcggcgtttcgggaggtgtttttggggtggccgggcattcgtgggagcgaggggaccacttccaaagccctggtgctgttggggtaggagggcggccggatcagccatgtggctgagtcgcgagtacaaaatgccggcctcggacatggcggcggcgctttgttaccccgcccggcggaggagctcaaaatggcagcgtcgagaaaatgtggcgcaggagaaatgcgagacaaagggggaagcgccgccccagcgggaacgccgcccggccgactcgcccgggccgggactcctcccccggtagtcgccggctcctccttttcttttttcctgcgtatataattttgattcgttgatccggagctctaccgcggcgttcccccagctgggtttgtagcagaagtgtttctgagaaaacccttgttctgttatcgctgactgtactgtttaggtcttaccactaaagctgtttggttccaaaacggccatatgagtaacatcgtcgtgatgctttcggttcatgtagccttgttattgctgatagtgaattgctaggctggtggggaagattcagtaaccacaagaagtggtgtgtgccagaatcccaaattctggcatgtgggtgacaagttccgacatgataaatccccggcttccgacatgataaatcccaggctgtttacatgaccaagtaatgtgtacttgggactacgggaaatgttaactgtggctgttgagagagagagagttttcacgaaggacagtgctaggtttacctctcgaagtctgttttcagtggtttttagctgtgccaatggatgacaaatctatacagaaacctgggtatagccatttgaaaatgtgaaaacgttttttttcattccaggtttggtgcacctcgatttggaggaagtagggcagggccttatctggaaagaagtttggaaaccctggggagaaattagttaaaaagaagtggaatctgatgagctgcctaaatttgagaagaatttttatcaagagcaccctgatttggctaggcgacagcagtgagtaaattcatgtggcttcatcaggctgtaactcgatcgtggattctagtaatgaaattctgacaggtgttttgcaaataactcaattttggtagagttacatgttctgcttcataattgggaaaggtgtgactcacttttggatataggtggctttgggatttttactaaattaggttgagtataacaataaattttttttttcataatagggtgttcataggtggtccagattaaaatgaaggctactttaaactagttactaaattatgaagttaggggcttacaattacgtatttagctaggggtggtgtcatgaattttaagactgttataatttgttttcagcaagaggtggaaacatacagaagaagcaaggaaattacagttagaggtcacaactgccgaagccagttctaaatttttatgaagccaatttccctggtaagtgctacttttcagtctacctacccgtgtttttgtttccacctaccccctctttttcttggcatcactaattttactaaatatctgttactaattatagcaaatgtcatggatgttattgcaagacagaatttactgaacccactgctattcaagctcagggatggccagttgctctaagtggattggatatgttggagtggcacagactggatctgggaaaacattgtctgtaagtttgggagaactcttagttgatctgatatatgcaagaaaatgtaatggtaatttaaaaacgagtattttaatgtatttctgtttgtccccactttcaccctaaatagtatttgcttcctgccattgtccacataatcatcagccattcctagagagaggcgatgggcctattgtaagtatatatttttactttattagaagcataatgtgtagattttagactacatagctaaagatgtaatcatttgtggggttttatatagaggttagctcatcctattcagctggagctgttttgggtattggacaaacatgaagaaaggatctgctagtataataagttagcagtttaaaactagtatccaggttgtgctgaaagctgtttctctttccttagtgtttggtgctggcaccaactcgggaactggccaacaggtgcagcaagtagctgctgaatattgtagagcatgtcgcttgaagtctactttatctacggtggtgctcctaagggaccacaaatacgtgatttggagagaggtatgtaataaaagggttttatttgtcattggtgctaaatatcctaggtattgtagttacacttacgttttaattaaaggtgtggaaatctgtattgcaacacctggaagactgattgactttttaggtgtggaaaaaccaatctgagaagaacaacctaccttgtccttgatgaagcagatagaagcttgatatgggctttgaaccccaaataaggaagattgtggatcaaataagagtaagtgcctttgaaatatgtgatcaaactgaattgtgttttcactcttaagagtctgatactaattttccccccaaaatccattagcctgataggcaaactctaatgtggagtgcgacttggccaaagaagtaagacagcttgctgaagatttcctgaaagactatattcatataaacattgggcacttgaactgagtgcaaaccacaacattcttcagattgtggatgtgtgtcatgacgtgaaaaggatgaaaagtaagttttattaactctgttatatttgcttcctaacaactttgcgtaaaattgagggatcattgtttggtgagttgttttaggttatttcagttggtgtgattcatttagttagcctactaatcctgaaaatttcttgaatccttcaaataatggctgtcacatttatagctttcctatagaaggaattcatgtgtcccctggttgacttaaggaccaaggtcgaactgctcgataagtggattagcaggcgtttcctctttgacttccagccatgtaaatgaacttaatgttttgctgaccataaatgtgtggccctagcaatggtcttttaaaactcggatttttcctttctctctcctattattagacttattcgtctaatggaagagatcatgatgagaaggagaataaaaccattgtttttgtggaaaccaaaagaagatgtgatgagcttacagaaaaatgaggagagatgggtatgtgtgagctcctccattgaagcagattgattaaacagcttaggaaagggcaaacttggatcacgagcagtggatttttttcatatctgatagtaatttaactttttcatttctggcgaaattaaagagatctgtgaccaaaagtggtcaagcctggagtctgaggttttcaatgtgagtttaataacacaacttgtcttttaacttaggtgcctgccatgggtatccatggtgacaagagtcaacaagagcgtgactgggttctaaatggaaatatttcaaatgaagtatttttcccccttacttaacctagctagaattctgctcagaaattgatcatgtatatgccttcctttgtagaattcaaacatggaaaagctcctattctgttgctacagatgtggcctccagagggctaggttagtacaaactcgcattcatggcttggttcccagaagatctccatttaacttttttaaagaaagtttattgctttctttaacctgcttttttctaagttttttttcacataaaggtgctgtctttgtggcaaggcctaggcatgaaatcggaggactcgagggggatggaggactagtgatcggctggctgcttccagtcgattgagaggtgaaaaagctgaacgtgtgccagtaatcttcaaaaggcagaacatatcacctcgccccgtaaactgttctctccgagggaaaaaatggaagttatcctcacagttcactgcctggtatttcttctgtcccatgctttgcatgactgccatggtacagccttgtttcaaactttcactgtgatctgtgggtctttgagtttcagtgagtttgctgaaatgtcgaagaagtattccaaacttcaatgttcaatgaaatttttgttcaagtttgaaatggagagagcagcttaaaaggtactaagccttttacaaattggtgagtactggcacatgagatctagagcaggacaacttctcacacatagtaagtgggaaaagaaagtgctttgaaagttcctccctcacctcacagtagtcgtcatgtcgagacctgccagagagagacacattctcaagtgaatcctggttcttggaagcgcttgcctagacgagacacagtgcataaaaacaacttttgggggacagtatgttttcttgcagctgcggttgtaaggtcttggcaagacaagcagtgtggccagaatttgaacttctgatgaatgtgtaatgcaaaggaccttgtacatttttttgtttcaaggtctcaaaatgagcacatgaagaggttgctgtgaaactttaagtggccctactgcgcagaagattcagatgtcacttgatgatctgtaagggaacttgctgatttgggaatgtgcttagggacacacattccttttgacagggtctgtcactgggtgggtgatgaattatacagatgacagtgcttttttttcttttttcaacctcaatggtattcctacaggaaatggataaccatttaactgtattttttgcagcccgtaccttcttgggaatac

SEQ ID NO: 5089 - DNA, 13961 bp, Homo sapiens
ctcatctacttctttctttggaaagtgctacaagatggagctgccagggcctcctagggagggaaaggttgcggatgacttagtggaaaagggaggtgttcatacaaaaggtgcagctggacaatctctttgacttgggtcctttgtccttatggggacagggacccttacatggagtgcaccctcatggcctgcatctctggccccattcggccatctgggctaggagaccaccaccacatgcacgctccctttaagcaaatgattcttctgccttttagagtgacgttcttgggctggcgttgaccttaggagtaacaacactcttggggtcaacagctttcaaactctatgctgtggctccaggattccaagttggttcttaaggagcagccccagtctctctccatccatcctgtaagaaccctccacagccccagccccaccttgatctttttctgtttttatattggtttctgcataaagatttgtttgaagatcaagttctgctattgaaagttgggcactctgccctgtacagttgattctgggactttagatagttaaagttgtgtttaaatgttgacaagaagctacttgatgttaaacatgcattcagttgcatataaattgtcacttactctctctgaagtccaaggacagaggggatgcagttgttgtattctgttactgttatctaagatgccaggagggcagggcatgtgaggtagaaggcataggtgtcagagactagtgggtgtgttcctacttaaattttttaacatagcacagattgcagggatattttatgtaaaacatccagctattcttgaaaaacagggttgatataatggcagcttgtgctgttatgtaagaaaagcgagcttaatggatcttcagacttgctcagtttatcttgccgataggagcaattctgacctacttggggatgaaagctggttttcacagcactcctttccccctgtggacactgtgctggatgggacgcatgccaggctgagcaaagctgagaccgcctcggctcgttgcctcagcacagcctatacctagagcctgcctggctgtctgtcggggagacctggcatggaggtccatggatcgggtaagagacagggtgaccactttgctatgtgagccaggagtgttattagagcatgtccagagagggagccaaggtcaaggcctgtcgagggtggacacccagtgacagttgctctgagctgggagcccagatttaaatccctagggcccgagagactgatgcgaagtgcagggaagccattgaccccaggagctgggaaaacaggtttctgtggacaggaggagggcgtccccacaaatgtcctgtgtgcgctccgcctgcacctgcctgttgtggatgtggggggaccccctcagttgatagggcctaggtggagggtacaactgctcccaggaagttttcttccacatagaagagccagagatgtgtttagtgtttctttataagtgcatagtgatgatttcttaacaagaaaatacaccctttgacatagtagtctttcagacttcactatggaaagttgaattaattaggattcatggtgttgacagtctatgggaaattatactatgaaaattcaatagtattttttttgtcagtgtgaatgtgagctaatttatgacctgggatatattctcactgaaattagccaaacggttagagcaatagcaagatttggtgttgattgattgtgggaattctgccaaatctcaacagccgtcctttggtggcagcagtagccatacattgcccctgaactcgtagcgtgagtctgggatgctgctgggcccctgactaggatgaggcagaaggaaaagcggcggggagccaccgagtgatgggcactatgggtgctttcctgagggtgggaagaggctgcgaggaaccatctttctcgtagtattgggagttcattctttattcctgtacatgtaatatattgtctcttgttaatcataaatcggaggattccaataggtcacctggggagtgaaggcagaggtcaccttctgggaagctcatgaaagaaaaccagaggccacgtgtgcttgtcaggcaggtctgtaggatccaggatgcagtctccatctcctccctgcctctctgagcatcggcagtgtggatgctgcagatacagagctgaattggatggcacagctccgtgcagaggccaggacaggctggaatggctaatggttgttgttgtcagagctcacccttgctgagtgctgctcacggctgcacaaccttccgagcatgcagcttgcattaacatatctaatctttaccacactgagggtcagagggctagttggtgaagccaagagtgggggcttggtcgccggctgtgaatctcttctgctgatgtgctgagctcagttcaggcagggactggattgacagaggcaggagacgagagcaccatgagtgtgtccaaagcagggtgcctggtgcaggagccaggatgcagagagggtagagagcagactgggagtgagttcactggctgtggcgtcacttgacctgtacaagcaggcgaggttgtctgttgggagtggacaacagtctggggagtggaggtgttgagagctggacagcttggaggagcttcccctggcaacaggtggttgttgggtgagcagtgtggtgtcccagtgatgtgtggacgccacactgttacggcctctgtgatttcagaggcatgcacatagcaggggcatggacgtgggccacaggcgagggagacagcaggccttgtgggtctagatggctaggagaggaagcaccatggatctgtgttgccctcgatgtcttaaatttggtgctgagttaaacatacattggctgtgactccactgtgctgagggaagggctggatacatgcaggaagagcaggagccagggagctgtagcggctgctagagaaaggagagtcctggccaccatcctgaagagctcaaggctttcaaagtttggtggaagttgagggtatgtcatgagaaatctaaagtcaaaccaaagaaagttatctaaagtccaaagagtcaaggccagggcctcaataaatgttgatggtttcccaggagaagccacagaaatgccggtgatgagagtgtttgaactggaccaagggaggcatggacgtttgggggatgggctgggaagtgaggggcaatggcagccgcagggctggagaacgctgtagccaggggtaccagtttccagagagaaatgagttttggtgaaagtgttctgaagtggagtgcaggaggcacaggctgccccttcccggcctctagcacacagctgcccctccagagaccccctgggacgggcctgtctgcccatgtgggtggggggggcctgacattggagcagggatcacacaggctcagtgtggtggacaggtagggatgtagctcaggaggatgagtccttggaaagaaagttgggagaggagcaaacggtggagacagggggggagaatgggtggtcacgggctggagggacctgcatttgttgaaagttggtggtgcatgttttcaaatcagaactttctaccagaagctatctgaatttagatgtcactttcattgtctctccttatgaggaggaacttcacaggaggccctgcgtgtcactttctgacctgcgtccaggtaatggcctcctcagaagccacaccctgatctgtctaggtggacagctttctttggcctggaaccctgcactagagggtgcagcatgtgatcacagtgtcggtttcattccgtgaccagtgcacagaagagagtgtcttctctctccttgaatgttgtgtgccccaggctccttgcagaaatcccctgtctacctggggtcagagcctgcctctgtccccagacgcttttataaaacctgagtgcatgtgcgagcctcgggctggttgccgttgctttctaaatatgccttgttaccatgtggtttctagcctgagaatgttcttactttttatttgttgagatcagttcatagcacataaatttaccattctaatcattttaaagtatacgatgcattgatttttgtacgttcacaaggttgtggaactgtcgccattatctaattccagaacatcttcatcacccaaaagaagccctgtactcattagcggtcactcccagttcctcctttcctcagcccctgcaaccacgaagctactttccttctctctgtttcccattccggacatctcactcactgggtcgtgcaatgagtggccttctgtgattcgcttctttcactcagcctgtgttccagctgattcctgttacgctccatcctttcatggctgtggtgtgccactgtgtggacacaccacatctgcctattcatttgttagctggtgtgcatttgggctcgtaacactttttgtctagtagaataacgttgcctgtgaacattcttgtctgtgttttggccctaggatattcttataccctaatctttcccactactttttgaaatttccacatcttttctcatccttctaattggttcccattctggaattttcttctgcctttagggagtcccaaataggagtggcactaaacatctgccaacctcctgtcccgcttgctattttcagagatattcgggaaactcaacaagtctttcttcattagctgcacagtggtcccttgaacgataattgaactgtgtgagtccacttaatgcagatttttttcagccaacacacagattgaaaatacggtgtatttaggatgagaaactgtgtatatggagagtccacttttcctatactcaggttcctcgaggtcgactgcaggattgagtatgtacagatttagtatactcacagggggtggtgggggactggggggtgctgggtcttggaaccaatcccccgcacatactaagggtggactggccagcctcctgcacagaatacaacccttcagggtgaaaaggcttgggggctttcaaaacactctgagccacagaactccttctggccaaacatcagcaaagcttcaaaagaccacgttgtttcaagaaaggttaatctaacagcctgcacaggctccatataatcaagacccattagcagggaacctgtagaaaagagagcgttctgagcctgcctgctcagtggctgccagctacgtaaacaagatctgaagacagtgggtgcctgttgccatatattcacaaaggcttatggcagcccgtttacaaagctgcatccacatgaagaaaatttgccctcagccaccgaaaaacaaaacaacaaaaaccccaacccacccaaatcaagcccaacccagaacaacatgaaaggaaacactccttttgaacataaactaatcctgctgcctctttccattagaaatggataaaggtaccttggccgttgctttcttgcacagttttgtgatgcagtggtctgattttaagatttgtatcctgtaggaggctggaccccctagccatatctagacatacagttagctacagtttggaaagaccccggtgctcggagagactcggacattcattgcgttgtattcactacttctaatctcttttcgtttgattgtattctttaaagcaaagtattttgtgataaattagtcactgcctttattgcagtgatacatcatttgcagaatggtaacaataatttcggttctcttgataggaaggtgggttagcaataccctttaaagaataccaaatttgatagaactttttgcacaataagtgcattatgttcatcataaaagagattgtttctcccaagggtgcgctgagttttaccttaacctcctgtagcgacatatgccaatgtggccatctcgggtgatttaaaagatttgttaccctctgcgtcacttatagcccaggtatgtcctgtctcccctggatggctgattggtgatttttaaaaggtttccattgtgctgtgggaacctgaaggcatcagaacgggcttttgcttgtttgctgttcatattctgttcatttaaagagtaaaagtgtgtggttggtattgtggcccatgttgagcaaagcaaagagtaagccactgtctgaagcccacctacgttgaatgtaatgaggctgagtgaaaaggatctgctacactgaacacagaacgtggaggtctgggctaaccacacaaaattgctgtgtgcagtgaacattcacgctgtactcttagccacatcccgcacaaaagacagaagacagctcccaggagatggagcatgtgtggcaaagattttccgcctggttactttgaaaaagcaaaaggaggctgaaactgtgctttgtaagctgcatgggttggtgctggctcctgacgtcagttcagaacactcaggagtgaaggcagaaacctggtgagggactcccaggagggcttctttctccacctttcagcctctggagttcaaatttcactcaacctgagtgcaccaaccccaccctcttatttacattgccctggcctttttggcggaatcaaagtccctacataccaaggagatcttttaccttctacactagtgggaggccaggtgcctgggagggaggtggacgcccccgccctcctctggcatgccactgtcctgctgtgaaagcctgtgtcaaggaaactgggctcagaggtgcagactgagagagccgctgggctgttttgaaggaaggtaagcaggagcatttgtgtgtgtgtgtgtgtgcgcgcgcgtgcatatgtgtatgtgtgtctgtgccgtgtggtgagtgtgtgtgtgcatgtgtgtggcttctgtaatgctacaaagacctgaaacgagctgtgtgcctgctgagatttaccaacttgccaagacttccagaggaaaagagctggactagccaggaggagagggcgttatggagtggaataatcagcagaacggatgctttaacgggcaagaaggaatgtcgctcaggacttgtccaggaatgcctttattggtttgcaagctgaggagtcttaacttactgacttctttttggggaagagtcagtgatggtctgacatgcttttgcaagctctctggccgcctctgtggccagccggcgtgggtggcctcagataaggccacaggacctcctcttttcctctgggcttgggcccctgtgttttcagttaggagtgcccaaagggaactgagctgcccagtcaggggcctgagataggcgcctgctgaatgctgagcctcaccggcgtgctggtgtgagaggtctgcccggggagccgccctggcctgccctgctgtcgtgcggctgtgggggcaccttggcggcgtctgtgacacgcctgccacagccccactcgggcacagtgctcctttatcgccacattccagagcctcacccaggagaccgcgggagcgctggaatctggcccagctcctgagtcgctcctgctctgcagtgggatgccttcccttcccaagaggcagtgtgtggctgggcaggcgtttctgtgtggaaggttctgctctggttcttgctttgttaattttttttctgctctatatttctctaagaatttacagtctgcctcatttttgaaagcgtgagcaagcagctcagctttacttcagagggagggattttccagcgccctccgcagtctcagcaaggtgtcctggtgctgccgctgcagcctctttcctgctgggcacctccctcctggcagctcagagggtgatttgggtttgggggcttgggaaggagttaactctcaggtgagactgatgcaccaagggagcaatgccttagaatggagttattctgcctaaggaggaaagagttgtccctacagagtagagtttattaccgtcttttattttttgtaaaaacaaaataaaaaaagaggaaaagggcacatttcatcgcgtcttgaaatatatcaaaatcataggtatctgatttagtagattaaaagcagtgttctcaaagacccaagtgtagtcctcatttttagctcttgaattttctgtggaatagaaaatgatttaataaaaactccaaaaatcattattagcaaagagtcagaattctattgtaataaaattaaagcagaccttgtttgagtgagggttatacatgctctaattataaatgtccacatggaaaaaacgagagtgatttttgcattgctatgggtaagataatacaacgccccttgagaaggaacctcttggctcagatatcgctcctgactgggaaggtctttcggtgtctgcagcccctaccaggcctccagggatcaggtcccttgggacactgcccgggctacccgtacctcccctcctcgcaaatgtgagaatgcccttgcttcattgttaaccccattcaaccctgccttgtgctctgggccacagcctagttttagccctcctggcttggtgatggactcttccatgcgccggagcctgaaatccaggcagtccttagcacctgtcctcaccagcactgaaacccccactggctgttccacattgtgcagcacagacccatcaactgaatggtctgctggaaaactcacaagtccagcgccggtgccatggtcatgtgtcagttgacctagcaaatccaggagaaatgttctctcactgctgaggggaggcatgtgatgcagtgatgggaaccctgggtgtgcatgacacaatctgccagaaaacccttgccctccccccatgaaacttggacatgcttcggtcccttgcaatccccctaaccttgtggttaagcagaggagaatccataccccttctgggtttggtttgagcctaatgagacaatagtacgaagtgcttggaagacagtggttgcccagttagcttattactgctgcttttgccacattgctgtcagtcaccgaggaaacaaacaaagtatgggatgggaaaactgttttacagtggtaagatcctgagctgggcagcttggccataaagtcgcactgggtggatggttagcaagttggtgcctgggacaatttcagtcatatcaaaaaatgacttagggaacttctgaatagtttttttaaacccatctttcaccatagctttatattagagaacagttcctcagtgtaatctcgagacgggaggtcagtggacctgcgttctgtgtactcactgattagatgttcatgagcactcctctgtccctcagctctgcacccagagggtccacacatgaatcacttgtgagtctgggaattcttcacttgaccagagagggggaaagcacagaaaggagggtttgcccaagcctgctgtgtgccatgccttttgtgttgaatcccagtggtcctgggagctgatatcagaaacacccccttctccaggttgcttctctgcagacaaggacagtgaggcacagaaaggcgagtgattcatctgaagtcacacagctatgatcaagccaggactcaagcctggattatgcagaacctctagaaggggagggaaggtgtgcacatgaatcactccaatggaaatgtcaaagacgctttatgtgacaatgaggcgcaaagggactatgatcgttatcccaaggagagaggtttccattgtctcatggaatttaggaagaggagggaaggcctttgaagagggggaggaggcatgggggagaaggagaaggagggaggggaggagggagaagaagaggaaagggaggagagaaggaggaggaaagggaggagggggaaaaagaggaagagggaaggaagggaggagacaagaggagccacctcaggttggggtctagtctgctgtgagtctcatttttgtcttgattcacaacggttgttttaactgagatgcaatttacatgcagtaaaatttgctctgtttagatatagtagtctgagtttgacaaacattatgccatgacactcccaccactatcaagacgaaatatttctattgcccaaaccatccctcacaccctttgcagccccactcttctcctggcccgaccacacccatttgtgtccagacacagtgtctccaccccagaatgtcacctatgtgagtcgtacagtcgagccctttgagtctggcagtgttcactcggcatagtccttgagaccctccaggagactgcctgcagatgagcactcgtttttgaaaccgaagcctctctgtcttagcattttccctgggctgtggttgtcagagcccaccatgggcacttgcagctgcagacacattccaataagcctccacttattgggactgtttggatatggtgaattgattcagctggcggccccaagtgagtcatttgagggtgacctagggacaggatggttcctggctgtgtctgagaagctacctgttccctgtggtggtccaggcacaggcaggacctctggcatatccatgctcctgaccccgatggggctgctggtaccatgggtgtgtgggagaactgaagactccagctaggaacagcacccgatccactaactgtgaggatagaaatgcactagctttaagaaaggaacaaaaactgtgaccatcactgcagcggctgtgacaccacaagggtctgttcctgaaatgaataattttaggagttagggaggaaagcacaaagcacttaatagtctctgaagaggagtgaggtgtatatgagtttgtgtgtgtgtgtgtgtgtgtgtgtgtgtcttgatctagtagttgatctgtgaaatataaaaagtgattgactaggattagaattttatctttttttgagtggagggaggttggtttaaatttcagatattctattcagtaggcttgtaaaaaaaatgttaatgttagtgcaggctctctcagcctctgatttctcatctgtaaaatggacttccctttcctgcttcacaggattgctttgggaattgagtaggatccctggggcctaacagtgtctgggcgcatgggaggagcttgcacggtggccttgtctttaggaggtcagctgagttgtagagaggggtgtttccagaattctctctgtttgtcaggtgatgaagatgccaattcctgagcctcacctggctcacctgagggtggctgcttcagcatcagtggatgcctttcttctccacactgctccgtctttcccttgcctctgttgatctgtctattcggatgccgtgaaatggcccaccaccctttccatctcttgtttctctctctgttccccaagggggcttgtccatttccagcacatcatcaggactgggctgaatattgcttttaagtccccgtttatgactagcatcatagcaagtgcttagtcaattctaaccaactttcatggagaagaattttctagttttcctttgaaactaaaaaattgcagggaggatactgttagttcttttgaaatgaaaaagtactttttaagcacacctgtcacaaaaatagaacatgagattcttagcatcaatacctagaaaaggaaaggttccacgtcgcttcataaatctatcagatttgtccttcctttgcttcaaccaacttctgttggaagcagggccagtggacagttcagtggattacacatcagtgatgatatttttggttgctgagtgattgatgatggagggtgctgaagtgtgagatcagctgtcctttggctatctgattgttagcatgccggggagcacagttgggcattgcctaatctgtttcaaccgggatggaagggatgttttcatatatttttttggtcttctccattttttgggtacttttgaaatactttctgagtgcctcttaaccctcttacctccttgtgggaaagccactttcagtagcagggttgggttggaaagagaaggatcccctgcagggaaggtgggtgaggagtctgttgctgcaagtcctccaaggagacaagaatgtatgctctgtattttcttcctttggtccttttccaggcgataaacctcactggtatgtcatgcagtgaaagtcattcagggtgtatttatgtttgttggatttttaactaagatctggccaccaggaaatcgttgccagaagtggacagcctcccttgggaggggaggtccttgatgctggttggctgggtctggtggcacgcaagggaaaggggacaccgaatgggatgatttaccctggactgagatgtggaaaggtctcctcctgcatccgcagctgaagagctatggcatccctgcaagttacttcctcccacctaagattaggttctgaatttgcagaatgagggttgattcagacttccccatgctcccttgagatggaagcaaaatgttaaaatatgttatttaatgatataaaaagatggaaggagcgacgagtggcaggaccccaccttttagaactctgtccttaccccaccacctcctcacagagtgtcagccctaatagcacatcaggtgccagagacagagtggagacttaaagccctgcgcctccctcatctggtgggggctcctcaccctgcctgctcctaggagctcatcagggcacaggaaccccacccacaacccatgtccaggaaccacaaatgggagtttagttggctatgcatttctgtggtctttctacatcacttttccaaaccagaaccatattatcagtagcatttctcatcagttaaggagggtattctttaatgatggatcagcgcctttgggggctgcaaaagcagggtgcgggctcctgtttggtttctcattggcgagactggcagtcagccatgcaggaccctgcttccacacctctgttaggtgtcttttctagtcatgattctctttttattgccttatcctgcagcttttgcattgagtcttagaaagcatagcaatggcagaaagtgtttaatgaggctctttcctatgtgcccagtgtagaggtagcagtttcataggtgagaagatagcgatacagaggtcagaagacagatatttacccagccctgccacttggagctgtgtgggttgagcaacgaaacgccagcctcacaggtggcaggaggataaaggagactggaaatggcaatagcatggtgccatttgcttgcagctgctgtttgccagggctctgtctcattaatcttgtgcccctggttccaagcacactgtggccagataatgttcaaatgttccctggatctctgcccatgcttcctgcttcatgggcaaatgggctaacctttaggtcatgacttttgtttttttggaatttagaacccttagattgggtgacttcagttatttttccagttgtgttcatttcagttggagaccagccaggtcagtagtgatggctgccctgctcccgcctctcacggatgctggacctggctgtgctgcctgggaagaggcccagagagtggggacacctgggttgcagtggccaagcgctgcacggctcttctaccttcagatccttgtgggctgtgtgtgtgtttgttttggttggtgattgttcttcgtttgcttgttttgcctgctaaggcagctgagctttcaaaatagctccccacattttgtcatgtgtgaaaaagctcaaacttttagcctgtcactaatattcaccgggtgtcagaggctgttcactaatgctagaaatgcaagggagagcaaaaaaagcaaactccctgccctcagtgagcctgagttccagtgggtaaaggtgcagttcttcgaatgcaagtatgtactgtggacaaaaactcagtgaggaaagggtggtagggcagcaccgttgaggaggtgagggagctgagatgcagagaaagacaaaagccaaggccacagggcagtgcatgcctgcagtggactgctaggaacagggcaggc

SEQ ID NO: 5090 - DNA, 14233 bp, Homo sapiens
tatctgcatgtacatattcacacagaagaagtcagggctttgcctttaaatataaaaagtgacatgataacaatattaatgtgagccttctagatttttatttcagcagtccccaggggggtcaacttcacattagcccacaaggagcacagagataacacagtgctgacttagtggtgctttcatcagacagtgtggtgagccagtgcccttgccaggaggccccacccactctgaaagtcaagtggagttgtgagactcctccaagggcacagtaataacagaggtagctcgccatacagaatgtgtcccctgatctttatgatttccttccatttcacagtcacattctatggtcactcttactgttacccccattttacaggcaaggaaattgacacgaagaagttgagagctagtaagtggcaaagtcagagtttcagctccatcagccgactccacagccatgggcgattatacagggctgatgtttcactttgtcttgtctaacctagaagtgacctaatgtcaaactaaaaagcacatggaaagtctcacagtcatggaataaccatgtaatttgtacatttggtaacccctatgaacctccacctccttatctaaaaatgcagactatagtacctgccatcacagccactgtgcagttttgaagtagtaggctttaggcatctgcagtaatgcttaactcgtatcatttaggcctagatactgatgtgcatataaatgacagtatttgctttaaaatacattagggagaggcttcacttcccggagggtgaattagacatacttttctctatttctctgctaagtacaacttaaaaccttggacagtaagtataagacaaatataagaaagctctgaagatggggagaaataggccagctagccatggacttcagggccaagggacccggtaggcttatttataatatctatgggccaggaaacaatcttcagaggactaaaagtaactgaacctgcagaacatgttctccaaccacaatggactcactagaaatcagtaacagaagggcaacggaacaccttcaacacttggaaactgaacagcacacttataaataatctatgggtcaaaaagaggtctcgagggaaatccaaaaacatactgaactgaatgaaaatgaggataaaatacaaaaattgtgagacatggctttatccactgctttaatacagccgcactgagaggaaatttgggcaagaagaaaattctgaaatgaatagtttatgctcttacctccataacctagaaaaggagaacaaactagacccaaggcaagcagaaggaaggagataataaaaatctaagcaaaatttaaaaagatacagagaagtaatagagaaaataaatgaaagaagtggttctttgaaagatcaataaaattgacaaacctctagcaagactaacaaaaaaatggaggacatagatactattgttaggaaggaaacaggcaccatcactaaagaccctgcagacaccaaaagaatatgaaggaatacacaaactactctacatgcatagtttttaaaacttaggttaaatagacagttccttaatgagcatgaactgtcacaactcacccaataggaaatagactacttgaatccctgtaactataaggaaattgacctagtaatttataatctcccaaaaaagaaatcttcggtttcactggataattctaccaaacatgtaaagaagaattaacactgattctacgcaaaccttccagaaaacagaagaggggggatcatgtcctaattcattttgtgaagctagtataccctgataccaaaaccaggcaaaaagaacagaaaaagaaaactacagaccaatatccccgcagattcagatacaaaactccttaacaaaacataaacaaatagaacacagcaatataaaaaagattgacacactgtagccaaatgggacatattctgagatgcaaggctggtttagatttgaaaattcattcatgtaatacactatactaacaggctaaagaaaaagctcacgacatatcagtcaatccaaaaaaagaataaaaagagtttggcaaaattcacatcattcatgatcaaaacttccagcaaaatagaagacaggtactccttcaaccttacaaaaagcatctaaaagccccacagctgacagcactctttttcaacatagttctggaagttctacagagacatatacaagaaaaggaaattaagacaacagatgagaggaaagaaataaaactgtcccttttgctggtgacatgatcatctacgtagaaagccccagggaatcttgagtctgctgctgacagattgtccaaacagaaaatcccagggaagaggcggagcttgcagtgagctgagattgcacactgcactccagcctgggcgacagtgtgagactctgtctcaaaaaaaaaaaaaagaaaaaaagaaaatcccagggaacaacaaaacaacaacaaaaagtgaaactgttagaacaaatcagccactttgcaggattctagttcgacacacaaaaactagttctatttcagtacgctacaatgcacctgtagaagctgaaattaaaaatataagtcacagcccggcggagtagctcagcctgtaatcccagcactttgggaggcaggggtgggcagatcacgaggtcaagagatcggaccatcctggccaacatggtgaaactctgtctgtactcaaaatacaaaaattagttggcgtggcagtgcgtgcctgtaatcccggctattcaggaggctgaggcaggagaatcacttaacccaggaggtggaggttacagtgagctgtgattgcaccactgcattccagcctggcgcgagctagactccgtctcaaaaaaaaaaaaaaaaaaaaaaaaaaatatatatatatataatatatatgtatatgcacacacacatatattcgtatgtatatatatacacacatatacaatatgtatacatatatttatgaaaaggacatagaggtggcatatgatcgcatatgtataatatatatatatatatatatatatgccacttataatagctcaaaaaaattaaatggttaatgtaaacctagcaaaccatgcacaagacttctgtgctgaaaactgcacaatgctgatgaggaaaccacagaatatttcaataagtggggagacatactgttttcatggatggaaaaccaacctagtagagctgtcacttctttccagattgacagacagttttaccacaattcctacaaaatctcagcaagatttttttgtagatatagacaacataattctaaaatttatgtggaaggctaaggaaccagaatagccaaaacaactttgagaaagaattaagtggaaggaatgggttacctaatttcaagacttattgtatagctacagtcatcaagactgtggtgtggatgaggaacagacacttaggttcatgaaacagagtagagaacccagaaacaggcctacacagtatgcccagctgatttttttgacaaaggtacagaagcaagtcggggaaggtcagcctttaacaaatgatgcgggggcacctgggcacccacaggcaaaacaatgaacagccaccaaagctcacactttatacaaaaattaacttaaaatggatgatggacttaaatgtaaaatgtaaacatagtattttttaaaatgggagaaaatctttgggatcactaggcaaagagttatgagttaggacaaaagcatgaaccataaaaggaaaagttgacaaattagactttataaaaattaacatttttgctatggaaagaacctgtgaagaggataaaaaagacaaactgcagagtagagaaaaggtttgcaaaccacatgtccaaaaaaaggaatatcatctagaatgtatataattctcaatactcagcagtaaagaacaaacaattcacttagaaaatgagccaaactattataaaaagtcgaaaaacaacagatgctggcaaagctgcagagaaaaagaacatgtatacacgttggagggaatgtgaattagttaagccactgtggaaagtagtttaaagatttctcaaaaactgaaaacagaactgccatttgacccagcagtcccattaccggatatacacccaaaaaaaaaaaatcattctaccaaaaagacgcatgcacttgtatgtttatcacagcacaattccaatagcaaagacatggactcaacctaggtgcccatcaacagtgaattggataaagaaatgtgggacatatacaccatcgaagtactccgcagacgtaaaaaaagaaccaaatcatgtctttgcaacaacatggatgcagctgtaggccattgtcctaagcaaattcagtatcccctaatttaaaataaaagttgaaattaaaaagaaaagccactgactaaattaaataaatggattttattcagtaggaaaaaaaattagaaaatggttcaaagaaaaaaagagacatgtcacgaagaggacgtagaggtggcttatgagcacgtgaaaagatgctcaacatcattagccatagcaaaatataaatttaaatcacacctatcagaatggctaaaataaaaaatagtgacaaatccaatactggtgagcatgtggaaaaactagaccccttatacgttgctggagggattgtaaaatggtacagctgctgtggaaaacaattttggcaatttcttaaaaatgaaaaacctcatctgccatgtgactcagtgattgcattcctgggcatttatcccaaagaaatagactttgttcacataaaacctgtacaggaactctttttactttaatagccccaaactgtagatgccttcaacaggccagtggttaaacaaattgtagtacctcaataccatggaacacttctcgcaataaaaataagtgaattattcatacacacaacaacccggatgggtctctagaacataggttgagtgagaaaagtcaaaacctgaagtctgtatagtgtatgattccatatatgtccactttttacatggcaaaattgtagacacagagaagagattcatgtctgctaatggttggaggggcaagagtagaaggggaatggagtagccaaaaaggcaacaggagattggcagaaagtggtggagtaagaggtcgggaaggtggagccaggccaggagccgttctctgtagttccagaaggtggtggtgtggcatccacatgcaatgtgaggtcattactgaacctcaggatgggaggtgactgctcagatttgcattttcacacatcactgtggctgctgcatgaagaacaggtgggatggacagtgggctggaacagaccaaatggtttcagaagagataggaggaaatagaacatttgtgtaggattcaggtggtgcaatcagctgaccttaacacagtggaattgggcctgactgctctttctaattgtattgcttttgtcattattgtttaaattaggttctggttcttgttaattagtatgcagttagtataacactatctccataaaattcctctgcagatgcattactaaaacataacttgatacctccttagtcagcataagccccatgtgttaagttttttccagacaaccaccaggataggtgtccaagagaaatagcccagttagttaaaggcttaaggacagattttattcaggattattgcaacaggagaaagtgctgggctcagccccaatgcagcaaagacagctggagatttatgaccgaggaatagagcaaaaggatctggtggatgaaagtcattaagaagggacatcaagggtaggggggttcttgctaaactggcctaacacgtttctgctacagacaggccagggacttagacacaaatggcgagggatgaggagcttgagacgtgtcaagggggattagatatcaagtgtgggggatgaaaagcaggattcttgctggactgagcttgccacggttggacgtggaaggccaatgttgaggcctagtggagaagagggttggaggagcctggctaaggtttggtcaaggagagtctgtcacaagatagacccatctgatccaggctaacgcaatagggtgaccaaatgcagcccgcacgcttctctgtgtttctctcaggtcctttgggcacttagtttataattttttattttctattttttatttttatgggtcatagtataggtgtgtatggagtacatgagatgttttgatacaggcatgcaatgtgtaaaatcacatcatggaaaacagggtattatgggcacttagtttagccataaggcttccgtgcaagtggcctgggagccagctggggccagcttctgccacaggcatccttcacccaccctctcacaaacaagcgattcttcaataaacaataaacagaatacacaaaaagcaaaccaaacatctctagatttattaatagatgggtgaattaaaggagtcttttccaaataatgtgacaacagaagccaagggggatgaatgcccaaagctggggcttgccagaacctgctggtaccagagctgattgctgaagtgtgaggaattttgtgagccagctgacagcacattggcagctgggatctgccagggcgggattgtttacaccacaggatttagcaaacgttatgaatcaaccctccatcggccccaagcttccctgacacaccaaacagtagaaattcactgcctttttttttttttttttaactctgcttggtgttagctaactagtcatgaagaatagaggctgaaggaccaaagagatctttctgcattttgacattcaaatatttggaaagattttccgcattcgcatttggattctagtcccattgccaggctcaagtaagctctgtgataacaacactcagtgttggaaactgctgtccgaagcatctctcagcagatagggaggcctaaaaggacacggagagtggtgtctggtgggtcctctcctgacatttcttctctctctggtcaaatgctggagcacacatatagtggctctgagacttcctatctgggtgagctcaggcagttctagggactctctgagccctagtttcatgtcctgtacaacagtagtcattcctactgcacatggttctgagaagattggaccagaacatgtagctctggctcctggcccagacctgatcaacactcgcaaatagtggacactgatgctgttaggagaacagagcatccatatgaagggcggttcctgagctggggagaccagtgacaactgtaagtctgggttcagagcatgagtcgggggacgagaaggcccctgggcatctggccctgggtggctgagccctgggaatcctgcttttcccaagatgtgcttgtgcccagtgtgctcatgttttaaatgccagcacctactccaggaaaatatgggtatttcaatatctgctcacattatgcatatttaaatatgaatttaaatactgttaattctcctagggatgtgttgtcatttaaaagaggttgtgattagcatgaaggactgggacaggagcaggagatggcagagcagctgtaggcactgatgtaatgcctccagctttatgggacgggcccaaccaggcttcacccatttggggccctcaagcgggagcgtcagtggcagcctcgccatcgtccgtctgttgaatgtattgccacatggccacattatgccccaggagcatgtgttggaggacagtatccttaggcttctcagaaattccacatgggagcctcaaatgacatgcttttcttgaaaacaaaaatatttgtaaaaatgtaacaatgggagtcgtttaattcaagtctcccctataagcaaaaatagataaaattatgaaatgtaagatgtaaattatttgtttcttagctgatccttaatcttgatgatattttcaaaacaaatgaataataaagactgagaaaaggtttcctttaaaaagtcgtggttctcgccaggcgcagtggctcatgcctgaatcccagcaccttaggaggccaaggcaggcggatcatgaggtcaagagatagagaccacctggccaacatggtgaaaccctgtctctactaaaaatgcaagaattagctgggcatggggcgcatgcctgtagttccagctactcgggaggctgaggcaggatttaaatactgtttgacccaggaggcggaggttgcatgagccgagatcgcaccactgtactgcagcctgacaacgagtgagactctgtcaaaaaaaaaaaaaaaaaaaagagtcgtggttctgatacatctcacttccaaactatttcataattttttaaaaatataaacacataacataaaagcatctattgaaggtgaacattgcaccagcattcagtagatttacggagtcatgagaccatcgcccctggtagttccagagcatccttatcctataacagctttacaagtggtattcagagggggttggggactttaggcttcagtgaaaaagattagcagttaatgttagtttacttcaagaggagcctttatatattttgcaacttctattttgtgttcagttcttctggagagtagggtgtagcattttaggggcctggcttccaagcatgcagcctcttctctgctgtcgattggaggtttgtgaagggctgggaggattgcctccatccaagtgccagtgcatgagactgatcaggagggtagcatgtgaagtggtcctcattggctcacaagaggggacacaggggtttggttggtctgtgcggacttcctggatttggtaggtttcaaagggtcatgatgtttgccacagggagaagaaaagggcagtaccagtggcactggtccttaccctctgtagctctatgatcttgaaagtttgcataacctctggaagcatcatttaaatctaagcaaaataagaatgtgtgtgcctgcatggtattgggggcagtcttaaaaatgaagatttcagcctatgaatatgctagtgtacaaaaatttgtcttaaaatttagttttttaattcagaatgcactttcttattgaaatatttcagagccccagggactgatagagagacacagcgtgagaagaggacaagaggaagacgagacagagagattattttgacacaatgctttatttttattgaaaaagctgtcatccttaaaaattgacagatacaatgcttttaccaatcttcttctttctttcctgtactcgactccttttctgttgaatttttatgagctctgaatgagaatgtttataatagggacaaaggcagtactgaatgtgaatatgtgtgacatttatagaggcccttgtttactttggattttctaagcctcaaaagcacatgcattcctatatggatttctccatgggtttatattcaggtacgaggcatatgtaagtgtgcataggaatagacatgcctggatacatgcctgtgatgtacttgcattccaattagtgccaaagaatgcacactggtgcatggtgaccccaaaaaactggtgggattagcaaacatcgcagcctcctccaacccctgccccagatgaacaacatgaaaaagaaagttgactgcttctaaattatatttaaaagtaaacatcagtgctgggttcgtggaggcagcctaaagtgctggcctgtgaatgtgcctttaggggtcttttgagatgagaacatgattcatttgagggtgatgaagctaaaaaaaaaaaaggtgttggctttctgtgctgacacccatccgcggagcaggccagcttggaagtgtccccatgtcagcctgcagacttctctacctgctgaatgttctcgtttgctcactttgggtttagaggaatctgcttttctaaatttattatcagctcattccattaccccctcctctcctggtggactgttcttgaccctcagcatgagaagttattctgaagtgctgctaacaggatttgatgctggccctggggcttggtgacaatgtggctctggtcctgcccgtctgtagctctgtgatcttgaacagtttgcataacctcgaaagcatcttttaaatctaagtaaaataagaatatgtgtgccatgcatggtgttggggaagtctcttaaaaatgaaaatttcagcctgtgaatacggtagtgtaacaaaaatttgtctaaaatttcattttttaaattcaaaatgcacttccttattcaagcattttctgagccccttgtctatgagaattgtgctccatcccgggattgaggaagggaggcggtcctggccctgggcagctctcgggctggggtcccttctgaagcagcctgtggctggtgtggaatccggaaccacagctcgggcctgagcctgggcttgtctcctcctcgctgctttgaacaggaaaaggagttcagcccagcaggatgcctcttagaactgggaatggcttggaagaaaatgcttatgagccccagcatataaaatgtgcaaggatgtttccctgctggaagcatttacctggtatccttgcatttttactttcctccgaaggccctcaccttgtaatccacctccccacagttcctcccctctagacagcagcctgcctcacagtggtgtcccaagagcactgggcgtcaagagtaaaatgcctgggcattttctctgaagcacctgttaccactgtcccttcaggctgtgatcctggccaaaatgcacccattctttttgacacacttgggagggtctgggattgtgagactgcagaagggtcagatgtcttgagtcactgagagggctgaagaaggaatatgtagtctgttcttgacatttgttactggcccgggcctgccccatcagagcctttgagggcattaccaggtgccccccagattagtgtacctcctcaacagataggcattggccaggctgtcctactaggccaggaaccaccttgttgtctgtttaaattctatcacattttagtgacacacatattagacatgttatatggtacatatgtgtgttatgtgtgcaggtatttatggctctgcctaattgaggcatttgccactttctgagcacttcttacaggccatgcacttatatatgcacaatgtagagaaagagcaaatgaacaagtttacaaaaaatcctgaaagccaggcaagtgagattccatcatttggaatgaaagtaaacttttctgatgcttcagggccaaccaagtgtgcatgggcgtcagaggtcaggtctccatgtgtcacctggcagagggatggtgtgagcagctactggaatttgatttttccagaggagcatgagattgggttactgtgaagtcccagtgtcctgaggttgtggagggtttgtgttttgtgtttgtttttaattccttctccgcaatgcccagtgagcactccacttgagtctcaagaaccccagagtagagctcgccctggggtgctggcagcacgtaattctcaggaacaaacaagtacattcgaataaagctgaggatctcagtctcagtgcctggtccctcggaggcattctagtatccctcttagttttgttttattggggcaagcctgttgctgaaaacagaacctgtgggtcaccctgactatccttcccaggccttcgaaactgccttgcatgtagtagagagactcacagtttgcaggagtggcaccgtctttgaggagctttcacataaagcatctgaagttcctttgctaagtcatgtgcccagtcctcaaaggacctgcagatcacctgatcgctgggagtagggctggtccagggttcctcttattgtgtgacacataaggttcgcccgagtccggtgggacagagatgtgggaggtgatgggatgcagccctgtaggacccgtgaggctggtggacaggcagtgcgggctggtgggagggtgttaaggagaattccatccagctgatcaggtcgtgtctcaggaaggacgtgccccctatggaggctcgagacctttaaacttgctcatcccttcccgtgtgtcttctctgggcgccccagctcctccttctccttggtttaatgccccttttctcacctccctctggcaaccaagtctgcttgttcttcctccgaaagggaaactcctgttgccccttctctccctctgttcctcctctccctcttgcttcaccttccctccgtccttttgtttctgctgcctcgctctcacctgcatttgaggatgtgacttcccagtgggacctgggttgggatttggtgtcaccctccctccctcagctcaggacatttccagagcagagtcttcatcacactcctggcatctaacacagagaaggactggataaaagtttgttttgttttctgatgggtaagtggaaggagagagacagtctctcgctccagggagctgagtgcatcatgcctgcaaagggcctgagcccgcagagtgggagctcgtgagaccagcacctgtgtttctgagaggagacctggcattgccggctggtggggtggctgtcctcttccaggtgtctgatttgcacccctgcttgattttgctaaggtgcagtgggggtcctggctgtagcagagtcaacatgtggacagtccaggtcctgtcctccccggggattctgggtgtttgggtggggggagcagactgtccgggaagaatttttaaatgttttttcccagtggacttgctgccacctggagcccacctttgaaatcactttagtccctggcactgcgctgaggagaaagaagcaagagaggaaagataaacagatctccagaagatgcttaaatcgtagattcacactcaggattgtcccagtcatggctgtgacacgggcacagaagcagcatccctgcctcctcctccctgctgcccatccctgtgggtttgctccgagtcactgagcccaagttccacggagggaatgggacccacccttgggagtgccatcctggtcacagtcaccctcctgggcctggctgccccatgctggtgccgccccgtgccgccttcctctctgcttgggggtgacaggcacgggaaaggccagtccatccgcttccgctgagcctgctctgtccgtggtaggcatttccgacagcatcatttgcaggagctgctgctctgcaacacataaacaaccaggaggaaatgcctactcagacctttgggaggaaggtcccagggatcttcctggcccatgtcggagcggtggccctgagggtcccaggcaagccgtgtccctcttggggtagggcattgactgcccactcttcacaggttgatgagtgtgccagggtcgtgcaggggctggaccggccatggctcggctcaggctgggcagcaagctgtgctggaagcacaggcgtgcacaggggctgaagaaaggaggcagcccaggaggaacggggacctgctcttccagggagagctttctagggaaggggtgacacaccagcatttgaagagggagtgggattttgccagacacaagagacagagaagccaggagtgagtgtctgttctgtgcttccccttgtgaaaaccctgagtaatgtccgtgtctctaaggcccagacacatgacaggcccctatgttctgccatgtggactgggtatagtcagatttcgggtcacgggaacagagcactttgacttgactgagggagatggtgtccaaatgctgaaaaaaatgtggggtcacttgaaaagggctttgtagaatgtataggagttttcagcagttggcttaggagtttggccttttagatgagagaagcatatgagcaaagaaatggaagaaaggggacacagtgcgtagaggctgccaacagcctacagtaggtgccagccggcagaacaggctgagggatccagaatcaggctctaggacagggtttgggcaggatgtttagcccattggggcccggaagaaaacctgcagggtttgagcagtgcagtgacagggtggatttgcattggaaggtcccctgggctgccttgaggagtgaaaggcttccagcctggtggcaggccagatgagaggcagatggccccatccagaggaaagggacatgggtgtaggctccgccggggtgggggg

SEQ ID NO: 5091 - DNA, 100000 bp, Homo sapiens
gtcagtcaggtagctgcaaagggctttacgtttccagtggactgctgccaagtggacataaacatttgaatagacattcccttctccaattcataattgtttttatttattaattattttattttatttgaggcggaatctcactctgttcaggctggagtgcagtggtgagatctcgctcaatacaacttctgcccctgggttcaagcaattctcatgcctcagtctcctgagtactgggattacaggtgttcaccaccaggcccagttaatttttgtgtttgtagtagagacaggtttcaccatgttggccagactggtctcgaactcctgacctcaagtgatcctcctgcccagcctcccaaagtgctgggactacaggcatgagccactgcgcccggcccacaaagcaaaccacagagccctaagccaatgatctagctgctttggtctatatttctgtgagtaccccaaggcaccagaccctgtgggaccagcggtcactctcaggccagggcgcctctcaaggctgttgcactcactcccctctccagccaatctccaaggcccgcccaggctgacggcacctccaaacagccgtggtttgccaagttctccttatgcctcaggcactgtgctaagagcttcagagggcaatctcgcccagttctcataaagtccatgtggctttagttttaataccctcatttacaggttagaaaactgaggcttgcagaggtgtttgtgatgcagctccaggattcttataaaatctacctgaatttaaaggatccaagtttagccattccaccatctggccccctccgcatgtttctccagcctaagctcttggcagcctcctgtgggctctctctcaccacctgttttgtcccctctggccatctccttgcattgcctggcacaggctcaagcactgccccctccaccgacaccaagctcttacagggcttcccgctttgcacctgcagcctgcccctcctcccccacatggctccaggaaggtctgcctggcagactcctgattctcaggcagcccctgcaagagccctccccaggctccctctcctgttcccttatagctattgggagacatctgtcatatgtcatcagagtatcactgctttccaagaaaggccttcctactgggcaaagaatgggcgatttctaccaagctgagtgatccccatcattggagtcagtcaagcatgtgttaggggtgtgaaggggccattgactgaaggttcttgcagtcggaaaaatctggaatctcagatccaccagagtaaccaatgttgacttcattcaggctctgtttttttactgcagtgatcctagagcagagggccatggggctggcacagggcacgaagtccctgtaggtatgttaagaagaaggcatgggccgggcgcggtggctcatgcctgtaatcccagcactttgggaggccgaggtggcagatcacctaaagttgggaattcaagaccagtctgaccaacatggagaaaccccgtcctactgaaaatacaaaaattagccgggcgtggtggcacatgcctgtaatcctagctactaggaggatgaggcaggagaattgcttgaacctgggaggcggagattgtggtgagccaagttgcgccattgcactccagcctgggcaacaagagcaaaactctgtctacaaaaaaaaaaaaaaaaagaagaagaagaagaagaaaaagaaactgaatctgcatccatgcagtgggcatcacaaagtgggctcccagggtccatgtttgtagaagttggtgtgcaggtgcagtttttgaaacaaggtgctgtattagggttctccagagaaacagatccaatagggcatatgcagattatagaagaaatttaattaattaattaattcatttatttttgagacagagtctcactcttcgcccaggctggagtgcagtggcgcattctcggctcactgcaagctccacctcccgggtcacgccattctcttgcctcagcctcccgagtagctgggactacaggcgcctgccaccagcctggctaattttttttttgttttgtattttttagtagagacagggttttaccgtgttgccaggatggtctcgatctcctgacctcgtgatctgcccgcctcggcctcccaaattgcgggattacaggcgtgagccactgcacctggcctagaagaaatttattataggaattggccacacaattatggctcacacaactatgtctgcaaactgaagacccaggaaagttggtgggtaattgccagtctgagtccaaaggcctgaaaaccaggagcactgatatttgagggcaaagaaaatgaatgttccagctcaagaaggaagaggaagaactcaccctttttctgccttttgttctacttgggcccttgaaggactggatggtgcccacccacactggtgaggatggattgctttactcagtctacccattcaaacgctaagctcttccagaaacacgctacccacaccccagaaatcacattttaccagctatctgggcaacccttagcccaatcaagttgacatcgacatgagccatcacaaacaccaaggttatgtaaattccgaaaaggttctgagacacggaaagctcaggtgcctctagccaggcctggcaactgtaaagcccactttgttgagctgtagtgaggattcgtgtgtttgggaagagaaaaaggaagagaggaaagggccaggtgttctataagagtctcaagggacttagtatctttttttttttttttttgagacagagtcttgctcgtcacccagactgcagtgcagtggtgcgatctcagctcactgcaacctccgcctcctggttcaagcgattctcctgtctcagcctcctgagtagctgaaactacaggtgcgtgccaccctcccagctaatttttgtatttttagtagagacggggtttcaccatattggccaggatgtctcgatctcttgaccttgtgatctgccctcctcggcctcccaaagtgctgggattatagtgtgagccactgcgcccggccgagactcagtatcttaaggcaaaacacaggcatttgccatgttccaactccacagttctctgaatgcgctgtagagctttgtaactccatcctgtgaatgtttcctgctgtctctttcagttggtctttgggaaatattttcagtgacagaaagtagaaataaggaaaaatatccaagtccttgctcatatacctcccttgatctagggatacaattcagatttttgcggtggcaaagacaatcttcattgcaatgacaagcttccaacacatttctaaaactcctacaggggaggagcaagaatgagtctgcaaagaagggctcagggaggaggagattggcgggagtttcttgcccagactcccctgccctctgcttggcatactaggaggagaggccactcttggcatattgctgctttttttttttttcagctaaatgttggagactttgttttcaaagttgagttttttttggatggctaaggatggaaaaaatgcacattcccttttcagatactggttcatgccctgtttttgtttaatttcttggaaacttgaagttgcacctgcgaagtggggaggccctgggctggggaagcgaagctctggaaggggcccaggtccgattggggatccagagaggcttcccttcatgtgcctctagacgaggtgtggggaacccgggaacagccatcccagccaacacagagtgcgtggggatactggagcccggtttttcttccctttcttgggacactgccagggaatataaccacagacactgcacgaatgagcacccaatcacagtttttctagaaacaaaggtgtggttggggcatcccattccattgctaccccaaaagggcagtgtggccggtggggccatctggcttgggtgtgggtagcagtttggagagatttagaagaggctccctgacaaagggtcagagaaccccagcactgcactgagttttcctgctgtgagctctcagacaaacaacagtgtcacctcctgtaaatgggtgccctaacactgcagaagctcaaattcatgttgtcattcagccaacatggtttttggcattatgatggtttcgtgatgcacagaatagcacgtaattggctctgggtgtgaagatcaccacggtcttaatgaagagagggttgagcaaagtgatgatttagtccaattgcacagagtggatggtgtgggcggcagctgggaagaagttaagagtagcctcaaggccagatagtcctgatccctcccacttcttcgcctgaccaggtgggtgaccttgaacaagttgcctagaatgtcagatcctgtttcttatcaggacaaaggagatcgtaacagtaccagcctcacccccattcctaacccagctgctgtgacctcctccccaccttcccctatggcatcttccctggcaccccttgactcatccattgactcttgacctggtgtctcctagagtgtaggaaaaatgcctgcctcatctctagggctggggcatggtgctcatgaagcctttgcctgggaataaatacccagatcagtctgggatgagaaatgacactaccttccagagcacagcaggggttgttcaagtcttccagaaaacagctcttgtttctcctcatgtggtgggagtggagtcagagcgtggctcaggccccacatctcagctgtttggatctggggactcgaagtttctggtggttacttctgaaagtcttttcaggataattattcttgctcggtttctctgccatctctgacaggctgttttccctgcttccccgctgccctgaaggggccagaggaacagggcaggaccccagggctgcggatgggttggcagctctgttcccgaatccaaagcagttcttggtgactgtcctccaagacttgccctgaccctgctccgggtgggattctgagaccgcctgctccacgtggcagatgaaatctaggctcttctgtgagaggctggcggggaggatgttttcctggaaaggaccacaggacaaaccctgatgaaatttctcttgtgacctccctggaggaagagcacttctgatttctgcaaacttttccattcccccgatctcacaaatggggaaactgaggctaagcgactgagttcagggcatctgaatctcagggatggacagtcaggatggacaacctataggcctttcctcctctgaaatctctctgctcgggatcgtttttctggtttcccctggcttgcctaaattctgctcattgtcccggcgcattttaagaagtcatgtgacttctaaagacttccctgacctcctccctcattagctgggtatttcaggggcttctacggcaccctaggctttccggagcggctgtgccctttatgtatgcgcgactcccactaggctatgagctacaggagggagggtaggtcttgtcccggagagcaccttaatcacaggcgctgaatgaaagaatgaactggttgtgcaggaacaggatccgaacccgcctccccaggtactctaacaccggcccggcggaacctgcaagccccagaccacttggagcctgggctgctcaatgggtctgataattccaggtcctctctgcgccagcgaagggaggtcccagggcgcacctcggcagggcgggggaccccggtgaagggcgctggaggcgcgctgcattgttagggtgatgaggccaggtgacccgccaggctcggggcggggcgcgggggccggccgtggcgattgcccgcgccgcctcgagggggccctgccgcggggccggcagccagccaggaggacgggcccgcccgcgcgctactcggagcccagcctcgttcggccatcgccctgccggaccgcgcctcaggctcccccaggtactggggccggggaaggggaaacgcggccacgcgccgcggtcctctttgtttcgggcccggcgcgggctttcgcgcccgggcgcaggaacgaggcttggggagcacagagatctggagctggggcgcggggactggttcggggagcgcggagacagagttcggggagcgcggggtacgggagctcagggcgcgggatggggtcacgggagaacccaggttagggagcgcggggacccggttgggggcgcacggcaaggggtttggtgcgcgcgggtacggggtttgcggcgcgtggggggcgggggctcggcggagtcccaggacaggggctggggcgcgggccagcttcgccggagtccggggacggggggctgactggctgggtttggggactggctggggcgcaggaccactcgagtgggacccgtgcgcccgggcgccctggactgagggcagagaccggagcagctatgtcgcagtcgctgtcggaccgagcggactttgctccctaggactccgtctcgagactccaggtggagagcgcagcaggggcttcaatgggcaggctcaagacccttctcctactttttctaggcaagctctccatgcgtctctttccctttccctttggtgggtgggaggcagggggtctttacgcgcttccttttttccctgaaggacgggacctcggggtggggggatattctggggtggggggtgctgtccaggctgggggccagctgtgtggcatgtgcctcctggcacgcgggagctgtcgctgacagcaggaggagggagggtcccggacggcccaggggtctcagtgtcggtgctgtgcagcgcctgacatgtgagtcccgggtcctttgcttggagtgatttgagtgtctgtggcgggaaggattcaggcgttcctcaggcattctccagacagtgtcagcagatgacccgaactccagctggttgaaaaactcaaagcgccatcagggtgtggggccagcagagagcactactgagggggtcacaaccccctgggaagcccccaggcttccttggggcgcattcacacactttgatctccgggttggctttccccccatttttttcactatttgaatgcatgatcatggaggactcgaaaatatactgaaaagtatgaatgcagaactcattgtattaatattgcatggcccttcgaactaaccaaccctttgacattttagattttcttgaggctttggtctgtgcatattaatttttaaattgctttcatgctttcccttttgaatgaggtttacttgttctggtgattctgttcttctctctttggggcctgtgaggttatatttgcaaatcaatcaacaagtattaagaaggcttttctgtgctgaggccttgagggccagggagggggtggggagtcgctgcagctgagggtggaggggcaaggccattacacagagatggaggtgcactgggtcctggtggggggtggtagcacagggggtggggggtgtgtacacagggaattgacaggaggaactggcagcagcccgactcctgaccttaggaatagtaatggtgaccccgaagacaaagtaacaggcatccgattgagtgtttgcctgtgctaaatgctttgcatgcattcatttcatttcacccaaatacattccttggagggagttgggattatgattaccccattttacagacgagtaaactgagcaaaggaaggctaagtaacttggccgagatgaaatgaaacatggtggtagtgcagcctggattctgggacaggactctagggtcccagacccctgttcctggctgctgctgcgcgtcgtcgactgaattctaatgcatgtccagacagcgattcctcagctgaggctgccatagcttcagcagctcagctgaattatgtctttaaaaaactaccaagatagaaaaactagtagcccagggcactacttattcctgaatgcaaattgattttttttttttttaacaaagtgtctcttggcacctaatgttttgaaagtgagctgtttgcaaatgtgactctggaaataaagggcggagagggggtgtcaaagtatgctcttccactgcaggaggtgttgctgaaggggatagcgagacctgaggaggaggcagtatggcaagaacagtgagtggaagggctgacctaccattggcagtcgcagcttatatctgcttaggactctacacaaggacccattttacagatgagtaaataccaagtaaattcttaaagtctgggaacagttagggatctgaatgagcccagttcctgactctgtgtgccccattcctttcttaagatcagcctgttgtaaaccacccctgttcggggaagcctcttgttccctccctgtgtccctgtgtatgaacttgagagggggaggaacttccaccttcctgagggcagaaagcattgtttagatccctgccacttactaggaagccaagacatttgctgagtgcctcagcagcacgcttagaattgaggcttcgaggcttcctcacgcggcccccatagatttcccagggaggggcctcctgtcttgcgggttgatctggtgggttgccccatgcagcaggagctatcatgggaagggtgggtctgggcgtctgaagctctccagaggtcagctgaccctgggaccccgggtccttcctgtaggaccccagaaatcactggggatcagctaacccctgcaagctgtgcctggaatgacctagagccagtcctgtctacctagatcctctgctgctatccttgttgatctagaatgagggatgctggttagttggttaattagtaggtggttgattaacttagttactctcttcctcacagcaagagtattaaaaaccatccaacatggaacacagttctttctttctgcccccacagtgaagggcgtgttgcgtggcttatcttcacagggatcatggctcacagttgtgtcgtttccacgctgcctcactgctcctaaacgctgagacaagaaaaatcgctgccaccaaaatgctgctgagcaggactaaattctctagattgagggcgttttgaatcttagagtatgttgaatccggatgcaggcccgtgtcctccgtggggcttttcgagtgcagctcgggcaggaacagtggtttccttgatgtctatccgttctcgtaaaagcagaaaactagactctccaagtttcgtgagctttctgtttgtactcttgactcaggaatgtgtttggtacacatccatcactgcaatgtgggatgtagtgctgagccagggtccctcgggtgtctccattgtctgcatggcggcatctcctgtcctgctcagtgtctccaggagcaccgtggccctctagacacacctctaaccaccgcccccccccaacccccgccccatgcacctggcgcagctctacctggtatccctcacctgttgcctcctaccctcgtgggagttgcctctgcgaaacaggagggaggaggccagtgaaaatgagggtgactgaggtgggggccatcaacttggggatgaagcactgcacacaatttagggtccctcggaatgcccactgtgtcagggaaggggaggattctcacatgcttctttttatttttttatttttattttttgagatggagtcttgctggagtccaggctggagtccagtcgggccatctcagctcatgcaatctctgcctcctgggttcaagcaattctgcctcagcctcccaagtagctgggatacaggcgcataccaccatgcccagctaatttttgtatttttagtagagatggggtttcacttgttggctaggctggtctcgaactcctgacctcaggtgatccacctgcctcggcctccaaagcgtggggttacaggcgtgagccactgtgcccggccgatttttttttttttttagaggcagtagtctactactcttttgtctcctgggcaaaatgaatgaaagattatactgaagattctatgtctgtgatctagaaaattccctctggcagagggaggtgctcccagagctaggaagtgctcctcagagccacccctcaggggagagacctctctgtccctgtctccacccagcgctgggcaggaagccctgggagccctctgcaaacagcccgccagctctcagcctaaaacgcggctaacaagacccccttccttttactactcaagtatccaaggtggcttgggcatttctgtccctagtctgatcgttgctgaaccgtgcatgtatgccatcctgatggtctccttttctggaagagagcgctgagacttagcgagctcaagtaacttgtgtgtgttgtgaggtactgagccttggatctgaatcccggtccgtcagcaatgcttggagttcttgccaagataggggtttgtgcagtccccacccacagcccagcccctggagtggccaggccaaggctcagagctgcggcgtgcctgctgtctacctcaaccagtgcgccagccccagctgcttcctcgaccccaaggctgggcctttctttactcttccttcctccctcagctctaattatggttcagttagattgtctgcccttcctcttcctcttctcttttggggaaagataatagcacttaaacgccctttgcaggcctggctttgtttctaagatatcagaagaatctttaggaatctttttccagctgcccaagcgagcggcaacctgtcggcacccaggaaggatgaatacgggtgcctgctgacgattacaagtgccactcctagccaggccatgcccctggggacaccggggaccctccaggtggactaaagtgtgtcacctcctttcattgtgtcttggcagccacagtgtgcgtggcacctcttgtgtgtagagtttatgaaactgctcctgaaaagtagagaccaattcttgatgctttgaatacactggaatacactcgtggcgatactgaaagaaagaaagtcctcggaagtgtctggccaaggccgttcactgccgtctgcagttgcttttctttttacaggaggcccgggctctgctccaggccctgggattatttctcgctggaggattcaggaatctgcgtctccccatcaccctggaacacagctgcagtgtgtaacatttcactcacttggagccaccaataaaaggcacaggcccacatctggctgtgcagggcaggcgggcaggagagtgggcctggggcacactgggccattagcaggggcatctgcgtcctggcctgtgcacattcctcccggagcgccgggctggctctgcaaacaaaggggcctggtcctggcattcttctccacctttaatccatcacctttcttagaggtgtccctgggcgcctacccctttcatcactggccattgggaggtagatcaaaggtacgcacaggaggcagtgacataggccaggctctggcatccacaaacctggggcagaactgtcctttgtcctgagaggtcctggggttattgtgactgtgttgtcatttgtcacctgcagcctggggttgtcgttcctccacaggtttgctcctccactgttccggagctcaggggtgggagccacgtggggttttgtttcctccttttgggctccagcccagtgtactttggtcctgctgaatttccatggccccaggggcctgaaaagcaccttgggtccttctggagaaccacttcctcattcttggaggtgctaatctgatccactgggaggagctgtgtgctaagtggttgacacaggggaggccagcgtgatagagatgagtttttctcaaagatcaaggacaggtgtttccagtttgtctcctctggaaagacctgcagagccgggtgacagggctggaggaaagggggcctgtgtccatgtcttgggtaggtgctaagggagacagagggctctacgtgggtgaagaatgcatttctctcttgtcctgcacgcaggagggaggccattttttatctgtattactcggagagtagcagaagactctcaagtaatgagcatattttgctgctttttttttttttttttttttttgaggcagagtctcactctgtcacccaggctgagtgtagtggtacaatctcagcttactgcaagatctgcctcccgggttcacgccattccctgcctcagcctcccaagtagctgggactacaggcgcctgccactacgcctggctgccggctaattttttgtatttttagtagagacggggtttcaccatgttagccagaatggtctgatctcctgacctcatgatccgccctcctcggcctcccaaagtgctgggattacaggcggagccaccgcgcccggccgtatctttgcttcttaatttgctttttgactatttttctacaaatagttttcttgtaatatgtgctcattgtagacttggaaaagatagagaaatgctaagaaaaaggaaaaaattccttctaatatcacctccacagaggttcatattttagccttctgtgtgccatatgttttctgtgcttttttaatttaccaagctgagatcataccatatgtatattttgtatcctgcattttaaagtcaatgtggcagtataagcatttcccaatccagaatagctctgcataaatatgactgctgatgacagtatagtactccagtatgtggatgtacctgatatttggacttcactatttgttcattgatcatttacatcctgtgttatgcttgcactaggtctttgggcagatcgtagctagtcatgctcttgaaaggatttctagcagactcttggcatcaaagaatacaaacatctttttttttaagctttggtaaaacatgcataacatgactttgtcgttttaatcatgtttaactgcggcagttaggcgacattaagaaccttcacgtgtgcaaccatcaccaccctccagctccagaactctttccattttgcagaactgaaactcgtgtcccttaagcactaactccccatgttcccctccccccagtccctggcaaccaccatctactttctgtccctgtgaaacggactacatcgggtgcctcatacaagtggaatcatacgtatttgtattttttgtgatttgtttatttcacttagaatactgtactcaaggtttcatcatgttgtagcatgtgtcacgatttctctctttttaaggctgaataataccgtgtgtgtggggtgtgtgtgtgtgtgtgtgtgtgtgtctgtatgaatagcacattttgtttatccatcatctgttgatacacttcagttacttctacccttcggctgttgtgaataatgctgctatgacatgggtgtataagtccctgctttccattttttttttggtgaacacaagctttttggactccttagtatatatggtcaaattgcagttgagacatagggtgctggctggattctcaggtgtccacccgctgtccttaaacatggctaggttatcacccccagggtaaaaaccaggctgcaggaaaaggaagagggagacttcttaccaagctattttgacagattgtgtaaacttgtgattaatgggatgagaaagcaggaagaatgtctttcatttaaaaaaaaaagagcctcggggttgcttggttttattttcaattaaaagggtctgattttgtttctggagaatggtttaatttggataaatggttcagtctgggaaccacatgccagagcctatgatctatgagtcaattactcagggtttcctcggctgcttttctgagggaacggtccagaactgggctcgcctggtttggctctgttaaaacgtcgatgcaggccctgggcagttggagtgaggcggttctgtgatcagtccttgaagtgcagccataatgccctccccataatgccttccccaactgaggtggttaatttttaccctctaagaatgtgttcacaattccaaatcaggaatgtcaacacaggctgtcgttttcccctccttggaacatgttgaaccagaattactggcatcttttccacgtgggcatttgcagaattggtgggatttgggggctcaaggaggaggcagactcatccgatgtttctcctctggattacttgaggtccctggccgggcaggcctgcaggcccagagaggggtggtgggttgctctatctggagtcaactggtgtttctttccaagaggatgctgggtgggggaggtgagggactaaatcctgggcgactttgcagaaggacccgtcgcgatggagggcagcgtgggcagaggccctgggcagggccacctgctgtgttctggagtagcaaagggatttgcagaaggcaaagaagaatacaaagacacaaggtagggtgtttcaccctttcggaaactgtggcaaagccctggacaactttccatggcgcttgtagatttgagaccaatgcccagcgacctagcgggctggtgggaggcagcgtggagggcggcagggtgtccccagggtggaggtggagagagtctgcacagaaatttccaagagcacagcccataagggaagaataggctgctcgtgaggtgggtgaaggcattgccctgctggcttgtatcagggcgttggctcctggtcctcaacaaagggcatattagcataatgaatagttaagttacttggttgggcttcagccttggggccgtggtctctttccgagggaaggactggtgggtgggccccacctctggagtccagcctgcattgggaccacgtggtttgagaaatgttttcccaagcctgggccacacggacccttgatttctggggcagccctggtggcaactccccacatatccctgtgaggccttctcattttccactggcaaggattcaggtgtaaccagattattctgatgaaaaatttgaggagacaggtaacccgcaacacacagagttgctatgttttgctcttttttttttttttgaacggagtctcgttctgtcgcccaggcacgatctcagctcactgcaacctccccatcccggttcaaataattcttctgcctcagcctccatagctgggactacagacgtgtgccaccacccccgctaatttttgtatttttagtagagacagtgtttcaccatgttggccaggctggttcgaactcctgacctcaggcgatctgcccgcctcggcctcccaaagtgctgggattacagccttagccactgcacccgatcatgtgttgctctttaactccccacccccacctccattaataggaataatccaaaacataggtcatcgagagcatactgtgcttttaaggcattttgttattattagtagagattttgcgacaactggaatggtgtttattcactttttaaaggctactcttctcacaggataacagaacacacgatcattcattttcctcttcccacgaaggtgttgcagcagtgggcgtgagaagcatagtgtgtgtgtgactaccgcgcgaatggttctccaaacctggatcccgacctaggcgttgccgttgccggtctctgggtgtcaccctcccattatgactgtagtgacttctcagaacgccctggagggatggccttactccaaatggtccctggctgccgggctatttgtgagtaaaagatgtttgtcagtgctgcttcttttagaacatgccattccacatcagctcagcttgtcgggtgtctggttgtctgtgcggagcccatggggagtctctgcagcctcacacctagcagtgaggtggcccctctgcgtggtcatgccctgcgggttgcattcctctccctgatggctggctgccaggacctgtgggccctggcggtgagagggtgggaggtgctgtggctcctgccaggctagctcttcacagactgggttagttcttccaagcatagttccctgggacaccacgcacggggcaagcacagctgtgtggccagcggcatgtgacagggctagacacgcactgggccgcttaatgccgaccttggcctgtgagtctgtgacaggactcttggtgagcggccagctgggggctgttggtgctgagttcagctttgtagccaaaaggttccagctgatttccagacagacccggcttccgttttcaatgccaagatgagcgggcgaatgagtgggagcggacagaggcttttggccgactgtgatcgctattgtctggatccccttgaccctctggaggtactgcctctcctttcatttgtacacaccggtttttctgacggtttcgcctcttgtcagctctgtgagccgggacaccagcttttccgtttcccatacgccagatggctttgagcaaacaagaggaaggccccagcgtgggtgcagcctgtggctgcttgtcctgcctgtttaccctgggggtgaagcggaaagggagcaggctttgcaggaacccggtggcaccccttctcgtccctgccacttgttctctttgtggccctgggatggtccccaacttctctgaagtggtgctgaaaactgtgttgatagcacggacctcactgagctgttagagtagctgtcgacactgtgtacccgaggttctttccagtggaaaccaggttagccttcgttccttttctttcatctgtggttggtcacccttttgagagctctgaccccaaaagaagttttttcagattggcccaagttcctccacgttgggccccccaagacagactgactgagaaggagtggagctgtgggcctcctgattccttcccaggctatgtcccttccagagtggtccggtgggacgctgactaccagaggcctggccctctgttctgaggcccagttagccatggcttcatctgctcacattctgtgggattgggttgtgtaattttcgttgtatctctctgtcccattaaatctgaattcctccaaggacaagaaggctgctgctgcttaaaaaaaaaaagaagaaaaaaaatgataagagctttagaaggagcttagagttagctacgtgtacttgccaagtgtgacatcactcagagcctccattccatcctctggacagccaggggctggcctcccaaccggtgctcactgggcacacttcactatgggaggggatagttacacatctagatgaaaaattctagaagtgattgcttacgaggagagagggaaatgccggcacattttcccaggctttgttcatgtttttattagggccacaactttcattcttggagttttgctttgtaaattatcctttaacttgcagaagagaaccatttacaactcatcttacagacttgagaatctagccactgatatttccttggaaaatagccacattgcaagttgttgtgttattgaaagttgatgcaaatgtccccaggagtccatgcaggtttcctgagaagagttgcacctacggagctgtgcttcagcacaaaagaatattctttctggacagagtgtgttgtggggtttgtttccttcaatctgtactgccaaatggcaagaatcatttcctttttcttcctcggaaaatggattccatcttgatgcagagccaccagcactgtgtaatcccttgtgtaatgtttatttatttatttttctttttattgagacggagtctcgctcttgtcgcccaggctggagtgcaatggagtgacttggctcactgcaacctccgcctcctaggttcaagtgattctcctgcctcagcctcccagtagttgggattataggcgcctgccaccacgcctggctaattttttatatttttagtaaggtggggtttcaccatgttggccaggctggtctggaactcttgacctcaggtgatccgctgccttggcctaccaaagtgctgggattacaggcgtgagccaccacgcccgacctatttttttattgagacagagtcttgttctgtcacccaggctggagtgcagtggcaccatctcgctcactgcatcctccacctaccaggttcaagtgattctcctgcctcagcctcccaagtgctgggattacagatgaccatcaccacgcccagctaatttttgtatttttagtagagacaggtttccccatgttggccaagctggtctcgaactcatgatctcaggtgatccacccacttggcctcccaaagtgttaggattacagacgtgagccaccacgccccgtccctgtgtaaatgtatgtatgtgtgtttgtgatagaatctcactctgttgcccaggctggagtgcagtgcgccatcttggctcactggaacctccacctccctggttcgagcaattctcctgcctcagctctcgagtagctgggattacaggcgcccatcaccacacctggctaattttttaaattttagtagagacggggtttcatcatgttggccaggccggtctggaactcctgaccccaggtatccaccctcctcggcctcccaaagtgctcggattacaggcgtgagccactgcgcctggcccttgtgtaatatttaaatgcaggttttgttcttataaagatgttgggcatccagcagcttgtcctgggaaaatgtctcctctcccgctttttgctttgtgctgagacccccagatctgttcacaaatactgcatcggggactgagtgcacgtaagacactagccaaattttggaggatgtttgggttcatataatacataggcttcgtgcctgaagcacatcaattctcagatggcaactgctcagatccctgcctggaggaggagtgggtgtggtgatggcagccacgctgtaatactgtgggctttgttcacagccacagtgaggaggagatagtgtgtcccggtacaagtatcgctctatcagcagatccatctgtccttcctcaaagaggctgcggcccacttcaggccattgtgtcaaacagttggcatttggccttggccctgggtaaaacacatggcagggtacacgtgggtgccactcacgactcccccacatctgccggggtttccataacgcactgttcgtttgcagctgcacgaatgcgatatggcacagcagccgctcatagacctcaggcttgttccatgcatagaagatgcacaccgcagagtggaggccgcaggcagggaagtaactggcataattattgactgtgtgtgaggccctgtgcggggagattcacttgttccttcctttattcttcattcactcactcattcctttcatgcagctcatgttcagtgagtgcctgctgtgtctagatacatttaaccctcactaactctgtagaaactgaggctcagaaggtgaatgcaggggaggtagcttgcccaccatctcagcttggacatggcagggcaaggggcttccgatcacgctctcagacccagagtctgcttgtctccattctgcctgctccggagcccccagttcttcagctgcatctcgaaggtgaaggaagacgatcccgtggcctgctcaggactatgtgcctgtgctgtggcctggctcgcctctccctaccctctcctgcaggccccagggtcctctggagccaaggcttagtgttttgaatcactggcctttcctttgagaaaaatggggctccctgtgcaacttttcaagagcttgatggcagggcagcctctcagagggtcttgggggagctcccaagtggagttttgccggggtgcctgtgggtacagacagcaaagtggaggcagcttagaaacagcatgtcacattgggctggagaatcagccggatgcccgagcctcttgttttaggggggactggcagaataagtcatgttaggcccagcttgttccttattactgatcgatgttaccacgagggatgtaccacagtttactcaaccactcaccagttgcaggacttccagttcatgacatgatatatcttttcagttatttagattatctttcatttctttcattggcatctgtgagtttggcatacaggtcctgtgtgtgtcttcagatttacacccaagtgtctcacttcttttttttttttttttttttgagaccgagtctcgctctgttgcccaggctggagtgcagtgcatgatctctgctcactggaagctccgtctcccagcttcactccattcgtctgcctcagctcccaagtagctgagactacagatgccccctgccatgcccgactaattttttgtattttagtagagacggggtttcaccgtgttagccaggatggtctcgatttcctgacctcgtgaccatctgcctcggccttccaaaatgctgggattacaggtgtgagccactgtgcctggcccacgtcttaaagtgattgtgaatggccttgtatttttaattctgtgtctgtgtattcatactagtacatagaaatgcaattgacttttgtatgtttaccttgtatcctgtgagtttgcaagttttgttttgtatattcctgggcatttcccatgtagataatcatgacatctgaaaaagggacaatgttatttcttcctggactttgccttgtagattgttgcacagtatgaattttacggttcttctctcctcattagattcaggataagcagtttttaaaaaatgattacatagtgtgaggtacctctacttgcttgcctcacattaagagatggaatgtcttttttttttttttttttttttgagatggagtccggctttgtagcccaggctggagtgtagtggtgccatttggctcactgcaacctccctccctgtttcaggtgattctcctgcctcagtagctgggatataggcacacacccaccacgtccagctgattttctgtattgttagtagagacggggttcaccatgttggccaggctggtctcgaactcctgcactcaggtgatccacctgcctgggttccctaagtgctgggattacaggcatgagttaccgtgcccggccatgagatggaatgtcttttgtcctgctgttggcccgctaagtcagatcacttggttgagacccgattcccttctacctttgatactgcctcctaacaactttcagccattttaacatacaaggatggcctttgctgaatcagttattcccttaggagttatgcagtggtagttcttaactgtttttaagcacttagaaacactattgtcttgcacataatcagactgttacttagcaatcccttttgcttgggagcaagctcttcagagtaaaagggagagtagagggggagaaaatcgtatttactgtgtgattccataggcagtttgcaaatctgacaaaacaaacatgtgtgccttttctcaaacctgactctgtaagagcaccctgagtacctttgggcagcacgctattgtaactgcagtggaacgtgaatgtggctgccatcactgccaaatgatagatgcctgcccaggctcacctaccaccgggcagctgcttgggtggctctgttgaggagtccatgtttttggacgagtgctatctaagtcagcagttctcacagtgaggtcctgacaccagcattagcatcccctggaaactgtaggaatgccagttctgggttccaccccagacagacctcctgcgtcagacactttgggttcggctcggcagggtttagaaccactcatctggattaatcttttttccaatatgtagtacaatctgaaaccccagtgaagctgttaattgagatgtctttaaagttccatgtggctttgagtaatccacgcatatcatgccatcagactgtggctggttgctcttccaaagcctcccacgcccgtgtgaggaataagctgcatttacagttctcatacttaggagaactccttttagtccctgaacccccaatgtgaatttttgcctaagattaagaaatccagcagagtgcgaaatggaaagcgaggttggtgttaactagtgtaaatttgtgcgtattttcagcatttgtttaatttaactttgtcccccacctactggcttattaccttaagaaataaaaaactggccaaggtagtgactcatgcctatctataatcccagtaatttgggaggctgaggcgggctgatcaccgaggtcaggagttcgagacaagcctggccagcatggtgaaaccccgtctctactaaaatacaaaaaatcagctgggcatatggtgtgcgcctgtagttccagctactcgggaagctaggcaggagaatcgcttgaacctgggaggtggaggttgcagttagctgaaattgcaccatgcactccagcctgggcgaaagagtgagcctctgtctccaaaaaaaaaggccgggcgcgtggctcatgcctgtaatcccagcactttgggaggctgaggcaggtggatcacgaggtcagagatcgagaccatcctggctaacagtgaaaccccgtctctactaaaaatacaaaaaatagccgggcttggtggtgggcgcctgtagtcccagctactcaggaggctgaggcaggagatggtgtgaacccaggaggcggagcttgcagtgagctgagatcgcgccactgcactccagttgggtgacagagtgagactctgtctcaaaaaaaaaaaaatagaaataaaaaaatcaactttctggaggccagtgtctttatagcctgctctactggttaaggattttgattcttcacatagagatgcagactgagcttcttttgtgtgcaagacagtctgcttttcttacaacgagagttcctatgaactcaggagcaagtaggtagccacgtgtgaatgtggaccaagctgtgaaaggggacatgtctgcagaggaaaagaaggtgctgtggaaactgagagctgaatgaggaagggtcggggaggcagccaagagcttagtgatattaatcagtcaggttgtccagggaagagaaccaacagggcatgttcatatatatatgcgtatacatgtatatacgcatatatataatgaataaattttagccgttcttgaggttgcagtctttttttgtttttttttgtttttttttttttgagacggagtcttgctctgttgcccaggctggagtgcgatggcacaatgttgctcactgcaacttctgcgtcctgggttcaagctattctcctgcctcagcctcccgagtactgggattacaggtgtgtgccaccaggcctggcaaatttttgtatttttagtagagatggatttcaccatgttggtcaggctggtcttgaactcctggcctcctgatctgcctgcctcgcctcccaaagtgctgggattacaggcatgagtcaccacgcccagcaaggttgcagtctgagtctgaaggcagcttggagcagaattcggaatctgtcttttctcttaagggcttcaatgattggattagccccactgacattatggagagtcatttgctttattcaaagtccactgtttaaatggttttttttttttttttttttgagacagagtctcgctctgtcacccaggctcagtgcagtggtgtgatctcggctcactgcaagctccacctcccgggctcacgccattccctgcttcagcctcctgagcagctgggactataggagcctgccaccatgccagctaatttttttgtatttttagtagagacggggtttcactgtgttagccaggaaggtcttgatctctgacctcgtgatctgcccatcttggcctcccaaagtgctgggattacaggcgtgagccacgcgcccggccttaaatgttaatcatatgtaaaaaataccctcatgcaacatctagactaagtttgactaaacaattggataccatggcctagccaagaggatgcataaaattaatgacactgcaaggaattgggattgtgactgtgactgtggtctggggcagtgggaagatttatctggttggcaagtgggtgtgggaaaagccaccaacagtgtcctccctgctcagtggcctaacccagggctgtcatgagataatacactgttcatcactaggcttgtggaacacaaagggagccactttctggagaagcggggcagagcttctgtaagtcgactttgatgacaccctggggtgagattggatctccccaggataggattggtgtcctccagagggaatgagcatcctgcttcagaggttgggcactcagtcttgctagtgagtcctgccccatggttgactagctcggacccaggaggtcatcactgggtcctgaagcttttctaccaaaactggtgaaaaggcctcttcaagggcacctttcagagtgagcacccaggagacgttcgtgaaagtgtgagctgcctcagcttaggaactgttcttatgtatttatctcaccgtccagatggtagggctgtggatttagatctttgtcgttggcctaggtttgagagtccttgaaggggggctccaggcaggagggttctgtgtttctggcaggtgcccatgcagctcctggctgtgaccactccatctgcccactcactctggatgatccttgtgtgcccaggcagagggcctggcccggggatgcccaggagttttgcctagcttcgctgttagggacataaacaagaacgggcatagctaaagaaggtatggccagagaaggctgggcccggagctgggggtggggctgtgtcttggctcccaacgttgttgttgttgaattatccccaggcactcatggagttgtcctgaaacccatcttccgttgccttgatttatccatgctgttcttacccatgtcatcttcagagagaaaagtctttttccatgcacagccaagagactgactttacttgttttgtacgtagttaagaattccaccaaaagaattccactgccataccagcatctccaaggatgtcccataaacttggttgcagagtttgtgaaatgttgcactccagtagaaggcagcagactaggcctggtgcggtggctcatgctgtaatcccagcactttgggagaccaaggcggcagatcacctgaggtcaggagtttgaaccagcctgacccatatgatgaaacctcatctctactaaaatacaaaaattagccgagttggtggtgggcacctgtaatcccagctacttgggaggctgcgacaggagaatcgcttgacccgggaggcggaggttgcagtgagccgagatagcgccattgcactccagactgggcaaaagagtgaaactccatatgggaaaaaaaaaaaaaaaggcagcagacgagactgaagggttgacctttcaagtgtttatccacctttgaccaaataaatctaattccatctctttgagttacttaagataactatcaatgataaagattttttttgcagaactctgttgaggaaaaatagctggcttttccatttccagaatgatctccgggtcagagacatacactgggtcagtccgggaggggaggccactcctcccctggatggtcagggtgcacagggaatttttgccatcatactgcaatggagaaatgtttacctatcaaactgtattgcaactgtgcttcaattacttccaccttgggctgttagtaaggattgacctattcaggttaccagtagactaagtggctgaccagctatctactgtgaagcagactaaataacttagtggtttaaaggaaaacaaattcttcttgaggtctagtgggctagctgcgtgggagctgtgctcagcaggtcttcacagcctgcctttctgtctgcatagtcctgcttcttagcaggtttatctcaggtcacccaagggcaaggcagaagctgcaggcaacacctcaggttctattccattggccaaagcaagaccagctggatgccagggttaggaaatagattccaccttttgacgagtcttgggagagaaatattgggccatgtttttcattctaaaatgttgcttgactcttccatttacttattcagcaaatttattttaaaaattggccccttgctgatacctgcaacccacctaaggaatgacacagcctacacttctgaggtgactgcatgatttggctatgagcttcctagtagccattgtgatgaggaaacaatggttttgaattgttttttggtatctaagcgatttaaaaaaaagagttaagaaaacagataatgaacagaaacaagttattctggaaagtagagaagtttctgaggctgaacctgaggtgggtggtcccatagggtccctgcatagtcctcagcataccctgcacccacccattagagaagtggaacacaacagtctctaacactcccagtggtggccaaaggcagtgtataagattcaggcccctaagaataaggtgccagggatttgagcatcctgtgctccatgttccaactctgagacacaaggacaaagcactagaatattgcactcgagctacagaagaataacctaggtgtgtgggactacagaggcatgagcatctgtcctagcttaccctctgaagttgcccaaccagcgtcgcaccacgtcctatccctattaccctagacaaagaggtgaccacctgtgcctcagtttacttctggtgttacagtgatattttcatgaagtcacacctgaaaaccctggggtgagcagtcactgtgacctgacatcagaggccaggggtctggcagttgtgttggggacacccatggcctgcctgatgtgggggtcacacaaggtcacacagggttgcttgggattacagcctgtttctagatggatctggtggcgcctgggttcctcactgaggacttgaggctccaggctccaggacattcccaagtcccccagccaggacctcagaaaggacactgtctgggtgggtttgagaggagcaagttaggggtgctgagaggtggggctgctgttgccctggaaagggggtcatttgtaggctgatgtctgtgctgggatcccagttcgagggttgcagagcagccagcgggaccacaggcagagtcggccaaggactggttgcccctgacagcagcgagaggtggacaagggagtctggagagaatgccaccgggtgagaagttaggtttagggcttggttgggcagatttatggaagacatgaaaacaccaggttttggacagagtgatatctaattggtttgtgctgctacaacctgataccttagattgggcaattgatagacgacaggatttatttctcacagttctggaggctggaagtccaagatcaaggccctcggtgtctggtggggcctgtttcctggttcatagatggtgacttctatgtgccctcacatggtagaggggtagggagctccctggggtcattattatgaggccctaagcccatcctgaggctccagcctctgacctaaccaccttcctgaggccccagctcctcataccatcaccttggggttcaggtctcaacataggaattgggggtaggggggcgggtcacagacattctgaccatggcaatgatcagaaaagcccagtttgaggtgggctgcaaagggagacccgcggccggctcttgcagtctgcgggggtggagcaggtggtgtagacccagcttcctaccttggggccccagtggccctagcagcatcgtgaatcccttcatgctaggtgtagtgtgtgtggattgttctcagggttttagcttcatcagatcatcagggctgctcgaccgccgaatgtgaaggccagggtttcctttcctatgctacagcagctctctctgcgtgtcctggtccccaggctgcccattgccctgagaagatgcatggtggagcttgggcctggaatgagggggagtggaaggaggtgagtgcaggatggacaagggccccagggagactggggccataggatgctgtgaactttgatggaggctcagagatgtagagcaggagggctggcctctcgtaagattggctcctgtggctcttgtttagccccttccagcccccatccctgcctcttgttctccattctctgcatagtcctgggggcgtaaagatgatgtgacgaggctgaggcaccgccctgcaccagaaagttcttggaactgccaagggcacattcctaagatgcaatgttgtgaagccacctctgctgtcccttggagattctcccgctcccattattaaaaatctgaacatgtgtcttgatgtctgtttatttattttttattttttgtgagatggagttttgctttgttgcccaggtgtgagtgcagtggcgtgacttggctcactgcaacctccacctctcaggttcaagcagttcttctgcctcagcctcccagtagctgagactacaggcgcgcgtcaccatgcctggctaatttctgtatttttagtaggatggagtttcaccatattggccagactggtctcaaattcctgatctcatgatccgcccccttggcctcccaaagtgatgggattacaggtgtgaaccaccacgacctgcctgtctgttatttaaatatgcattaaacatggggttggaagagtgacatgggaggtctatatacacggcgttgcgagatttgcttctgccttccagtgctttcccttgggctccctctggggagattcggctctgggagatttgcggccagttttgccattaccaggtgagtggaagggctcgaggggtcatgcaaagcttcctcctgctcatggccttggacataaccaaggagggcttggactggaccctgagcagggttttcctgcaggtgtacacagaggaatgtcccatagggtggcttgtgggagagtgggaccctggggaggcagagctgggaccctctgctgaggggggccccagcagtgggccttgtcctctcctcatgcgtgggaaacctgcccagggaggctgtggttatttgtcccagtttttccatcgacgaaacaggagtcggtggaaatttgcaagtaggtgatggagaggtgggcctgaaccccaagtccttagaatgaaaacctgggcctttcttggtccctcaggtgtgctccactgcagggtggggaggtgctggggtcggcctctttgaagttgggctatggacacaaaggggttggggttggtggaggcacccactcttgcatggaggagggtgtggaccctctgccaagtgtcaagttagcctgaaatgaggcacagactgggagctttgcttttgccctggggtaagaataaaagaagaaaacaatgcaggccgaggaagcattcctaggagtggcgcagcctctttgatcctcctcggcaccggcttgctgtagcttgctcttatcaggaggcaaataccctgtttccttttatgttgggaacctacaagaggctctgatgctagaatcggctccctcattcttgcctgcaggaagcagtgtcctgtatacaggcgtcagcacccacagggggtggacagtggagggccagcctgggcctgcctcgtgtgctcaggcctccttggtggggtgggagtggtgcagaagttctcgtcatttgtcatttgccagagggacgatgggcagcagcagagatgtcccgaggcctgctcaccgcaggccttctacgcagccctctggaaaagggccatccttccagtttggagacttcctctggagaattccatgacacacattcttgaacgtggatgtaatccagtaaggcgtggttcatggcatgtggtgtggaataattcattgttgacagtttgctctaggaatggcgtggcctccctacctcctcccactacatgctagtggccccccagtggtggtgatggttaaaatgtcctcacatttccaaatgtccccagcgcctccattattagtaggcagagaagtcagtcggcacttaaaaaaacaaactaggatgaaaaatccagagagtattctgccagttgccacgtcatattcccataaaaccttcagttatttacccaatgggtgctttacctggttgttacttaagatagatttctgtatgtgttgcaaggaaaggattgcagaaatggacaggaccatttttttcgttccacattgtgactcttcctttcctgttttgaaagattaaaagatagcaccccctagatgggtgagggttgggttaaatagtagtgtgggacagaaaggtccatttgtgagctcgctgcaggcaggtttgatggtcctggtggaatagccttggcggctgctggttttcaaagcctctgacaaagctgtgcatatcacccgtgatgcaccctgaggaaagacgaaaagtcagcctctcccttacgtaggacgcttgtaaacttcccagacgcactgttggtcttaaggattgttctgaccctggacatttgcaggacttgtcaaggtggatctgagcctcctcatgtgctccaggcagagatcaggattcggatgcatcacaactggtggaagatggggactaggcaccctgcacaccctgcacaggtcaggttctgttgtccccgcccccgctgctcctggttatcgtctgtggggggcatggcttggtggcagggacggaggacagagggctgggagtagggcctcttggctgcaacctgcccttctgcccagcacgttgcattgagaatcgccaggtgccattccttccttgcatgccatgctcactgtaccaagacttgtggagttttgccatttgggtttatgggaggttgcattcccctcagcccagccatgagagcgggcagcgtctggcctggggcccgcactttgcagcccctgaagatctcagctttatgcctctgctttgcttccctcagcttgggaagcttcactcgcccctgcccccagaggtgactcagatgtacccactgaccggaggaacttgttgggaggaagtcacaattatgggttagggaaagaaaagtcaaacaaccaacaaaataataatcatgctcgcctgtggattggcctaagggatgtggggccctctgtcgtcctcggttccctacctcagagcttcagatgccagactcaggccggaggctcctagggccccaggacaggcagaacacccacattcatggggtgcagagttgtccccagatggcctggagagacccctgctcagggggtcttggcccttaggtgtctcaggatgaggactctaaataatctatctgggaacctccttagagtagctgactgttttactaaaggtaattttttaaaaatcacgttttgattttaaagtgtctccaggatctctgcagtttactagaacctcttactgcccaattgtcaacagggttattctacaaaagaggcatgtgggttcaaggagaatctgaacatgggattcacacactgaactccaactggttcctccgcctttgtgtgtgtttatatgcgtatgtgtgtatgtaagtgcacgttcctaaattatatgtacacaagtgtatgtgtgtccacatgaacacacacatgtataccgtgcatgcagcatgcacacctacatgtatgtgtctatgtgcatgtaatgtgcatgtgtgtattatgtggtgcaggcttactttggagatactgcagtttggtgccaactggaccattgcaataaaataatattgagataaagtaagttgcacacatcttttagtttcccagtgcatataaaagttgttatactaagctgtagttatattaagtgtgaaaatggcagtatgtctagaaaaacaatgacatgtcaatttaaaaatgcgttattgctaaagaatggtaacaatcatctgagccttcacaagttaaaatctttttgctgatggaaagtcttgcctacaagttcatggctttggacggtcagtagctactgaaggttggggtggctgtggcaattccttaaaataagacgatgataagtttgccacgtcagttgactccttcatgaaagacttctctgtagcatgtgatggtgtttatagcattttatccacggtagaacttttttcaaaattggaattagtcctttcaaaccctttgctgctttattacatttacacaattacatttgtgtaactttctttttttttttttttgagacaaagtcttgctcttgtccctcaggctggagtgtgttggcatgatttcagctcacgcaacctccgcctcctgggttgaagcgattctcctgcctcagcctcccaagtagctgggttacaggcgcctgccaccacacccggctagttttggtatttttagtagagacagggtttaccgtgttggccaggctagtctggaactcctgacctcaggtgatccacccgcctcagcccccaaagtgctgggattacaggcttgagccaccacgcccgaccacatttgtgtaatttttaaatattttgttgttatttcaataatatgtacagcatcttctttatcaagggtagattcattcttttttttttgagacagagtctcgctctgttgccaggctggagtgcagtggcgcatctcggctcactgcaacctctgcctcccgggttcaagcgatcctcctgcctccgcctctgagtagctgggattacaggcgcacactaccatgcccagctaatttttgtatttttagtggacggggtttcaccatgttggccaggatggtctccatctcttgaccttgtgatccaccgcctcagcctcccaaaatgctgggattacaggtgtgaaccaccgtgctcggcccgattcatcttaagaaaccactttctttgcttatgcataagaagcaacttctcatccattaaagatgatcatgcgattgcagcaattcagtcacatcttcaggctccacgtctagttctagtgccttgctgttcccagcacatttgcagctcctttcttcactgaagtcttgaaccctcaagacattcataagggttgaaatcaacttcttccaaactcctgttaatattgacaatttgactcctctcatgaatcacaaatgttcttaaaggcatctggactgttgaatcttttccagattgttttttttttttgagatggagtcttcctctgtcacccagactggagtgcagtggcgcatctcagctcactgcaacctctgcctcctgggttcaagtaattctcctgtctcggcctccgagtagctgggattacaggcacccgccaccatgcctggctaatttttgtatttttagtaagacagggtttcaccatgttggcaggtaggtcttgaactcctgacctcaggtgatctaccgtcttggcctcccaaagtgctgggattacaggtgtgagccactgtacctggcccaaaagtatttcttaaaaagtaagacttgagggccaggcacagtggctcacgcttgtaatcccacactttgggaggccgaggtgggcggatcacctgaggtcaggcgttcgagaccagcctggcaacatggtgaaaccccgtctctactaaaaatacaaaaattagacaggcttggtggcagctcctgtaatcccagctactcgggaggctgaggcaggaaaatcgcttgaacctcgaggtgaggttgcagtgagccggaggctgcagttagccgagattgcaccattgcactccagcctggcaaaaagagccagacttcatctcaaaaaaaaaaaagtaagagttgaaagtcaaaattctccttgatccatgggccatagaatggatgttgtgttagtaggcatgaaaacaacattctttctttgtacatctctgtcagagttgctgcatgaccacctgcattgtcaacaggtagtatattttgaaacgaatctctttttttctgagcagtagtgtctccacagtgagctcaacataagtctcaacagtgagcttaaaatagtcaataaaccatgttgtatgcagaagttctgtatccaggctttactgttctatttatagagcacagggaggatagattttgcataattcttaggactctggaatcttcagaatggtaaatgagcatttgcttcaacttccaggcattagtgccttagcccctcacaagacagttagcctgtgcttcgaagctttgaagcttgacattgattctcctctctggctatgaaagtcctaggtggcatcttctaatagaaggctgattttgttgcattgaaatctgttgtttagtgtagccaccttcatcaatggtcttagctagatcttcgaataacttgcggcagcttctacattagtacttgctgcttcaccttactctgctatgtttggagacggcttgtttacctaaacctcttgagccaacctctgctagcttcaaacttttccctgccgcttcctcaccttgctgagtctgcatagaattgaagagagttagggccttgcttggattaggctttggcttaagggaatgtggtggctggtttgatcttctaatccagaccatcaaactttctttgtaacagcaaaaaggctgttttgctttcttatcattggtgtgtttatggagcagcacttttaatttccttcaagaacttttcatttgcatttgcaccttggctaatgtttggcatgagaggcctggcttttagcctgtctgagcacatgccttccccactaagcgactcatttctagcttttaagagatgtgactcttcctttcacttcaacactactggttataattggcctgatttcagtgttgttgtgtctcagggaatatggaggtccgaggagagggaagagcagtccagagcatcagaacacacagaacgtttatccattgagttcgcagtcttaatggatttggttcatggcaccccaaaacaattacaatagtaacatcaaagagcacagatacaaataaccatgaaagatataataataatgaaaaagtttgaaatatggtgagagcttcaaaatgtgacacagggaccagaagtgagctcatgcttttgggaaaatggcactgacgtgggttgccacaaacctttagtttgttaaaaaaaactgagtatctgcaaagttcaataaagaaagcacaataaaacgaggtctgtctgcctgtgtgtgtcttgttgatttctgcaacggagcagagagtgattttttgttgttatttttcttcttgtttctccaggcaaattgtttctcccttcactcatgtgccaagctctagacggcttcctggcttggcaagattactgttaacgatccctaagcattccttttatttgttaaatccctgttattctgttagaatctatcttgcgccaaaatagcctcaggagaaaaataatgaaaaaaaaagaaatgaattaggtgtgccagagaatgtgatgggcgtggggaggtttatgcagataaatatggtgggtaagaatgccgcccttttcaatgtctgtttaaatgtttccattttccttgtaaaagcactccaacacaagaatgcatttgcagagaggccaaggatcgctcccggtggacacacggttttgtagcctcccttccaccccacccctgccccgctccagctgtgccttagcagacgtcattccctgttatttagtctctgcaagtgcaagaatttagggtgataacagccatacttccattccatgaatttcacacttcttactctctacttatctaacacacatgtgcacagtgtgaaccttggtctgcgacttaactttgcctgtgtggggtgttgtttctctcctgtctgtggacacttactgagtgagattcacaggtgtggaaagagcagggtctgcagtgcgaatgttttcgtagttctcatgtagactgtccaatgacttttcaaagtgctccccaaggcatgaattattccactgggggctccttgcctgtagttttgaaccctgacccagccaaaggctcccctgctcctggtggcttgctggaactctagctccttccctttggcctgaggtggccacacccagggctccagccaatgacgttttgtgccctcacccacctcctccgtggtctccccatttgcttaaggaaacactggagtgagacagaaccatccagtccatggctgtgccccactgggcctccaccttcagacgtgcccagggtctagccacctgcttttgctcagttcccgagtccagcggcaggaagtgacaccaggccagccttctgcccgggagctcaggtgctagagcttgtctgccctctgtgagcagggagcccaccttgcccatttgagaaagaagcaggggcactccgaggagatgcttctgaaggaaccgggtgttttaggaagatcttcctggcgcttcccacaggtctggtgaatctattcacccaggctcccaagaggctgagcccctccttgccctttttctgagtgagctctgttccttggctgggtgcagacttgggagatgtgctcagtcactccacagcaaaattcttctctttggggtggcatgactcctcaggagtggggtaagactgtttaggaatgaccaaacttaggtctgttttgttttgtaactttgttaatatcccatgggcgttttccatataagtaatatggatgtgattattatttttagtgacttcatagtattcgaatcccattctatgttgtaccataaaatgaccagagcccagttgctggctattaaaactgcttccagccttttttttgtgcataattctgtaccctgcccttccacgtagatctttccaggcatggtcattgcctagaacacattccttgaaggagaattgaccattgtgatatgtgtttgaaatgagaacatgagattttgttcgcatgtgccttgcccattgagaccctgctgcaaatgtgtctttgtgctctatctcctggtcctagctgtcttgctgtgggacaactagggacagcatcttgcttactgaggttgggaaggtgaaggtcagagggacagcaagccaaggttaccgccttacaggacgatcctgtggtctggctgctcacccatttgttctacgcgtttatcttttgcaaagggcttgcagttcaccaagccctctccatacatcaaggcttcctgtggacattgctggccatggaccatggggccgtgtttctattcccatttcccttcttccttccttcattaattcagcaacaggcatggaccccttctcgcgtctgggccttggataggtgaagggcagggtgagggtgagggcttccctgtgatgtaagaacttttgtggggccctgaggcctggggccagaagacctgcccgatccaccctgagaaggcctcgcaggggagacctcagtgttgcatttggggaccatgtttagctgagtggggatgggtgggagggatggaagaggggagaggagaccaaggcagggtctggcacccctgtcaagagccaaacgaagtaactaggttgtggggatggggtggggggcggggacgtgggtagagttgatactgcagtgttctggtcagagcatgaaaaacctgaatgggccagtaggcggtctgtgtgccagggcccatcaggagtatcattcattcattcacaaatccttagctgtgttctaggcagggggatccctctgaaccggatggacagatggacagagtttatgccctcttagaggtgagtttttcatacccgatgactgtaagaccaaggtgatggacttttccctagggcctcatgcaggagaggcataaactgagcagggatctgggggagtgagcccgtttgtaaggacagcaagtgccaatgtcctgaggcagcacctggctgaggggttggagagcaggccagagacaggcaggggctagatcacattggtctgtgggctcatgagagaacttttttttttgagatggagtttccctctgttgccgggctggagtgcagtggctgatctcagctcactgcaacctccgcctcctgggttcaagtgattctcctgcctcagcccccgagtagctgggattacaggcacccgccaccacacatggctaagtttttttggtattttagtagagacagggtttcaccatgttggccaggatggtctcaatctcctgacctcgtgcctgcccactttggcctcccaaagtgctgggattacaggtgtgaaccaccgcgcctggcaaaagaactttcatttatttattttttaagggtgtagattctaaaagctggagagggtttgtgctacattgtcatgtcctgattcctgtcttaagaagctccatttggttggcctgtgatgcacagagatggtcagttcagtggtgggtggaccaggatggtgggagtggagaccgggaactgggcctttttggggctttattttgcagggcttgctgacagattggctgtgtgcttaagagaaagagaaggagccccaaggttgagacttgactgtgtggggaagtggtgctattgtgcagaccgagcagcagggaggacatgttggggagaaaactgggagttcttatttgggggttgaagtgagcggtgcttcggggatggcccagtgaaggtgggagcaggtggtgctcggactcagcaggtcaggggagaagaagcttggagtggtcaggaccatcagccggcagacggtggtgggaagggtgacagccggcctgggggtgcattcacagggaggacctgcaggtcgagcccaggcaccctgaaacttagaagtacccaaggggataaaaccctccaaaggaggcaaggcaggaccagtgaggtagggcacggggtcacagcgaccagggaagaaaatgcatcagagatggtgtgttcaaatgcggctgggattggaataaaatgagggacaggtgtcccttatgggtctgacaggctatggctaggtggtgacttatggaaagttgcagtgagatgggttgacatggattctggagcccatgaaccttggggtaaggggcagtgactatagtcagcctttaggaaggcttcctataaggggaacagcagagagacaggccaggtatgggaaggctgggtggcattcaaggagggttgtgttttcaaagatgggatgtgttacagcaggctgtatgccatgggaaagttggcacaggcaagaaaaacgtgaaggttaggagctggagggacggggtggtggtgactcacccctataatcccagcactttgggaggccaaggagggtggatcacctgagtcaggagttcgaggccagcctgaccaacatggtgaaacctcaacactactaaaaatacaaattagccgggtgtggtggtgcatgcctgtagtccgagctacttgggagactgacacagagaaacgtctgcacctgggaggcagaggttgcagtgaactgagatcgcgccactgcacccagcctgggcgacagagtgagactccgtcaggagttggagaatgagagccagggtggcggggacaatgctggagcccgctgtgcatgtgcatctgggtttggcacctggcagcgatgacatgagctggtgaactgcagtggtctccattttcttctgggctgaggtttgttgggagctttagctcctgtgcgtgttgctgcacagagcagctatgcactgatgagaaaggactgtgaggggtggatggcggcgtagacgtggggccatgctgagggctcctggaagtctgtgacttggcttgctgtccctcagaccttcatcttccctacctcatgcagggaagatgcacaattggacctggccatctgatggaactataggattgtccccagtaccttgtgctggtgactacagtggacacctagaggtctgggaggagcagctcccggaaccccattgataaaagtgtctcgtgtccagtgtgtgccgctgccccctgcaatttcagcaatttcagcaatttcagcagagcatgcctccaaatctaatgtccccagggctccactgagtgctggttactccttcacgcccacccacacttgccttccactccccgacacaggccccttatctctcttaattcttagccagttgaagtcaacacaattcttcgctttgccctccgccccactcccaccctttgctctgagcctctgcttacctgttttggtcaaggcccagtctacactggagcccgacacacacgcctccctccctcctcaccctggagggtccaccgcctccttggctttatcttctctctgtccctcctaggctataaactcgggaatgaatgaatggacagatgaaccctgccagtatattgtaaaccatctaatcagaaactcaaagggcagcagataggaggccacagctcagggtttccaaaggcccagcccagggcgtgactgaggggtgtggtagtcaagggggtgaccttaaacctggcgtctgtctttgtcattttagtcattccatccgcagcgcctgttgagcacagcgtgtcttaccaggcgggtgctgagcgcacacactgagagaccgtggtcttggcacacggtagtttatagtatgagtggggtatgccgcaagcccatgtctgttccctgctagcctggtggacagtgatggctgtcactgcagacatgggatgagaagcttcagtggtgaggtgggattgaactgcctttttctttgcttgaataacatttaaaaacttttttttttaaataaggagataagaggattgtgagtactatgctgtaagtatactttagtgatatttaaaaaaattaaagagcaatacatcgaaccttttaggaagctgaaaacagatgtgtagaaattgccacagctcccagcctcagcacctcaccgtcctgggccacctggggaggggttttcctcaggctctattcagtggatgtgcacagggctgggacgcaggaagactgtaaggaaggagctctcctcggtgacggcaggtcctgggagctcagtccagctccggaacagcagtgctgctgtgcgggactgtgtgtgaggccagggggtgccggacgtggacgccacgtgagacaagtggctcagtaagatggttaaggtctgagcctcagcgcctcattagaagcttttgaggtcggttgcaattgatcatccgctttagcagatgaagaaactgtggcccagaataattaataataaaccccaggcagtgagtagaggagtggggtcggggtccgccgcagctctctggaccacctcagtcaggcctcctgggggaggctccaggctacaggagagcagggcacctgcctctatccccaatctcatggctctctgtgcttcttaacccaactacaaatcagagctcctgggaagactggaagaaatatcactgcctagggttcccccaagactgtggagtcccctgactgtggtgtagtggtaggggtggagtttgtgtgatgtcggtatgtttttaaccagctcctgcaggggattgaggagcagtgttggctgagaactgctcaggctgcccccaggtgggatcccctagggctcattacccacagttccagatgtggtccagtggtcattttctgatctaagtcaggcaatttggggcattttcggtcaggaagaaactggggaggtgtgaaaggacgggggtcgattaggaggtttccgaaaggacagtggtaactgagatggctatctgtgggtgacccgcctcccatgccccagccttcccatgggagccccccaagggaggggagaccaggctgggtcctcttgtgtcagcaccctgtttaaggatctggtgcaggttttgaagctgagcaggttgttaaactcctagagccttgggcgccttgtccacatcaaacagtaacagagatttctatgggagggggtgtagaaagccctcccctttcgtgaccagtggcatgcactaccatctagctcttcctcgtgttctagaagagaccagtctggccaatatggtgaaaccctgtctctactaaaaatacaaaattagctgggcatggtggtgcatgcctgtagtctcagctacttgggaggctgaggcggagaatcgcttgaacctgggaggtggacgttgcagtgagccgagattgtgccacactgactccaggcgacagagcgagactccgtctcaaaaaaaaaaaaaaaaaaatgccctcttagcatctcaatgtattatcacggaagagtttaaaaggccaggcacaacaccaacaactgttcctttttctttacccccctggaggaagtgaacatacctctctccgtttttagtgttcgggtgctcaaagtggcagagtaagtcctaacatcgtggatctccaggcttttcgtacaacaactctgcagggttcttctgcttggagtcaacttgatggtgaagaaatgcttggcaagggtggaaaagtaaatcatgatgtcctcagcacagggcacctattaactagacagtttccttgttctcattttcggttagaataggtggggcagctcatttgacaggaggaaactggcttttggaagtgctgggatgcctactgatccgtgcctgggtcctgggacacccattggtagcgtaggtctgtaagctggacctggggacttgggcttgtggttatttagctctgcgacctcggcagttctggaagctatcacagttggaggctggaagtccaagatcaaggctctggcagttgtctggtgagggctggctcctggttcatccaaggcaccttctatctgtgtcctcccaggcagaatgggtgaagggtcttgtggggtccctttcttaaaggcattaaccccattcatcagagtctcccctcatgacctaagcacctcccaaaggcctcacctcctaatatcgtcactcgtgggtgaggatttcaacatatggattttggaggcacacagagagcccgtagctgtggggtccgttttaccatgagaaaggtgtgctccgtgcttgtgagaggtggagacaggtggcccttgtttatcttttgggctgggcacccccacccccgacccatggataggtgaaggaagaagatgctcctcttggcaccagcctctgactcttcctgctcctctgaagggagggaaggggcgagatcctaccagggacttagctggagggggctggggagagccaccttaatttaaactttcttttgctctcctgtgcacagtctgtaatgaaacagctctgttttgagcagagagagggaagaagcacccactggaggggaattttgtaaggaaagcattttttatttacttccaaagtcagggggaaggaactctgtgacgagtcagagcagagggaaacaaatgctggttccccagggcgggcaaaaacaccatgcaaaggatgtcagaagtcaccatctgtttgtcagagaagccctgaagtgtggcagtcgcagaatgacatttcattgacagcctgcacaccccagggactcccatgggtggggacaggctgcgtgcccgggaactttgtagccaatggagacgtttggttaacctggtggaataaatacactctcctctgtggccagtggactctcattcatacgttatctactgagtgtctgtgtgattttcatgagaaacagtgttgtgtaaaggacaagcagtactgctttcaagtcctgcttccacccgagtgggtaactccagctttggaccatctgagggtcaggcacttcacaaatggcatctttgatcattaataccactctgggagttggctccttgtctcctaggatgtcgctgggtcactaagagcctgggcgaaagccccctcacccagggactggaagtcagctccccacctctccagtctttcaggtgccccatgcacatatctgagcccctgggacttgacgtaccgaaagtcctctgctggtcttccccctccagcatggcctggggaacaggtgtgaagatgtttgctggataggtgagatgcaagtgtgcctgaacattcctgaatgtcccagagggtgagtgccctgggaggcacactgttacactgtcccttctgatttcggatggagcacaagctggctgcacagggaaagagacaaaagggaggattttccaaagtctgtgtttggacagggcccaggtacaagacctgcccctagagacagtgtctgggctcctgctgcccagtgaccagtgttcccacctttggacaaggagagagggccaggctcatttctgcagatgagagctggcaacaacttgctgatgtcagaaattccttaaactgaaggagtctttttcaatatcagaggcaaagtgcctttttttttttttttttgacagtcttgcatgttccccgtggttggagtgcaatggcgtgatctcggctcactgcaacctctgcctcctgattcacatgattctcctgcctcagcctcccaagtagctgggattacaggcgcccaccacacacctggctaattttttgtatctttagtagagacgggttttcactatgttggccagatcgttttgaactcctgacctcgtgatctgccctcctcagcctcccaaagtgttgggattcaggttgagccaccgtgctcggccgtaaagtgcttttaaatgtgctttaggtggcacatgaaactccctcacactcggacaccctcaagccatggagcagtgggactggccatgtcagtttcgtgtcgacgggcatgtagtgggtagaggagagctaggagtcatctgcccagagtactggtggccccaatttcagagcactgaggctaggaatcgggaatcagggctggatcctgcaggacagtggctctgtgagcacacgtcagagggactaaggatttggactctccacccccacttgggttgtctggccaaggtgtggtgaggatttggtttagatgatgcctctctgcaaaacacccagtggtaatgcatattctcatctctgaatcacaggtggcgctgaccatggctgtcccatccaaggtcatggtcaccttgaccccttgattaggtggagactgaagctttcctgttgttgacttactcttttcccttttatagtaaataaaggaaagtatttagagactagtattctctctaaagatcaaccagtgacagcctattagattctgtctctccactgcacaaactcccgagtctcccatcccacgacgcatggaagctgagacctttacgcttcctaatacctgctcccaggactcccattgcctctctgagactgtctctgtggtcatttgctttttttttttgagatggagtctcgctctgttgcccacactggagtgcagtggcacaatttcggccactgcaagctccgtctctcaggatcatgccattcttctgcctcagcctcccgggtagcgggactacaggtgcctgccaccatgcccagctaatttttttgtatttttagtagagacaggtttcaccgtgttagccaggatggtctccatctcctgaccttgtgatccgctcgcctcgcctcacaaagtgctgggattacaggcgtgagtcactgcgcccggcctcggtcatttgctctatcagtagggactcaaagagtcttggatttgtattgtattcaatgggtcataatccatattatcactattttgatctccaagttgtttacagtttgcctggtgggagcctcttcagctggcccctgtgtctttttgttaaaaaacccattgttctgtgagcactgtcttacttttggccaaaaagaagagatttcaggctcattggggggtgactgttggtattggagcctcccaccctccaaggacagatctgggagtatctctgtgtgtgtgtgcatgtgtgtgtgtgcatggttcgtatacacacattcacatctactttgatttctagatgtatctacgtctctagatggaaactctgagtcacaccaatatctgattcctgtctcccaacacagggcttactatatgtcccccattctagactagcaagctcctcccgaaggtgcctcccatttttcttctcacgatccttatgctcaatcatcctgtgcatgaccaatctcccgtcacctctccactgctatgccgtcctctcccctgtacatttatctgtgtttctagggctgttgcccgaggctgaggtctcttacctagagtttccatgtccactcctgctttctcccgagtgtcctcccaggactgcaggggtcctccaggatgaacatacacctgtgatgctttttcctttttgccagttagagcccctgtgacgttggagtccagcccagctcggtactggggcctccttccttgtgactgcttgtgcaatcctgctcaccaccctgtacttgcttcttgagccctgtctaccctcagtgtccaacacagctgtgcattagccacccagcctttggccagttcaccaaaaatacggcgcttaccacccttgcctctcctcacctcttttcctgtctggaaagtgtctgcttctgcttcagtcacaggccattcatggagttcttcccatgatctgtggactccgtgccccctcctaacctgcgtgtagatcgtccctctgggaggggcggggtgagccagccgctgtatttcctctgcatcgagcacacacgttgctcacgtatctgtgggtgaatgcatgatcgtgtgagggaatgactcataggagcagcctccagtttccagtgacaaaacgggcacgagtggcccctcagcctcccccagggaaccttgtacttggtgttaaagtctgactcatggaggggctcatgtcctagttccagctgggtttccaacccaggttgagatgtagcctctcttcctgatggctggttgctgatgtctgccttagccgtctggaattcatcctccctgggaagaacctcattttgtcctgggaagaacctcattttgttcctgggaagaaccttgttttgttcctgggaagaacccattttgttcctgggaagaacctcgttttgttcctgggaagaaccttgttttgttcctggaaccaagtgcagtcagaagctagggtgagacaacctggcgagtaaaaagcacagaggatgtggcaaagcacgaagaaaattggaagctgggcagcagcacagagctcactgtggcttaagatggagtgaggccagtctgccacccaagttttgaggtgagggtctgtgcctggagggtctgtgccctggcttctgagtcccttcgcatccccagaccctcagctacagcttactttgggaggactcagaagggtgtggtctgagacaggcagtgaacaccggtgttgatgtggtgaaatacagcaaaggagaatgttttcattcctgcaccagtgtttattgctcctgcttgggctgtgtgtggaaaatcccagacaaggttaggacttcctattggaggtacaagacttataccacactagagggtcagggccccaaccatccttgagtggctcagccatggaggatgataaccagtctgggaggtcagatggggggcggatcttcaactgagcccaggacagcggtttcagccagaaaggagaatgggaaactgccttgggagaagccccaagtgagcccaagggcgagagcagaaggaccctggagtgtaagagcctagattgcaagactggcaggaggaggtcaagtcgggggcagggagaggggctggagaggcggcctgctgatgaatgcggattcgccttcgattgagcactgtttcctgccagtgaaaaatcagtttgttgtcctcactggggaggttatcacacgcacgatatttgttactagtaacgaagtgtgggagttttctgaatggctactttttaaataagtaagagcagattcagggtatccctgcaataaaaagccaccttcaaccattgccttccactctggcttgcataggcagtgggctggcctgtgctcctggccgttgttctgggtggaccccagagagtgtgaatcctggtactcaggttggaggagttttatcctgctggggctatctgttcattgctgaattcagatttctttggccggttcctgtgggcaccatgtaagggcggtggtagatccagctgacctctgggcgtgtttgccctgggtaaaccatgacgcagcatatcctgttcttagctgtttgtaggcactgctatgtacctggtattgtgtcagtgtgaagcaatctggaatgaatacgatacagatgtgttctcagggaaaaatgtttgaaagactaaagtttggatatgctataggaaaaaaatgatgaatgtatacagaaaaatgaatgaggaatgaatatagaaaaaggtgaataatggtgtcatttgaaggacagggggaaatgagatgcctgcttgtctgccaggtgatgatttagtgaggaattggaacccagaatggtgtgtctaggaggaggttttttcctttgtagttaaaagttgaagagcagctttgctcttctactcagaaacagaaagatggatatttagtgccagaacttgagaggttaacgtcagccagttgattgatggctggaatttgcacatatgtcagccataaaggccacgacttagcccacccagctgctccccacatccaaggcatgtggagttgcaagtggagctgtagatctgaagttagatgttggagccataaaggctgagctctgggacactgctcctaggctgggcctggagtgaagccagtggtaggagtacagggttagctggcctgagactagaaggccccctatcctgctcgaggcaggggtctcttccgctgcccaccgtagaccacaggcagtggcttcatcttgaactgttcttttagttttagacttgccacaaagcttcttgcagacagccaagatccactgcccgggaaggctggtgaagtccgacaggcattgaaaggagggatctgcctgtggatcttgccgcctctcctcctggcgtttctaagtgaccctttcttcaggatcctggcttgtccatctctcccatcaccctgtcatcttcacctcctgaacttcgggtttctaatttccttctaaaacgcagacccataaaggaagacgggacttcagatgtgctgtgaattgtcctgatttgccagagcaggatggcggggggtggggggggtgcggtgagggagggataggctgggagataggaggtgcagcccagcccccaggtgtgcaaggccccgggcggtcctgtgctttgatatttgttgaaatccttacctggttaggcgtgtccctctctgcaaggccaggctcctagttttttgtagaagaagcaaattagaaaaaaagcctttctgcctcggtgtttacctgctttccactcaaatgccctgtttgctagtgtagattatcagggtagtgtagattactgctcattacagtgcagagttgactggataatattcaagatttagaaattccgaaagccagagcttgcccgttttgattcttttaagcacctcgccagcgttctcggagaggtttgaaatcctagtaaagtgaaccctgcgccaagcgcggcgcgtcggtaattccaatcagatggcggctgcaagatctgctccccccgcctggaaggcgtttcctcacccactttcccagtgtttggcggctcagctgtgcctccgcgctcgctcggagctgcggttggggcgggcgggggagggagggctaattgtgtcagatggagggacgccgtgcgggaccgtgcgctcgcgcctggcttttgttcccgggtctgacttctgacgggcaggagtggccgtggaggctgcggcgcgcggctgggacctggccggcggccacggagagcccttggcccctcccgtgttggccatttcctgggacttgtgtcgcaggggactcgggaggcatcctccccccagatagccgctggggaggggtcagcggccccctcgcccggccgagcccggctccccgcgggcggcaggggcagccatgaggctgcgcgcctgacccctgggccaccgggagggttcgcgcgcggaacccggtcgcgccggcgccggcccaggtgagtgcggcccggagctggtgtgcatggccaggggcgcgaggcacgggcgcctcagggctgcacgcacgtgggctgcgccgggtgtgcactggtgcccgtggacgctgtgctgtgtgtacccgcttgtgctcatgtgtatgcgtgtgcccttgtcagtgcgcgtatgtcaggtgtgtgcaccccgtctgcacgtccacgcgtgtgtgcttgtgagcgcgcgtctgtgtgtcaggcatgtgtacgctggtccgtgcctgagtcctcgtgggtgcgtgtgtacccttgtgttgcacgcgcaggacaaggagcgagagggccagtggagctttgcctagtgggggcgtctttggtaagcgtggaagagggttcaggcttagctctttctaactcaactgcctcttgaaaagcttcttgggttcatttccctgcaatggaattgggatactggccattgcgcagacctgcatccctcgcgtgtttcttgcaaaggtaaagggcattttagctctgcaatgaagtgggggtgcgctgggatgtaggaatccttacaggttccctggggaccgcatgggttccagcggtgtctgtggtccacaggacggcctttcacggtgtttgaattaaacagagcggtgctggttgcaccccgctaggttcagcctccctttccctaagttattgctgaattaaacagagcggtgtggttggctccccgctaggttcagcctccctttccctaagttattgcatttgtttttctaagcttttgtaaggttctgtggggtgaaaaactgtcaaaatttcagctggttaacttgagtgtactgcgttcccttttaaagtttagtggtcaaacgctgctgcctggaagtgtgggacaatatgtgttggatgtggagggtgtccctcttgccccagataccggccccctgtgggcgggaaatatccccgaggcccggaagtgttcctggctgtttaacatcagagtaaagttggctgggaatgtgtttttgatcagtgtctgcctctccagaatgcctctgaaggtttcccagtgcctgaatgcctacctaaatcctcttactatggtggagctgaatatttcctgaaaggaaacatagctgggattgtgctgatgcagctttgcacttttgcgtgtgtaaccattttgccgggcgacctttagccgggagaacctatccgagagatccctgcggttttgcatttcggcaagtggagcattcatgtggagcacctccctgttcaattttgcagagatttttctttctcaaagagacctcacaatcaagaccagcactaattactgtgtccccctcagggagtccttgtgaaccagcagcctgctctctacccttccaacattttgttcctaacaattaagtgcaattagattcctgaactgagcctgctaaatgcttcagcattgctgcctcctctccccctttggagaaatgaaagcacagtatcaggtgaaaacaagggcagtctaatcccgtctggtctcattcacaatagagatgttatgtacagatgaagcgtgagcagatgttattacactatcctaatgaactcctcagagatccagcaattcaaatggctgagccctcgcaacagtgcttatgcttttccctctttaagttttctagctgtggaccagtgggcaagaaagctgcaggaaaacaggcctctttctccctggttggaataaaggtatttgtgaggaatgaaaggtcacagtatcttccttggcccacagactgtggctaattcatttggtcaacaaatattaattgagggtccaggtccactgtctgccaggcgctgggcagggccctaagaggacaaaggggaaagagcctgtgtcctgcatctaggaaattgcaatatagcacaggagagaaggcatataaacaaataacgcaatacgagtgaaaagtacgtaccagctgctgcattgcaatagagagatgtgtttgttggtgtttgaatgctactcttgtctgagcgtgagactggggcttgaggcatatgaggcctagtctcatatgcctcatccattggctgtgtggtgctgcatctcggttttgcatctcacctcacggtttgtagactagtggtgattacggtaatgacacagaagcacttagctagtgttccaactgcataattagcagcatcattatccttcttttgcagagcactgaacacacaaccgtgttatcagaaaggatgcaatctctttgaaaaaaccagataccgacataggaacaactcataataacagtaccttaaatgtatatagatacttacagtatagtcggttatatacagtgtggttctgtcttggccgcaaattagaatcacgggatggagctggggtggggggtttgaaacattccagtgttctgattcaacctccaggtaatctgatttaattggtctggggtggacctgggtcagctgttttaaaaactgccccagtgattcctatgaactgacagatgatacacgtttggtcatttacaatagctgttaagagacaggagggggaggatatcttttctatttagagaggttgtgacttgtcctgggccacagagcttgtagtgtaggtatcagaacttatggaaggcttctgcttggttcaggactctttcccctactttatttattttttcttttttttagatggagtctcactctgtcaacccaggctggagtgccgtgccatgatctcggcctactcagcctctgactcctgggttcaagggattctcctccctcagcctcctgagtagctgggatacgggtgcccgccaccacgcccagctaatttttatatttttagtagagacggggtttcccatgttggccaggctggtcttgaactcctgagctcaggtgatcaacccgcctcggcgtccaaaatgctgggattacaggcatgagccaccgcgcttggccatgaagttctttattagtgattgtattagtccattttcatgctgctgatgaagacatacccaagactgggcaattttacaggaaaaaggatttaatggactcacagttccacgtgctggggaggcctcacaatcattcgaaaggtgaaaggcacatctcacatggcagcaggcaaagagagagagcttgtgcagggaactcccccttataaaaccatcagatctcatgataattattcattatcacgagaacacacaggaaagacctgccgccatgattcagttacctcccactgggtccctctcacaacactgggaattcaagatgagatttgggcggggacacagtcaagccatatcagtgattaaatgttaggactgttaggtgttcttgatgaatcaatccttttattattatgagaggactttcttatccttggtaatgttctttgatctgtagcctactttgtctgatatagccactccaactccctttgattaacatcagcaaggtacctcttttttctagcctttgtctttaaaaaaaaaaaaaagggccaggtgcggtggctcacacctgtaatcccagcgctttgggaggccaaggcgatggatcacgaggtcaggagttcgagaccagcctgaccaacatggtgaaaccctgtcttactaaaaatacaaaaattagccaggcatggtggcgggtgcctgtaatcccagctacttagaggctgaggcagagaattgcttgaactcgggaggcagaagttgcagtgagccaagatgcgccactgtactccagtgtgggcgacagagcgagactctgtctcaaaaaaaaaaaaaaaaaatatatatatatatatatatatatatatataaaatctgacaacttttgttgacttaaattgagatacttagactatttacataaatatgattattaatatggcaaggtttgaatcgtcatactgctacttgttttctatttctcctacctattgtttgttctgcctttgttttattccttttgccatttagattaattgaataatttttattatttcattttatctctcttgttgcttattacctataattcatgattttagtggttgctctagggtttatactatacctcttaacatcacaggctaccttcaagtgatattatatccacttcatgaatactatgagagcctataatagtcttatgggatctttggggtgtccaatttctggctggaaacctctgtggccgtggcacctttgcctgagttcttgtcctgtgtccaggaagaatgagataggcagacgggaagggtgaagaagatgaagataagctttattaagtgttaaacagctcagaggagacccaagtgtcctctctgtaggcaggtcatcccgacctctgctgctctcagcagagaggaggcctggagagggtagttcctctctgcagctggaagtcccaacatctctgcaggtctctgaagtctcggcagagagggtagctcctctgtgcagctggtctcttgtggtctctccattctcttgtcctctctcttgctctggctgaacatggaaaagcccttggaggggaggaagtgcctgtgattggtccatgggcggccatgggctggctggaagaggcaccatgagtccccactccatctgtgggactggcagcccgtccccagcctacaggccctccctggcctgaaggtggggcttactgaggacccacccccttctgcccaggactttgcctaccgctgccattcaaggcccggtacttgtccccaatcccgctctgagatgagaggtggggggccgggagaggagacaggcaggcagccagaatagacactcctgagccagcagggatggtgggcgggggggggcttccatgcgcccgagggtgcaggccgcagagatgcctgggtgctgtgcctgggagggtggctgagctgcctgcactcagggagctcctgcttttccccagctcccgcctgtgtggtggagtggaggcccaggtctgcagccgtggatggtggctgcagctgcaccccggtgggcagatcctcctgctcctggccccactcaagagcgcagggaggcttggatctacagctgcagtttgggagctgcagtggcacccagggagttcccaccccaactcagaaggggtggagctcccaccgctccatggagagtgcagccccagcctcacctccctgctgcagccagcgtgatggtagcaccgctgtcatcaatagtatatttccttttcttctttcctgaactttgtgctattttttcgaaaatttacttttacatatgtcacatgtcacattacactattgtttaaacagttaatttcttttggtgagctttaaataataagaaaaactcataaatttacctgtgtaattagcattctggtgctcttcatctgttggtgtaaagccataattccatctgccatgtcctttttgccaagcactgtctttaatatgtcataggtgtcagctggtgatgattttttttgggctttattgtatatctttttttgcatattttaagaagtttttggttcacttttattttgaagagcatttttattgggtacaggattctagattgacaagttttctttcagtattttgttttatttattttgtttatttttttaacttttagattcagggtacatgtgcaggtttattatatagtaaattgtgtgttgtgggggtttggtgtacagattatttcctcctccaggtaataagcgagtactcgataggtagtttttcaatcttcaccctccttccaccctccaccctcaagtagccctggtgtctgttcccttctttgtgtccatctttcagtatttcctattatactgctgtttctcacttatattttttaaaacaatgagaaacctgttatcctattggttggttccctgatgtaatgtgtcttttggccccgtggttgtttttaagatctttctctttgttactgggttaagcaatttgattattgtatgccttggggtagttcctgtcacatttcttgtgctagaatatatatatatatatatattttttttttttttttgagatggagtttcactcttgttgccaggctggagtgcaatggcgcgatctcggctcactgcaacctccacctcctgggttcaaggatttcctgccttagcctcccgagtagctgggattacaggcaccaccaccatgcccggcaattttttgtatttttagtagacacggggtttcaccgtgttggccaggctggtctggaatcctgacctcaggtgatccacccgcctctgcctcccaaagtgctcggattacaggtgtggccaccgagcctggccaagaaatttcttgagtttcttggatctgtgggtttatagttttctcctggtttgaaaaagtttcagccattattttttcaaatatccccccttccctgccctctccgtcagtctccattacacatatgttatgttggttaaagttctcccacagcttactgtgcttgtttatttgtttatttaggttgtctcatctctgtgtgctttgcgttgggaggttgtactgtgatgtcttcaagttcattcacctgtgcttctgcaggatctaatctgccagtatcgcatccagtgtatcttgcactgtattcttacattttcctcaatgaatgtttgatttgatctttttatgtttttcagatctctacttaactttctagcatatagaatagttattatgtggacatttgggttatataaagctgttatgacctttctttctcttgtggacataggctttatttctctttagtgtaaataagaatggaattgctgagtcataggttaggtgtatgtttagtttataagaaattgtcaaaccattttctaaagtagttgtaccatttattccacattcaaataccatttcatcttttcaaataaatttaattattccagtgggtgagtaatggcctcctgaatccatatggatattaagtactgatagaatacacggtcacatatcagcaaatagaatgattagtgcttgactctaaaagcaaattgaattcttataaggttatcatatagctgaagccttggctctacaaacatgaataggtagctgagtggttagtttttccaagtgctaatcttgtaattgtgtttgaggaagaaccacatgtgtatcacaggctggactgtctcttctttgcaggagagctcagagaggctcaagagcttaatggtgattctggaacacctttgaaccggaaagccagttgacttcctcataacataattatgctgtttagctaattactttttccaaagaaaaagggttgagagtctagaagtgtatgtggattactttgtcacagaagtaggtgctctacggctgaagtctggaagggagtgcattttcacataatgatgttggttgatgtaagtttctaggcaccccatgtggtgattgatgagttgggtgagagtgaacgtccgtctaggctctggaattgggaatgctaacatggtatccgtgggtcgtcttgggaattttagcatcacaagatggtttcttgttctctgtttgcttggtaaaattcctgtttttgctctttacaatccactagatttattatttcccttaaatgaaaaggaaaaagaaacaaactatgagatgaacgttgacaatttcttcctttactttttcagccggaagaattaacctcgagtctgcacgctttaagaacaaggcctttaaaaaatccaaagtgtgtggagtttgcaaacaaattattgaggtcaaggtatttcatgccgaggtaagtctgtgtttatgattctctcactgattaatccgagcaaaacaaacaagaaacaaaacgaaaactttttttcaggagtttccgaaagttaaacatggaattccccttcttagtttatatgtcccccaaccccctacccccttacttagcagggccaaccgtatttacatagataagtgctcatgaggacatttttacagaaagagcagagttcccgatgggagaggaggcagcaatttgtaaattaatcatttattctcaggtctgctcgaagtgtcagtaactcaggttgtttagtttgactttcagatctgttactcaagtttgcgatgaaatgtttctatctttagatttcgggttcattttggtatggcccctttcagatccttcactaaactaagccaccagcttgggtaccagatatttagacgtcaagtaatgaatggacttgccaattcttttgtgactgcacattaataaatctagtaagagaggtgtgactgtaagaatgtgggagtggtggggggcaggggctgcttggcggaccagtggggtacaccacacaagggagtcactaggaggaccaggtccttggagagtgcgggggctgctctttggcatcattcatctgcggggttggggatttcctctagaaaatgtgcagagtctcagcctgtgggctttgtgctgttaggacctccccctcagtgcctccttccctgcagacccccagcagatggtcctgatggccactttagagtagggtgcctgtgatggaacgatgcacgcagtcaaaccttatgggttgaggatgtgaccaggggcctctaaggggctcttgggattcttttacagttcaaggcctgagtgtgggtgagaagactggggtgcccctcctctgattcggccccttggagaatcagtgctgaagaatgtgttggatgagtggtgggtaccggccaccctggtcgctaagtaaagccagagaccagggagccacctgtgtaattcatctagatctgcatccaaggcagagacacgggctgtagtgtactctgagccaactgataggacatcctgtgattcaaaactttttttttttttttggagacagggtctcgctctgtcatccaggtaggagtgcagtgggatgatagggctcactgcagccttgacctcctggcccaagccatcctcccacctcagccactccatagctggactataggcatgcgccacatgcctagctaattttcttacttttttagagacatctcattatgttgtccaggctgctcttaaactcttggcctcaagtgattctcctgccttgcctcccaaagtgctgggattacaggtttgagccattgttttaagcccgtacttgcaaaggcactgcactaggtgatatcttggtcatctgtgaatgctgtggcctgtcactggccatcccctgcatagcttgtccagttcaggagggccatgtcagccaaatgtggtggccctttggtttggggcctgcaggtgtaaggtgatgagaaattgcactgatgctctcggacaggcgtctccatcaagcttgctctaaaatgtctgtgggcaaatacagcagcccctctgtgtcccaataccctacagggtccagtaggggctttgtgcctttccaggaacatggcaaaaatagaacccaaggagtctccccatctttgaatgtcattctcatagaaatgctcatattttatttttttatttattaatttatttttgagatagagtcttgctctgtcacccaggctgcagtgcatggcgcgatctcggctcactgcaagctctgcctcccaggttcacgccattctcctgcctagcctccccagcagctgggactacaggcgcccgccaccatgcccggctaatttttttttttgtatttttaatagagatggggtttcaccatgttagccaggatggtctccatctcctgacttgtgatccgcctgcctcggcctcccaaagtgctgggattacaggcgtgagccaccagcccggccagaaatgctcatattttaaaattttggtctctaactttgactcccaagtgtaaaagaaggaaaaggaaagtcgtggttgaattggaaccatgaaaccagcagcacagagacctgggaatcagagctgtcagggcctggtgttgatccgagagccctggtcctgtgccagggagccattgggcgatactgggagagctgtcatgagcagcatggcatcagcagggacactgggcttgttctcggcttcctcaccctgtgatgacgtcccgggcaaagttgcacagccgaggttccccatgaactgacttctgcctgtcagatgctatgtggggacaggtctgatttagagcaaaggtggaggtcagacagagctgggtcctggcccagcccctgacaggggcaaagctcctcactctgggtctaggacttagggtaagggctgttccaagggcagaagtcaggctaaagtgcacagccagcgttgtggtacttaggtttgttgctggtgttaggattgctctgagggaacccactgtgggtagctccacatggctgatgccgcatgtgtgtttggttagcctcgcaccacacatccttgagctgtaatccagtgggggagctccttagacacagaggcctttgcacaacttaccacagtggcttgggctgcactaggttggttatactgcttgaggagtaattttccttctttgtataaaagagaactgagtttactgaagagtcatctcagacatccttttaatacttcagtattctgttcctgccatttaagtagtattgactattttcagagtaaaggaaccaacgaaagagaagagcttggagaaagcacggcctccagctgtgaaacgcgcaacacgtcttggacggcggggagcctgtcttctttctttatctggaggatcattgtcttgggccttccctgggttgggacttgtgtctcttcctctgtcctgcagttgcacacactcagagggccagggaaggaccccagattgatcctctgattccaaatgaactctgttttgtggtatttaaatatgtggcgtgtgaaatattacggaggggtgaggaggcctgccagagtggtgttatgtgcctgagtgtgtgggtgcacatatgcatggctatgtgtgcagtgcatgcatgcagattgagttcatgcatatgaggacaagcagtgcacacacctgtgattgcatgtgtgtgctgcgtgcatgcgtctgagtgaatgcatttgcttgagcgcacagatattccacattgtgaggaacatgtgagagcatccctcctgttcagaccactttgtagagttcagctgctctatgcgtccattatcttatcttgagggagatagaaacagagaaaatgtgcatgcacacaggagagcttttgttcttgaaagagaagagagggaataaatagtgccctatctggacaagatgtcaacaggcttatcttgctgtgtgtcacctggttgttaaggaagatgcagtaaggcatgcgtctccagataatggtttaaatttcacacgcttctggcaacatccaggcactcacgagacaaagcccagtgtggtggccccgtggcccatctactggtttctgttggtaatgatgcttcccgcctcctcttggaactctctggagttctgcttcggtgggaggcagcgagacacctaagcgtcacctccgaggattcaaggcccactttggcctggaggaccccacacgtacccaaatggacaagcaacggggctgccagctctgtcctcgtgcagcattatctcctgtcctgttggctaatgctcctctactccagggaacccagtgtagcactggtttttctcactggtgaatagatttttggtcagtggaggtaacaagggaaaaaacagccatgtaccttttttcatccttgaagaaaatcactcatggacagctatgatgttaggtgacttcacccctctcctcacgctggtttatccctttcttctttacctcctcctcccctacagcttactttccaccgcaggatgcatggctgctcccattgccttttttttttttttttttttttttttttgagacggagctcgctctgtcgcccaggccggactgcggactgcagtggcgcgatctcggctcactgcagttccgcctcccgggttcacgccattctcctgcctcagcctcccgagtagctgggactaaggcgcccgccaccgcgcccggctaattttttgtatttttagtagagacggggtttcacttgttagccaggatggtctcgatctcctgacctcatgatccacccgcctcggcctcccaagtgctgggattacaggcgtgagccaccgcgcccggcctcccattgccttttttaagctgttcctttccaggggcagccaggatgcaggcattatggacacacaggcacctgctcctgtgtgtccctgttcgtggctctgggcgcctcagctaggatgggatgtcttgtctagaggcgtagaaagagatcaggatgtggggtcaagttctggctgtgccactcacaccctgggcagtttggacagtaggcttttatgaagcccattttctcaaccctaaaatgggcatgaaaatgagatccagtggtgcagagctgggactcagggaggggtgtacgtgaaagggcctggtctgcaggccagtgaggcaggacgggaccaccgcctccccaggggacggctgcttcgtgctggaggcagtgctgcactgcaccctggatgtgccgcctctcagagggcgctggttcagcttcccccaaagagttgccctgagcttgctggctgtgaatcctgggggtggtgtggtgagttggttcacctttccagcctgggtgcctgcagtgcatgcatgtgtgttcttgtgtgtctgtgctgaattcctccctcactccttgctctcctcttagcagtcccatatggtgaagctcttcgccttgagccctctggcctggtgggcttcagtagggtctgtccccatggtccctgggtctttctttgtggtgggtggtggcaagcacacagctgctttttgcagagagaactggcagagctgaggatgtggtaggcttgggaagctgcatgtcctgttgagttcatggcaggaggtcattatcaggagaaggaaccaggaactggcccagatgaaggaaaacctttgccttctggagaaggagggccaccgcccttcagggagcacttgcaggctccatccccgaggagggaccccactcaaggcacttggtggaggcattgggaggaaacagcagccatgggcaccgttggagcagaggcattctgactcaagggacgggcccacctctggtttctggcgctgttgactttacatgtggtgagtgttgtgcccttgggcatatgtgcactgagatcttgaggacttctgttgagaagtgtctgtcttcttctttctgtggcatagttttttggaactgcctcacgtgtgcctgtgttatggtcagaatgtttgtgtctccccaaaattcttatgttgacattctaacccccatgggatggtggcattaggagatggggccttggggaggtgatatgttttgtgagtgggcctcatgggtgggattagggcccttatgaaagggaccctagaaagctccctcacaccttggctatgtgaggatgcagtaaggaggcaccatctatgaaccaggaagtgggtcttcccagacaccacatctgtggtgccttgaccttggacttgcagcctccagagctgtgagaaatagcaactgtttataagccacctagtttagggtaatttttaaacagtagcccaaactggagagacatcatgtttttatgcacatagctctaggaattatgttaataaacaatagaaacttttttttttttgagatggagtctcgctctgtcacccaggctggagtgcattggcgcgattcagctcacagcaagctctgcctcccaggttcacgccattctcccgcctcagcctcccggtagctgggactacaggcgcccgccaccacacccggctaattttttgtatttttagtagaacggggtttcaccatgttagccaggatggtctcgatctcctgacctcatgatccgcctctttggcctctcaaagtgctgggattacaggcgtgagccaccgtgcccggcctagaaacctttataaaaaacatacaggattccatgtttcagaagtcttttagacatgattgttttcttagctttttcagttatgttaagttaatgtgtgtgctagagaccaggaggtgttcagggtgctcccaagcctgaggtgccatggtctgttgaggccaaggggccctgtggacaggagggtcatggtgtaggctgaggcggctgagataagcccccatcatcagagcaggagtactgggggtcggaagttacgtggaggctgtgaggctggcctgggggtgtgggtgggatggactacagtgcagaggcttgcggctcagaggtgggcagatctgaaatgccttagggagacacacagggaatgtcacccgtcgagagccctaggcctgcaaaggctgctgatgcacagaggcttagttttctaacttaatgcaagcaacaaatctatgatcctgcttgcctgtgagaaggcggggatatggtgtccccacttttggggggcgggcatcccatccctgctgatacctgggaccagatccactgaatgggagagcccctggccaggctttggcccccagccctgcctgctgctcacccttgctggccttcttcctggaggctgggccccggtctccatcgccgtgcagacctccattcctccttcctaacccagcttccctgggtctggccctttgtctgcccaggctgggtgcccttgagatccagtctcctgtttgcctctccgctcctctcctgtttgtactcagagacggctctgggaaactgtaaaccatccagcgggaagaacctgtgcctgcatcctcatggggccctttgaggctgtgcctgccttatttggtctctcctgactcccccaggtgctttgaaggccggctgcacagggctcatttttgacctcttgctggactgtgctgctctgcctgctaccctcatcctttaggtttcagctcaagcaccaggtcctcaggaaggtgcctccctgcctgccgctgtgtcccctagcatctgcccttttccctccagaactatccatggccagtgacagccagccatccggatgttcactggggcagtgattctctgccctcagctggagcccaggggcatgaggggctggctctgtgttgttcaccagatgcctgtgcacagggcagacacctcgtcccaaagtggagtgctgtcttgtcttgcagggtgaaccctcaccagcacacttttacgagcaggtgcggcagctggtgcattgcgatgcccacggtgaccaaggcttcgaagggctggagtctagtgggctggagtagtgagcaggaacaggatcccgtgtgaggagtgctttatagaggtatttgcagcctccttgggagcacagaggagggacaggcaattctgggaggtggtggggcagggagtgtgggcattgtcaggacgatggaggaactgctgtgttctgatcattgtttatgaatctatctgctcccctgggccgactgcccctactatgatgcgatgcactgcgtttcttgggtatcctgagtctcagcaaagggcctagagcccagtaggtgcacagggaagtaagttgcatgacaatccagatgaatttgtgcagataaacacctggctcattgatccgtcttctctggcaaatccatgtgaaatggctccagatgttatttccaaagttctttccagacaattggaggtggtgagtcccccaaccctgagggcaagcccagccccaccctggggttacttctaccggggaactgagctcagccctcccatcagacttgccccatccagagaggtgcaacacgacagaatctcccagaagctcccaaaggggaaggaggcacccaggccaaatttatctgaataatttctggtcggtggtggttatccgatgggaagcagcacttccctgcctcaaattctgctcctctgttgcaatacaaagcctttctcagccgcctccacacggactttatcgtggattttgtctgaaatccttcctgttttctaactctgtggctgggaagaaggcctgacccctcccagatgtttctcaacggtctgggttgtcaggatttgaggtttctgcatgcagggacgtctgggttgtgttagttgattgtgctggtggattttgatttttaaaactcacgagtagtgtagccaagctcataaatccaagtatttgttttgcagtaactgtgatctggattttatgttaagttgtggggttgttttctgttggtttattcagatggatgtaatgctacctctgggtgttcaaggtctgcctaggtgtggcaggggggcaaggccaagtggcaacttcgattccacatcctcgaagccagggaagaggcagtgctgtgcttcacggagcccacgtggtatcagcaaccctgggacactggcaggcctgaagtgttaagaaatgtgaggagcggccggcatggtggctgaagcctgtaatcccagcactttgggaggctgaggcaggcggatcacgggtcaggagatcgagaccatcctggataacatggtgaaaccccgtctctactaaaaaaacacaaaaaattagcaggtgtggtggcgggcgcctgtagtcccagctactcgggagactgggcaggagaatgacatgaacccgggaggcggagcttgcagtgagccgagattgtgccacgcactccagcctgggcaacagagcgagactccgtctcaaaaaaaaaaaaaaaaaaaaaaaaagaaatgtgaggagctctgttccagaggatggagtcgaagcctggcctctgcatgaccagccagacggcccctaacctagggtgagcatggacaggcaggatcccctatcaccctccccctccagccagctcactgtggctagcatgggtctaggaggtgcctactgtgttaggtctggccacccacacacaggtggacatctgccaccgggctgctgggctagtgagggacaagaagtcctggacagtcacacccatgtgtgtgggggactggggttcttgggagggtgctctggtttacatggtgatgagtggccccaccgctggggtctgctcacacactgagtgaggtggggacttgtttccttccaaatgtgtatttgaaggagacaattactaagagggtttcctagttagacttaagatgtttttgagggattggtaccatcttctttctttcctttcattctcaatattgtataatatgatccctttgaatatctgatggagatgcagagacattctccttgcacccgtgccttgtgttggggggggatatcttaaatggggggcaggttgacaacaaggaaagagacaacaaggttcgtcctatacatagattatgtaagtaatgttagggatgggagtggcgccctgagacgaagcagcaggcggggcctcagtgggtctcactgactctgggcttattctctggactgtgaagtgggcagtgaggcctggctggccctactcacaggctgtttgaggaacatgtgagtcaagggacgtaaaaggactctgtcagctcctgagtgcttcatcaaattagtcagtgccgcagctgattcagtgtcctatttgtgaagattaagtccacctcgatgatttctgagaggctcaaaggttaaacctgtgatctccagagccaggctgatgtgagttagaccttagctccactgcctctctgtgcttcagtttcccggtctgccacatgaggacaaaactgatactcatcaaggggttgtgtgaggatcagattcatgtctgagcacgtgaaccagcccatacgataagaatcccttgagggggataatgatttatttatttatttacttattttttatattctttcttgtagagatgggggtcttactgttgcccaggctgttttccaactctaacctcaaataagcctgccaactttgcctcccaaagtgctgggaattcaggcgtcggctctgtgcctggccccagtgattatttttcgagaaaagaaaatcattacgtggaaagaaaagagaaagagtaaaactgaatatctggggatgaaaacttcaagagttttaggggctgtttcttgaagtgtgttgcagtgttcttgggcagatctggcgtggggaggtgaggatctgtgggagagtgagaacagcaaatagataagagcatggagatggccgccctatgacatcggcgagggaccttgcggcgacatccaatcctacctgtgccacacgggcgcacagagagggctgtctgtctcgaatgggagcatcttgagccttatccccattcctgagtttgtgttcaacaggggtggtctggagggtttaacttcccttttgggaggcacctggctgaggaaatggtgcttgggaggcaggctgggtgcagccaagagccttgggctctctgcaaccccagtcaacctgcacaaaggcctgtgcaaatactggagtttgtgagagtgactatcttggttgactgattctgattgattgattattgttgactgattcttgattgattgattattgattggttgatgcctcaacaattaattttatagtgccttttgggtggtggcctccctcaggctgtgtgacccactccctgtcaccttctcacccatttgctgctatttttcttcttgtctcttcagacttttttgacccccgatacagaaatgactgtggaaccctccctccgcctttaggctcccgctgcccttcctggagttactttcctgtacctcaggtcatcctgattgaatccacggttcctgtgattttcctttcctcttgcactgcagtgtacattcatgaatgttttttgtgttcccaatgtatccaggtccagatcagtttctgccctgttgtaggtgtccaggacatatttataggctacaaaatgtttcagctgtgggtattaatgaatactggtggaattaaggagggaataaaggtagaagtatttagtttggtgagtattaacttgtggttagctttgtatctttacaaactctggtttgttggaggtggtgaaggtccctgcgggtgagctcttccccttccctttcccacgagacttatctgaggcttgccctgtgggtggctttcgggggtaaagattggtaatgaacctttcctctaggtttcttttgtcaagcgtggggctgcaggacgctgtggctggtagcctggtaagatgagtgtgatttgaagcggggcttgtggagaccatccaggaaaacagcacgcagggtttctattgcaaggttgggcgttcttgtcttcagtcaacattggccagcctccgtaggaccatagaattggcacaccccatgacactgtgaaggaaaaagagcctgtgtaagacaccaggctgaattgggatacaacacatgagctagatttttgtttgtttgtttttgagcggagttttgctcttgttgcccaggctggagtgcagtgctgtggtcttggctcactgcacctccgcctcctgggttcaagtgattctcctgcctcagcttcccgagtagctgggattaaggcgcccaccaccacgcctggctaatttttgtagttttagtagagttggggtttcacctgttggccaggctggtctcgaactcctgacctcagatgatccacccacctcggcctcccaagtgctgggattatagccgtgagccactgctcctgacccacaagagctagatttttattgtgtgtgtttgtgtatcttcacaggaaatcattttagccattgctcttgtcagcgtagaggaggaggacggacctggcccatctccttacgtgctgccgcatgtgtagatggggcatagcagggtagggggtgctgcttactgagttggagctgggagccgggcacagtcactgtggtgtagaacggggtagaggcaggatgtggggatgctgcagctcattgagttgagatgggtcctgatagtcactgcaggtgtagacaaggcagaggcaggatgggaggatgctgctcacgagttgagatggggtcctggcagtcactgcaagtttagatgggacagaggcaggatgtgggactctgctcactgagttgagatggggtcctggcagtcactgcaagtgtagatgggagctggcagagtcagggatgggctgctccacaggaagctgtggccctggacagttgcacccatttctgttcctcagtgccgtgatctttacaatttgtacattagagtagttaatctctagattttctctttctcaatagactatatagagaccactccccaaatagacaatttcataggttctctactaataattcacatatgtcatatacatttgcattttgatccctttgtgtactgctacctggaaacaacaaggtattccctttacatagattatgtaagtcatcatgcatccagtgatgtgacgttttggtagaggtgttctttctttggcttatttctggggaagcagcgagcgtggtggaggtgaggtggatggtggagacagcctgccagcattcctgctctgccttttctgcttagagtcattgtgaggaatagcagggtaaatacacatgaaacacaaagaacctgaggagctccagaaagtgttcaatggtgtcagtaatgacgatggtgataatgatattttagtgatggtgatgagggtggcaatggtatgccgataatgatgttgtaattgatggtgtgatggtaacgatgatggtgatggtgggtggtggcgtgattgatgatgatggtatattatgatgatggtgttgatggggatggtgatgatgatggtatgatgttggtgaagatggtgaggtcaagatgatcatgatggtgatggtgagtggtgatggtgtaattgatggagatgatgtggtgatggtgtggttgatggtgaccatggcactggtgattatgttgacatgatgatgggatggtgacgatgttgatgaatggtgacaatgatggtgatgatgatgttgatgacagcatgatagtgctgtgactggtgatggtgatagtgatagtgtagttgatggtgatagtaacatggcaatggtaacgattgtgatgatgatgctgatcgtgatgatactgatggtgatgataatggagaagggttaggggcatattctgtgatgcaggccagtatttctaccgttcctttttggctcattcttggactttcaggtccctgactttcacattttaacctcctagttaaatgaaatttcatatgtggttaagtagaaagaaaacatttcatcttttaaaaactgttatgttacatgtaagggccctgttatctctactcttggaactttaagtaagggaaagaaaagataaaatgacattgagcaatggggttaagtgtccagttgtggtttttcttacactcctcaaaccttgctggtgtgctcataccatcagttaggactctgaggcaacccgttctcactacattcactgagttcccttgggtggcctaacatggtccagttgccatcgatatcccaaaatggtgtatttcacagaggacagaggaaggtgctgttatgggtgagtctcggcattctggaatgagtagattcggccccaaaagttacaagttttgtgggacttggtccctggaagaaggtaatccagggaggatccagggtcagaccacgtgtaaatgctccccatttgagagatggtttctgggatctaatagtggaatcagcgagactatcatggaatgagacaggatggcacagaaaaagaagtgctgcaacaagagagacagctgtagggaaggcctaaaggagatgagagttggaaaggaagcaaggagaaaggagaaaagaagcaaggagaaagctgagaaaggagaccaggggaaagtgggatgaagggagttttgtaagaaagatttggtaatgggttgttccacgcgttaacccaacattattaagcacctgctaggagagaaagatgagagttttgtgtcctgtcttgagtccatcggagtcagcaatacactaagtgattacagataaaggtttggagatagagggcaggtcggtaggtgtgtgttttttgctttgggccaggtgcagtattaggactccagagaacatggtagttatttaaaactaacaaggcaacaatggggtcatggggttgagcagtaatgtgggcattgggcaggccttgtctggcggtcccccgctgtgggttaatcagtcccccctgccttgtggagcctgttactgggacacagagaggctggcaaacttgacagttgatgtaggagaagcagagggtgactcacaggcttgtttataacttggtcaatatgtttcgagtttgtataaaagattctgacaaccctgtaagacagtggcctggattcccaaggctggtgggacgttgtgaagaatagcagttccaagacaacatataaaaatgttgggcgtttgcaagcagacagctctgggctgtaactgctgcagcgggagccaggattcttaaacatgagtctggaacctcgtctgacaagggaactgatgtgtggtttgcagactgtcagctgtggagccgaggttcaggcaaagccatgagaaggggcctgccacacaccagctcagacgccggagggtaactgggctggagaaggttcaggctcctcacaggaaaacgcttttggtggagcctacttgctggaatgtcactgaccctctcacttgagatttttcagcttttcagtttttgcaagttgaggatgaaaagtgatgtctcctttttattatgtttttcattcatctggtgattacatgagttgaacatctaaaaagatacaaaaaagctgcctgcagcatttctgtttacttagcaaagagcctttcaaatcctttgttcattgcttatttaaaaattagattattttagggcgtggtaggtggcttatgcttgtaatcccagcattttgggacgccgaggcgggagaatcgatcgaaccgggagttcaagaccagcctgggcaacaaaacaagaccccatttctacaaaaaatttaaaattggcctgcacagtggcacgcgccaatggtcccagctaccctagaggctgaggcagaggattgcttcagcctgtaaatttgaggctgcagtgagctatgatcatgccactgcacccagcctgggtgacagtgagacctcatctctaaaaagaaaaaaataaataacattttgaaattaataaatttaaaaatcatttttttaaatttctgagacttcactatattatgaatataaatcttatctgtgatattaggcagaacttttgccaatttctaatgacatttgtcctcgaaaaggtcagtttcttatctttccactttgtacattgcaaacattccagtcagttgctgtctaagtttgtttgtggcctgtttgtcacgcaaaagttgtaatgtttggtttgttcagtctactcatcttttcatttagttcatactcttgttccttgttgtagaatgtctgccctttccaaagtcacaaagatgttctctgatattttattctaataattcatttcagcttttccattccgaatcagttctatgattgatgcatctgaaattcatggtatttctgttattattagatgatgtttttcatggagtaaccagttttcccagttttgttgtctggctcctcctttcgtctgagttgtgaggtctctctccagtgtcattttctctcctatagatgaggccaccgccatgtctgtcggtcacaaagtttatttcatacaacacagagtgctgtatatctgttagcttgccttttgtaagaactctcacatgtgaaatagtttgagatcataatttttcaatagcacctaatattttgtttgtatatatatgtaattttatctttttattgcttaggtaaactatcttttcatggcagagaggaatcttggctatcaccctgttctactcctaattacagaagggaaatgtgtgccagaggggacatgactggcacggatccttggagaggggctggagtgacatgtgagttcagactcctgaggtccctggacacctgctcctggtcctggtgtgtagctatggtagatgtttgctttagtgggctcatgcatgtggagccccagttcttgcaccaggccagaagagcctttgcacaccagctcactgggtgttccagtccagctctgggaggtgggcctgcccatctagagctgggctggcagctggtgtcactgcttaacctgctctgtcgcccaggcaggcagcttccgctctgtgctgcagtttgctgttcgtgcaacggagtgagaatgtgctttctccctggtccccatgggaacaggtggaacaaggcgtctaaagtacatggagcttgtggaaggcaccgtggcagccaataacggggctgcatggaaggagcctctcccagccagagggcatgtgtcttctgcagggggaggtgcagcggccggcaggctccgggcagtgtgccgggccccggttctgcaacccaagttctccaggttcttcttgtgggtccagctccgtgctagagggggaggttccagaagctgaggcattttcccttgcttcgtttacaggagtgggaagccttcgccagaagcccctgggagaattcacttacctttctgttggtcaaagttgggtcttaccccattctgagagcctcaggcaaggagaatgaacggggttgccctcgtgctgcggtctcgggcacccactgctagggtcctagaagaccctaaagggctcctgtcagtgtggttgtattcatcacgatttaccctattagaaatgggaaactgatgagtatttaaaatatttagtcagttaaaagcaatggtaatgaaccaattacatgttaaaatgaacataagcttaataaaaataactatgtttcaaaacaacaaaatgagaggaggtgcatttttttttgtgattctttatgcagccttaatcaagaggctggttacccttgcatgcagtcttctgcaatgtttggttgaagcgtcaaagacaatctagccccataaacatatctacttggaaaaggaggcatttaataggcttttccggccattgtagctatttcattttgattctacaccagaactcaagtgcagttgcttaaagttcagtttcactgtggaatctgaaattgtgtcagtagagtttttccacgctgttttattaaaatccactggcctgtcttgcacaccaagtgcatcttttacccgggtggaacaccacgcactggacatttggaaattattggtccactgacaatttcgcagaactctaaatgttgacatatttgttatacaatctcaggaaaatccccacatttgttaataatttgttgattttaacagaaatgtcctaggagttgttaggccctggtgatgggtacaagtctttttttttttttttttttaaagacagtcttactctgtcacccagggcacgatctcggccactgcaacctctgcctcctgggttcaggagattcttgtgcctcagcctcccaagtagcgggattacagacatgcatcatcatgcccagctaatttcttgtatttttagtagagatgggtttcactatgttggccaggctagtctcaaactcctgacctcaagtgatctgcccgcctagcctcccaaagtgttgagattacaggcgtgagccaccgcacctggcctgggtactagtttttaaaattctaattttcacttgaaatctcaaattttgacattggtttatgatgacagctcacttcatttttgagaaaatgacaagcactcgagtctgaataactgcattttgtctgtaggagttctttcaaataaaaatgacatcccctgagaaggtggctagtttagctgccagtcacacaactgctattccaaaaaggaggcgggtctgcctggctgagggtcaaagtgaaccatacgttttgtcttctgggcctgtgtgcttcagagatggattttggtgcgaagttcttttctgttttggagcctcccttctggccagcaccttcacagccccgaatccctaagtggtatcaggtaatgaggtctccatagcttgtgggcctgctggctatgggcttctgaaagcagcctggaacaggtcaagattgggacacagttgtccagcacgtgaatcctcagtctcatcccaaaccccagtctcacattagtaaaacaggcgaagataggtagcttctttccagggtgtgtggaaatttggcaatacgcatgcagttcaaacttttaggtgctgagtgtattagctgctgttactcgtgttagtgctgctattgtgagaccctggtcatgcacaacagagacgctgtccttgaggagcttgcagcccatcgggagagatggacacagggagatcatcatgatatgaaagccatgatgacctgccatgatggttcagtggcacagaagggtgtcaactcaggaacgaggcagctgagccgggcccaggaggtgggtgcaggatggcgtgaatgaggaggtgaggtggtatgggcagggttagggcaggcaggggtagggcaggcagggggctgtctcctgtgggggcaggataggaagctgggcctgggcactgtttgattcatattttgtaatatgtcagaaggcagggagagtatggctggatgcaaacactgaatttgatgcacagacgggctggagtccaccttcatggaccatggctgcccccttggctgagtcacccttacagtttctccccgagggtgcttacgaggagcaagtgcagtaacatacgggaaagtatcttgtacactgcctggtcggtgctgaccagagctgggccacggatagattgacggtggacttgctactctgaggatatccatgctgctgacaatcgagtgtgaagtcctagtccaaacatttgtaaaactttgaggtcacttgtctacataccagaaacaatggccctgcctctcaggattgtagtcttggctctgggcagtttatatgatttcactatgataattgaatttaatgattttgccctacagtgcgatggctgtctggtggccgagtaggccacccaccatgaatgtatcataccactgccaccttgcactgaccagggccatttttttgtgttgagttggcgtgttgcatgacaaatgatcccaaagttagtaccttaacatagcagtaagcatctgttatctcccactgtgtcagtgatcggaatttgggacacaggtgactgggcagttctggctcagggtctctggagaggctgcacatctgaaggcttggttggggttggagaccagcttccgaggtggcacacttctgtggctggaagctggggccagctgtttgtgggaagcctcagttcctctccatgggggcctctccacgggctgcttgagtgtcctcacaacatggcatctggctgtcctcagaatgagtgatcctgagaccaggacagaagtcacgatgtcttttagccacaaaagtcacacaccatctcctctgcaggttgcactgtcacacagcccagctgattcactgtgggagggggctatacaccagcagggggccaagagacgaggtcacccaggccatctggaaggctaaccgctgcatgatgtcgggtcctgtgacatgctgctagacgtgtgtgggcagaattctttgcctgactctcactcaccagaggccagaggcctgcccaccgcccttctccttatctcagtcctttgtgctggccttgctggggatggtttctgtctggacttttaatcttgtgtggaagccccttgtttcccaaggcaagtctctcttgatttgaaaatcactgatcacctttgtgtgttttgcccatcagaagtgtaggataaatacatgtctttgtgaataatcttacaaacctcaaggtatagaatgacattcagcaattcaaaaatatagatcatacaaagataacaacctagctgtaactactggattctaataattgccaggcagtgggcaagtgaccttatctgtttcatcctcattcaacccacacaaacctttttgactttgacacatcatagaaaacagagtgcaggagggggagtgagcattgattaaattcacggggtgttgacacgcagagctgggatgtggggcccctctccctacttctgaggccttggtcttcaggtcccacacacttctgcatgtggacattgctttctatttcaaagcagggtcccttgaaggattccatttgacccatgatagctccgtgggaggaacagagacccagcttgaggggcagagcctggataggaggctttggtcactgttccccaaccaggtctctttccctcctcccacagctgtccctgtgggctggcaaacgtgggggaaggggggcatgtacccgacgttcccttggagctggcacaggaggctgtgttgggattattagggttgttgcttcatttctctctccctgtcctgcaaggcctgcctgcagcatgcccgtggtctcgtggggaggtttatgcctcatgatcacagctgcagcctctgggcagaagggcctgtaaatccgcattggttccagctccgcattgcattgttagggcctccgaagggacacaggatcgctccgttcacacaatggcccctctggaaggattctcctataggaatttagacatgatttattctgacagtcagttctcaggttggccggaagtggaagcacttccgaaatccagagcacgactttctcacaaatttaaaggctcccatccggtctttcatggacactttaaatttgattcttaaggggcatcttccagtttctcttcttttttcagggatcagctataatttcgggcacacacgaatgcattctgctgctgaaattcactattcttctttagggatccagttggctggacgtacataccccttgaaaaaccaatctgctcatgaccccttgaaaaaccaattgctcatgaccgtgctcccaagacattcctacctgagccacctgagctgttgctaacagcaacagttgtaactctgctcttgcacaccatgtcctcactgccttctgtccacactgcctgtgtcatatgtaaaaatctctctcgtgccagagagaggccacctatgggatcttcaagcagagactctgaaggattgagagggtttgaagatgtaagaattcttgctagagagactgttgacacacattctttctcttttttttttttccagcctgcaagtattcctgccacaagaatgtgaagccaaggtaagcattccgttgctttcccatgggactttttatagctgacttgccttcattgaatgatatgtgtgggggggcctctttggactgcagccacggaaagaaaacctttaggaaagccagggctgggatacggtgtatacttttcatctcaaggataaaccaaaagctttgaaatccacggttttgattatggaaaataattcttaagaatttgatttcagatagaattcaatagttgtcccctggccacatcaacagctccttctcagtggcacatggtcctggtttctcactgccttgtcatactgcctctcggtggagagagggcaggagcagggaggccagggcattcccctggcctggagacttttctgcctcattttggagatagttgtgcataacggattggggttttcagctgccacggaaacctgggaaccctggagtaaggtttagtgagttcactgaggtttgtgagtctctagagaggttcaattgcccgatggcctctatgaccaaggaggcctggctatgtcctgttgggcttagggttttggtgagtggggaagtgaggtggctggaagtgccgtgtgggaagtgacagacaccccaaggaagaagcacatggttttctacttgtcttggtgctcgcaccttcagatctcctggggatggtggctgtacttacggaatcccaggtatgatttgggtctgcagtcggggtgtcagcagtgttttgccccatctactgtttgccctgcctatgggggctctgtaggtgccctgacaggttgtccccatggctgtaggtccgggaagaggagttttagagtcttgggattttgctactgttacagacctcatgggtcagcgttttgatcatttccagccctgccttcggctccgagtggaaggctatgctggaagctgattcatgttaccatgaactcactgcatgtgggtctgttttccatgtgaggactagggcggtggtttccccgaccctcccgatctcaggcatacacaaacacacacatgagtaaatacaccatgtgcatgcacataaatacacatgcatgcacataaatacacatgcacacaaacacattgtgctcacacgcatacatgcatatgtgtgcacagaaatacacacacacacacacacaccaaagttggaagaactagactagtatagctctatttcttttctcccaagagactttttaagtcttcattatggagaatgccgagcacgtgcaggagcagagaggatggcacagggcctgctgcccccttcctgaaccccagaccagcagcccctgtgacctggccacacctccttgcggctgcctccttcagatgtcatgtggggtgcacttctcgggcctcctgggggctgtgtgagcgcttctcctcttgctttccaccctgctctggagagggcttccccttttccagaggatgggcatttcttgttcacacactcctaggcgtagctgatttctgaccgtggtttatttgggttttttgtccacagataggctcctttcctggggtgctgtgcaccttcagtggtgtggagcagtgcttctgaatgcagtggtgagtgggaagattgtacctttgggggagcatttcaacttggagagcttccccctcccctaggaggactgggatgtgttgtccctcacccctgtttatggtgcctttgtccgcattgcttgcaccttgggtcggctgcggagtaggaggaggggtgggctgcttgtcctgactctgttgtgggcccagccacctctgagccacagccgcagagtgagcctgctgttgttccttccatttcttaaatgaagcctgtcgccggctgcttaagggttgaattctttggttcaaagtgtattccaaaatccttaactatcactgaatatggaattctaacggcagcaattggcagtttgctgagggatggataagctcttattcctatcagatccagtgtggggaaatatatccgtgttcattttttttataatacagctttgaaccacagggagaaagcccctggcaataacaaagcaccttctcattccaaaaatataatgccgtcgttgtggggatatgagggccataactccccagctgctcctgcagggtatgtggctaagggagcgctcggtcttccaggaactgaatatggctgtggcttctcccacattattgcactcggctttgagtccttcattactgtgtttacatatattgcccagtgggctccttagacgctgcaccagattgctcaggcaagtatgaagccttggttcagctcataggctttggtctggcatcaacccaagactgggtggtagcgtgtgctgtgttaaaccccctcgatggtgttcccctctggtgggagcacttgcgcctgtgtctacaggctccacacatgccctggagcatgtggctgggtgtggtggtgctgttgatctgctgctgtcagtgacattgtcacaggctcctcccatccggccctcagagccccttctgtggcactgacaatgtggagaaaccatcctgcagaaatgggaccgagacagcagctggggacctgcctcaggcagggaggcagagccatcgttgggacatttgagaagcgccaaaagactgctatcactctcttcttgagccattggacagtatgtccctcaggccaggccatgcagctcagtggatggatggaggcagagacctggacttggatccagtggggctttttgtctcctgaagcctttctagtcccccttgctatggtcttgatgttttgtctcccccagattcctgtgttgaaacctgacccccaaggtgatggtagctggaaatgaggcctttggggagatgattaggtcgcgagggtggagtgtctataaatgagattagtgctttataaaagggaccccagagagatcccttacctcttctgccatgagcatacatggcaaaaggcaccctctatgaaccctgaaaagggcccacaccagacactgaatctgctggtgcctgatcttgtacttcccaaccctagaaccttgggaagtatatttctgttgtttataagcccccaatattttgttatagcagcccacatggacttagataggccctgagcctcactttctcctgcataaaaaaagtgaataataggtttctgtaataaacagaaaaataactttctcttgctgttggttatgttaatacttacttaagtttcagggaagtcacataatgtatgtacaacacttgaaagtttgggatttcaactgttttgcttcctggaatgcagtgcttattcatgtagccacatgagctgtgtgggcatcatgacttgcttttttcctggctgtcacttgacttatggcaagagtgaaaaaagaagtaggagaaatgaagcagttgtaggaaagcagatgttgggaggggagaagggggaggaaagggtggcaggtggtgcccccctgaaggaaatgaagggggcttaggcaagcagatggaggcatgggaatcctatccttgaaacctgcagcctggcatctggtgagatgcctcttccgcctctgcccacttgcagacacatttgctccttagagttgcctttgtgtagggtattgagtatcatcttgaatcatcagaggtgaaatggacctgcagatatttttttgtaaacttaagaccccacgtagggaccatacgcaggagttagtgaggggaaatgcgcaggagtaatgttggggagatgccctgcacagggtcccgatgcgcagctcccccttaatccaggaaaaacacagaacctcctaccacctgggctccaatgctctcagacccccggctcatcctcagcctttgcagcctggctgcgaaggtccagcttgctgtttctctctctcatgtgcctcggtttgcacccttcttggatataaaatacaggagtgctggtgttgcctcttgctgagtctgtagaaggagagtgcagcaagaggagagaggtcccaggctctgtccagctcttggctcctgcaggtggcctcagcatcttcttccactgtcccggtgctacgtctggcacttgccaagccaggagcctttccccgctctccagctcgctgcttgagggagagagaatttgtgataggcttgctgctctttttaagctgagactacaggaggtcctggggaagtcacggaaccccctgctgccctcatcgcctgctgccctgggggcctttgctgggctctcccacagggatccccatgtcctggctgcggctgatgcaggagctttttcacttccaccagacagcccagggcaaagacttggtcctctgccatggaaaacacgggacctagagtttatggctcttcagaaactgtccctagacattcatcctgggcgtcaacagacgctcagtggcctaacgataagtttcaaccattaacttctgtctggcagttaactttcatcttcagatcactcctttctctgcatgctaagagccgcagctgccgtgcagtgggatacgggcctgctgggtcccgggattgacctctccagccccctctccccattgtctgatgaaaaacctcgagaccccaggaggtgaaacaacttacctattgtcacctagcttctgggcccagaattcatgggcgttgatttcaaagttctgatttttgctgttccatgtgttctttttggtgctttgccatcttcagtatcagaaatggagctgaggtttgtgtgggtgactttagcccaccttgctcgtatgccacagaacctactatgcctcttgtgaactccagctccagggccaacttctctaaaacacggttgagcgtctctcccgcttggcttggggctcactcctcttgggctgcatctctatttcctctcatgaaatgatgcctgagaattctctgactcccgcatggctcaggcctcttcttcccgtgaaggctctgctcatacatccgtggcatcttgtccgagactcccagtcctcccacagacagtgagcaggggcagtatctctccccaattcccatagctctttgcaaccctgcagggcctcggctgtcgcagctgtgcgtttctgttttggaccttctcacccgtgcacaaggaggaggctgtgggagctgctgctttgctgaccctgagctctcggttactgcattctttgacctgtctcatcttccatgtccagaccttaccctgtctagggccccagagcctccactctcagcatcccaccagccagctccgctctgctcagggcaggggcctgtctttcctgccagccacaggccacggaggctgcagactctcgtccccaccttcagcagggttggtgctccctggctgttggtggaggatggaatctggtgaagctcattgccacagcttttaaggttggggttcagctttgacctccccaaaaggtgtaagtagtggcctttcttcatatggtcttcactagaatgaatgatctgaatttgctagtaacaaggcctaataaattctttctttctctcttctttctccctccctccctccctccctccctccctcccttccttcctctcttcctcccttttttccttcctcccttcctctcttcctccctttctcctcttctccctttctccctttctcctttctctctttctgtttgtctttcttccctccgtcacccgggctggaatgcagtggtggatctttcacagcaacgtccacctcttgggttcaagggattcttctgcctcagcctcccagtagctggggttataggcgtgtgccaacacgcctggctatttttttttaatttttattttagtagaggcggggtttcaccatattggccaggctggtctcaaactcctaacctcaaggatccacccaccttggcctcccagagtgctgggattctagtgtgagccattgagcccagcaggaccaatacgtttttcataaccaaaaggaaaatccctggccctgcgtgtaaaagctttttgttgtttgtgagttcatctctttcctgcccctatttgtaccctttacaatagcttaggaagatggttactccctctgaactcagcttcttcatttgagcataggatttttagggtgtcatgagatacatctctccatgtccagcctgtgcagaaggaatgccactcagtcagcctgttgagggatctgcaggaccctgccgagtgctttagatatgctctgtcatttactcgcacacttctgtctgaggaggcttgttctgctccctcttacaggtgacagggctgggaccagcagttgcatctcttgctaaggcctgcgatggtcctgccccagctcacgcggccagcagggctctgcctctctctgccgtctcagtaaatgtttacacgggcatcccttctcctcccccccacttcttgctctaagggcagaggcagttaatttttaagccagccagttcagcagaatttcctgagggtagctctcggccgtgcacagagctggacccagatgcagcatgctgtcacagggagcttctgtctgcagccccacaggacgaaatgagagtctgattctgccagatgttgcaggtctccacctatgtttgccaagtgtgtgtgtgtgtgcgtgtgtgtgtgtgtttaatgtttgacagcttttaaaatggtttttaaaattagaagatgttatttttagagcagttcagatttgccgcaaaattgaggggaaagaaccgagggctcacacacacgtgcttacattacacacgcatgcatattcacgcacagagacacacactctcctgccgtcagcatcgccgaccagaacagcacatttgttagaattgatgagccagtattgatgagtccacagtctacgtagggctcactctgggtgttgtacattccatgggtttggacaggtgcatgataagtgactccaccatgacagtaccgtatggagtagtttcgctgccctagaaatcctctgtgccgcgttctctctcctgcaccccggcagccgctgaccttttcactgtcttcatagtgttgcctttccagaatgccatagggttggaatcatacatgtgtagccttttcagatgggcttccttccttgataatatgcatttaaatttcttccctgtcatttcttggcttgatagctcatttctttcagctgaataacactctgtcatctggatgtgccacagtttaccctccattcacctaccaaggtgggtactgattggtggcttccatgtctttcttttttgctagttgtcactactgcagaagaaccatgaagcatccttaaattctgctctttttgaggacacttttattcctttcctgtaagatcccttttctggtaggctgtcctcaccaatcatttttgactcattttaatagaaagtcactttacacattaacaccttactagaggcatgtttatacctgtgtctcttttctactgggaactattactcctgactcccagagtctgggaagtggccccactgtgtgaacccatcagccaaggccaccatgtgggctctaggctcactctcaaagtcagcaagccacattggcttttcatgtcagcacaattatactttgtacaaaagaattaaggtttctaaatcctagtaatctgagcctcaatcagaggcattcattgtggacttctaggcctttcttggactgaaggtggccagcaggaccaagccactgtcaactaaggaagtgcgtcagctgggcgacacagctgccagcagctcggggccttgccctgtggggctctgctccttgcaccgtctcggctctgcggggctttatggtgaccctgctggcattccacaggctgggaagtcactgagttcccactttacaccagaggaaacaggtctttgaaactggtggtgacctttggccgggctgagggaccatgttggctgtctggttatgagtgaagttctcgccctgtgatggcaggtttgtttttagtgcggcataagtgtaagctatatttgtgtaggaagtcctagccctgccccaaaagaggccaaaagagaattatgatcttttgaaacaagatatttgttttaaataaataataaattttaaaatgtatcctgtgttttctctgaatcatcagttttcattccacattgtgtttaacagatgaaacaacacatacctggaatgaatctgcacctatttgccacatcattttactacgtggccagtaacctaattagcagctctgcagccagcatctgtatctgtgtcctggcaggaggctagaaggtgcagccggagggagaatgtgggtccctgcatcctgcacgtggccaggccaggcctgtctgccttgactctcggcatctgtgaaatgagggtaactttccatgcactgtggttacatgggagggtaggaggctgttggcaagggcaccccgtgcctgcaagttgttttattgattaaactagggctttcgaggtgccctggaaatcttcttctgaaccccactctgtgtcttttgaccagttctaacctgagaaagaagctctccctgcagaacctccatacttgagaaataatttgggcaagcgtgctgttggttaaggttcactccccacctccacctgcgggatgttgttgggtgtctgtttaccaggggtgtcacggaggagagaaggggccagtgacctcatgcagccaggctctgatgacagagtgggacacccagagaagaagaggccccgaattcaaaacagatgccactttcatggtgacagtaatgaatgtttgagtgactgccctactgggtcagatagaccagggtggggagcccggtcctggagggagccccatatagctcgggggcaggggacagagcagcaaggccaggcatccatgggcacacgtcgctccagtgtaacaaaaacaaaagaaaagagcacgcggtgaacatttcctgctccgtgtgtgtgtgtgtgttgtgtgtgtgtgtgtgtgtgtgtgttccatacgtgaaactctgtactaggcgaatacttttttctcttgcctggcctctttgggagaacagaagtacaaaatggaaatttgcatgtgtgctctcagaagcagcttctgaaactttgaggactcataaaagagaagaatgaataacagcctgggtctggatcctgactctgctttgtcttacccatgtgaccttgggcttcagtttctcctctataaaacaggaattaacccctactaagaggactgcggagaactgaattcaacactccccaagcacagggcctggtggcttctgcaggagtgctcttttccccttttaatacctaatctgcatcattgtattaggaatcactgtagatgtctacagtgtcagttgctggaaatactctttctgcagttgtggtactgacgctagtagatttatttcatgaaatgttgcctacgctagcataaatcactatgcattttatttattaactgttaaatgacaagaaagtatattattttctaaattttcttctgagaatggggtctgctcttttaagcaaacaaattccattagtgggcttaattagtgcctcagacttagcctgaggcccacctgaaagtggttccatatgctaatggcagagccgtgggcttaatattttctgacactggaatccaagtgcctcttgccgatgctgccttggttctggcgagctctgtgacctttcccctgactggctgcccttcttctactccccccagcctcctgcatttgcacaggctcaccctgccttggctcaccccacagggacttccgtagtcctggcccacatcgctgcagccagggtatctgggcctagggcagagtgggtgctgcaggtgtccctgcctgcttggtcttggacttctgatgtgatttcccacaacccctgacgagcaggtacagatgcatccccagccctccgcctctctcacctgtgcctgggttctgtactgcgtgtgcgtggactctcccactcagactctgtttgcgttggccaccatgcttttactcccgcttctcttgaaacacgttctggccggtggtgtgcagatgagggttttaccctgctgggggtgcagcgggctgattggcagcctctgctgattcccctggtgaaaaacctcacctccccccgcctgcttccaagctaccagcctgacattaatcagcttgaaacatcctgaaaatgccatttggctccagcacctcctgcccatcagctctggtcacaggggaacgtccctccttccacacatgtggccccaggtgctctttctgctgactctggctgccatcgcaggagcccttggcccctttctagaagaccccaaactctgtattcccctgtgtgagctacatcctgttcagtgatgtccttttttgacgtgcttatcttactaccccttttttcagacaccattcagtttttgaactgctcagagtctataatgtatgcttcctcccattatcctgcacccctcctccaggctcactggggtcctctcctctcctcaatccagggcctcttcaccctgggcttctgggctgggtggcatcggggcctctccccagccctgtggcaccgtgtgctcttctggatcacagctcttcctctctgaccctgcctctggctctgtccaggttagaaatcacttgtcataatgtgtgtggtttcgtccactgctctcctgagtggtctgtccttacccttccctctgccgagatggaggaggaaggtgtgctgcagttggggagctgcagaacggccgttctctttcaatgtttagacaccatatgcagtgcatctttttaaaatttctactacagcattcttccacatggatgccacccaccctggcatctagcaatgtcatctctgcagaagctatctccgggactttctggcagtcctgggccctggctctggctgggagactgcattctgctctgagtgtaggttcccagtgggatcttgttcctgaggcctctctatggcccgttcagctcaggtcttccagagcctgagttcaggctgggagaggtgttggaagcccgcccctgttggacataaccatccctgtcaggctaggagagacctctgcaggcctcgtcctcagggcggggtcgtggccctgtgcccaccatacttccagacaccccactctgtctcgtgcagcccctccccagacgctgccctctcatgttgtcagcgtgtgtgtccatgagtctcagccccctagccacaggacaggcacttagttgatgtgcggcactgaagcctgtgctctctggcgactgcccagtgttgctgtgcatgcgccttcatgcctctcattgagacatggcttcacgttccatgggagaagaacgtttcttttttttttttttttttttgagacggagtctggctctgtcgccaggctggggtgcagtggcgcaatctcggctcactgcaagctccgcctcccgggttcacctattctcctgcctcagcctcccgagtagctgggactacaggcgccggggagaagaacgttctaatcaaaccgctggctttatttttgtggggctacttctgaagggtaggtttcctatgaagcccccatttcttctttttttcagccacatttttatcagcggggccaaaacccatacgaagcattcaaatccccacctccagattttgaattgtaaaataaaacttgtttcacctgggtttccccttccccccttttgtaaagcagttaattttaggcagggattcaggaagtcctactcccattttctgtcaagcacagaaatagctcgcggggcgccctctctccgcctccgggagcagctggcggagttcatttttgtgtgtttctaggcatttcaactcctgccttttgcgcactgtgtgtgtgtctgtgcaccctcaactccaaattaccctggaactttccgaacccgcaggcttcctttctgttcttaataaagcggtgtgcaaggatctgagctgttaacctcccttatcactggaaactgccccctgttcagaaggtctttagaataacaaactcacaatgtgtctttcaggggaggtggagtggatagaatggctgaatggttgcaatactgtgatggagaaattctgctttcagaatctttatctaaaacctttcgctttttcagaggtttctttcttctaaaaagcatttggaggggagtcgattgaacctcaggaggttggttagaaagcttgcactgcccagcaagagctggagtggcccaaccttgaacaatgggtggggtcagtaggagtagacttgtgggcattttaaaggtagacctgttaggattggcatacccacccggtgggcagaggcacggcttgtgagtaatccttaggttttgaatttgagacactgggcagagaggatgccactggcaggattttgtgaacaggggtggaagtttagctttagacctgcaggaacagtttaggtttcatggaatatgtttatgtggacattagagttaaatggaatgccattataagattttgtgaacaggggtggcagtttagcttcagaccagcaggaactagtttgggttcatgaaatatgcttatgtggacattagagttggccagttggccatttgcagctcaatgctaattttaaaagatttgataagttgtgagctcttagggtttctcatgttttcttttctttcagcttttttttttttttgagagggagtctcgctctgttgcccaggctggagtgcagtgcgcgatctcggctcattgcaagctccgcctcctgggttcatgccattctcctgcctcacctcccaagtagctgggactacaggcgcccgccaccatgcccggctattttttttttttttttgtatttttagtagagacagggtttcagcgtgttagccaggatggtctcgatctccgacctcgtgatccacccgccttggcctcccaaagtgctgggattacaggtgtgagccacgcgcccggcctcttgtcagccttctttagagcaaaggacagttggtaaaacccaaactgtcatcatgtgattgttaaacactcttgccaaaatgtatttcagggaaaatttctctggtcctacctttgtggaatttaccattttcttccctgaataactgttgtatgtttatacctttcttccattttaaactgaatttcgaaggcaactgctaattctttctcatctccgagtgcccgaagtgtgatatttgatatgccattctgcaatgaatgaatgaatgagaggttgagacactgacccaaagtctggcgaagtgaccagctcacttatttgtgctattccttttctttaggatgaccactgaacattgactgtcagagctctgcgcttcactctggagggtggttttatcgagatctgggcatcccctccctaggggtgaccacttcctctgccttgtcattagcaaaggtcagtggaagccagggcttgatatgaagagcctgctattgatttcatatggaaacccagatgccacagacccccaagaagcaggagctgggggtggcattagctgatgtcatcgccgaggctctgctccctgtgagctcagtgccgtcctgatgaatgggccttggctctcacagcagtgggagctcctcctgctccagagctccatgtccggaaccccgcctttctcagcataggctggcgtggttgaaaatacaaacacctgcttgcctgctccctggtggatgtggggccacccctcattttaaaagcctcggaaaactgtgctttgttttagtgttactgcctccttgaccttttcctttaaaataagaagaggatattacaaaatcacaggagcagagggtcatacatttctgtgctcttctcttgaagcagaaataaaagcacatcttatttgtgtgtctcctaagaaggggccttgccactgggccttgaggcacaggcacctgcccagtaggaggtgggcggtggttttccaggcagagggagcagcctgggctgaggctcacaggtgggaggtagggtaggcaagggagttgagcctggactatgttggctgcaggtgaggacagaggataagaagaatcaggtgtggggagctgacagtgccaggccctggagtctaccgtacggcaggcagggcgcctgccgatatgcggctgtgtcctccatgaaggcctgcgcaccaggcacatgggctccaacccagccttcctgctgctggccaaacagagagctgtggtgaggggctgcccccactgggggtggccagagccatgacagaaagccagtgtagggtggacatgagatgatgactcccgtcattcgtgagtgggattaggagtcactggcacacagttggaaagggagccatttctgtgccaatagttaaggtccccactcagtaggcccctacagcttcttcagagtcaggtatttaacttgtattttaaacatgaataaatcaaagcaaaatcaaaaagcgttccttcatttgttagactaccagttgagtgttttagaatgttcatggtgtcaggcatggcatctggaccctccttccaggagcctgtaggatcgctctcaggaactggctgtgattgatggggccatgccacatcaacatacacccggggccatctctgtaggacatgactctcgggtttcaccgtccactcaggcctatggtcttgggcagtggttcctccctgccttccttcaggtgaacaggacgggcgagggacatgtctgttttgcccctggttaagtattatcatgaatcagtctcattgtgcagcctcatcatcagaaaattgtccaggaaatgcctagtctgaaaaatatggagttctgtttcaggagagaggcaaagtctgtatggccgactgagatggccttcggtaactatgcgctgtctttgaaaggccgtggggtcccctttcaccctcactccaatctgacagtgtatattgatatagtcccactgtcaagactttcctatgagcttgaggttcacatccaccccgcgggtcgtattatccctatgtcacagatgaggaggaaaattgagttcacagaggacagtctcgtaaattcatcagagccagctgggagaagcagagggcttgccctaatttcagtctctgatgcaaagacagagctttttcggttctgtccagtcactctggggcttgaaacagtatattatggtttaaaatacatatttgtttaaaaccgaagcttacattcaagaacaccacatacgtgcatgttcagcctgatgcattttttggtgaatcgcagcgtagatggacgagaggctgccctctgcctctctgcccactggctagtgtcctgggtcatgtctgcccgcctcgtgctgagccacagccgcgctctgtcggcctcttgcccccaccatcggcggctgaaatctcctcactgtgacagctcatggcctcattgctgctgttggctttttcaagtgctgattttgagccctttcctctacttcccgacacagagcactgaaggatggcattctggtgcccaacacactgtctgggcatgctggggctgtgcgcattgctgggcacactatttctgttctctgttgttcctaacaaatcccctgtacactcagtggctgaaaccaacaagctgtgatggattcgtgactggctgggcagtgcttgcttcatgtggtgctgacagggggactgggtggccagaaggtacaaacgccctcatgcccatttccaacgattggcactgggcacctcggtgcccccttgtggtgtctccatgcggctgttcaggcttcccttcattatgggggctgggcccaagaatggatgctccaggcgaaggcggcaactgcagctgtctaaggccaggcttcggagttctgccaattccaccactcacagcaggccacagggcaaacccaggacgagcccagactcaagaggacagggacagactctacctcttgatgggggaatggcagagttcctttacagaagaccctggtgatgccaccgtctttgaaaacacaacctactaaacttattcaggcaatagcatgcaggatgttattgtagaggtaatcatcagtctcttctgatgaattaaaatgtaaattactcaaaatgtcagtgtcagtactttattactttattattaattataggtggccggtgagaatttaggctgatcagatgtagctggtgaggaatgcatgagttgggacctggattttccttgtgaaatggatccagtaatgtggatgcagttaaatcttggtccttggcattataatgctctataaaaagacggttcatcaactcaatactaccttttaatctttctgcaattaggttggattatgatttatgagtttttcttcttgctttttttgcaagccattagcattttatcaatcccagatgtcctctttctctttttgaaaagataaggcgtaggactgtggtaagtgttggcttcaggggtctgtagaccctgattctgcctctgtgggcctcggctgcaccatgagatgctggcctccctgctcagccctggtcttgtaagacagactcactgcaggaaggcgtttgggccccgagcgatcctgtgctgtgccctttgctgggacttgtgtatacagcatgcaagtgacctgaaagtgcttttcagccacttcgagaatcccctggacattgttccaacaataggttacatttgatttctgatctgagacaaataatggtgacataatggatagaggatactatgctttgctttaaatctattatattccctaccagtggtaacttgtttgcctgaggccagcgaggcctggccctgccttgtgggccatgggcctcaactgggtaaaggtagccaatgttaaaagctacacagcctaagtaaagaatgaaaaagaaggttccagtaggttcagctaagcccactgggataggggcactactcttttgtctaaaaattattagattccatagagttggattgaaggggaaactgaggcccctagaggtgaggagagccgagaccaagccaagaccaaggacgggaaagcttgagcctttcttttttcattttactgtgccacagacatgatcttcactagtgcttgttaactgtaaggaaaaatataatgacctgattctgggaattttccttctcttttcttccgctcctgtcccggttctcagcccgcaggctgagaaggtttaattgcgtctgccggcgggtgttttctcatggggattagagcaggctaaattgggctttgacgcttagtgggtaacagagcttcctgaggaatgtgaacctaattagggattccagggtcaagcctgacaaggagacacagaagcaaagttagggtgagctcttgaaggaagcagagaaagttaataaagctcgaatgtcctcattttgtactgccattctttgtatagatctgctgttgtttgcaggctgtgttgaaaatctgaccctgggcctctcttcaaccctctacctagccccctgtccccagcaccattggaaaagcagccttgaatgatgagtaaggccaccttcggcatgtcaggagccccggcctcacctgggggacccagctcctgttggtgtgcccagaacgttctgtgtcgactgacgtctccacccgtcctgtcagacctttgattgttagtgctggggggttgcattttgttccccaaatttaaatgttgaagtccaaatccccaggaccccagaatatggcaggatttgagataaggtctttaaagaggtaattaggttgaaatagggtcattaggatgggcctaatcagtatgactggtgtccttagaaagactgggacacagacacacacaaggaatggccacggaggacacggggagaaggtggccatctgcaggcccgggagagaggcctcaggaggaaccccctgcccacatcttcatctcagcctcctagcctccaggactatgggaggataaacggcgtggtgtcagctgcccattctgtggtatgttgttacaacagccgccccttacccgagctagactgttgcttatttaagcagataaacacttgggtcagtgtcagcactgggaatgagggactttccttctgtgattattctccttaccctgcccttgtaataaatgataataatggtatataaacacatgaacaatgcatcctttttcaatcttaactaatgggtgaattaaagatttgctattttattgatcagtaacatacaatgtaagaagtcaaagctgtggtataatagagtggcccttcgtaaaagctccaccctccttgcaaccaggctgctactccgtgtagagatatagaagagtcccaacccccaattatatcgtaaggtcctggtggtcagcaaatatttgggtccgtatctgtttttccctggctagttcagggcctcagaggtaggttacctctgactgttttatgacttaggaaagaaagtactgccatcttggcgccatcacgaagtttctttaaaagaattgtttttgtaaagataaaataaaagtaaacttcatttctgagtctttgcaactttcttagagttaaaactattatgattaaagtaattttatgtatgatagaacttgtgcataggtgatgtctctgtacttggcttaactcagtgaattgctttctcccttgtctgcaaggttggcaaggtcagtggctggcccgtttgtctctactcagtttctacttgttttgcacctgatgctgtcccacggatttgcattcggtgttgtgtggtgtgtgtgcatttgtggaacgccgtttcattgctgtgggttggtattgttgagctgattctcccctccagaatcctgacatgacaaggtttgcccaggcctgcttgataccagagtagagtagagacttcacctgtgggcaaatgacctggagaacaagcaggaagaaacgattagaggagccaagcctccaggctttcctgtagctgccgggtgtgtaaaagcatgcttgacacttgagggtgctcgcttcagttcttttttttttttcttttgagacggagtcttgctctgtcgcccaggctggagtgcagtggcagatcccagctcactgcaacctcccaggttcaagcaattctcctgtctcagcctcctgagagctgggattacaggcacgtgccgccacgccctgctaagttttgtatttttagtagagaggggttttgccatgttgaccaggttggtctcgagctcctgacctcaggtgatccgcccactgggcctcccaaagtgctgggattataggtttgagctactgtgcccggcctctcttcatccttacttcatgtttctgtgaggttctaggaagctgattcacgtgacccaccatgactgaatttttgatgatttggaaaagatagaattgaaatttacatttattctctttatacagatatgcatgtttatacagaatatgtagtgcatcagctatacccacacggctttagagaactgatggaaaaatgtcactttctatatggctgtttacaaagtgaaatttaataagaaacacaataaaagctgagtttggagttttattgtgttcatcaaaaggaaaacaatgtcggtcagcacgaggagaactgagttgtcctttatttctcccaggacttggatctcccagaagtagcagagagggattggttcaggtttgaagagttgatctcactccttactgaggaagatctcacccgaggccctgtgtctgttagcactgggggtaatggtggccgggccagtgcaccttgatgaaagcactttctaaggcagaatgtacttgttagctgaagtgctttcattc

SEQ ID NO: 5092 - DNA, 21605 bp, Homo sapiens
gcacatatacaccatggaatactatgcagccataaaaaagcatgagttcatgtcctttggatgaagctggaaaccatcattctgagcaaactgtcgaaggacagaaaaccaaacaccgatgttctcactcataggtgggaattgaacaatgagaacacttggacacagggtggggaaatcacacactggggcctgtcgtggggttgggggagggatagcattaggcgaaatacctatgtaaatgatgagttaatgggtgcagcacaccaacatgacacatgtatacatatgtaataacctgcacattgtgcacatgtaccttagaacttaaagtataataaaaataaataaataagcttaaaaaaaaggtacacccactttggagaaatgtttgacagtttcttacaaaattaacaccatataatccagtaatcctactcctggatatttacccaagagaaattaagatacagtccacaaaaagatatactagaatgtttacaggagtttattcatagtagtaaaaaaactgaaacagcccaaagttcatcaacagataaaaggataaactgtgattttaaaaaaaataatggccgggcgcagtggttcatgcctgtaatcccagcactttaggaggccgaggtgaacgatcacctgaggtcgggagttcgagaccagcctgaccaacatggagaaacctcatctctataaaaatacaaaattagccgggcatggtggtgcatgcctgtaatcccagctgcttgggagctaaggcaggagaatcgcttgaacccgggaggcggaggttgtggtgcgccgagattgtccattgcactccagcctgggcaacaagaatgaaactgtgtctcaaaaaacaaaacaaacaacaaaaatagtcaactctgattggtccaggtcatgctgttgagtcaggccatttcatagtggtttgagaagcctttgaattggatgaaggtgggaggggtgtcagtggaagggccccgaggatgtcctaggggctgtgggcatggcaggtattctgcagcttgtcttgtttaagaccaaagcaagccattcttcacaaagattgtcatgattctggtttgaatgatcactaatttattttttttgagagagggtctcactctgtcacccaggctggagtgcagtggcgcgatctggctcactgcaacctccacctcctgggttcacgccattctcctgcctcagcctcccgagagctgggattacaggtgcccaccaccacgactggctaatttttgtatttttagtggagagggatttcaccatgttggccaggccggtcttgaacttctggcctcaagcgatctgcccgctcggcctcccaaagtgctgggattacaggggtgagccactgcgcctggcctgaatgatactaatttaacattgctaaagtctgcatgatgaggctttcccgagtttacgcatgatttacatacctggtttccttttggatgtgtggtcgtctgcatcaaccaaggactgtcggagataagtgagaacatagagggtattttttttttttttttttttttttgagacagagtctcctctatcacccaggctggagtgcagtggcgcgatctcggctcattgtaagctccgcctccgggttcacgctattctcctgcctcagcctcccgagtagctgggactacaggtgcccgccccacgcccggctaagttgtttgtatttttagtagagacggggtttcaccgtgttagccagatggtctcgatctcctaacctcgtgatccaccagcctcagccttccaaagtgctgggatacaggcgtgagccaccgcgcccggacatagagggtatttttaaatgctttgaaattctaaagagaaaagggaaaaaaaaagtctcaataggaaaaatgtgacaaacggaatcccggcacctgttaatggttaattctcacaacagtgtctcagtgcatatccttggccagcagccacacctcggtcccctggagtggcagttccaagtcactggcatggccacaacagtttctgactcgagctaaggacagaactttgtttttgtccaaaattccctcattattatttttgtttgttttgttgttttttgagacggagtcttgctgtgtcgcccagcctggagtgcagtggcagatcttggctcactgcaacctccgcctcccgggttcaagcgatgctcctgcctcagcctctgagtagcttggattatcccaggcgctcaccaccacgcccgggtaatttttgtattttcacagagacagggatttcaccatgttggccagcctgttctccaactcctgacctcaggtaaccacccgcctcggcctcccagagtgctgggattacaggcatgagccaccgcccctggcccaaattccctcattaaacagtttctcttgcagaagcacaatgagtgaaattggcatgagccatttcactaaataaccacatcagtgaatttcctggtcctcactcaacaaacaaaacaactggtggttttccaggctggttcatttgagtctaccctcaaccagcacctgcccaacttctggcctagaagaggcacacgtggcagaaatacaagcagacggcagaataaatagctcaatgaaaagagtcaaactttgtaaaacatttgaagagattcattctgagtcaaatatagtgaccatggcctatgacccagccctcaggagacccagggaaaatgtgtgcaaggtggtggacacagctgggttttatacattgcagggagacatgagacagcaattaaatacatatagatatatattggggccagctgtggtggctcacatctgtaatcctagcactttgggaggtgaggccagtggatcacttgagctcaggagttcgagaccagcctgggcaacgtggcaaaccctgtctctactaaaaatacaaaacgtagccaggcatggtggcacacacctgcgggagtgggaggaccgctggagccgggaagttgaggctgcagtgagccgtgattgcaccactgcctccagcctgggtgacagagcgagaccctgtctcaaacacaaaacaaaacaaaacaaaaaaaacaaaacaaaaaaacaaaaccttggtttagaaaggtaggataacttgaagtgggaggctttcaggttataggtagattttaaaattttctgattcacaattggttaaaagagttatatcaatagaaaggaatgtctgggttatgataaggggttgtggagtatcccccccaaaaaaagcctccaagtagcaggcttcagagaatatattgtaaatatttctttcttttttcttttttttgagatggaatctcactctgtcgtccaggctggagtgcagtggcacaatctcggctcactacaacctccgcctcccaggttcaagcaattctcctgcctcagccttcctagtactgggattacaggtgtgtgccatcacgcctggctattttattttattattttattttatttattttattttattttaattttatttttgagacggagtctcggtctgtcacccaggctggagtgcagtggcgcgatctcggctcactgcaagctcggcctcccaggttcatgccattttctgcctcagcctcctgagtagcagctgggaccacaggtgcccgccaccacgcccagcaatttttttgtatgtttttagtggagacgggttttcaccgtgttagccaggatggtctcatctcctgacctcgtgatccgcccgcctcggcctcccaaagtgctgggattacaggcatagccaccgcgcccggccacgcctggctaatttttatatttttagtagagacaggtttcacatgttgtgccactgcatcccagcctcggcgacagagcaagactgtctcaaaacaaacaaaaataaagtgtgtattttttgacctaattaataaaagttcccatgtaataaaattttcaaaaacagtctttcaagtttttaaagatatatgtataaggaagttcatttcagtgatattgtaaaaggaaaacaatgaacaaaacagagtacatcaagaggcttgttgaataaatgatgtgcatctagagaagtcattaaaatgttgaagactttttttattttgctttatttttgtgagatagggtctcactctgtcgcccaggctggagtgcagtggcacaatcacggctcactcagcctcaaactcccaggctcaagtgatcctcctgcctcagccttggtagtagctgtgataccggcacatccctccataccgggctaatttttgtattttgttgtagagatggggtttaccatgttgtcccggctggtctcaaactcctggactcaagtgatcctcctgcctcagcccccaaagtgctaggattagaggcctcagcaaccgcacctggcctgacgacctatttttgtatgactattttataatggtaggatataatgcaatcttttggtgaataaacaacaaaatatctatactcatattatttttaaataggaaagatataccctaaatgattactgacgttttaacaaagtagtgggatagaaggggatttctacttctttgggtttttttctttgatttttacaatgaactcgtattatttcctagtaagaatgtaaatcaagagacaactttttattcatgggaggaattatcaatgtcaagagtcaaaacagataagaactgttaaatagtgcttatggctgggcgcggtggcttattgcctgtaatcccagcagtttgggaggctgaggcaggcaatcatgaggtcaggagttcgagaccagcctggccaacatggtgaaactctgtctctacaaaaatacaaaaattagctgggcgcggtgccgcctgcctgtaatcccagctactcgggagctgagacaggagaattgcttgaacccgggaggcagaggttgcagtgagctgagatcacccactgcactccagcctgggcgacagagcaagactccgtctcaaaaaaaaaaaaaaaaatagtgcttatcatattcagcaaaaagcaagcagcttgtggtcacagtaagagcagttttgtatgaataaatatggtttaaaattgtttttcaaaaaacaaacataaaaaaccaaaaccaaacatttctcaggaattttgtgaggacgaattttgtgtgtggagaaaacggacaaataatttccccatatatttaaatgctcaaaagttcactcaggtgctctcaccaggcaattacatgacaagtgatcacgtgcgaaaatacagagaatctggctcgttttaaagtgcaggagaaagcaaggccttactgtttctgaatttgctgtgtgtgtgtgtgtgtgtgtgtgtgtgtggtgtgtgtgtgtatgagaagatgggatctggctctgaagcgcagacaggagtgcagtggaagatcgtagctcaccgcggcctcaaactcctagattcaagaagtgatcggccgggcgtgtggttcacgcctgtaatcccagcactttgagaggccgaggtcaggagatcaagatcatgtggctaacacggtgaaatcccgtctctactaaaaatacaaaaaattagccgggcgtggggcgggcgcctgtagtcacagctactcgggaggctgaagcaggagaatggcgtgaacccggaggcgcagcttgcagtgagccgagatcacgccactgcactccagcctggtcaacacaagagactccgtctcaaaaaaaaaaaaaaaaaaaagtgatcctcccgccccagcctccgggtagctaggactacaagcatgcaccactgtgtctggcttttttctttttttcttttttttaagttttctgtaaagacggggtcttgctaccttgtccaggatggtctcaaactcctggctcaagcgatcttcctgctttggcctcccaaagtgctgggaatacaggcatgagccacccgacaggccatgttgctgaatttggaaagtggagcaaagaatcatgcaaaaaattaagaaaccaaaacgcaaccaaggcgaattcaattgcatttttttttcccagcgacactttctggacacgaacctctctcttcggcgaacctattccagggcgcccttcattttcatttcttgaacaacagccttgcaggccgagccgctgttcccgagaactcggcagccacagggagcagttgcatggacccaggagcgcgagaggccctgctctgccagcttcggccaatcagaggccgggagcggtgggcgtgacgtggggcggtgcgcggggctgggcggcggctgaggcgcgtgtctcgcgtggtcgctgggtctgcgtcttcccgagccagtgtgctgagctctccgcgtcgctctgtcgcccgcgcctggcctaccgcggcactcccggctgcacgctctgcttggcctcccatgccggtggacctcagcaagtggtccgggcccttgagcctgcaagaagtggacgagagccgcagcacccgctgcatgtcacctacgccggggcggcggtggacgagctgggcaaatgctgacgcccacccaggtacaccgggcggcgggcgtgcagcgagcggcacggcgcggagcctgtgccggcctcctgggtgggacccagcggagacagggccaggggcggtggggaggtcagcctgcgtgtgtcgaggcccccccaggccagaggtcccggggtccatgtcccatgctgggggccaccccgagcaccgggaacccggcctgtggcgtggccaggcaggttcggcctcggcagaaattcattcacttttcccgggcttcagacccaagagggacctaggttcggaacaggccggatccccctctccccccacaggccagggcgctggagagggacgtcgccgggaagagtaggctgtggctgcccggacgcccccagagcttcccctagggcctcagcattttagcctggttttggagggctgaagcctcacccgagagcctgtgacgcattatgtaactggcatgagcgcgccggccgatttctcctttgttaaatgggtcgagagcgtccagccggtacgtggagggcaacggtttagttttggtctttgacctcccacgcccacggctggggctgccgaagtgaagaaactagatttgcagacgccactgctagttggttatgaagctccgggcaacgcgtaaaataaactgccccgaccttacattgttttggatgttcacagaatttaattttttggatgtttaaatatgtagtgcccatctaacacagcctcccttttcctgctccctgccccctctcatcaccttggctttctccttttctttgcactttgaaacgtacagttaatgcagtttcacttcagcaggctccaggtaacctcctgatcaccaaatccagaaacgctgtgattcggacagacaatgtaagggtgtcgttgagaggggactcagtgccagggttggaatcccaccttatctgtttctcttaatagtgtgctgggatactagccccatggtgttgttgggactaaataatatacagcctgggcaacatagcaagaccccaactctacaaaaaaaaattggccggtgtgatggtgtgagcatgtagttcccagctgctcaggaggctgaggtgggaggatcgtcgattgagcgctggaggttgaggctacagtgagccttgatagcgtcactacactccggctgagtgacagaaggagacctggtctcaaataaaatacataacgtatataaaactccagtcctggctcttacagtcaatacagggtcattgattttattaaaaatctattctgttttgctttggagagtctgagatcaaagaaagagtattggtttcttcagcatttcttgtttttggacagagtctcactctgtcgcccaggctggagtgcagtggggtgatcttggccgcctgcgcctctgcctccccagctcaagtgatcctcccacctcagcctcccgagtagctgggattcagattcccgccaccatgcccagctaatttttgtagttttagtagaggcaggtttcacctgttggccaggctggtctcaaacccctgacctcaagtgatcctctctcctaggcctcccaagtgctgggattacaggcgtgagccaccacacccagccagtttcttcagcatttctgattttttactgcaaactggttccttcatacaggttaagaatagacccaccagcatttcgtggatggtcttgattcagggaagctctacaccttggtcctgacagacccggatgctcccacaggaaggatcccaaatacaggtgagaggtgagaaagacgagaagagcaggtcatgcaggatgagttatcgggtgtaagtcccttgctggacacagagaagtagacctggtttgggatcccccacccatgcttaagccagagagtgcctttcctgcccttttgcccccctacagcagtgtctgtaactcacagccgagagccatatccacctgtggcctgtttttatacagccccagagctaagaatggtttttacatttttatttagttatttattttttatttttttgagacaagtctcagtcacccaggctggagtgcagtggcatgatcttggctcactgcaacctccactcccaggttcaagtgattctcatgcctcagctaaccgagtagctggaattacaagcgccaccaccatgcctggctaatttttgtatttttagtagagacggggtttcaccttgtccagctgctctcgaactcctgacctcaggtgatctgcccgcctcagtctcccaaagtgctgggttacaggtgtgagccactatgcccggcctggttttcacatttttaaatgattggtgaaaattgaaagaagaatagtactttatgatgtggaaattacacaaaatttacctgtcagtgtcatcagttaacgttttattggagcaaagctatgtgtcatctgtggctgctttcatgctgcaaggccaagttgaatagttgcaacagagactgtggcccccaaagcttaacaaatttatctctggccttttagtggaaagtttgctgacctttgctctagaaaatgtcagagggtgggggggctgggtctgctcttctgcaaacacatgaggttcgtgctggcctctaagaaagtgagactgggccgggcgcggtggctcatgcctgtaattccagcactttgggaggccgagtcgggggatcacgaggtcaggagttcaagaccagtctggccaacatggtgaaaccccgtctcactaaaaatacgaaaattagccaggcatgatggcaggcgcctgtaatcccagctacttggagcctgaggcagagaattgcttgagcccaggaggaggagcttgcagtgagccgagatctgccactgcattccagcctgggtgacagagtgagactctgtctcaaaaaaaaaaaaaaagaaaggactgttgttcgtggctgtgttgtggcagccagcatgttcttgatgcccagttgtgactgtgcagtgaatgttccctgatctcctgtggtgctgacatcccgtgtttcttcatcagagaatggcatcatttcctggtggtcaacatgaagggcaatgacatcagcagtggcaagtcctctccgattatgtgggctcggggcctcccaagggcacaggttagtaaaggttgttttggtgggaggttggggagggagctcgggggcacattaggattgacccaatgcttttctttgagagcccttaaccctgctggaaatagcatctcagcttacctctagggcagctgcctcagggcacacattcagacctgcagcagtgtcaggtggctagagccttgggttctggacgacggaccctttgtgtagagctgtctctgcacccctagccctttagcaagcagggaagtggtgagagggaagcactgttgcagaaagcttagcatggccttttggggctgcagtgagtgaatacacagttaaactatctcaagcctttgcccggggtgatctttgagtttctttaaacatttcagaaatgatcatagtttccaaattaactatataaggttgctttctgtatttgttctgaaaaagtctagctgggtatattgaaaacagatttggaagacttcagtagaactatttgaaggcgcacacacacacacacacattgtattgtgtagtatcgtgttatagctattaatataaaatacatgtagatatttagagatagaaagagaaagcccaccgtattgaaacttccaggttgggtaagtgccacctaagctgatggtgagatatgcattcttattgcctggtgtcagttcaggatgtttccatttggtggaactgtcataatcctagctttttgtacagctttccagccaggagttaacatgaagaggtacaagaacatctctgacatggacagttggtcagggctcatggtttctctgtagacccggaagcttcagatgcctttaaaccctctcacgcagcatagtagatggtaaagggacagatttcccagggacctagtaagttctctagggcagtataaaattaggcaggttaattatgggaagcttacccatgagaataaggcaattctctcagtaagagctgtgttctcattttttttttttgagatggagtcttgctctgtctcccaggcggagtgcagtggcacgatctcgctcactgcaagctccacctccccggttcatgccattccctgcctcagcctcccgagtagctgggactacaggtgtccgccaccatgcctggctaatttatgcatttttagtagagacggggtttcaccgtgttagccaggatggtctcaatctccgaccttgtgatctacctgcctcggtctcccaaagtgttgggattacaggcgtgagccacgcgcccggcagagctgtgttctcatttttaaaaaagcctcagtaactcattttcttgttttttttccatattcttgtaatatggtataatttacatggtaacaaaatccacagatcggagggttcagtcagcaaatgtgatcaatgcatacacccatggaaggtagcagccattggaagacagatgacatttccatcgcccaacgacgttctcatgtgacctttttacttaaattccccagagctaaccatattctgactcctgtctccataaatcactttcactattctttttttttttctgagatggagtctcgctctgtctcccaggctggagtgcaatggcgtgatctcgctcactacaacctctacctcctgtgttcaaatgattcttctgcctcagcctcctgagtactgggatgacaggcgcccaccaccacgcccagctaatttttgtatttttagtagagtcaggtttcaccatgttggccaggctggtctcgaacttctgaccttgtgatccgcccgccttgcctcccaaagtgctgggattacaggcgtgagccactgtgtccagccactttcgctattttgtgttcatataatggtatcatggaccaggcacggtggctcacgcctataatcccagctgttgggaggtggaggcagttggatcacttgaagccaggaattcaagaccggcctggccacatggtacaactctgtctctaccaaaaatacaaaaattatccaggcatggtggcatactctgtagtcccagccacctgtggggctgaggtgggaggatggcttgaacccgggaggtgaggttgcagtgagctgagattgtgccattgcgctctagcctgggcgatagagcaagccttgcctccaaaaaaaaagtatcatgcaatgtgtattttaaaaaatttgggtgactggtctcttcattccagataatatctgtgagattggtccatagattgtatcaatagttaccccttttattgctcagtaatattcccgttggtgaacaggccagtttgtttagccattctctattatgggcatttgggatgtttccagtatttggatattatgaagaaatatccaaatattatcagtctttttgtttaaacttctgtgtattattctaggactatttagctttgaaaagaaattgggcacatgctacaccaggatgaaccctgaggaacattatgttagtgaaatgagccagcacacaaagacaaataccgtacaattctatgagatacctaaagtagccaagctcactgaacaaagtggagtggctgccatgcattctttttttttttttttttttaaattttttttttcttgagacagagtcttgctctgtcacccaggctggagtgcaatggtgtgatcgcggctcctgcaacctccacctcccaggtttaagcgattctcctgcctcagcctcccgagtagctgaatacaggtgtccaccatcacacccggctaattttttttacttttagtagagacagggttctccatgttgggcaggctggtcttgaactcctgagctcagatgatctgcccacctcagctcccaaagtgctgggattacaggcaagagccaccatgcctggcaaaatttaccatcttaccctttttttgaggctggagtgcagtggtgtgatctcagctcacttcagcctccacctccaggttcaagtgatcctcccacctcagcctcctgggtagctaggattacagacacgtgcaccatgtctggctaatttttatatttttagtagagacggggtttcaccatcttggccagctggtctcgaattcctgacctcaagtgatccacctgccttagcctctcaaagtgctggattacaggtgtgagccactgcgccccctccatcttaaccatttttaagtgtacactacatagcgttaactacattcactttttttttttttttttttttgagatagggtcttactctgcccctaggctggagcacagtggcacgttttcagctcactgcagggctcagctcacctccgggctcaagcaaccctcctacctcaggctcccgagaagctgggactacaggcacaggctcctaccacatccagcaaatttttgtatttctagtagagacggggtttcgccatattgccaagctggtctcaaattcctcctgggctcaggtgaccctcccaccttggcctcccaaagtctgggattataaatgtgagctaccatgcccgaccactacattcacattgttgtgaaacaatctctagatttttcatcttccccaacagaaaccctgtccccattgaccaacagctcccatttcccttcccctagccctggcagccaccattccactttctgttgcagtgtttgtctatttagatacctcgtggaattgtacagtatttgtcttgcgactggctaatttcactaatgaatgttctcaaggttctctggtgtagcatgtgtctgaatttctttttaaggctgaatagcctagagtaacacaggggagtaaagaaaaaataaaaggctggataatattctgttgtgttataaaccacattctgatcatcttttcatccatcagtggacagtcgggttgcttctgctcttggctattgtgaatactgctgcattgaacatgggtgtgcaaatatttaaacaacttttaaaaaataactttgtttctggccgggtgcagtggctcacagctgtaatcccagcacttgggagggcgagatgggtggatcacttgaggtcaggagttttgccaacatggtgaaacctgtctctactaaaaatacaaaaacaaaacaaaacaaaacataactgggcgtggtggcacgacctgtaatcctagctactcaggaggctgaggcaggagaattgcttgaacccaggaggcgaggttgtagtgagccgagatcatgccactgcactccacgcctaggcaacagagtgagatccgtctcaaaaaaaaaaaaaaaaacccactttttaaaaaaataagagctcatggtaccatttgcatccagtacatcattgaagcttgtagaaagctgcttagttaaagtgaggttggtcacttcgaagcagtcctccagttttctaagcaagtaagttttggaggtagaaagaaaagttctcctttatcctagaggctcgactgtggtatggtgggcccgggtcattgatttgcttgtccttaattggttgctcctacctgacagaagtgaaatgggtgttctgatggggggtgtgggtggtgacttgagaaggtccgggagcctgaagtgggatgaatgaagagcacagaggtcgttgggaggcgaggataagggggtgcagaggccagatcccacaggccaggagaggctgaactaagggcttgggcttgacaccagttacagcaggggcctaacacattctattaggtgatgcaaaagtaattgcggtttttgccattaatgtgttaattgccattaaatgttaattgcaccaaatacctgtctggaccctcggtgtcctccttgtaaatggtgtggtctgggtgctccatgttgaaacattcgataaaaatggatgatgtccccatctcaagtgctgggctgtggtacatcttccctctgcctctccccacaggcctccaccgctatgtctggctggtttacggcaggacaggccgctaaagtgtgacgagcccatcctcagcaaccgatctggagaccacctggcaaattcaaggtggcgtccttccgtaaaaagtatgagctcagggccccggtggctgcacgtgttaccaggccgagtgggatgactatgtgcccaaactgtacgagcagctgtctggaagtagggggttagcttggggacctgaactgtcctggaggccccaagccatgttccccgttcagtgttgcatgtataatagatttctcctcttcctgccccccttggcatgggtgagcctgaccagtcagatggtagttgagggtgacttttcctgctgcctggcctttataatttactcactcactctgatttatgttttgatcaaatttgaacttcattttggggggtattttgtactgtgatggggtcatcaaattattaatctgaaaatagcaacccagaatgtaaaaaaaaaaaactggggggaaaaagaccaggtctacagtgatagagcaaagcatcaaagaatcttaaggaaggtttaaaaaaaaaaaaaaaaaaaaagattggttgcctctgcctttgtgatctgagtccagaatggtacacaatgtgattttatggtgatgtcactcacctagacaaccagggctggcattgaggctaacctccaacacagtgcatctcagatgcctcagtaggcatcagatgtcactctggtccctttaaagagcaatcctggaagaagcaggagggagggtggctttctgttgttgggacatggcaatctagaccggcagcagcgctcgctgacagcttgggaggaacctgagatctgtgttttttaaattgatcgttcttcatgggggtaagaaaagctggtctgagttgctgaatgttgcattaattgtgctgtttgcttgtagttgaataaaaatagaaactgaatgaaggaactgagtccccggatgttttgttctattgggtataggtttcataagtggagaagtcaagtctcagggtgagtcgtctccgtgaccagcaagtaacagctgggacttgtctaggggccatatggagggtctgtgcctctacatgtgccattaacccacagcaggagcaacagttcagatttgaggtttctaaaaaaaaaatcataaaatgtgaggccgagtcttatgcccaaaaagcacctttgcttcaagtggtccttttgacccaagaaggatgttctaaagagatggctgaaaaccttcccccttggtgaagtctggcgcggacactgtaacaatgcctaaaagtagcctgcacttcccgttctgatgtgttatccacagaggctcagtaccaaagaggtcgcagggtaggagggtgagaaggtcacggtctcatgccatctgatgtaccgaaagaaagaaaggaggtgtttgaaggtgcaaatcactgtgatttggtctctgcgatgcaaagggggggtcctgaatcaggcctgacaggtgctaatgactagcccttccccatctttcactgcagtcttttttctctgaaaaaacttggaaatgttgccttgctggaagcacataaggtagatgtagttttctttttttctttttttaatttttttgagatggagtctcaccctgtcacccaggtggaacgcagtggaataatctcggctcaccgcaacctccacctcctgggtgggttcaaggattctcttgcctcagcctcctgagtagctgggattacaggcatgcaccactatgcccactaattttgtatttttagtagaaaaggggttttgccatgttggccaggcggctctcaaatcctgacctcctgaccactttggcctcccaaagtgctgggattacaggcatgagccacctgccaagcctggaagttttttttttttttttttttttttttactttagagttctaaaatcgtttttttacgtaataagattttgttgaacacaagttacaaagaaaacaactgtcagcgggcgccgtggctcacgcctgtaatcccagcactttgagaggccgaggtgggtggatgactgaggtcaggagttcaagaccagcctggccaacatggtaaaacaccatccctactaaaatacaaaaattagctggacatggtggcgggcgcttgtaatcccagctactagggaggctaggcaggagaatcgcttgagcctgggaggcgaggttgcagtgagctgtgatcgcgccatgcacttaagcctgggtgacaagagcgaaactctgtctcgaaaaaaaaaaaaactgtcctttgaccttggaaataaatgtaaagtctgggcatggagactcacacctgtaatcccagcatttgtgaggccaaggtggggcagatcaccagcctgggcaacatggcaaaacccctctcttctaaaaaaatgcaaaaattagcccgatgtgtggactcgttcctgtagtcccagctactgggaggctgaggtgggaggatcacttgaggtcaggaggtcaaggctgcagtaattccagtacttgggaggtggaggcagaagaactgcttaaacctgggaggtggaggatgcagtgagcaacatcacgccactgcactccaacctgggtgacagagcgacactccatctaaaaaaaaatagaaaaagaaaaacatattaatactaacacggaactaaagagaaaaaaaaatacataatatgagaaggcagtagtcatctaagaaagaagggtgatgccttcaactggtatgtgattgaacttccccaagggcggctaggaagggggtgacccccattctgaactcaactctggctcaaggtccagctgataaccaccgggcccactgggtcacaaattccagcttcctcatttaaaaaacatcagggttgcagggggttgtcagcctgccttatttacctcacagcgttgttgaggacaaaatcatcttttttgggattaagagttaatgtatgtaaatgactaaacttggctgattgtcatataagaacaaagtacaaaagtccagtttcctcaggtctgtttcctcacgcagcctccgcctcctgggttcaagcgattctcccgcctcagccttcctagtccccctgcttccttactgcctcctcaggcaggtactaggaggagtaggacaactctgtccatagcagtgtttgttaggagcagggacccacatccctgcttccgggtaactgccctgggacacatcttgacaaacttgcgcagtgggacttttttttgagaccgagtctcattctgttgctcagctggagtgcagtggtgccatcttggctcactgcagtctccgcctcccgggttcaagcgatctcctgcctcagcctcccgagtagctgggattataggcgcccaccaccacgcccggctatttttgtatttttagtagagacggggtttcaccatgttggccaggctgatctcaaactctgacctcagatgatccacccacctcgatctcccaaagtgctgggattacagctgtgagcaccgagaccttttctaaagatagcacctacaatctcagacatagggccctttcccaaatagctagacatttctcaccacagtgagaaatggatgaaagaggctacaggaagcttttcaccctactgaaggtggaatactcctttgggtatagatcagacaggtctcgattcagacccaccctgccactggagtgagcttatttcttcatttgtgaaagcctagtgttccatcatgggcaagcgtaagcacgccatcgacgttatctgtttctctaaccctttccagtattatttcagatgtacctaatatagaaactccaatgaacagaggtacttaggaaacacaattatcatgagtgtgatgttacagaaggttttgtagttgggattaacccatgttgataattatttagagtatacctttctgctttagcctatcagagtgaacatgactggtcacatttgtctccgtacatgaacatcctgtaggaaacaagagtgatctttaggtcatcatattcttttcttttaaacagagtttcactgttgttgcccaggctggagtgcagtggtgccatcttggctcactcaacctccgcctcccacgttcaagcgattctcctgcctcagcctcccgagtaggtgggatacaggtgcccgccaccacacccagctaatttttgtatttttagtagagatggggtttcccatgttggccaggctggtcttgaattcctgacctcaggtgatccacccacctcagcctccaaagtgctgggcccaccccacgtcatcatactctaaagagcaatttccaggagtgtcaagggagagaacacaagtcatgggttcttagtttctgtttctggttgggccagtaaagcccttcctcgtcccccttttccatttatcactagacacagaaaccaaaaaccatagcttcggctgccaaaagcctagaacaaaacaaaacagagtaacaacaaaataaggtgggttggaaagcctgattgatagaggcttaagcatttgggatcttactgagattgtcctgactcccaatcatatccctgaaattttatattttttactatctcattgttttacatgtaaaattatttaataaaagcagaatatgaggggagagggatctaatattacagtggggtcatttcaaattttggttatagtgccttctccacagcctgcttttctttaagggtgcccaatttctctctcagcaatgcatgcttctatgcacgactggcacgtggggggttttgtgtgtgtgtgtgtggtgtgtgtgcgcgcgtgcgcgcgcacatgccttctattctttaggacagaaaggtgcagtgaccacgtgcccacatcgaatggtgcaacactatcttcagccccatagaagaacttggagacagagctttacctgaaaggcttgaatggctcttcttggagcgaccgaggctatggaaacagtttcaggagggtggctgtccctctgagttgtgaactggtgaacctagaagggaacttcctgctacaataacacagcaaggcgatgtgatgaacacttttatttacaaatataataaaagctctgacagttatcatgctcttccttggaacctgaaaaatgttttgttttgttttaaagtgcatgcaaaagaagtaaagcctttttttttttcatcattttttattgtaagaaatacacagtttgaaagtgtgaataatgcaatatttatgaccaagaaatgggacttaggaggggaagggagataaagaaaaagatcaagatgatctgattgagagacagtgttgaactcaaatactgaactggaaaaggagggaggtggggaggaacaggaggaggaagtaaaaaaattgatcagagaaacagttaaaatacaatatgaaaataagtaatacctctccttaaattcttctatacacaaaatacacgatttgccaaagcccaatttgtgctactgggattctgtgactccttaagtgtattcacatcctctgcaacagcagaaaatgattatgatacaatcagaaatgctgaagacaagttaaactcttgccagcaggttcttaaaaatcacaagatctcttcacccacccaccccccgtccccaaaaaagtaataatatgtcaccactgatatgtacatcacattagtttctgtaaaatgtatcaaattttcaatctttaataaaactttgttttttttatcctgatgaataaataccaaaaaaataaaataaaataaaataatgcagcagctagttaagtgtaaggctgcggatattgtgtctctctcccccttggcatttattattattattttttgtttactttcacagattggtggtaatgagtgattgcttaaagcaatatacatccacttttttgttgttggtttattggttttgttaaaactgtctccaaagttttcactgaaacattttaatcacatcaatactgtgacgtgtactgtgaatagaagagacggccaggttttggccagactgaaagttgacacggggggaggaagggggcccctgatggagtaagaataaacaggcatagtccgacacgatgtcagtaagagtaagagagagagagagtgagagcaacgcccgttaaatggggaatgtggttttgcagggtctgaatttttttctgttttctttttttttttttttttgtaaatggcaaaaaatttaatctcatctgtagtcctccttaggaaaatctaatgtaccaaattcccaaatcccattctgaggctctccatgtcaaaagtttcaatctctcgctctgcctttccaataggttctttattctctcgctgcgttccttctgaagggcagccagctcccttcaatctgaaagaagcacgatgcagttcttaatggaaagcatctcctaacaggcaccacgtgcacgcgatacacccataggcacacatatgacatgcacacacacataggcacacaatgaagtgcgcgcgcgcgcacacacacacacacacacacacacacacaggaactacgggggaccgaggaaggctggctgagtcctgtgatcaatgcatctaaatcattatatttaaaattgctcacaagaatatcaatgtttggggtccacctggggctggcaatgccgttctagcagcccagcggctgggcggatctaggtcagtgtcctgtgttaggggatggctcatgagaagtaaaagacactcaagcacaattggattgtgctgctttcccacagagagccaaatgcctctgggtcattag

SEQ ID NO: 5093 - DNA, 12766 bp, Homo sapiens
tacttgggaggctaaggacggagaatcgctggaactcgagaggtggaggctatcgatagtattgggtttgcaatctgcggaggctttctaaaagcaaaagtgagaaacctctttctttctctttttttttttttttttttgagacggagttcactcttgttgcccaggctggagtgcatggcacgatcttggctcactgcaacctctacctcctgggttcaagcacttctcctgcccagcctcccgagtagctgggattacaggcatgcgccaccacacgcggctaattttgtattttagtagagacggggtttctccatgttggtcaggctggtctcaaactcctgacctcagtgatctgcccgcctcagcctcccaaagtgttgggattacaggtgtgagccaccgtgcccgcctctttctgtactcttatcctcgatttcttttttttctttgtatttttagtagggacgggtttcaccatgttggccagcctggtcttgatctcctgacctcgtgatccacccacctggcctcccaaagtcctgggattacaggcataagccactgcacctggcccttcttatcctgatttttaggtgcccaagactactgatttgtagtcaaggtcaaaactatcagggttcagaaccaatctccacacacacatgcaagcattcacactcctacaaattattgttatttaaagaatagtagatgctcattatgaaatataaatttcctataataaactagacataaccaattcaacatattagttcctttcattaaaaaaattaatgtgaaaatatatttatattatgtacttgcattactgagataatttagaatatgtgatgtctagaagtttaaaatttagaaactttatacttttatagttatatattataaatatcaatatatatgaacatattataaatatagtatactgtgtctatattatatagaatgcaattaaattagatataacatacttataatatatttatatattacatatgattatgtcttatattttatagttttacagttatatatttaatagtatgtaccttgcatttctggaataatttagaacaatgagaggtttagaagtttaaatttagaaaccatactatagttttctgcttgacattaaaaacaaacagattcagaaacataatcttatttcttattataaaatggaagattctacatgagtaaatgttataatgaacatagcctttatgtgccctactttttctttaatcaattttgatgaaagcatttctaaatttattacataattttctaatttttaaaagtaactgaatatgcatacataacctccttaaacaagcatatgaaatgtgaatatagaactttaaaactgaatagaatgaatatgtttctagcgcattaaatgttttaaattacatgtttaaaaactcagcatttttgtcacaaatatttttcccctattattctataacacaaaggcacctgagatggttgtttgctcctgacactaaacgctctggctgctctgcctttaaatgattagctctgccttctagctcccctgactttttcgtatggttaaattattcttgtgcctgtttgtatgcatgtatctaacagctcagttccttgagctctttctgattggtctatcaaaccagttgtagacagaaaccaggtagccatgcttttagcagtctatataatctaagaataaacaggtggccgggtgcagtggctcatgcctgtattccagcactttgggaggcagaggtgggcggatcacctgaggtcgggagttcgagaccgcctgaccaacatggagaaaccccgtctctactaaatacacaaaattagccgggtgtggactccggtggctgagacaggagaatcacttgaacccgggaggtggaggttgcagtcagcgagatcgcgccattgcactccagcctgggcaacaagagcaaaactctgtctcaaaaaaaaaaaaaagagaaaaacgagcttcaagtaacagtgtgaaggattttctgaagacttgaaaacatgagattttagcacttggattttgtaacatttattctgcctgcttgaaatccctttttgactccttcaagacagctgagattgccagagaactgatttctagacaatgagatatgctttgattaatttcttattttcagaatggaagcaatagctctacataaaagttccttgacagaaatatgtatgtttagtatactgtttgatagtctatttaagaacaaaattccattcctaattagagatcacatacaggaaaggagttggtacatggtaaacaataaatgctagttaattggagtttaagtaggaatgtgcaatttgaaaaagtagaaagcataacattttcacacctaaatgtgcctaatgtgccaacctaaaaccagaaatacaatcatataaaaatatactagggccgagcacaatggctcatgcctgtaatcccagcactttgggaggctgaggcaggtgatcacctgaggtcaggagttggagaccagcgtggccaacatggtgaaccctatctctataaaaatacaaaaaattagctgggtgtggtggcatgtgcctgtagtcccagctactcagaggctgaggttcaagaatcacttgaacccaggaggcagaggttgtagtcagctgagatccaccactgcactccagcctgggcaacaagagtgaatctgtctccaaacaaacaaacaaaaaacaaaatatatatatatatatgagtgtgtgtgtgtctgtgtgtgtgtgcatgtgtattatatttatatatatatatcacaataagatgacagagtggaacaaaagtctcttattttatcatatggtggcccctgtttggtaaaaatcacatagcaattaaaacatcaagaacaatccaaatatggggggaactggagtggaggatgagaaatgacaaagataaaaattctaggagagaatataaggctgtgccttttacttttacaaacaaataattataaaatgatgtcaactttcaccatctctttctgagtgtttatagaatggaatttctaataggctagatatcattaatcttacagaatatataccaagtgacacaccaaagtattaacaaatgttaaatactgaaacaaaagttaaatggaacagaaatgaaattagtaattttacagatcaaatagataaaaaaaaaaaagaaaaagaaaaaaatgtaatagtaaaagataatagaggtccttcgacttaccaagcagtgtgttctttcaagtaacagcctttgtactcaatagtattaggatgcttcaatgtcgtaaaaatttaacttccttaagaatatcttgccatttctattgaagtcagaaaagaacattttaatttaatttttgataggaaaatagtatttcctatcaagtatacgtatatacatttatattattgtaaatggacataaagtaaatgtttaataaatgaagaagctatttaacatgctatttctttctctctctctttttgtttttaattgagacagagtcttgctctatgcccaggctggactgcagtggcacgatctcggctcactgcaacctctgctgcccggttcaggttcaagtgattctcgtgcctcccaagtagctgggactacaggcgtgcaccaccagacaaactaatttttttgtatttttagtagagacgaggtttctccgtgttggccaggctggctcgaactcctgacctcaggtgatccgcccaccttggcctcccaaagtgctgggatcacggcgtgagacactgtgcccggcctaaacatgccatttctttagtttgaatacatgtaaaacaaatctatcaccaaatacattacaaaaaagccattacacatacccatgttctggtctcaaaatagtttttttccttttcaggcacccaggctagagtacagtgttgcagtcacagccactgaagcctccacatcccaggctcaagcaatcttcccacttgagcctcccgagtggcggactacaggcacacaccaccacacccagctagtttgtttgatgttttgtagaggtgggtctcaccatattgcccaggcttgtcttgagctcctgggctcaagcgatcctccagccttgcttcccaaagtgctgggattacaggcctaagccacctcatccagcctgcaaaatagttattgagctagaacattagcctttttaaaaataattatgaatgttcacacatttgtatgaaaacttcaggaacttttattatatgctccacaagaaggaaaaaaaaattgttctaaaaaaagtttaaagaattttgttaatttcttttttcttttttttttttttttttttgagacaggcctcgctctgtcacccaggctggagtgcagcggcgtgatctcggctcactgcaagctcgcctcccgggttcacgccattctcctgcctcagtctcctgagtagctgggactacaggccccgccaccacgcccggctaattttttgtatttttagtagagatggggtttcatcatgtagccaggatggtctcaatctcccgacctcgtgagccgcccacctcggcctcgcaaagtgtgggattacaggcgtgaaccaccgcgcccggccagaattttgttaatttcatactaactgtttatttcagtttaggtatacaactgtctctatctcacctcatgggtctgcttcccacataggacatcttcttaattgccaccacctcattggtgtgagcatttgtagcctgtgttagagggtagaagaaaaagaaaaagaattagtgatgtttcagccaatttaacttaaatattgactagagactatttatttatatatttatttattgacagtctcattctgtcgctcaggcggagtgcagctcactgcaacctctacctcttgggttcaagcgattctcctgtttcagcccccaagcagcagggattacaggcacgcaccaccatgccacgctaatgttttttgtattttagtagaaatggggttccaccatgttgaccaggctggtcttaaactcctgacttcaaatatccgcccgcctcggcctcccaaagtgctgagattacaggtgttttattttatttttgggaaagaatcgagctgtgttgctcatgctggagtgcactggggcacgatcttggctcacttagcctctgcctcccgggttcaagctattctcctgcttcagcctctcaagtaactgcggttataggcacccaccaccacacctggctaatttttatatttttagtagagatggggtttaccattttggccaggctggtctcaaactcctgacctcacgtgatctgcccgcctcagcccccaaagtgctgggattacagacgttagccaccgtgcctggcctcatattatatttaaataatatctccatactgcagtatcacagttcaaagatgcttcactttttgataggctaaaagacatctccactcccattttaatgtatagtttctctatattcttttctggatacatgtaagattgtaatataaaaaatgattagggtttaatatatcaaaccaaacaaaaaatgtcaattcccaaatgacccattctggcttcaccttgtaaactgtccatcaatggagaaccagtaaataaataaatatgatatgaccatataataaaataaccacttaaggaatgaggtaatcatgtgcaatgcaatatgaaaagatgttaaaaatgttttggtcaaaaacaagctataaagagaatccaatttttgcaaaatagtaataatgtgagtatacgtgtagaaaaaattataaagaattgcttcttttccgagaaaacaacaaatggcggatgacgccggtgcagcgggggggacggaggccctggtggccctgggatggggaaccgcggtggcttccgcggaggtttcggcgtggcatccggggccggggtcgcggccgtggacggggccggggccgaggccgcggagctgcggaggcaaggccgaggataaggagtggatgcccgtcaccaagttgggccgcttggtcaggacatgaagatcaagtccctggaggagatctatctcttctccctgcccattaaggaacagagatcattgatttcttcctgggggcctctctcaaggatgaggttttgaagattatgcagtgcagaagcagacccgtgccggccagcgcaccaggttcaaggcgtttgttgctatcgggactacaatggccacgtcggtctgggtgttaagtgctccaaggaggtggccaccgcctccgtggggccatcatcctggccaagctctccattgtccccgtgcgcagaggctactggggaacaagatcggcaagccccacactgtcccttgcaaggtgacaggccgctgcggctcttgctggtgcgcctcatccctgcacccaggggcactggcatcgtctccgcacctgtgcctagaagctgctcatgatggctggtatcgatgactgctacacctcagcccggggctgcactccaccctgggcaacttcgccaaggccacctttgatgccatttctaagacctacagctactgacccccgacctctggaaggagactgtatttaccaagtctccctatcaggaattcactaccacctcgttaagacccacaccagagtctccgtgcagcggactcaggctccagctgtgctacaacatagggtttttatacaagaaaaataaagtgaattaagcgtgaaaaaaaaatttaaaagaatttataccagaatatatatcagtgataatccctggagcagtgctatctgatgaactttctttgatgatgggacagttctatttctagattgtccaaaagagtaacatgtgaatgtggctagtgtgactgagaaaataaattttaaattttaatagttaacgtgcctactgctattgtattgaacagtacagcagaaagtaagattaatcctaagggggactttggtttcaggattacttatattttataataagactgtattacatatatacatgcctacatttatgatgtatatatgtgtattttttatctatagaggttgccttgtctcataattatgtctactgtcttctccatactccaaatgtaacagttcattgaaagtacatatgaaaaccattaatattcaagtaatagtcttttcctctcaacttactcaagatatacatatatatatatacacaacacacacatacatacgtacatacttttttctttttttaagacaggatcttgctctgtctccaggctggagtgcagtggtacaatctcagctcactgcaacctctgcctcccaggctcagtgatcttcccaccacagcctcttgagtagctgggattacaggcggccaccaccacgctggctaatttttatatatgtagtagagacagggtttcaccatattggccaggctggtctgaactcctggcctcaagtaatccgcccgcatcagcctcccaaagtactggaattatagggtgagctactgctcccagcctcaacttatttaaaatatttaaaactattagttttcttaaattttcataaaaataaatacaagacattaaaagattacctctgcatcagtgccataccctaatgtaagtaagctattttgcttctgtcacattattatcattgtggaccaataaagcatcgcagtggttctgaagtaaaagattggaattcattcactgataaagtcaggttaacattttagagaaaaattcataatcattttcttaaatacaactaatttaaaatgaacctcttagatacaatggtttctttatgatttttaaaaacggttaattcaaacaataaacaataattagtatgtacaaataatttgaccacagattcttatggaatgtcaaaatgaaaaaaaaaaaacccacaataacgtactacaggagttttttttaaaaaagcattaaggtaaaagtacctttatatattaatgagttatccactagacataattttccagtctgcagaactccacaaaacatattttagatattttattgatttagaaagtacagaatgacttttgttaaaaacaaaatctctaacactgttctggcttttaaactttaacactaaactgtgcttatatggcaatcaaaataaaagctgatgtaaattcagtattacaataaaggttaaagggactatatctgaaagtagatatttgaggcatcaatatatatagtgcagcttaaggagcctgagaaagatttagaaatattcaggcaatgagaaattttaacttcttgtgaggttttaaaaaataattaaccatactaaaaaatagaaaagcccacagaaataaaatcagatagtattattatttaattgctattaaggttatttataattaatgctatatttggacctaaaaacatgaaaaataaccacctaaaataaaaatatatttcttacatttataggataatcactgattagaacttaatgcttcactcacttacacatcctaatgtataggcagagacttgaaatttgaaaaacatttccatttgattattctatagatgtgaactttttagtgcaaatgttaattttgctatagatgtgatttttatactggctaaaagtcaaaacatgctagatagaaacttaaaaaaaaatcaatgtttagtacagaaaaaggagagtatcaatggggtctcagctttctagtgcatacagtactagaatgactacagcctctatcatttcaagttttattcttgaaacttacattcatgcttaaacttccaatagtctcaatggtctcagtaactattaccaagatcattgattcaagaaatattattaagaacttactattatgtgtttatatttttaaacattttacagctataccttttctattttatagacaaatataaaaaattatgttaatttaggaggcaggccaggcatggtgctcactcctgtaatcccagcactttgggaggccaacgtgggtggatcacctgaggtcagagtttgagaccagtctggccaacatggtgaaagcctgtctctactaaaaatatgaaaatagcagggcgtggtggcacacgtctgtaatcccagctacttgggaggctgaggcagaagactgcttgtacccaggaggcggaggttgcagtcagccaagattgcaccactgcactacagctaggtgacagagtgagattttgtctaaaaaaaaaaaaaaaaaaataggaggctgaggcggaggatcacttgagcccaggagtttggaaccagcctgggcaacatagcaaaaccctgttctacaaaaaaattaaaaccaaaattagctgggtgtggtggcacatgcttgtagtcgtactacctactcaggaggcagaggcagtaggattgcttgagtccaagggttcaaggttacatgagctatgatcacaccactgtactccagcttgggtgacagagtgagagaccctgtctcaaataaatgaataaataaaaattttaaaagtgaaaaagctttctttttgccctatttttgaaccccaactaaaaggtaattatatccagaaagatagaattaaactatttgctttagggggttatggataatatactgagttcaacaaaggtgatctagaaacctacaaactttagattgtgtttaggtgaatacaaaaatgaacatgcgcagtcctttttttgtttgttttccttagtacagtttcttactacctcatttgttaatgctgctaatttattctttatttttttaatttttttttagagatgggttcccactatgttgcccaggctggtctcgaactcctgggctaagtgattctcccacctcggcctcccaaagtgctgggattacatgtgtgagccaccacgccaaccaatgatgcaaatttcaaaattacttacgtaaatccaaacacacagaaatacttatcaagttaataatttctgttttctctgaacataacatatactctcagctgattgatttacaagagctgttccagcttacaattcacactaagtttattccctggcagcattcagtgtaaaagctgtgacctacagaggctaacagaattatagtgtttaggtataaaaatactagcgccagactctggtctttatggcttgccagcatgactatgacttatgaaaagtactaattgcagtaccaagttctcagagttcttcatcattcattcattcaacaaatacttattagctcccacaatttatcaggaattgggctaagtgctagggataagatagtgagttaatatgccagtacctatctctcctctaggaggatagacaataacaaaaataaaacaataaaagacaaatgtaaaactgcaattctgatatgtgccacaaagaagggtatttgttactttgagaaccacaacggtggatgtgacttagggaggtcaggaaagccttccctgaagaaatgaggtttagctgagagctaaatgatgaacaggagttaagaaggtgaaaatagaagggagaaatattcagagagaacagtttacgcaagattccaggaaggatgatcagaagaaaggaatcagagctcagcaatgagaatgagagagaagatagctcaagtagagatagggaccatgaaggacctttgggctggctatagtagggattttgatcttggcctaagaacgagggagagcccctaaagctttatagggaaaggggatgggatgagatttacatttcttttttcaagctcatcgaggttgcacaacagactgaagagaccaaagcaggcaatcatagttgtccaaataagagatagcgagtcttcctggtaataatggtacaagtaacaaaaggaaaaatctattagcacggagtagaagcaacttatataaatactactttggccaacaggaaaatccatttttaaggtactgccatgtgaccactacagataaaaggttaaagcttttcgtaagttctatagtacagtgtcattaattcccttttaatctgttttttagtgctttatgggtgtacataggcctgtacttttacatttatatacaggccctatagagttaatgattacgtttatcaatgccactctgctactgtatcatttctctagtctatcatcagcaacaaataatatatatttagtgcctactgtaatgagatcgtgccagcctttagagttgtaaacaaatattagaaatagtcctcaccttcaaaacgcacacactctagctaaatagacagggcttagcccaaaaagcaaataaaccactagtcttctgcagcctagtacaacgtaggtctcattttgccactattataaatggcttttataagtttcaaagcatgcttggtttattgtagtcattctgaaacattagcactttaagaaggtttggctgcttttttttttttttgagacagagtctcactctgtcccccaggctggaggcagtggcacaatctcagctcactgcaagctccacctcccgggttcacgccattctcctcctcagcctccccagtagctgggactacaggcgcccgccaccatgcctggctaatttttgtatttttagtagagatggggtttcaccatgttagccaggatggtctcgatctcctgactcgtgatccacccgcctcggcctcccaagtgctgggactacaggcatgagccactgcaccggccttggctgctttttaaatgagaagagtcaaatagagactgactcttgccaggagaattctgagaagatgaattagatttaaaataatagaagaaaagaaagcaaagatgacagagaatacatctgtaagcaaaacaaacaggtcacaaatgaatatatacagatgtttccattttaaaaagttcaaaactaagcaaaaccaatttacatttttaggagtacagattaagtggttataactataaagaaaagtaagaaaataatcaccataaaaatcagaatggtggatactttaaggggacggagagggttctgactgagggagacataaagaggggcttttgggatgctgcagtattgtatttcttgatctgggtggtgtttttacacagagatttaccttttaattcttctgaagttctatattaaaatagatatgtatattgtatatacttctttatgtatactttaataaaaacgctttgttaacaagaggacctgagactaaagaagacagaactttgggcctaaatgatattctgactacacactaacaagggagtgttaactaagaaattagcaccctttttcttttcttttttttttttttgagacagaatctcactctgtcccccaggctggagtgagtggcacaatcttggctcactgcaagctctgcctcccgagttcacgccattctcctgctcagcctcccgagtagctaagtagctaagtacaggcgtccaccaccatgtccggctaagttttctatttttcagtagagacggggtttctccgtgttagccaggatagtctcgaactctgacctcgtgatccgcctgcctcagcctcctaaagtgctgggattacaggcgtgagccatgcgcccagccgaaattagcac

SEQ ID NO: 5094 - DNA, 12724 bp, Homo sapiens
ttcttcctggtttagtcttgggagggtgtatgtgtcaaggaatttatccatttcttctaattttctagtttatttgtgtagaggtgtttatagtattctctgatggtggtttgtattttgtgggatcggtggtgatataccctttatcattttttattgcgtctatttgattcttcttcttttcttctttattagtcttgctagcagtctatcaattttgttgatctttttgaaaaccagcttctggattcattgattttttgaagggtttttttgtgtctctatttccttcagtctgctctgattttagttatttcttgccttctgctagcatttgaatgtgtttgctcttgctctctagttcttttaattgtgatgttagggtgtcaattttagatctttcctgctttctcactgggtgtttagtggtataaatttccctctacacactgctttgaatgtgtcccagagatctggtatgttgtgtctttgttctctttggtttcaaagaacatttttatttctgccttcttttgttatgaacccagtagtcattcaggagcagtttgttcagtttccatgtagttgagggttttgattgagtttcttaatcctgagttctagtttgattgcactgtggtctgagagaagtttgttataatttctgttcttttacatttgctgaggagtgctttacttccaactatgggtcaattttggaataggtgtggtgtggtgctgaaaagaatgtatattctgttgatttgggtggagagttctgtagatgtctattaggtccgcttggtgcagagctgagttcaattccggatatccttgttaactttctgtctcgttgatctgtctaatgttgatctgtctaatgttacagtggggtgttaaagtctcccattgttattgtgtgagagtctaagtctctttgtaggctctaaggacttgctttatgaacctgggtgttcctgtattgggtgcatatatgtttaggtagttagctcttcttgttgaattgatccctttaccattatgtaatggccttctttgtctttttgatctttgttggtttaaagcctgttttatcagagatgaggattgcaacccctgccttttttgttttccattttcttggtagatcttcctccatccctttattttgagcctatgttgtgtgtgcacatgagatgggtttcctgaatacagcacactgatgggtcttgactcttttctaatttgcccgtctgtgtctttttactggagcatttagcccatttacattaaggttatattgttatgtgtgaatttgatcctgtcattatgatgttagctggttattttgctcattgttgatgcagttttttcctagcctcaatggtctttacaatttggcatgtttttgcagtgctggtaccggttgtgcctttccatatttagtgcttccttcaggagctcttttaggtcagcctggtgatgacaaaatctctcagcatttgcttgtctgtaaagtattttatttctccttacttatgaagcttagtttggctggatatgaaattctgggttgaaaattctttcctttaagatgttgaatattggcccccactctcttctggcttgtagagtttctgctgagagatctgtgttattctgatgggcttccctttgtgggtaacccgacctttctctctggctgcccttacatttttcccttcatttcaactttggtgaatctgacaattatgtgccttgtagttgctctctcaaggagtatctttgtggcgttctctgtatttcctgaatttgaatgttgacctgcctgctagattggggaagttctcctggataatatcctgcagagtgttttccaacttggttcattctgcccgtcactttcaggtacaccaatcagatatagatttggtcttttcacatagtccatatttcttggaggctttgttcatttctttttattcttttttctctaaacttctcttttgcttcatttcattcatttgatcttccatcactgataccctttcttccagttgatcgatcagctactgagtcttgtgcattcgtcatgtagttctcatgccttggttttcagctccacaggtcctttaaggacttctctgtattggttattctagttagccattagtctaatttatttcaaggtttttaacttttttgccatgggttcgagcttcctcctttagctcggagtagttgatcgtctgaagccttcttctctcaaattgtcaaagtcattctctgtccagctttgtacgttgctggtgaggagctgcattcctttggaggaggagaggcactctgatttttagagttccagtttttctgctctgtttttccccatctttgtggttttatctacctttggtctttgtgatggtgacgtacagatgggtttttggtgtggatgtcctttctgtttgttagttttcctctaacaggaccctcagcttgcagcagatttttaaaagaacttccaggaccttgtctgttattgacgcctatgtcactacaggaatcagagcagggcattacattgatcctttaagaaattttgctaccctataccccttgaccctactctttttttttttttaatttttaaaggtattgttagaaatttcccaaggtttatttgaaatgacacaccactgaaaacataacttttaagatgatttgtggatacagtacacatcacctatcttactttaggacagtctgtgaagatatatttttcctgctgcagttcctttgtcaagtgactttagacagatacaggactgcaaggtgactcaggtcatgctggcataggagaagcaggtgctagtgtttcacttgaactagttttgggctggggtggaatgaaagctccctaggccatgaggacatctttgcaatgtggagagacccaaatcagtgggtgttgctctttgaatgttgaaggccttgtcagcatactggtcaccagtttcatcatcacttcatactgtttgtaccaaagcaccacagtttccttatgaaactagcttcaaggctggagatgtttttgaaagtattaatataaaatccaattcgtcttgacataataatggtaacttttcttgtaagtcaccattaaactcttcaaactttctctatgcttctgaaattctacttctgccttagacagaggctcctatccttcctcctgaagctctgttagcccgatggaggtgggcaggcactgtcatagtccgtcagcttcctgctgcacttggtgtgtgattcttcaagtcaggaaattggtccaggtagttttccggtgttagcaaggatgcaccatgagttttttgtggatatcctcccagagcacatcacctttctcaccaaccattttccaccttcctgcccagaccaatccagcgcacagacttcacacagtgactcagcttcgtcaggtctcttgaatgcctttgattgcttctaaacatcctcagagttctctcaggtctggtacctctgcttcttgtggcttgaagttctggacatattcttcaaactgtttgtcttttgtccagcagctttccctggcttctggaggacgttttcctgtgagtggctgagtctcttccagcattcttggcaaagatgccctcttgatgttggccagggctgcaggtccaggacctgggagagctgagcgctcagtgtggctggtggcgtggaggggcgggaggaagtggggaggatcagaggaggggtgaggtcttcgaccctactgttgatatgttgttcagggaccatcgggagccagagctctgctctgtttcacgggactccacaaagagaactgcaagtcccagtctttcactctcttggactttttatcttgtctcttcatcacatctcttcagtataaggaagaacagaagggaggagagaaactcagggttgtcagtcaaatgtgtccatttacagaatttataaatgtattgttatcctagttatctttatactagcctgctatggcaggtttcaggatcactgacctagagggtgagtcaagaaagattttctttgatgtggcttagatccccctgaattcatcccaaaagcccaagggaagaaagaacaggattaagtatacattgcccatatcttggaaacaatacagagagcagtaacagacagaagaactagcagacacacagaaagacatgggtcctttaaattttatttattcattttaatgaaaaattatattttgttaaaaatggtctatggagaagttctgtaatacagtagggaataagaactatgttatatttaccatcctcgagcaacagtcaagaagctacaaaagagaaaggcaaatttcacacacagccaagttgagtaaaaaaacaaaatcttttggtctaatcagataaagatcatttactagcctggaaactattgtgaggtattattttatttttgttttctctgtgttatttatacatcccaagaatcctaaaaatccccacctttctgtgatgaagagtaggtgggcagccatagatcactgagtgtcagtatacagaggccagagatgaggggcatccagctgactggtcactgggtggccccttgtgtagccaagcacatcataccctgtattttggtcaaaagaatatctttcttttaaaattaatttaaacttatcatttgagtcatggatactggctcttcacctggccataggaccacaaacccctcttctcatgcctagactctgaaaagaatcaaaagtatttggagccagaaaaggccatttatcttctagttatgagcattgcctccatcctctcccttcctccccactctccacatagaccaactgtttgtttttcaactctgctattttgcacatgccagacacccctatctagtttatctctgatgttcccctaaaccagacctctcataccactttatgaaaatgcatctcttgttcagtagtaactggaattaactatcaagacaatggtcatctgaattagaaattatactctgttttcaaattattatcaatattatttgataaatgttaaccaaagttttaactgacacatttctcatagagatactttccctagactcatcattttgaattgagggaaatggttaccctcattgaagaaagtaattgagggaaatggcttactctcattgaagaaagtctcattcttcacgtgcaattttctagaaacagcagccagctccatatatgcaagagaactggattatgtctgaagccaaaaatgccttattcctatgtataacaggactaatatatgcaggcctatggagagcaatgggcattgactgaaatgccggtgacccaaatcatagacccaagaatatatatataattggttcatatatatatattatttatataatatatataaacacacacagtacatacacacactattatatattaagtatatataatagtgtgtattatatatattaaaatatataatagtgtatgggtatgtatctgtgtgtgtatatgtatgtgtgtaagtatgtagtatgtgtatggtgccagccataagctaatcaaacaatgtgagttaaattacctgagaaacaatatcagttgagcactgagatatgtacttagtgttgtacatatatcttatacaaatagcaatagacaggcagggtaaaataatgttctaagtagcagagggattgactgatttccctgaaatgctcagggattgattagttctcattgaaatgactttccctagttacttatgcggcaacattgtcatcctgtccaggtcccctgaattattcctcagagaccagtgaaacaagtcatgctctagagtgaggcagagagaataaacgaagtatgccactctgaatctgcttattttaatgctatagataaatgggttcataaaaggtgggaaaaggaagtggatgtagctcttgtgatgtgaacgacatgaggaacatgctttccaaacctatgaataaatgtcagacaactacagtgacatagaagaccaggatgcagcagatatgagagacacatgtgttgagggcctggccctttctcctccagaaccaatgcccatgacagtcttgagaatcaaaatgtaggagaaaagatgatgagaaagtccaacaagaccattgcaaataaaactacaactggatagagaggttgaaggtgatgtcagcacaggctagcttgatgacatcttggtgtagacagaaagcagggagagtacatgggatcgacagtagggaaaccagtgtaggcgaacaactattggcatatggacagaccagcccttgtcaatacccgcacaccaatcttcattacctgggtgttggtcggatagaggtatatcttaaggggttgtggatggtaatgaaacagtcataagccatggcagcaagacacctgactccatgacagaaagagtatggataaaataggcctgagagaagcagctccatggccaatctccctgtgatctaaccacagaacacctagcactgtgggcattgtgtcaatgtcactccgaggtctgtagctgccaacatagctaagaaatagtacatgggctcaggaggttatgatcattcctgatgagaaagagaagagtgccactgccaagaagtatggagtgtaggctgccaataatgggatgaatatccagtgatgtgccttctccatgcctgggaagcagtaagctggaaggtggaagcagacttattgagccccattgccagctttgcaaagaggaaatatttactccaggtaaagcaatagtaatcagttgtataaaagttgctccttgagaatctacctgttcataagatgttcaccagtcctgactttcagtgacagcaaggatgataattagtcattcctgggagatcctaggtatgggaaaatagaatgtataaagaagatattattagggtttactctatgtaagattattggatactacgttggggatacagctattcatgcagataaacattgttgaattcattgtaaatcatataacccagaaaataaaaacaaaatgaaaaagaaatcactatatttgaatagtgctgtaatggcctgaaacttataggtcacttttcaggtgctcttcatcctgactggtggtattatagggtggatgtaaaggtttcccaggctattgagacctaaaagatcagtagaaaaatggttctaagcactattggaaaagcagatataagattatatggaaaaacaaatacacaagtaagaaatatatgagcaaatacaataaaatagaaatttcagagattgacttttcttcaatattcctggagggaaaattcaattgatgaagcccagagacttttgggtagttagaaaatgacgtaagagtgacttacctgtgtgtgtttccaagcacatagaactctatgttgcccagctttataaccctagttattgatacactgcttcaagaattcaaattttcataatataaattgaagaataaacagtaaaatgtggatttgatgtaagcttttgaaggcactaattgataatagcaccaaactactgttgcatatcacctactggtgatgcaaaaataaaaattggtaatttaggcaagatcaaggagaattttttttttaaactatggaatctgatgggatttgacaaaagtgagaaggctctgtgactcattagaattcaagatttcagctggtgcaggcagccaacctctgagaatacataaattgtgtgttggtggatgagccagagaaaataggcccaccttctcttatggttggtttggactatacatctcattactattgaaagagcatattgatgtaaatttatgcacgatttacaagacctctttctgtcatgaaaagaatgcatccaagattactggactttcattttcagaagaatttgttgaagttcagctctgctctttctaacaataatgatcttgggaaagtaatttaatcttgagatttgttacataacctgtaaagactactagtgatttctgtcttctcagtcattctcttgacacaagtaaggggaaatgttttgtaaagagtggataatttttttatttttgtgtttttgttatgtttcagagaagtacctcctttctctttctctagtgagtacatgtcaggattattcaccagaggtgtgtcaaatgatttcctttttttctgtggaagccttgggaacagatataagatatgatggggtttttaggagcctgtgtttgactttaaataaagatattaaactatagttttctaatcagcagataaaatgtgatatgtctgggtgggaaagggaaaggagaaaagattgtgagccaatgtgggaacttctgacatagctaaaagtaacgttgagcctggggcattgggctgagggaagtagaggggaaagcaactctgtcctcaaaaagtgagaaaaggaggtattatgctcaatctgcctgccagtgagaggttcagacaatactcagcttatgcaggattaaagagcagtatggcaaataaaaattgtacataggtatataacttattgttttattataggtatcattgttaaatgattaccataatcaaactaattaatatatctatcacctcacataatactttaatttttttggtagtaaaaatatgtgaggtctgctttcttagcaaattttaaataacctaaataaagctgggagggaaaagataatacagaacattaatctagttaattgtgtttattactactaaataaacatataattgataaattaaaaaaaaaacaggagtaggaatacagatagggaaaataaagctgagaaacaaatgtatggaacaaataattgttgaatttctacgtgtgtcaagtattggactggggcattatatacacctcattttttgggaagaatccttaaatagctgtttgtcttgtctgttttcatattgaaaactgagtgctttcacttgattcatcagttgcttttgtggtatatgagatgatctgtgagtttcagaggggataaaaatctaaacctttgcctcatccctgcagccattcaccctcttccagggtctctgtcatagaatagattgagtttttattaatgagaaactaattctcaaagtctcaaactctgccgcataaactgtggctctatgcagacacctcagcaggagcccattcagatgttaactttcatatattctccaccttccctttggcttttttccttcacttttcctgacactcttttctgtctcaagcactagtatctccatcctttttttacccccttacctttggctattatcctttctgtgatggtaatattgagtgcaaacttgattggattgaaggatgcaaagtattgttcctgggtgtgcttaagggtgttgccaaaggagattaacatttgagtcagtagactgggagaggcagacccaccaccctccgtctgggtgggtactatctaatcagctgccagggcggctagaagaaagcagcaaaagaagatggaagagtagtggatgcctgttacacaatataaacctttccaggtgcaaagtcacacaggctatgtgaatctgtacccctgatccagaggcacacataacccaagcccgtccaagcttaattttgaattggtttattagtcatatggtcagatagtgacttttttctagaaagtatttgaacctctgatgattacagaggtatacctcctcaagaatttggaaggttgattctatatttggcacttatctggacttctagggtaaaagacatggggttgggggagggggactctcagggttagaatggaagccagagagattaaagaatcagtcaggtggaggaaattactacaaccccataattcatgcctgagtcaacacccatgctctggtttgttcgagaattgtttgccttatgtgttccagaatctatccttcacttttttatatttgaagaggaactctcaaagaaaccaagttttagagatgtcagggagtctttaggacccatgcctactcatatatctactcttagcagacaacactattacttttctcttgctaagaaatcagcttcatctctctgttttttttttgccttggttcctgcaatgagatcttacagaggagattcataaataccctcactgacctgaaactttgttcccttccattcttcagttccatagtcatgttctcacatctttagccgtatgaaagatttgggcatcatcttttcagaatctgcacatgacctggctggtaggaacatttattttagaagctcctccccagagaccattcctgatttagtaattattgttcttccctccctccctcttctgctccctcctctcttccctctctccctactccttccttccatctttttctctattatttgtgccctcagccttgtgggtattgggcttgaacagcacaactcaagatctctgtctctgtcctggcttttactggaggttttcctctttggaggttgaatattttgtctacattgtggctttggctcttgctgtgctactttggaatattttatctcattgcatttcatagtccttactgtaaaacgcatataataattgccatccaaagtgatgtggtgtgcttggctgaagcaccatgtgatgagtatgcctgctgcatccctggaaaagagaaaacttctggtaggctaaactcaagaagggaatagttagtgataactgagaatgtgcgttcacgttgggtactagagaaggctgcctgaattttattatattgactcagtctatctagctctctgctttcaagctttctctgatctaaaccaagcaggaaatatagagaaattcaggttacataggccaagaagatatataggctttctcttgagataaactgggaagatttgactgttgaagtaaatgtagggaataaattacctcccagaggtgataccagatctgctggggctatgaagacaggctgtctgattccccacacataaaggtcctaccagtgcttgattcagccagtaacttatttgaaaaaagaaagattatttaaaagcttggggggacaattaagtgttccagctccctctaaggaggagttaatacagagtaaatatttcttaagaccaagttggctataaaagggagacatctgggaaggtgctatctttattaataaccacaggactgcttctcttcacagatgttgagaaggaacaacatgatctaagtctttaggtaagaacaagaaccctgctcttcctcaccatcaaacaagttatggtacctgggagtatggtgaatactcctagatatataaagagtgtactaggagactcctctataagctctccagagaaagtacggagaagaagtgaaggatctcaatagtccacagctttggatgtgtgcacagatttcgtctgaagttgatagaacttcaaaagcaattccaagtgctaccaaccaactacctaagacttctgtactcagtgatgtgaatatgattgaccctctcatatgtcttctttcctttctaaagatgaacaggaaggcacctcttattctactacattttactttttaaacaaagcagagaaaattatggctgtaaatgttagaagtttatctgattttctaggtgttccattatagaacttcttgcttctatcctcagtctttatgatctctttccttccctatattttttttcctcgcttttatctcttctctcattgtctttcttctcagaaaccaagagccacgactagctgagacacaagaattttcacaaaacaaagtagagtgattccatagatcactattatagctgcttaccaggtatgtctgcatggaattcttgggaatggagaaggaggaaactttaagttgcggttattattggcaaaatacaatcattgccttacagtttggttagctttccctgtagtgttcatcacttgtgctgcatattctctgataagaaggaatttttcacaaagttgagatacgtgaaagattaggttaaaggagattattgctgaaacgtcagagaagtaagagtgttgacgagaaatgaagtacatagaacacagaaggggaggagctaagctggattatctttgcgtcagtaactgaagaatatacatcactcattgtatgttcagtaggcactgaattctggtttagtctctcagtcctaggacagaatatggatgctgaaaaatgattctttcaaagtgctgagtgttgcctcacgcccagttgtctggcatctcttcactgaaactattacagttagatctctctctatgggtggaaggtaagaggatcgtttcctttggtggcatctttagggtagtgcctacactgacaaagtaactctgaaggggtatatttggatacgaccatctttttaacttagataaaaacaacttcaagaagttgttctggcatgtgacaagaaaaaaaagcaagggatgctttgctctaattcagctatatttactaatgactcttgatttcctcacaagtgaatatgttccccctcagacttccattttgagtaaatggcttcacca

SEQ ID NO: 5095 - DNA, 33774 bp, Homo sapiens
agcctgcctttgtagaagacagaatctcaggtgactttgatctccatggtatagtcctcgctttttctgtccttcatgactaggctcattggaggttccatctctggagcttctatcatgggggcctggcctttgggtggtttagtcctccagagatcgaggacactatgctctggccccccaaggtaccatcccagatgatgtggtcctctgagaggcccaactcttgtgtcctgctgttcggcagtcaggctctttgtggtctagttttctgggagacatctccttaatatttagtcctcatagagtgcagacagctgtgtcctggacttcctgggacaatggttcctaggtttaaacctctgggggtctggtcctccaggattttcatctgcagcaggcaggtccctccaaggtctgtcttccatcgtctggccctttggtgagcctgtcccccaaggcctggctgtttatggtatagacgacggtggtccagacttgctgtagcatggttctctgcacttagccccacaatgtttttttgtgtagtggccaaacttcctggggatctgtggggtgatttgaccctggacaggagtcatcctcctgttctagctctccagtggtcctgtctctgtaggactggtccccagtggtgcgcttggttgtgactggtccctctcacaggcctgttccccatgttctaggacacgcggggttcctctctgatcgggcccgcctctggggatctcagtgtttgtttaagagtaggtactgttgggggagagaacatacattgtaccaagcaggcctgcttgggcatggcggtcgtctctccctaacccccacccttgaccctaaatgttcagaaagagttccaggttatgttacctccttacggctattgatggcctgttgcagccacagcaattccatggccaagtgctgcggtggtactgaagctcttgaagctgaggttggctgtggggcagtctttgatctgggcttctgtgaaggagggaagaaaggaaggagaaaaccttgagggaccagaccctgggaatggcctagccttagactttggaaactccctcccctgcactgcccaaccatgtggtggcctatcccggcagagggaagacgggaaagggatgcagcttatctagcgcaagcctttcaccttcagatgggaggctgaggcacagtgagggtcaggggcttgccctgatctttgcagagggtacctggattctccatccttgtcgtgtctctggtcttctcttggctgggtttcctgtctgcttcatctgaagccaggagctgtgatctctgcagaggcttccttgatttgctgagcctctcctgacttcttcagcaccatctcctcccaggtggcctctccctcagactcttcactgggaagtggttccacagcccctgctctggatttgctaccctgtctcctgctttccaggctgatgggattttgccttctgagaaacaagagagatgtgagagccccagggctaaaccctccaagtatctgggcaccatgatctagcagacaagttggtgagggttaaggagtggggttgaggaggtgagtctactgcctcttccagtgagaaaagcttatcactgggaagggtgggtccaccctgcccaagtccctccttcccttctctcctaggtgtgttctacctctgggaggatcgcggcctgggaatgcggccctcggtccactgaagcgtgcccaggtcgccctcgaccctcgtacaatcgcctcatactcagctcgcaggctctggaactggcgtcggaccaagaagcccggacgcaggcctggtatggagaacgagaggaaagaagtcccttatcacggtaagaggggggcatctcggaggactgtcctgaagaggtcgtcccggcgaatgcaagaggggacctacggcggggaaaggataggtgggctgtgcgctagggctccggggggctcgagggacgatccagactggatgcccctcctcgccttaaggctcttcccgtttccctgatccggcgcgaggtgtggtgggagtggggacgcgcagggcagggagtccgtgggtcccagctttcctcagccggttggggacagccggtatctccagaggttggcgcgcagttaggggactgaacgtggtgcatctcgctgggaggtccaggtacgagaccccatgatttccctaaaggaaaaatcctggaaccccgcgcccgcccccgcacctgcaatgcagacaccttccgaaccagcagctctggtccatgggcgccaactgccaggcccgcccgcgcgcctgcgaagtacgtcattggtcggctcgctcctgagcatgcgcgggcgtgggctttgccccagccgttcccacggcaacctcctccgtccagggtagaggcgtcctggcgacaggcgtacctgcgtccccccagcccccgactcccctcccacagccgcaaggggcactccaatcccgcaggcggtacctccataaccgaggctgtctccgcggagaccgggaggaaaggcgcaaggaggggaagcaggacacggagccgctgctttctttctggtttaattccattcaacgcccccctcccccatagcacctggggggcgcagaacacccgcccgagtctgtaaaaagtcacagtttgaagagaatgagaggggcagttgggcctgcgtgggacgcctacgcagcggactgctcctcaggctcggcgttctcggccagtgcagcttctggctgtgcccgtcaaggatcgtggcgctttggaccagtccttcctcccccccggtctcccatcttgcacaggtttagttccctcacctgtgcaaagggccggggacggggtctcgggccgtctgtggactgaggttgcagtccccgcctgccctctctcacccccttctcttcatccagatcgtgcaggtcagacacactggggtgtgtgcgcgcgcactcgcgcgtttctgactgaggaccaggtgaggtggtagtgtaaattagtaaaaataattgttcaatctgaaaggataggaggacatcggacaagctttgctatgattgatgtcagctaaagtactacaaagattttgatcagtagtaaaacatcccctacaaccacttttcttctaattttgggaaattctaaattcctgtacctgggtttgggcagtctgtggctaaatctgacaggactgcagaggtggggaagttggttgtgtgtgaatactcctggagggctggagaggaggaaactgcctctcaggaacacacacacatagacgggttccttggaaaggatacatagaattactgagtcttccagctgccaacaaagagaaaaagggaggcttctgttaggaggggaaccaggccaatccccaatgctctgggggctatcttctggggaggttgaggggcccagagctcttggaccatgcactcccaccttttcacccagggcccaggaatggctttgggagtatgtaccttcccacccctcatgcccccaggaaccaaagcacccagacatgaacccacattgctaagcagtggtccaggttacggtcagccattgtcttcttctgctcctctggcagcccctcagtgacccatcctcttcctcttcatcgtcctcctcctccccacacacatccaggctgaagtgcagcgggctagcttctcctgcatctcccgaacgtgctccagctgctcaaaggagcattccttcctggaacgaagcccctgtctgaaccctgggaaagagtcctggaaccctggaaccctggaccatggtcccagccatgccccatggactgggccctacagccctatccacacacccgctaaaccagcccccaggactcaccgaaggcctgcagccggccagagtggaaatcattgagcggttcaggagtcccccctccatctcatagacatcagtcacctcggtcaggaaggagtgcgcaggggcgtgcctgcagagccgcttccacctccagccaggactgggcggcacttctcttgcctactctgggtggggtggacatgaccatgatcacagggtagggggcagtcaggcactcccgatcttttgtgccatctgcctatgcaccagtttatctgtctatctgcactaactctctgcccatctacttactagcataaatgggtaactttatggttccccttgggcactgggaggggtgaggaggcgtgaagaggtcaaaaagaagtcttttctgctaataacacagccaggcagtgcctgaaagggggtccctgggttcctgtctgagtgcctcactcatttgttttataccctgaatgagtcacttatcctccctagtcttcagcgtatatagagacagctactccctattgccaccagggctgtcttacctcctcccaaaatatctttctgcccctcttcttttttttgttttttgagacagagtctcgctctgttgcccaggctggagtgcagtggtgtgatccggctcactgcaacctcgcctcctgggttcaagtgattctcttgcctcagcctcccaagtgctggcattatgggcgcctgccactatgccctgctaattttttttacttttagtagagtggggtttcaccgtgttggccaggctggtcttgaactcctgacctcaggtcatctgccttcttggccttccacagtgctaggattacaggcctgagccactgcccctagccctcttcttttttttaattaaaaaaaaaattttttttttgtttgagacagagtctcactgtcacacagctggagtgcagtggcacaatctcggttcactgcaacctctgccttccaggttcaagtgttcttgtgcctcagcctcccaagttgctgggattataggcacccaccatcacgcctggcaacttttgtatttttaacagagatgaggtttcaccatgttgaccaagctggtctcaaactctgacctcaggtgatctgcctgcctcagcgtccccaagtgctgggattataggctgagcaccatgcccagccaaccctcttctatttaaaaactcttttaaacaaaaacaaaaatactagaaaacaaagccaaaccaataaaccaaaaaaactgtcttaaaatttccactgctctcggataaaattgaatgcccctgccagcctggccctcctgccttcccagttgcctttcctgtactctccccacagccttgagcttcatgccccttaggcaagtggtgtgcaaaaccaggggaaacacagtggtcttatctggagcaactggagaaagaatacattgtatttagtggggacaaacatggacacattataaggcagcatgcaaactcccaatcataaaaaaaattcaacaagaattcaaattgtgcccccaggtatttcctcaccatttcctgttccctgatactccaggcccccaaaccacctgtggttcctgaaacctttcaggtaatagctttcttccatatttaaccaggtaagcctctcagcgtggaacattcactttcttgcagagttgctcactccctccctgaggcgaatcctcacgctatgtgatcccagtgacccacctggcctttttgccacacattgagggtagggactgggtctgagtgagctctgagttctcaggggtctgctccagaaagcatcaattattgcttaggaactaaaggcggaggccccccttgccttcctctctacagtgaacccagagttggggtccctcctcctttccttcccttctgtacccacctcttgaacttgcccgctgcttgggggatggcagatgaggaagtcctagggccaaggagccgctgtggctgtaggcacagggaccctccgtagtgtgcctggggcctgggctggctgggccaggcagggctgggactccgtttcttctttttgtcatccattgggcgctggctgggcctcaggcctagggggaagcaaccccacaaagatagccaggggcaaagttagcccttcacccagaaatccctagagctgcaccaaggaagggccctgggaccttccagcttgtcacctcatctatacggtagggcagagccagatgccagtgtctgctgctgggatcgtggatgtacacttgaaggacctctaaggcccaacctaattccccttctgcctgaaaacctaggcccctcctgaaagggtggaccagtcacaactatcttggcgctactggggcttcctgtcacggtggctggggggcgggctggcagaggaaatgtagtgggagacaagacggaggtgagctgcagaagcccagccgaaattagggatgtcttaactaaaccctattctatttatcaggggcctaagcagatgctaacaaccctgtcagcatgggagggggacaaggtgcaggtaggggcgcctgggaaagccccaggtgtgggtaattgtaggagaagccgcagcatacagggcagggttcattgtgggtttccccacatagacaccggcatccctccacttccacccacccccaaccgaaaatattagggactcctataggtcccgcgggtgtgctttcagctgcttcatttttcccagtcggaaagtccctctgggcttcagctgcagccagggtggactgggtggttggccgctggctgcctgggcctcgacaaaggctgcgcctgtggctgggctgctccgaggtccccggtccagcagcgccccccagcctccggtcggctggggttccctcctctgggggtctcattccaggctgctgctaccggcctaacttcgaattctgggactgggggggttgggggggtgggtggcgcttaagcatttcactgacacatagctggctgccactgacggggtctgcgggtgtggggaggggagatagggcgcatcctctgcctctccgtgcagcagcttgacccaattagggacctgatagaagaacggagccggagcctgtgctccccaggagcggctggggcgaccggggatctatttcccaagccgggctccaaagccatgtgccaaactcatcgctcagctccgcagccgcgctcgaagacgagcgtcagacccgcgtcattccgcccccgccctcactccctcagggggctactgacctgaggtttggggtctcgagtgatgcttcggtgcaagttccctccgccctccgccctctcccccgggaacaccaccgggtgaaagctaagctggagggagttcatttgcatttaaagagaagtgaccttctccttagcgcggtggggtgagatgggaggagcatccccgcgtatgctaacagttcctctcactcgacctcacctccccgcctgaacctaggggaccctgttggttgtggatgtctattttaaaaagattttccctttcccggcagtttcagagagaagctacagttcttacaaaatggtggtggctttgtcagaaagggggtggggcgggggagaggagagacagatgagtgagtgagagagagagaatgtaagcacagaagaagcacaagcagcaacagcagcacatcaggaagacacttcgagcaaagacagccatcaatggagtgagtccagtgccctattagcactttacatacatttcatccccataacaacccttaaggaagataccagtgtcattcccattctactgaaagtaagcaacagtcttttgagggcaaaacccctctctctacaatgcagacagttttctctggtaagtggtgggggctgtattttgccgcagatgaagtgacaggatcctccccaccccccaggcctaggagacaggtgtggggagcaccaggtcataaggtagacacgcgattccctggcacctgactccagtcctcagggaaacctgagcacctgatggaggtgacccagtgtgactgctgctgcctgcagccagatcaatgggggcagctatttaaagcctggcagaggctcctggcgcaggtccccagaacagcatctgatacaacaggagagaggctatgtttggccaggcggctcagcaggctcaagtgagctggcccagggcagtgcacacagcacccagcccaccttccccatccccgggcaggagtggcttcctggggttgggcctcttggtgatgtggggagccatgggcactgctcctgagggcacctgctcagggcttcttcctgggacttccaacactcagaacactccacaagggtaaagagtaattccgaactttttcaataacaggggcccagactggggacaacagaaatccctctccttccccaccggagctgctagagagacagtggtaatgctgctgacagagggagcacccctgtggttcccatcctcagctgctcactggggggtcagaaacctcattattctcagagctgctttgcttggaatctccaagagtggggcggcaccccccccacaccctccagaggatctgcgactagaaataacatggccagatggaaaacatgtatcaggacccagctagaagggtcagaggctctgctgggactgtcacgtcattgtgggcacatctatttgtggaggcctggagggaagggcaggtgggttgtctctccatttcctgggcattcagcacatatcatcctttgtgcctgaccaacccaggacccagaagaacagggtgctgggtgaggccaccagcagcatgtctcccatataggagtcccatgctgaggtgggtaaatggggggtgtaaaaactgaacagagaatgtgctctccttaaggaatgatacaattagaggcccctgtgaattcccttgggcaggccagggctataggagcctaccccagctcagacccaaatagcagtgatgagtgtccacccctcttaacctgggcctcaaatgcctatgcctggctccatgccttttgccttactgctggagcctatcaatttcctattgaacaccttcagttgccccccctgccctctggatctagcccacattccttaacctggtacccgactctgggcccagcctcaccccctctcccagtcccatggacctgcttcccagctgtacatttaatcactaaatgacgttcatcttctacctgccctgtggttcagaaggccattccagtatcaccccctcaccttgctgaagggggcaggggcctcctctctgctctcagcaccatgacctgtctatagctaaaagtaccttttcccttcactagcctgtgagcccccaggtcaggaaaacttttttgtgtgtgtgtgatcctctctgaggcaagggtcttgccaactttgccagggctccactcaggcagctcaagtgaatatgccagcatcctgaggctgtggcgactgctaaagacactgtggaatatgtaagataccagggaaccaccatgggcgctctgcagcagactgaacaagtcagtgatgatggaaggggctgaatggatcagatccagaaacaaaggaataacaggtcaggagagaaacaagtaaggcaacagactctttatttaatgtggtttaaaataatcaaaatcaagtccctggctgttgtgaatacccaaaggagacaaaaaagctgccagtgagcttcaaacaagtctgagtggccgggctgggccataaggaaagcagttacagggacagaggcagctcccttcccccaggaagggcaagaggagcaggtgcctggctgtccctggggtaccacctctgtgctgtgcaaggcggaaaggctggggcagcagctggagaatcagctcagaggccttggccctcccccgtggacaccaggcagctccactggcctccgggtcagccctcgggccaccgtgatggggtggaggagggttaaataaccatctttacagaaataacagtctctacagaaagtgcctgagctcagcccatggtccgataacctcatggaaaacaaacaacaataaaaaaaaaaagtgctgctgacacctctcagaatctggtggacatgaagctctcagcggacaaggccctgaaaacaatttactattagcagagccatgcgctcttgagcttcacctctgtggtcccctggaggaaaagctagcaatctaagaaaccaacacagatcttggtcctaaactgaggtcacaagtgtgggacccacccaggtgaggaagacactggccttcactcatgataggcacctcccctgcatctggcccaggacctgggctactttggaaagcagaagcagacagctgtagtgattggttgatttggtcaatgaagagaagaaaaaggtagggaacctcattgcagactggcctgaaggtctagacatggatggagctgtgagcaaaggctgcaccttgctggggcccacattcctgacctgggaaacccagctggggccacctgctcactgtggcctctacaccaccacactgggatccagcagctccagtccctccacaggcattaagaggtagctaagtgtgagtcaggcaattatgtgggccactgtaggcctttcccctctcttcaagggggaggtgcatacctctgcctcttccctgcacctctctcgcctagcaaacactctgtgaggtggcagctcttgtaccagcttagcctggcacaggggctggggtagggaaaaggccctactgagcaggaagaggcaaggactactccagacagagggattcaaaggggaagaaaaaggtctgggaaacacttcacaggacagcagtatctcagccagagatggcagagatctcaacactacacagctgcttgagggcacctagatgtgaaggatacaccagagaatagcaggcaactcgatgcagatcagtggtacctgccctggggcaggagaaggagaaatggtgtgccattcattgccatctctggtctcagtcacacatgattcagtacttaacattctttgtgaaccaactatctgagagatttaaggtaagggctaaaagagtgggctaggtatggaagatgaagggactgcaggacaatgaactagcttcaaagaaaaacagcaagaagcaaagccctaaccatccttccatcttggtctgagtcattctgttgtcccagaaaactgcttggcacaaacactggctataccctggcaagtttgcaacagcagaacattcagcatatagaatggctctacacagtaatagtagttatgtactggagtgggggtagaacaggacacagaaacaactgtctgcagccttttatggatttctggggcccagtcaatagttcaatttcatttcttacctgttagacaaagctatgggctcccacacaggaagaagtagaatccccaaggacaggcagggaggtgccagaaatagaatcaggacaaatcttgaggattgcacatgtgggggtgggggcaggaagcagaaaacccatgaagccaaagaggcagctggacatgggacccagcaactgctgcatggagaagtgctgatgggaactggtggtggcctctcaggactgaaacccacaggtaagcttgtggaaagccatcagaagccctttcctttcttttaccacaaacaacctgatctcaccaaacagaaacctcagcatcaagatggcaaaggagccaagtggggtggtgaaggaggtgggacactgaggccaggcacccaggcaccactgctacagcatccctcttccttggaaggtcctcaatcaaacactgtcatgtgcaaaaaaaaaagaaaaagaaaaaaaaaaaaaaagaaaaagaaaaaagaaaaaaacaccttcagaaataatcctttgggtgatctcttgtcaatcatttgtgcggctagagaggcacctgtgaatgataaggctactgagaagcatcattggcctggtcctgcactaccaaagggcaggggaagcgatgcccaaggggctcctgaccagcacatcatcccagcaaaaacattctccaggtcccttgttccaggcaggaaatccccagctctgagcgccctccagggctctgcctagggacaccttttccaggtctagagaatcaaaggagcctccagagagctaggagggcctgagctgaccaagcaagccctgctcacaagacaaatgcagtcaagactgggtgtattacttgtcttgagctctgaagggcagggaggggtctgagcctcaaatcaacagagaaatgctcaagtcacttctgccaactcactgtgatggcagctacagatgacagccctctcaagactcttcagctcacagacaagccactgacttcatctgtacacacccccaccccaatgcaagcccactgtacacttacaggtataaatgcatttgcaaggccttgcaaatgccctatgtacgtaaaactgacccacaaaatccaaaattgcaagtgccagatgccagcaggtcagaacatcctggcttcagcaatgggctgctcagcatgggagccttttatgggccggcctggctgggctgccgctcccttcccagcatgacccaacaccaggctctctaggcccggcggaggtgggctcttgaggcccagtctggcctgatgcttctgtgctcggtgctcctggtagcaaggcgcttctgtgaccctgggggagctgggtgcttgagccccaggcccctctgcctcctctcagggccactgtcagtgagggagccctggccaccagcactcaggtcctgtacctcttgttcaggtcattgcgctctgtctgcagtgcccggcacagcttctccagccgttgatttttacctgcaggccctccagttctttatcccggactgttttctagggaaagaaatagaccttcagtgccgtgccccatcaacctcccacttaccatcaccacttggcggcaaacctttaacaaggctgagagcagaccgagtccaaagctggccccctctaggaaacagtcctgttgaagccatgactaggctgtcaggtggggcagcatggtgcagaaaaggggcacggctggagataacgtattcctccatttatctaccacgtgaccttggcaaaggacttgacttttagcctgtctcatctataaaacaggactactaataccatcctcagagctcaagagaaggtcaatgaacaacgtacctaaaaacattcagcagcaaaaaagacaaaaaaaacccaaaaacttcagcaaggtctggcttgcagttgctgctccatcgttagttcctttcttctacattacagctgtgaaatcacaaactacctgggctgctttacatgtaaaccaggcacatcactggccccgtttttttctgctcttttattcctttcttccatttgctcccttcactcccactggaacctaccactgggctcaccacctcccatggggagagaacagcattaactttggacttggcattgtgtgcaaatctcacctctacctcatgctagctgtgtcactgatgggtagaacatcaggaaagggcctgatatgcgctaagtgcacacccccaccctggctgcagatcacagacgcccacctcctcagccatctcaagcagggccttgttgctgctctcccaccgggaccggtcatggtggtttctttctccagcttcttgatcttcttagtcatctaggttatgtgacagaagaaggaaatggtcagagctggcctctccaaggtctgtgtctccaaggtggggactgcactgtgtctccaaggtggggaatgattgatcccaaggcgcaaggcattacaggatgcagtaatgccctctgtgccacctcaccaccaggaagtcagaggtgtccaccaccaataacaagaatggtaaggggccaggcatggtggctcacgcctataatcccagcactttgggaggccaggcgggcagatcacttgaggccaagagttcgagaccagcctggccaacatggtgaaacccgtctctactaaaaatacaaaaaaaaaagaaagaaaaaattagccaggcatggtggcaccgcctgtaattccagctagtcaggaggctgaggcaggagaatcacttgaacccggggggaaaggctgcaatgagctgagatcatgccactgcactccagcctgggcaataggtgagtcccatctcaaacaacaacaacaacaacaacaacaacaacaaaccccccaaaaaaaccaaaaaacagaaaagactgccccattccctgggacaacctggagtgtatacataccactgatatgcctcaagaggggaaaggctgtgaaccttcctaacagccctgcccttgagacaccccaatgggagcttcctgaaggcaggcccaacaattttgaatgaagcagcttatgccccagcaccatgcctggcctggaccacagttaccttttccatctcctgcttgaatgtggtgaatactcgctgcttttggaaagtgtgttctggaactcctcaaacttctctgtgtatagggcaagtgtggggagaaagcagcccacagataagactgggtttctctgggaggcactctggtcaaacactcagacccgtccttgactctctgaccagtaattctattgagatactatttttcctaaaacaaagcaaagctatatatttggaaggatataatccaaaatgctaagcctggaaagaggagacttagggtgacttttattttgcctttatgttgattttcaaactcttctgttccacctcctcaaaagcaatacatttctgagctacaaatgaagtcctctgagcccacctaacacctggtcaccaccacataggtactgtgcaggtccggagagaacaaaggctcaaccaagcgtcatagcagccaggacacagccagtcctagaatgagggtcccatttcactacccccagatggggcccagtgagggaaacttgaaggcacagggtcaggttatatgctctcacctgtgcttcaggtgggtctcttgctgcttcatcagctcacacatcctctgggactctactgccctttcaggagctatttccaagacagaaccccagatcctgtcagaagcccccaggggctagtttggtttttagccacaagcaccagacccactgaggcttcctgctctcagactggtaccaaggaatctgtgcctggtctggccagacttctcccatataacccggctatgagctgagcagagcccagcctgtctcctcccacacccccaccccaaccctggggcctgagcctcacaaatccttctcccgctggtgccgctcttctgcctcctttagcatctcctgggcctgctgggcttggcatccaccagctgctgttgtaggtccttgtgtttgaagactttgtcgatatgcgcaacaaagatggtgggagcagtcggcttgtcaggcgctccctttctcagggtagcccccagccacagaccagggcactttgcccagccccccatctcaatctgatatgatggactccatgtgtaccacacaacatgggccccaagtctctggaaggtcagctttccaacctcacgtgtttctctcccagtgagtcagaccttggtaagcacatggtttatggatggaatctgctccaagaaggcaagcaataaacacactcaaatctctgaccccaggattgatcacctatgggctggaagccctcacttctgtgtccctgattctcttgtaaatgggaagaatgggcaaaaaaatgcctctaagaacataacagcctagctcagttggcaaagacttgccatatctaggcaagactagacatgtgcatccccaaggaatggctgtcctgcctactagaggagcgctgcagcctgtgtcaggtgagagagaagggatggagagaaggtgaaggactcaggtgctacttcaaggtaaaatcaactggacttgctgaaataagggaaaataactccatttttttggatgggaagggaaggtgcctagcaggtaagtccagtttgggtatgatgagggtgcctgtgtctgttggggagggctgtaaatgcaaagcagcagggcctggtagtcctgcacctccttctccacggtagtactaagtccttttttgccttggcggggagagaaaacgggggtattcagattctgaagttcgtgtctcactgtagtggcccaggaagcctctatgtctcagcgctgagggatagaaccaaaccaactcccctcaaaccaaacaagcagctttgttcccagaggatgaagtatgcaaggaaaggggtgggtcaggggagcgccctctaggtcctgcacacacgatcatcacttggcctatgaacctaagagggcagatcttcccggtctcacccactgccacaccccagggctaggaaagggcctaatccagagcaggtcctctgccagccctgtaagggggctgcaggttcccttctcatgatgagaacgcgcccagaacagccaggtgactggcagggaagatccaagattcaagtgcctggggtggcagccaacgcagtgacaaagggagtgacatcctgctttttttttttttttttttgagatggagtctcggtatatcacccaggctagagtgcagtagcaaatcttggctcattgcaacctctgcctcctgggttcaagcaattctcctgcctcagcctctgagtagctgggactacagccgtgcaccaccacacctggctaattttttgtatttttatagagacagggtttcaccatgttggccaggctggtcttgaactcctgacctcaggtgatcgcccgctttggcctcccaaagtgttgggattacaggcatgagccaccacgcccagcctataaattctgccttttgagtggcaggagcagcaaggaatcagtggacacagtctctggatccatcactgatcacaggtacacccctcccctgcaattccaaattctacaaagttctgaaatggaaattgtcataagctggcagccagacttgacctgcatcattgtaagcccataattaggtgagtatttggaagttctactgcataaatacattaatgtgtctggcttccccaagccctgctgagggtgctatataacacacagtccatacatgtacctccattctaaaatgtgatagttctaattccaaaagatgcctggcccagtcatttgggacaaggcactgtggacctgggctgtgtggctgtaagtgagtctcttctccacacctgttttttatctatgaggaatacattactctcctcccaaggaggaggaggaggaagaaagggagaatgggatgaagcctgaaaggtactgtcccagtgcctagcacacactcaaaacctcacaatttctgggccatgactctgtccgtgatacccttacctcctcgcgcagctcatactgctcaatcagcttcttgagctctcagccagctccatgttctcttggcgcagcttggagttgcgctcattgtgctgttcctctgcagctgaatgtcattcagtgtcacctggaagtgcgaggtcacctccttgcgcttccctcctcctcccgggcccgctgcacaccttcttcctgggcaaagaagtcagcccgagagcatcatccactgctacctcacaagggtcccccagctagtccacagatggtctctgccaaagccctccctgctcccaaagcgtggagtagccagactccaggatgttgtgcaatgcgggtccaatgggcccctctgtatatcaggtgacatcaagtgagattctccccctagaaaaatcaggcacatggcaggcgcggtggctcacgcctgtaatcccagcactttgggaggctgagtgggcggatcacgaggtcaggagtttgagaccagcctggccaatatggtgaaaccccgttctactaaaatacaaaaattagccggcgtgatggtgtgcacctgtggtcccagctgcttggaggctgaggcagaggagtcatttgaacctgggaggcggaggttgtggtgagctatgacgcgccactgcactccagcctgggcgatgggccacagagcaagactccgtccccaaaaaaaaaaaaggaagaaaaaatgcaggcacacatgcacacatgtaagtgctaagtgccattcgaagcaagtcggatctcctaaggcctattcttccagatttcagattaatgtgcatttgtccctctgtacccccagagaccaagctgttaaaatttagtaacacccagggtttgcaaagtgtgcagaattaggcactcaacacttttgatggggaaggcacactgccccctcactggaggcaatccagcaaaatctattaaaatgaaaaatctgcatatactgtgacctagccatttaattccatgacttatcctacagataagttctatataactgaccagtgataaatataacagaattttcactatagttctatatgtaataatgaaaaattgtaaacaacccccaaaatgcttaactagggcactgatataatatatccatataatgagaagatagccctacacatactgtagggaaaaatgttatgtaaagtgaaaaaaaggcacaggatatgaaatggtacatgtatataatttcattctaaaaactacatgtaagattttacatataaaaaagaaagttaaaaggtgtatttaaacttggtgtaaccacagactgacctcaccatagaagcagcagaacatgggaggacccaggttcctgactgaccaacgtctgggacaagagctgcttgtcagagccaggctccgcttaccaggggactgtcatttcattgagaaatactaacgccagtgcattatggatctcttagtactttatccttcaccttatctaatacatgtcaaatgattacaagcagtacttcttaacgtaaggcattattgagaaagtgtatttctatgccacaagcctgcactactttttttttttttggacactgagtctcactctgttgcccaggctgtaatgcagtgatgcaattcggctcactgcaacctcagcctcccaggtgcaagcaattctcatgcctgagccacctggtagctgggattataggcatttgccagcacactcggctaatttttgtatttttagtagatggggtttcactgcgttgaccaggttggtctcaaactcctggcctcaagtgatccatcccctcagcctcccaaagtgttgggattacaggtgtgagccaccacacccagccttgctttttacactgatttcatgttgaaattgtaatgttttggatattgggttaagtatattactaaattaatttctgttttttagtggccagaagatttttaatcacttatgtgtgccactgcgctggccctagcctgcactactttttaagaggaaagcccatgaaagaaacattaagtggagtcaaggaaaccagagtcacctgttccagggggcccaggcctaccttgagggagcggtttgccgctgcagctcacggcataggctctcaagcttgctgcgggccaggacggccttgcttgctcaccgcgcaggtggtccttctcttgcaccagctggctctgctttttctgtaggagttcatctgcttctgtgaattccggtgctcctccagctggggacagggatagggagggcagtgagcatcttgtggggccttcctggtggggggatcactatgcaggtctagggtctcctagctgccctgacccttaccctctcaggccaggagcactctcatgggctgatgctgtgccgtgcttacacgctcctcccatgaactcacaataaccccaaaggctccaccgtagggacaagaaatggtaactcactagggcaagcaggggccacacagccagcagatgccaattcctatccagctctgactctgggccactagagccacttcaagctgttgcatttccccaacttgcggacactcatgcccgaggatgagaccacctgctaccgtaccttgtgcctattaacagacgacccccatcgctccctcgcattccttcaaaacgttagcgctgcgttcatcagcgctctcccaacacaattacttttctcatttgtggccacttcagtatcaacagataatccttctactccctggcctcacagtccatcacctcttccacaaacccactcctttccccagctcagtcccctcccatgaccctatccaggcctgtacaacagaaatataatgcaaaccacataagtattaaaaatattctactggccgcactaaaaaagtaaaaaacaggtgaaattaattttagaatatatgtatttaacctaatatccaaaacattacaatttcaacacggaatcaatgtaaaaagtgaggccgggagtggtggctcatgcctgtaatcccagcactttgggaggctgaggaggcagatcacttgaggtcaggagttcaagaccagcctggccaacatggtgaaaccgttctactaaaaaaaaaatacaaaaaagtagccagtttggtggcatgcgcctgtaatctcagtactcaggaggctgtgaggcaggagaatcgtttgaacctggaagcaggacatcacgccatgcactccagcctgggtgactgagacactctctcacaaaaagatgttttatattctttgttttgcttaagtcttcaaaagctgatgtgtatcttacatttatagcatgttcaaattcaactggccacatgtcaattagctagagacgaatttatcttggacagcgcagatctagacttgtcactaccagagagcacacccactatctcaatttccagcatcccagtccaggactacatcacctatctttttagctcattccaatcagtatctgtgatcctcagaaagtctcttacctataggacctccaatccattgactcaaccatccttccactctcctttaaaataactacttacctggcttggatttcttacaccctcaactctcttggcccttccccagtagtactgcaccctagtaaagcaccttcctgctttacaccagtactataacaaccctacttgaagagttcactttaaattcatggccaccaatttcaggaagaccagcaatcccaatacaatgcatagctattcacactcctctccttccagacaactatttcatcgttctcatcaaatctcaaaaacagaagaaactagagaatcaggggcacaagctgcacatctaccagtccacctgccccgcctctcctccagtcacacagacctagccatgtggttaccacagccaagcccccttcttggcaggcctcagctcccctcctctactcacaacaccactctagcaactcatttcctctctgcatcagcaattttcccctggctggatcactccaaaagggtgcttatcttccttatacctttatttaatccttacaagaatgtcattaggcaggtatgacattccccattttaaagatagtaaagttccttacaggaaaatattaataaatgtgtgtggaatgaattaattttaaaaaaatacttagaggccaggcacagtggctcacacctgtaatcccagcactttgggaggctagacgggcggatcacgaggccaagagatcaagaccatcctggccaacatactgaaactcgtctctactaaaacatacaaaatttagccaggcatggtgacatgcacctgtaatcccagtactcgggaggctgaggcaggagactcgcttgaacctgggaggtggaggttgcaatgagcgagatcgcgccactgcactccagcctggtgacagagcgagactctgactctgaataaaaaataaataggccaggcgtggtggctcaagcctgtaatcccagcactttgggaggccgagcgggcggatcacgaggtcaagagatcgagaccatcctggctaacacggtgaaaccccgctctactaaaaaaaaaaaaaaaaaaaaaaatagcctagcatggtggcgggcgcctgtagcccagctactcgggaggctgaggcaggagaatggcatgaacccagaaggcggagcttgcgcgagccgagatcgtgccactgcaccccagcctgggcgacagagcaagaccccgtctcaaaaataaataaataaataaatacatacatacatacatacatacatacatacacaggctggaccatcaatggataaatctgttagttcaaattctgacaagggacctgatgatggaagatctggctgccccacccccaacccactgaacaatgttacaacaaagtgggaagagcatgcttgcatttattgtgatggaacatgaagtacttatgaagaattcttgtcaaaaagttgaactgaattggatcaagctttagagctaacttctacttcacttacatgtaccaggaggtaagaagtaaaatgataccacagagatgacaaagctagaagggggcatcctacaagacagctgtctagtttctgttaaaagtcaatgtcatggggaatatgaggaggcagtgacaagaagatgctctggagtaaaaggaaaaagtatcaagtgactagtgttagttttattaactgtgatatggctctatgcatctgtatttgaggaagaagcatcaagatcacaaggtgtcttggactaggccaggaacaagggctctaccaccttggaatcattctttgagaaatttctttcaaggatatgcagtttctcctcttgctgcacagccctgaagaggctggctggaagtgattcccctttaacagatagttcagagaaaagctgaacaggaattaagccacctacttgactctgcaccccaaccttacaccaggtggcatgctgattttcccaacgcagggaaggtgcccgcggagggggaactgaccagttcagcatacttcttgcacagagcagccagcttctcctctggggactcagagtattcaatgtctgcatcagcaacgtgatctccttccctgaaaagcacaggacaaagacatgcaccctcttctccaggtgtcccctccaggcctgggctcacactcatgaggctgaagacagccctccccatcatactttatattttgcttgttgattagctgccttcctgccataaggaccaactcaatcctgccctcactatagccccagtactgtccatagtaccacacagaggatatgctcaacaaatgcttatcaaatgaacgactgtaccctagtgaaatctcttagtaggcaccattggcaggagaaaaaaactgcctgctctaccaatagaagaaaggttcccacttatgaattcagggctactgtttcatactgtttcaatgcaaggaaggcccacctcctgatagaggtaggatccaaaaaggaataggtatcttagcctccttgagaaatactaactcttgtcaacagagtagccaaacagtgaactttaaaatgaagatactttcggccaggaaggtggctcatgcctgtaatcccagcactttgggaggccgaggcaggcggatcacgagtcaagagatcgagaccatcctaacatggtgaaaccccatctctactaaagacatacacaaaaaattagcttggtgtggtggcacgcgcctgtagtcccagttactccggaggctgaggaggagaatcgcttgaacccaggaggcggaggttgcagtgagcccagatcgcgccactgcctccagcttggtgacagagcgagactctgtctaaaaaaattaattaattaaaaaaaaaagcagggtacagtggcttacgcctgtaatcccagcactttgggaggctgaggcgggcggacacgaggtcaggagatcaaaaccatcctggctaacacagtgaaaccccgtctctactaaaaaaatacaaaaaaattagccgggcatggtagcaggagcctgtagtcccagctactcggaggctgaggcaggagaatggcgtgaacccaggaggtggagcttgcagtgagccgagatccgccactgcactccaacctagggacagagcgaggctccatctcaaaaaaaaaaaaaaaaaaaaaggcagggtacggtggcccacgcctgtaatcccagcactttgggaggcccaggtggcggatcatgaggtcaggagatcgagactatcctggctaacacagtgaaaccctgtcacactaaaaaaatacaaaaattagccgggcatggtggcaggcgcctgtagtcccagctactgggaggctgaggcaggagaatggtgtgaacccgggaggcggagcttgcagggagctgagtcgcgccagtgcactccagcttgggtgacagagcaagactccatctcagttgggggtgggggtgaagaagatgatactttccatgtatgtgacgttaagattttttcctttttcttttttgagatggagtctcaccctgtcacccaggctggagtgcaatggcatgatctcagctcatgaaaactctgcctcacgggttcaagtgattctcctgcctcagcctcccgagtatctggattataggcacgtgccaccacgcccggctgattttttgtatctttagtagaactggggttcaccatgttggccaggctggtctcgaactcctgacctcataatctgcctgccttggcccccaaagtgctggagttacaggtgtgagccactctgcctagtcgtccctaagattttttaagttcctctttaaagtaagaggatacataaggggaaaagggaataggaataaaacatgatataatgacactcgacttagattctagattctttttttttttttttgagacagagtttactcttgtcacccaggctggatgtagtggcacaatctcagttcactgcaacctctgcctccgggttcaagccattctcctgcctcagcctcccaagtagctgggattacaggcgtgtgcagcatgtccagctaatttttgtatttttagtagagacgggatttcatcatgttggccagctgttctcgaactcctgaccctcaggtgatccacccgcctcggcctcccaaagtgctgaattacaggcgtgagccaccacacccggcctagactcttaaacatacataccctgctgtaaatgactgtcactgcctattccccattgcctgtgactgagtcagggagccttccctctcctccccagaagggcccaagagatcagcatggagactgcaattcgcaggcatgtgtgccaatccaacccacggatgggttttgtttggctcttaccattttagctgctaactatgaaaaatctagagttctcacataactctagatttctggcttttctttatttaaaaaaaaaaaaaaaaaaaaaagcctgactgcacccagcctgtagttttgcctgctctcagttggctagctagagcaactaatcaggaagcagtaaagcctccatcttcaggtggccccatggccagcccgcttatgcagatatttgggttttcaactctggcctagtctaattttcttactgtaaagaaaatataaactaagacccagagaggagaagggacacacccaaggtcacacagcaggtagactggctggcacaggagcctaccctagcctcccgtctccattttctcaaagagagaacagtcccatgccaagctccagttgctccaaaacccagaaggctttgtgctggtaactcctgatctctctatgccgtggcccccacatccctggctttgattagactagagtgacttgctgtctgagaagtaccgttttcctttgaatcctggcagaacagactggcccagagaacgtcagtccaaactccctctcctcaccagcttcacaaagagccgccctctgctcacccaaaccctggcttttttcttctcctgtggccttcgatggtctcggtctccgacctcgtcactctgcggatctcttctgtgtttggatcccccttggagggttccttctctccattgactactggattggttcaggctccccattccttgccacataggtccgggacttctctgcatcttcgggtcagccggctcaccctgtgccccatcctcgccggggcccccctggttattgtccacacagatgtgctcagtatgtcttccagttggcggctcagctcctcagagacatcacgaagggcccagactgagccgttctggcttgagcccctacagcaggagaggatgaggggtagagtgagaagaagacgattataccactggttgggatttttcaggcccagccaaactcatcagtttggttaaatgttgcctaacttttttttttatggaaactgagaagcaagaatggagtatcatcagcaaatctagttcctgtcagaatttagattcgaaacatcttttaaatcaagaaattaagtaatcgttgcctaacttctttaagtctgtttacttgtaaaatgacacaactatttctactaccacccgaacatatttgttagatcataaaagtatgtaaagcatcagcacacagggtggcacggagcaacttctagtccatctccttcccccccacaaaaccatttcttgccattagatcattctagaaatgcctcaaacaggaagggcagttagctgctggtggctgaggtgttctaacgggacctggatttcctgactgggtgcctcgtttggctgccacctgacttaatccgtcggagcttctctccagaactctgttcctgtgcttagagggggcagctccgccaactgccagagcgcaggggggaccgcggcccccagcactgtcctctcattctacatctcctcccccggacaacctggcctcggcctgtaagtccagaagcgaggccgaccccacagctcctcccctgcccgctggcaacgcagagctggcacacaccctccggcttccgaggagcctggctctgccgggaccttctgcttctactgcaggagccgcctggctgggccgctcctgggctcctcgggtcctgcttccggttgtcctgggctgctttttggattggattgtttggcagccccttctttttgtcttggttcttcattgtgatgagcgatgctgggtcaggagaagatcctttgaaacaaacacagttgctattttccagacttcgaaattcttcgcagcctggatcagaaaccccacagcaggcgcacaaagcttcttaaaataaacggaccggcaggcccgggcggaggcgccaacggctctctggtcttggcgggtcaggagagcccgacgtgccggggcaggctttggggcgcagctcccacagcgggtgagggaagaggcctcttctccctggagccacttcccgcacaaccggccccctcgcggcaggccgggcgcgggattggctcagggccggagactgagtggcgggactcccggcaccgcccccgcccctcaggccccacgtgcgccccccgcgcgccagccacccacgccccgcgcgccctcaagccgcgaggcacgcccgcgcatgcgcatatcccagacagcccccggcccacgcggggagttggcgtgatttccccacaggccgagaacatccggcccgcacactctcaaatagtctcgcccaccggccgccgctgcacgtacctcaccgcgacgtccgatggcttccccacctctggcctcgcaccggaaaccccgagtaactgctgcggccagccgcctgctcccgcctcagccaatcaatagccggcgccggcgcggagcttgctggaaggacgaagcgagggcggcctcggaggcgggcgccccggcagggcggggcagggaaagactacgcgtccctctttacgcaggggctagccgcagatcccaaggtgcataagggacgtagtcctgggagtccaaaaggagcccgtcattctgcacgagtgcccatgtcaaccttgttctatctcgcagaagctatgcttcaactcccaaagccttgcgcctggctgttgtttccgcaggcctccatcaaaccttcctccctggccgtgaacaaatgtgactccatccgggaacccgaggactcgggaagagggatagagtcctgggctgagactcaggagacccatactccatcccaacttcatcacggatttgctgtgtggctggacgttctgttctctctctgggcctcatgtccttcttccaaaggaggcttttaataacaatagcagttccttgaacgcttactgttgctttcccgctatctaatagcttggttctcataaccactcatagaaataactactatcgttatccccattttacggaaaaggacagtaagagaaaggttaggtaacttatccaaggtatatcgatagtgagtggttaaaacagggattcaaaactggtaagtctgagaccagcaccaggtaattacctggtctttcacccagaagaaacactaccacagcaggtttccctgaggcgtcaaggtaacttgtgaaagtaggtcatattttcccctctccattaccattttggcagtagttcctcagaaaggtgctgagttaggcttcaggcatattcatgagccttttctctacccacactctacaaagtctcactggggttaaagtagaaaaaacccccacagttccctacactgagatcacaattctgtatccccattgcttctggataatgaaatcaaacccaacaatcctgtgcctggaatttgaagcctaagagatttgacttttgccaaacccaaaattttttgagcccagttcaaaggtcacttcagagccttcccagtgctctgcaaaccgtacttgctccctggtctgcagagttgttacagcattagcagtgaggtgttgaaattactatttacttataatcagtgaattttgcaagaactgttggctaaatagtctagtcccagagcctcgcatcaggtgtgggtagagaagattgtaaactgttgtgctaattgagcgttggtttagggctgttagatgttaaatatttcccccaaaggctcagtgaaagacttcagagccgtgcatgttggattcagattttcagattggggaagctcaaccggtaaaatttgagaaaatcccaaattggaaaacttctggtcccaagcatgttggataagagatattcaatttttagtataatgatggaacgaggctcagaaaggttggaatctagatgtcctgaaaccaaggccctgattatttctagaaagcattctggaaatctcttgagaaggcaccatataaatcaggccttgatagatttccaataacaagggtgttctaggtgagataaagaacataaaaatgtatgcatggggtgagggaagaggatgtagtagaagggtcaacaatagcctagaggggccagttgggtaatgagaacagcaagaataattgacagaaacataggttaacaagttactttctcctttgctataaacaaatatagcaacaatattagcacctgccagagtgagggagaggtggtgattgcagtaaaatcagcagctcttgcacattgttagcaagcagaaactcaggccgggtagggccagattgtattttgttttttagacaggttttactcagctgctggggctggagtgcagtgatcataatactcactgcagactcgaccacctggactcaagtgatccccttgccccagcctcccaagtactaggattacaggtatgtgccaccacagccagctaacttttaaatttttttgtagagacgatctcactttgctgcccaggctggtcttgaactcctggcctcaagtgatcctcctacctggcctcccaaagggttgggattacaggcatgagccacagtgcttggcctctttttaaaatggagacttcaggacagtctttttcaagacagacatttgatttaaaaaaaaaatgttgcaactaattcaaacttaaacacgctctgccaagcaaaaccttcctgtgggttcaatcaatttctggctgcttgtctgtaatctctgctttaggaattatctaaactgaagggaggagttgtgaactatttgatcttaagaggttcaggctgggcacgatggctcatgcctgtaatccagcactttgggaggcggaggcaggcggatcacctgaggtcaagagttcaagaccagcctgccaacgtgaaaccccgtctctactaaaaatacaaaaattagctgggcgtggtggcgggacctgtaatcccagctatttgggaggctgaggcaggagaatcgcttgaacccaggaggcgaggttgcagtgaaccgagatcacgccattgtactccagcctggatgccaagaataaaaactccgtttcaaaaaaaaaaaaaaggttcaaagggctgtagagtggtgctgatgaaactagtcaaaatcatttagagaaactctagaaaatgcaaactaaactacagtgacagccacaatcagtggttgctggaggtggggcagaaaggagggattctcaagcgggaagcttacggctatgaaggtcatagatatattcactatcttgtggttgttttatgggtgcatatgtgtttaatttatcaacgtgtatatactttaaatatgtacagtttattgtatgtcaattatatttaataaagtcgatgaaaaaaactttagagcaggtgcaggttggtacaactcttatttccatgttaagctacaaatttaaacacctcctcattctcttcccccaaatccagtctagggtcctccaagccaaagaagacaatttagaactttgcaacaggtttttatttttgctttatattattacagtgtttgaaacctaaagaaatacattttctcttcaaatttggatgtgtatataataacatttgtctggactcagcacactcaatgccatgttttcttcgcctatgtctgcttgaaatcaagctgtgtctgtctacccaggggccctgagaacatggaaaatagagtttatgttattagaaaaataaaagcaaatgaatttgcaaagaaaaaccagtgagaaggattagatcatcttccaagggtccatagctggtaacccaagccattctcgggggatatccagtctctgagtggctgggactccattacccactttccttctttaataggtcaaaggcaattcccaaaaagctggctaaaaaagccgacacccaactccagagtctgagggttcatgaagatgtgacttttttttttgagacaagagcctcaccctgtcgcccaggctggcacaatcttggctcctgcaacctctgcctcctaggttcaagagattctcctgcctcagcctcccacgtagctggatcacaggtgcccaccaccacacctggcttattttttttatttttttatttttgtaggacggggttttactatgttggtcaggctggttttgaacccctaacctcaagtgatctgccgcctcagcctcccaaagtgctaggattacaggcatgagccaccgcgcccagctgaagattggattttttttttttttttttttttgagatggagtctcgcactgtcacccaagctggatgcagtggcatgatcttggctcactgcaacctccgcctcctgggttcaagtgattctccgtctcagcctcccaagtagctgggattacaggcgcctgccaccacgcccagctaatttttgtatttttattagagatggggtttcactatgttgccaggctggtctcaaactcctgactcgtgatccacccgcctcggcctcccaaagtgctgggattacaggcatgtgccaccgcgctggccagatgtggactctttaaagacatgctctgagtcagaggttcccagccagtgttggatctctgagagcttacttccttcaatgccccccaggccatggcgtatataatagttaaggagaacagggctggcattcagcaacagggttcaggtacgagctaatgtggacatcagagtcagcctggcccagaggcagctaggcaggccactaagatacactacataaaccttttccatggtgttctgggcctaacatgtaatactgcctcttctaactctcacagcctgcttagttctgcacatagcccagacctgaagcaaagcgcccttgcagagaaaaaaataacagcttaattcacagatttggttggtcttgacctcaagttcttcctttgccacggtctaaatcaggtgtggggctagaggacagataatgagagactgaatcatttatgaaggccttggccaagagcagctagtgcccactacatggatcccagcagggccaaattctcaacttgttggcttacaaaagaatgaaaaagctcaaacagaaaacatactggacaaggttggtccagaacatgaatcctaaatggctatggaataaatttattctgagcaatatctcagtctcacactcactaattctagggtagttctattgaagatgtttaccatggtttagcgcactgagccctgcaccttccccaggctgccagggaagcagagaggtacaaacattcctaatgccccagtcagccgttctccctatggggtccctggattacctgcagggacctgggggaaattggctccctgtttcagctgagagtctggaatctgaaccctagatgaatctactgaagaatgctcaagatgtggataccaagctgagtgagtctaggggagaagagaggcctgaacaaaagagctggggcttcaaagaggtgtatgagaggtgaggttagtagtgccaggctttcctatcttttccttcagtttgctagaaacaagtacaactttagggtgtggggggaaggcaggtagacatgaagaatggaaatacagttcattctgctagacattttaaactggtttggcttgagaaaaatagaagtctgtgcctgagaaccttcttttcctctcccttatttaagtacaatagcagctataactgtgcagttcagctccaaaaaacagggctcctggaagatggctttcatggcagagagtgatggggtagattaatgggctctaggtaaggagcaacaccaagggtccctgaaaactgagccaacacctgctccctgggggggggccatttgtattccctgacccatgtaacaagcctgccagctgtgggtggaatccatgtggttctatcagaaggctgcagccaacatcaaggccggcagtcaccagggtcagctgggatctgaagggaggcttctaagaccagacaccctgttgtactaaagatgatgatttgggggtgggatgcctggaggggctggcaccattcaaaaaatattggaaaacattagccaagaaaaaggctccttgtccctcctaatccatatccagataccccaaccagagatcttaaaaaggatagaccagccatatgccaacatgccaggattccaaagcatgcctcaactaattagggtattccctacagcagactggggtagaggggctccatctggcaataaccagagagccttacctcgcctaggccagggtatggaatctagatgaagatgtccacaaacagtggctctcaagcc

SEQ ID NO: 5096 - DNA, 47285 bp, Homo sapiens
ataaatattgtccactacagagccaagcaatgtgccattattacattttctttctcaaaaattttccatttttcctgtagtttttttcctttgcttatttttctatatactgtcttaattcccccccccaatataccattggatgtgacaaatgtccactgatattcttttccaaaactttatcagttggccgggcgcggtggctcacgcctgtaatcccagcactttgggaggccaggcgggtggatcacgaggtcaagagatcgagaccatcctggctaacatggtgaaacccgtctctactaaaaatattaaaaaaaaaaaaaattagctgggcgtggtggcgggcgcctgagtcccagctactcaggaggctgaagcaggagaatggcgtgaacccgggaggcgaagctgcagtgagccaagatcgcaccactgcactccagcctgggagacagagcgagactccgtccaaaaaaaaaaaaaaactttatcagtaaatgcattaattattccctcccccacaacccgggcctgcttcctagcaccctttgtctttctctccttcccactccgtgtctttttcttctatctggacaagttgccctctaattttgctgcacagctgtcaagctgagactcctctttgcgataatctgtattagattctctgtttcccaaaaaccatgtcttccccttttttgtgtaatatatatattatatatatataatatatatatatatatatataatatatatatatatattaatatatatatatatacacacacacatacatatatatacgcacatatatatgtgtataatatgtgtgtgtgtatatatatatatatatatatcatttttttttttttttttttttttttgagtctcgctctgccaccaaggctggagtgcagtggtgcaatctcggttcactgcaactccgcctcccgggttcacgccattctcctgcctcagcctcccgagtagctgggactatggcgcctgtcaccacgcctggctaattttttgtatttttagcagagacggggtttcacctattagccagaatggtctggatctcctgacctcgtgatccgccggcctcggcttccccaagtgctgggattgcaggcatgagccccggcacccgccttcccttttatattttaactccttgttttgctggattatatcctctagtaagtacccaagacaaggtgcatgagaagtaaaacgtttttagtccctgaatgtctgaaaatacctttaatttgtccccacattttattataaattgttagaaatacttttcccatagacatttcaaggccttgctgcactactttatgacgccagtgttgctcttgagaagtctgatgatctttgtgttgacctttttgaaaatctttcctctctctagaagctgttaggatcttccctttttctttagcattctgaaatttcacaattgtctcattggtacgggttttctaacttttgagcgtgcctttttgatctggagctactttcctttggtttgggaagtattattggattatttctttaattatttcttttgtttggtgtctcttcctctctcatataactcatattagtctgggtgcttcctggattggtcatctgatttcttttccttcccctacccactgccgcccgactgtccatctctttaatttgtgttctgttttctgggagaattctcaattctatctcctgacttttctgttagaatttttatttcaaaagtattatctaattctctgaatgttcctttttttcaaattgtccctttttcatagataaattcttctcatatcttcaagggcattgtgatttctttgaagatttttctgctttttgcttgtctctgttgcctgtgagcaatttttctctattttgggctttgcctttcatgtcacagctttgcccaagtgtttggtgatccttcagtatttagaaatgagacactaaaacatcaatgaaagttctgtgtgtggtgggtagtaaactgattggcctcaatggcaggtgatcaaatgggagtcagctgttttgttatggggcctctgaatgtcattagctgtagataatggtaataatggcagtaaacttacagtaaagttgcaaaactcccatacatgtcttacccagacactattgttaacactttgctgcatttgctttctaattcaatatctctgtgtgtgtgtgtataatatacacacacatatatacacacacatatacacacacacatatacacacacacatataatacatacacacatatatacacacacacacatatagttcctatatatgtgtacacactgaacattttaaatttcaaacatgattccttaaatattaggttggtgcaaaagtaattgtgtttttgccattgaaagtaatggcaaaaccgcaaatacctttgcaccaactgaatacttcgtgtacatttttttaagatcagtgacgttcacttaagaaacaattcagttttcaaactcagatatttaacattaatataatctattattgaatctacagaactccttcaaatttccccattgtcccaacaatattctttatataaattttttttctgggccaggatccaatatagaaagagagcactgcaatgaggtttcgcagctcttttgtcccccttaatcaggaagagcttccagtctttccatatctttcattacattgcccttttttcacactgacatttttgaaaagtcaagccagctattttgtagatttttttttttttttttcgagacggagtttcgctcttgcgcccaggctggagtgtgcaatggtgtgatctctgctcaccacaacctctgcttcctgggtcaagtgattctcctgtctcagccccccaagtagctgggattacaggcatgcaccaccagctgggttaattttgtatttttagtagagacggggttgctccatgttgttcaggctggttcaaactcctgacctcaggtgatccacctgcctcggcctcccaaagtgctgggattacagcctgagccaccgcacccagcctgtagaatgttaatgtcgggtttgtgcaatgtttcctatgattctatccatattgtgcatttttggcagaaacaatgttgtttcctttttgttgaacaggaattgatctacaatttttatccaagattgcctcccacacattatttcattctaccgatgtacctggaaactctccagatgtttatgcagaacaacagccttgctctgattttttcacaatataatttattctaaagagcacactgtacccattcttttgccccgtaaacctttaatggcttttagccaaaagcagtgaaaatctgtctaaattttgccctgctgagttggacctgatgcatttgtttctacactgcccatatgtagactgtacttagaaatatcttgcactttttagatttcgcagcccaacgctggatggatgattaaccaagtaggagggtattaggaacaagaggttgccattttaatgcagtttttgaaaaacaacagctttggccacacctggtgctcacgcctgtaatcccagtactttgggaggccagggcaggcaaatcacttgaggtcagagtttgagacccacctggccaacatggtgaaaccccatctctactaaaaatacaaaaatagctgggtgtggtggcaagtgcctgtaattccagcggcttgggaggctgaggcacgagatcacttgaacctgggaggcggaggttgcagtgagccgagattgtgccattgcgctccacctgggcaacagagtgagactgtatctcaaaaacaaacaaataaataaataaaataacactgtattgagacataattcacatacccataaaactcaccctttaagagtgtaaaatttccgggttttggtatatttacagacttgtagtgatgtaaccatcaccaatatctaattttaaagagttttgatgcagggcagctgagaccccagattgggtctcagcccagcagggttttagctttgtccaggaaagaattcaagagagagcccgtggtgtgagacagcaacttttatgaggtggcggtgtccagcagcagcagagggggcctgctcctgcagtgcagggctgccccaaggcagtgtgctgagagcagcagctctgggcgattctgcagtcatgttgatacccactttagttacatgcagattaaggggcagtttatgcagacatttctaggaaaagggtagtaactttgggtcctcgggtcattgccatggaaggggggtgataactccaggggcgtgccctggaaactgacatggcacactgatatgatgggcatatcttatgctcatcttccacccagtcctgttttagctagtcctcaatttggtcctcaatctggtgtccaagccccacctctggcgtaagtcctgactcctacctgtttcaccatcactgcagttttaagagtaacgaatttgggtccctggtgaagtggccagaggcagagcttctgtgtgaactatttggaggggaggggaaaaactctcccagactgcaggttctgaaaggaatacagagatgtcagagactgcagttgcagagaaagcttttataggagggtgtagaattaaaggacaagaggactctacatgtggatgaggagggcaccctgtccggcagtactgcaagagcaaaagtttggaggtgggagtgaggtagtgcgtctgccggccagaattcttgggccagggtgagcagaaaggttggaggccaaggaaggtgggtggtggtgaaccttatcctgaagtgtgcaaggtgacagtcagaagcttagactccagccacgggccctgcatgtggcctcctagctgtagtctgtccaccgagatcgtgagatgctggtggttgaaagaactgcacctctgagcaggtgaagagagaagctaaggagggtgatggcagaggcgatgggacaggctttctaacaatgaggggctggggatcaacgctctacggaagctaaaagagccccagcaaccacccgcctgggccctgagctccctccaaagcggaggggattcactaagaggttgctcccctagcattgaactcagcatcctatactggtcccaccatgaagacccccaagagtgcttcagaccattgcttctcacattctctgtataaagcactaatttgtttttagatttccaagcatgtcacggaccaatatgtttgttaaatatacaagaatgaattgctagaaagatgaaattaaaaagacatacaccgccaggtgcagtggctacgcccataatctcaccactttgggaggcggaggtaggtgcatcgcttgagcccaggagtcaagatcagcctaggcaacaaagtgagacccccgtatctacaaaacttaaaaaattagcaggtgtggtggcgcagtctgtagtcccagctattctggaggccgaagtgggaggatcgttgaggctgcagtgagccgagatcgcaccactgcactccagcctgggtgatagagtgagctctgtctccaaaaaaaaaaaggacatacatcatgcaagtttggatttttgtttttagatcaactgacgaagttacgggatcaaactgctgtaggagctgccaaacgcttctctccattctggccgcggggccgcggaccgccctttaagtagcccgttttatccccggcagaggtgagccttaggcaggcctagagactttcccgggtcctccaggccggggaacgccccgctcgaggccgggcttgggcggagactgcgccggggctgctgaaaactagccgaggagagccaggagccggagagatcgcgcgcctgccgccgccggagcctgcgagccgagaccgtaagcgccggggccggccgggcccgcactccccggacgcagacgcggttcgggctccgcgcgggctggccgccggggtgggcggcgggccggggcgccgaggggtcggggctgcggtcggcccgcggggtgcagagggacttgtagttggtccgcccccagctcctgccccggccaggagactggcgtgccgcctactgggggaaggagcctgcaggcgaccgcggacttctcgcagggaattcgcgtcccagactgtgggcggacgccgcagggagggaggctcgcgaccccgagagcgcacgcgtcccctggcctgggcgagctctgcttccagggccgtggctcgctcggcggtgaaagcacttaatttgtcacccaagtcggaacactgattttcatgcgcgtccgtgtgaagagacaccaaacaggctttgtgtgagcaacatggctgtttatttcacctgggtgcaggcgggcgagtccgaaaagagtcagccaagggagataggggtggggccgttttataggatttgggtggtaaaggaaaattacagtcaaaggggggttctctggcgggcagagtggggggggtcacaggtgctcagtaggggagcttttgagccaggatgagccaggagaaggaatttcacaagaaatgtcatcagttaaggcaggaacaggtcattttcacttttgtggtggaatgacatcagtaaggcaggaaccggccatctggatgtgtaggtgcaggccacaggggatatgatggcttgcttcggctcagaggcctgacactgatcacaccttttagttgaaatgcgctttcatctcatctgctgccgcagccgccgcccggcaccccctcgctctggtctcgggattgaaggccaccctctcctcttgtagaacaggaaacttgcccgggagttcaccttgtagttgaagccaggaatgtggtcaacctgagcaaaagcgccgcggagaccgagtggccgcctgcctccctcctggcagatgtcggttttctctgagcttctggctccttccttgccctggcggctcccgagtcttggaggtggggtgcctagcaatgttgtaatcctaattttgacttttttttcttaaattgaatgccccctccatagcccacctcccattgtttaaacttcaggttccgcaaagcctgatccgcccctacaggcaacactcgttgtcctggaagttctgtgagggctcagcttgtgctggaggtgggaggtgagggggacccatgcacttggcaggcccgcttccaggacagcccttgctgggattgatgagctgttggtggaaaattgttgaggaccttggggttggtggctgttcggtaccactgtgcagcctcctctgcatccagcataatttaaaataaacattttcagaagccacacttctccagaaagtaacattgttttctggtgtaacggttgcctccttcaggagctaggtttgggggataatagggggcctttcactggccccacttggtctgacttagcacaaaaactctgcgagtgctctccaagcagtttttctttcccaaatttccacacctaggagcgctgaggaggcatgggcggtacttaggaactgctcactgtggaactgaggcacagcgggagcatgccctcgtgggatttgcagttctaggggcagagggataataaacaaaatacattgtaaactataaagtatgttagaagatgatgtgtaatatggagataaataaaactttaagaggggagaggagtgccaggtggaaagggaaggcctcactgaagggtggcactggcatgacctgaagagttagggagcagccaagctgctgcctggggtgcaggtgcaaaggctggggcaggagtgtgcccagcttgaatggcctgatgtttgtgtttgcagagtgtgggtcaagcgatgagtgacctactggataaactgaactagctcagtctgtaagtgaggggactcctgactttctgcggccttcttcccaattccaggaaaggaaggaccttccacagaaaataactatcagcaagacagccagggtgaacctcagcaccatctgtgacaagccacatgctctctgctgatgcctcctgcctctcagctgtgcctgaagcacactagctggcatggacttacgcggtgggaacatcttcaggaagccctgaatgagggctctgtgggcagagggacctttgcagaagggcatcttgaccactgcaggaggtggagtgactctcctggggtgtcctggttcctgctgatgtcttaagcataactggcattttcagggagcccaggttcaccaatgcacagtgccctcctgtcgacctgatacccaggcttggtgattgctcacctggcaccttgattcccgtttggtatcttggcccaggcccagacatgtgaaagcaggggctaccgagattcatttctcattcttacgccaagaggttcaaccacatggatcacagctgggtgtaccaaataagggaggccaagcatgagctggtcacccctgctgaagaagtagctcgaagcccacccactcggggaagagtgggcacagatgggatagacagatagtgattcgaggggtgcctaggatctcatacgaaaacccacctctgctagggccataaatcccatcaacagcaattcattcctttgagagtaatacagtgatgtgggaagaggattgggctggaaaaaagacttggctcatgtcccagcctgccattaatgtgtcccctctctggacctcatctgtaaaatgaggttaggctcagcgactgcaggccttcttgcagctctgctatgtgatgattctgtggcaaagtctgaagggattcaggaaaggaatgtgtaggagggaaacagtaagttttgaagggactcagtgggccctgtgcctctgctgggtccagtgaagacacttcaactagagtgaaggccctggccacagggtagggaggcaaaatcttaagagttcaagggccctgagtcaaggcaggagggtcactgcccacccagctggccccctgggctgcctgtgtgtggttcttgacccagacctagtggcttagggcagagtctccaaggggctgtgggataaggtggggattgcaggagggagaaggcaccccgcagttcccccgttaggggaccaaagcgttgccaaggatccagccacacccctctcctgggagggaggagctggtgggcgctccaggaagagcttcctctcaacaaggagaaaactgccaatccaatcctccgttatataactgagcacacgattgtgcaaaccaagctcacactgacagcctcccctattgtcaaggtttatttactttcccaggggaagtcatagttcatccttctcagcagaaagcagccatttgactgccacagcctgacctacggcattccaggagatggttcagagacctggtgtggagtcctcatgcccacccgccctgctgtctgtgtctttccgttgttgcctggtgggtgggtgtggtttagtgcatggtccagcccccgcacagccacacccttaggctctccaaggcctaactgagcaagcttgcagaagaggggaaagtgttcttttcttgaggagttaaagagacttctggaaaattctccagctactccacaaactaggatcacagccttgttcttaggtcgggagcaggagtttttgctgcctttagcatttgggaagtttgataatagagactgaatttgaatgtctttttggtacttaagagctggattaactacttcacaatctgagcttcatttttaattctttttaaaacagaaaaagtggctgggcaagatggcgccacctgtaatcccagcattttgggaagctgaggtgggtggatcacttgagcccaggagtctgagaccagcctgggcaacaaagtgagacctcgtctctataaagaataaattagctggagtggtggagcacacctgtaatcccagcactttaggaagctgaggcaggaggatctcttagcccaagagttcaagaccaccctgggcaacatagcgagaccctgtctcaaataattttaaaaagaaaaactacctcttcttaagatggttgtagtatgggagatggtgtgtttaagtttcccaccccagtgtcacagctcagggcttctctagccttcctcacagcggttgggggtcccagacacatcctgaagtctaggccgtgttctgagtgtctctgccacgggcccgcctgctggctttagtccaggagcagcctggactgtgactcttgaaggctgtgggaggctggtgccgggagcaggaggtctcagtgcatccctgaagggtcagagagccatgccgtgagaggcaggagcaggcagccattggccctccagccctcaccaaaggccaccacctcagcttgtccctggcaactcagcctgggaatttgctttccctgtggaacgagagacactggccgcattgggggtgactttccggtcctacaaaattgtagccctctttctgctagaactggtgagactggctaatttcggagagactttaggaaagtaagagaaatacattggtcccagtgccaagcccaaggccatctttccaggtatgggtatatcctgcagtgataagagaagactgactcttccagctctttgggggaaatgaatatactttcccacgttccagtttttctggctgtggcagacctgtttgctgccaagttgttcctgtggggaaacagcagtgggcccagcaaatgtagcaccaggtcggggcacagccaccaggtggaagaagcaaccctgccctcttccggttccagtgtgcctcactgaggcaggacttccagaccctaccaggaaggctgctatccgggtcatgtgataccctgtcaggacatcgttgtttttgtcttgtttttttttgagacagggtctggtctgttgtccaggctggagtgcagtggcgccatctcagctgtctgcaaactccgccccacaggctcaagccatcctcagcctcccaagtagctgggattacaggcgtgcaccaccatgccagctaattttcttttttttttttttttttttttgtagagacaaggtttcactgtgttcccaggctggtcttgaactcctgggctcaagcgatccacctgcctcagcctcccaaagtctgggattacaggcgtgagccacggcacccggtcgagatggaacatcttaatttcagagtgccttcaggactgttgattgaaccccataaatatttttagtcttttgggacttttaaatcctttttgaaacctaagcattgccacaaacaaactaaccttcaccacgaccaaacaaccagaactcggaccctggtcctcgggctgccctacaggaagcacccctagtcctcttgctctctgctagatgagacggcaggctcaggttcctccatgaggcccggctttcagtgctctctgttacacactgcaaggaagcttccagatcgtggagcacattgttgaggaaaagacacttggggagaagggggaggtgcagagtgtggttaatggtgggaaggaactccggtaagtggttatatgatctgctcctattatcccctggaataggagcctctctccactcaagtagagatgccaaggactggcccggcatggtggctcatgcctgtaatcccggcactttgggaggcaaagcaggcggatcgcttaacaggagtttgagaccagcctggccaacatggcgaaaccctttcctactaaaaatacaaaaatcagccgggcatggtggtggcaggtgcctgtaatcccgctactcaggaggctgaggcatgagaattgcttgaatctgggaggtcgaggctgcagtggctgagattgcaccattgcactccagcctgggcaataaagcaaggctctgtctttaaaataaaagaaaaaacaagttattctaactttttttaattttaaaagattaaaaaaagagaagtcaaggactgaaattgcatagagggcaatgctttttctttataggtggtgaactgggtctgcttgagttttttctctggtaatttagaaccaatggaagcaactcaacagctctaatttaattggcagaatgtgagatggaatgggacctcaaatgaaactccaggccaagagctctgagccctgcagcatgtggggcatctctcggtcttcttgagttctgtaacttaaagttttgtggcctttaaagagtgtggaagtagccgtcccctctccgaaggtgcacaggatttggcagcccacccgcgtggccttccccttcccctctccagaccctccacagcagatggggcccggaggcctggagaagtggagtcactgacctgaggctacatggctggcaggcagcagggcaggcagcaaagcaggcagtgagggcctaactgcccgcgggctggctcggggctccctcaccacattggcatcccagtgccaatcccaaattgttttctttctatctctccagacatgagatagcatggaggtggagggaattccctcccacacagagggcgatatgccccagaacacactcctgcccccaagaaggctgtctcctgacactttttactgctcttttactctccccagctttttttttcctgcttgtaaactgcatttttcctttcccttggtttctggctctaactgttttcccagggcttggctccggcgcttgcacagagataaacacggccattggcctgtgcacaatcccagcttgcctgcatccggcctcttccatcctgagtctccaggggtccctgggttcagggacaatggctgagggagaagctgggagttccccccagggtttgcctccgtactcttgggccagccaagggagtggggctgggagcttcaggatggcttttgggaagccctgggagccccaaggcttgggtagctgctgacagggagttcacagcaggaacgctcccagctcccatcctgcgtccgcttggcaggcaggccaggaatgggagggaagccatccgttttccctttccactggatgttcccttcgccttccccagggaggagtgatgaggctggggtgcggggagggcagtatgggggcaggcttgggaccaggcctgcagaagcagcagaccctccagcccacctacctctctggcctggcatctgaggggcaggtcatgccatagtttttcccttccctctctgcccccacactttcctccccaaagtggcagacttcccccaggagaagcactgcttttcacgctgctgtgagtctcagtcactattagagaaacacagtcagagccaggccgcccaactgtcgcagggctgggtccacctcatggcctttgttctggaaaaatacttgggattctgccctgcaatgcacttagccaaggccgggcacatggcaagtgctgagtcatggcggctagcactttactgcgattttaggagcactttcttgtggtgaggttctgactgcttgttgggttgggggaggggagtctttgggcaggcggtagacctgccctttactttgtgtggcggatctgagtctgaccccatctttttagacccaaaaccctgatatttgtagtgcgcctggatactggttctccagtcttctttggggtcagggggcgttatagtgcctcatgccaccactcagccctcttcctgcatcttatggtctgtctctaccaactaggctaagtaggttattttattattcctcaaggggaattcagctcttcttgttcaaaagttctgattaattttcttgctctcattcaaagaatttttaaattcattcattcattcaacaaataattaagcttctctagaatgccaggcactgagagtccagatgggagccaaagcagacatggtcagtggcctcaggagcttccgtccagctgtcagtcacataatcaccctgacaaatgtgagctcgacgaggctaggactgagagatctgccttgctgggataggtcaggagaggctacccagaggaggacagtcagtctgaaatctgaaaggtggatagaagttagggaggtgggaaggggagggaaagcttttcgacagagggattcgccttcataaagccccacagtaagacagcatggtgagccaaaactgaaagatcggggggcagcgtgagatcccagccctaaaactctcacttagcttcaagtaaactgtttctccataatattgataccagtagcactctgaggggctaggggagtgtgagatcacacaggccttgaaggccacactaacccaaggacaatgggaagctctttaaggtttcgcaggggatgggatatacatgatcagatttgcatttccaaaagatcactctggctggctcatgcctgtaatccagctatttgggaggctaaagcaggaggatcacttgagccaggagtttgagaccagcctgggcaatatagtgagaacctgtctccattaaaaaaaaaaaaaaaaaaaggtttgtatggtggctcacgcctgtaatcccagcactttgggaggcggagggggcggatcacgaggtcaggagattgagaccatcctggccaatatggtgaaaccccatcctgctaaaaatacaaaaaattagccgggcgtagtggcgggcgcctgtagtcccagctactgggaggctgaggcaggagaatggcgtgaacccgggaggcggagcttgcagtgagccgaattgcgccactgcactccagcctgggcgacagagcgagactccgtctcaaaaaaaaaaaaaaaaaaaatacaaaaattatctgggcatggtggcatgcgcctgtagtccccgctactcggagactgaggcaggagacttgcttgaaccagggcggaggttgcagtgagccgagatcggccactgcactccagcctggggacagagagagactccatctaaaaaaaaaaaaaatgtttaaaaagattgctgtggcttcagagtggccattgtgttggaaggggtagagcagatgtggtggaccgggcagggtagtagtccaggggagagccacaggaacctgggctgggttggagtggatttgagatgtactttggaagttcagctgccagaacttactgatatctgtggcggatgaaggagaggggtttcaaggacgttgcctgggtttttggcttggcagtagcagggcggtaatgtcagttactgagggagggaacaccaagagaagacaaagtttagggggacaggatacagtgcgatttcagatgcactggagaaaattttgacacaaggtactgtctgggccccagtggctctgctctaatacatttataactctttgtccgcacttaatcactctgtcatactagctgccagggggccaagaaatgtcaagtgtttggctggtcttctccaactaaaattaaaatcctttgctaaggaagaaggagagaacattgctagcagtctgcctcaacatcccaattgatggcgtatttgccgcagccaccagctcatcaaggacagctgcggtgaacctttgagtctgagtaatctcctgtctgggccacctttcttcactcaaccacaaaatcctcacattccaagtatattttctttctttcttttttttgtttttttgagacagagtcttgctgtgttcccaggctggagtgcagtggtgtgatcttggctcactgcaacctccgcctcctgggttcagcaattctccctgcctcagcctcctgagtagctgggattacaggcatgcccggctaattttgtatttttagtagagacggagtttcaccatgttggccaggctggtcttgaactcctgcctcaggtgatctgcccaccttggcctccaaagtgctgggattacaagcatgagccacccgcctgtccccaagtatattttcttagctcactcttttcagcatgtaatttacagaaggtaatctgaattgtaaacacgatttctaagttaaaactcctgggtcagctcgtgatgaagagcaatttataaaagagatagtatagtaataaatgagacaactacactcggaaatgtggatcatcaactcttatgcgaaaatagcctatgagactcttgtgttttttcattcatgccagcgcttcctcacttccatcccattccattccacatgctcttctttctgcctggattattccattccaccattatttttctcctggtaaactcctattcatacttaaaaaccctgctcatgaccccttctctgtgaaaactttgtggcaaaacctaaccacttctgcttgtgcacactctcttccatctgtgtgcatatagtatgtgtctataactggaagggtgtttatctgttatcgtttgtctgccctgctaaagtgtgagctcctacagttacagggttgtgtgttagtcctgtgcctgcacagtacccagccagtagttacactcagtgttgctgaaccaacctctggtcaaaaacatgtttatacttgcttttccaaggcgccaatccaaatctcttatttactttaaaaacaaataacttcttggcactttaaaaaccacattcaaataacagaaaaagagttcattgaactttaagtatcaatcttaaaatgaattgtatgttttaaaacttgacttagtgacacacttaagagaatttttaaaaagcaaacttttatttttaccccagtgtaacaaatattagttccattaaattattaaactgatctaccttttcttttttttttgagatggagtcttgcctgttgcccaggctggagtctagtggggcaatctcggctcactgcaacctccgcctaccaggttcaagcgattcttctgcctcagcctcccgagtagctgggactacaagtgcacactccacacccagctaatttttgtgtttttagtagagacggggtttcaccatgttggccaggtggtcacgaactcctgacctaaagtgatctgctcgccttggcctcccaaagtgctgggatacaggtgtgagccaccatacccagcctgtttttcattttttggttctttttttttttttttttttttttgagacaggttcttcctctcaggctggagtgcagtgatcatagctcactcagcctcaaccacctgggctcaagcaatcttcccacttcagcctcccgagtagctgggactcaggcatgcaccaccatgcctggctaatttttttttattatttgtggagatggggtttgccatgttgcccaggctggtctcaaactcctgggctcaagtaatctacctgcgttggctcccaaagtgctgggattacaggtgatttaccttttaactgtgccaaagaacaaagcactactttatttgctctcctgtatttaaaatggtcctttatacctcagatccagaaagataacacaagtaaactaacaagtactctacttgtatcatttgttgttttctaacagtttacattagtccatctttgaagggtaaagaccattgattgctcatctaacttcttcaccttgaattagtgagattttcttccacctttcacaaatgcatgcccaaaatttgacttcagtgtagattggaattaaaatgtatgcaatcccatttcttacagtaggagccaaatgttcatcaagtcccctctgagctcagtatcttgtagctaaatgaccactatcttccagtcacgtttttaaaaaaatcatgctggtttgcaacaaaaattgtattttctttactaggcaagtgaaccatttgttgggaagagtaccttggcttcgagaaaaaaatgatttcattctgaaaggcttccctccaaccccctcctgcacaaactctcagcccagtaacttgtcagtattctggaaaagtgattacaaaacaaaaactcgaatcagataaaatatatctctggaacttttgaggcagatcatgaagctctgatttcaggtgctagcaaaataaagcaggcactctcattttgtattgtttacttctcagtttttcatggtgtctcctaaactttgatgttttgaagaagttctaatgttgctacatcagcaggagctgaccacagggaagagataaatatagctctccttggaaagggaaggcttagccaccagaattctgccccttgatgctgagaatgcaccttctccgaacagtggaaaagaggggtggagattaccccagggacatatcttgcaaaatgctgatacccgaaatgtacatagccttgtgctttggtcatcctcccaaatcatgtccttggtgaaggcacatgagaggagagcagatgctgccagaccacggtgcctgacgccatgcactccctcacgtccgcctgtttatgtgcacacggctgcagcgggaccttggggtgtgggctaaataacaagaaaggggctcctctggggtctgttacaaggcagagatgctccacggtaattagggatttagggaagaggaaggaacacacatgttgataataagtagttcaacattattatccccattttcagatgcagctactgagcttagagaggtttcataacttgcccagagcccctcaactagtaacagtggagccgagatttgaacgacccaaagaggaaagcaaacaagcagcccctttatactttttttttttttaagatgagggtcttgctatgttgcccaggctgatattgaattccggccacaagtgattcaccaccttggccccacgaagtactgggattacagtcatgagctacacactgggccaaagccctcgtattgtaacctccaagatgttttcatttctaaagtcaaggttgtcagagttgctgttttgcagggagccatgggatggggagtctccgggaaacccagctggctccttaaatggcatcacccaagttggccatcaagcttccccagactcagtcaccggccccctctttccctggctgtagagcaggggtttggactcgaggctgctgagttccttccagcttccatgcccagtggcagtgacttatcaactggcccacccggtggatgtagggtgatgcagccctgctctgtcctcttgagtgctgggtggccatgagagagggaggccatggagggaggggagggttctcatctgcttagtgccaccccctccccagcccaccccaggtctctgccgccttgggttcctgcgtgagcagtccttctcactctgggcgatgttcgctttcccagcccaaccccaagaagtccaccctggggaggacagagggagtctccacggctccaccccccatgctttgtcggagatctggccaggcagagtggtgccctcttgactgagcctcggcctttgctttccccttactccacataaagccgcagccctggcgagggagcccagaggctgaggacagcctgctgggtgcctggcactctctagatcctccctgcctgggcggtgggctctgcaattctccctgtctcgaactgcagcagaatgtgtgggcagggttaggcagataggagtgggtgcctggactcattggtcagactctaagaccgcccacccccgccgcccccgcgtccttcccaggactggctgacccaccagataggggagggtgttgtttcttattattacttttttgagaaaagctatgcaggcctgggagacgtctgtgccctaggagtcccttctggctgaagactcaaggctgcaaacaggtgctgagagggaacaagaaggggagttggggtgcacacacccagtgacagaccaggagtgagtgctgtggccacagattctaatcctcacaacgcagtgtgatttaggctaagccccttgcctactccgattcttgccttaaataagtgaaaggaaagtcaagtttgatgagttgtggctctttagtgggtggatttgcatgtaccatggatacatttaccagggtctaggaattgtcaagcgcccagcaggctgccatcaggcctccgactccttcgccaggcggctttatttggagtaagaggaaagcaaaggtttgaggctcagtcagagggcgccactctgcctggccagctctccgacaaagcagacgggggggtgtggagcctggtgaccccctccgtcctccccagggtgggctccttgggcttgggctggtggaagtgatattgcctgcagcaagaagaaggactgttcatgtgggagcgcaaggcggcagcggggttgaaacccacccccacacagtcaacacctgctgtcacaccaggctaatcaagaacaccttctttggtgcattaaccacctgctattaaataaagggctgttactaggtggcaaagtaaccactgcagtagagcctatttgtaatctgagatcagtggctgtaaggcaccatccttgagcaagcaagtactaatattcttgttatcttaattagaatgcaagagatcgtgtttttaaattctctttgaatctgtcactttgccctcctcttcctgggtgatacacctggtagtgctgtgggggccatcataatgccccttgtcccagattcccttcttttagatgggactcgagcatgatcatttcagccctgtatctctcaggtcagcgtggttcagtttgctgtgcagagtccggggagataaccacgctgtgcacacatgagattggctgacttggcaggactgtgcaatttcagaaggccgtggggagtgggggccagtgcctgcagcctgccctgcctctctcacaggccttagagcatcgccaggtgcagagctccacagctctctttcccaaggagtaatcagaggtgagaacgtggagcctggtggacaggtgaaagcactgggatctttctgcccagaaagggaaagttgcacatttatatcctagagggaagcgacagcagtgcttctccctgtgctgagtacaggtaaggagggtggtttgtaaagttcactggggagggtgatccctctttattgtttaatattatgctcgcagcctccttgacaacatcatgcaaaatgtgtcttactagcttctgtgcataaaatattggtggagctcttcgctgtgctgggccagtcaccagtgctgggcacgtgggtcaaggcagtgcccaggacgggcacagccctgccttcccaagctatggtttatttggtaggatctgcctgcccagtgaagtgtgttcagctgctcctgttgctgggggaagcttgctctctgccttcggctgcctcccacacgctcccatgtgtctcccagtccctaaccccagtcctgctttcaataccgcaggggcttttagctgacttttctccatcttcttaaagggaggatttcctggcagagacataacgtctttctggaaatgaaagaagctgatgcatgtttttcttttctgaattacttaaataagaggaactcatttccaggtattccctgccttgttttattgtgggagtgtggtcccagctgcccatctgatcagctgacatagggtccttggggccaggcactgttactgcttgggattgaaagatgaaagccacagggccaggcacagcagctgtgcctctaatctcatcactttggaaagccgaggtgggcggatcgctggaggtcaggagttgagaccagcctggccaacatggtgaaacgctgtctttactaaaaatacaaaaattagaggaggtggtggtatgcacctgtaatcacagctactcaggagtctgaggcacgagaatccttgaacccagggacagaagttgcagtgagccgagatcgcaccactgcactctttgagatctgtctcaaaaaaaaaaaaaaaaaaaaaaagggaaagcaatggcctggcttggctggaatggaacatgcatcaacgtgtcccacgtgtctccagcagggatagcgaaggcctgcccctggcacatggtagactgagtaaatgttgatcagtgagaccttgaggcactttagagtttacaatccagagagggagatagattggaagttcaagggtggacacctgggcatgattcccggacgaaggctgcagtcggttctaagaagtatgctggtgactatgagagaagaggttgtggtttcctctcttgaaagctgtctccataatcacatgtggggtgataagggctctggtcaggggagggggcgaggcacacagggggctgaatctgatggcatgaggacttggtgatggctgtggggaaagaattggagatgactctagggcctgagggtgggaagctgggagttcacgggatcactgatagaaacgcggaggtggggggtgccaagctgattttcctgattagattcctacagaactgcaggaataaggcgagagccatcgccctgggtggatttctgtttggagtctatcgctggaccactgtggacaagtatttcatagaacgacccccagtagcccaattcaggtttagaggggcagctcttgacaggagcaaactccagggcctctgcaaccccccagcgagtcccaaacatctgacatgtagccaatggaggacatgcaagtggtggggttcccagcgggaccacctcctgccttgggtttccaagacagagcgaggggtgctgctggggcgtggttgcaggggccttgtcagaactcgatgctttctcctccgtctgggtcctaactgcagtgctctagagaccctcctctgactcaggcataaggacggcccgcatattcatgcaggttacttgaacaagaacagtctgtgggttacttccctaggaatgaggaagatgaagagctagatacaatgctgggctggtatctgcctgatagtgctttgccaagactatggtttcttcctctttgatcaaaaaagacacaggagtcagacaaatggggattaaaagacaactgagttgatgtaaatgtaacaggcaacactatggacacagaaagtagattagaggctgcttaggacctaagtggagggcagtaggggagcgacagctgaagggtatggagtttctccgtgccgatgaaatgttctacagttgactgtggctatggctgcacatgtctgtgaatatcctagaaaccactgagggttcactttaaatgggcgaattgtatggtatatgaattatgtttcaataaagctctacacagctaagctgtgtggccatggctgggcttcctagcagtgtcccccaaccccaaatgaacttactctcccagcacttgggcctccccattaccccctgtctgccctgaggataacctctctccaagaaggacagagcaggggctgtgggccaccattcaggaaaggtgctccttcccctgggggagggaacccagaggtcatggacagaagccttctcagacatgcaaaaaaatgaggctgtcgggcgccgtggctcacacctgtaatcccagcactttgggaggccgagggggcggatcacgaggtcaagagattgagaccatcctggctaacatggtgaaaccccatcctactaaaaatacaaaaattagctgggtgtggtggcacgtgcctgtagtcccagctactgggaggctgaggcaggagaatggtgggaacctgggaggcaaaggttgcaatgagctgagttgtgccactgcactccagcctggtgacacagtgaaactccatctcaaaaaaaaaaacacatgaggcctcagaaatgtagctcccaaaaccccctacccagggctgtgcagaagccaaccaggttcctattttcccaggatgatgaacagttttcaaagcttagtaggattgtgggtattttgtctcattgtctgttgtttttccatttttctagatcatatatatataatatttaactatatataatatgtatatagtgtgtgtatatatatatataatatgtatatattaggtaagtgtaaataaaatcagggacagggttggagcgcagcaggaaagagcctgctggggatagagtctctgggctgtcagggccgggctgggcgggctccgttgttaatggcttcccctctcttgcaggagccatgtggctagaaatcctcctcacttcagtgctgggctttgccatctctggttcatctcccgggacaaagaggaaactttgccacttgaagatgggtggtgggggcaggcacgaggtccgcagccagggaggacgacagcatccgccctttcaaggtggaaacgtagatgaggagatccacgtaaggcaccttgggccgggccgggctgggcagtggagagggtgtgtgtcgaagacaggggttgggtcttaggccagatgcgggaggggacgggggcttgggatggtccatcctacttgggagtgtgtttcagtctgcttttcctctgctgggcaggtgcagttgctttggagagggatgcccagccctcccactttctctcttctcctttccctacccaggcccagcagtgctcaggcaggagatggggtaacctgtatcaaaggtcacagaaagcagtgtcatcacctcctctatgccctgcctgaagccttgggagtgaggttgtgggagaaagtagcaggttcccgtcagagacccaggaagcactgagaaggcagggatgctactggttaggaccggctgtgtgtcagccattcctggtcacattcaatccctacggtgatcccgcggggtaggattgttgttcccaaactgcagatgcagaagctgaagctcaggggcataaagcaactgttcaaggcggcctagctaacatgcggaaggatttgaagtccaatctaatcctgaagctctgcccctcctctgcacagggatagagtcaggaaggaggtgactgggcaggtggggtgactgagaatgcattctcggggaggagcaaggcttgagtgggggacaggacggtaggcaggctggcatggccctgccaatcctttctttcattccgtgggttttgagcacctactgtgtgaggcccagtgagtgcttgggagaagagacagccccttccgtccaacagcatacagtccatgaatgagaaaaggaatgtgcacaaagaaaagtagactaaaagataaataaagataggcaggtgcggtggctcacgcttttaatcccagcactttaggaggctgaggcggtggatcactgaggtcaggagttcaagaccagcctggccaacatcgtgaaaccccgtctctactaaaatacaaaaaattagccgggcatagtggcgggcacctataataatcccagctactcgggagctgaggcaggagaatcccttgaacccaggaggcagaggctgcagtgagccaagatcacacactgcactccagcctgggcaacaagagtgaaatgccatctcaaaaaaagaaacagatgataaggataaatgtcacaaaaagcatggataaaagtcatgagagttccaaggaggaagaatttaaaagcagaagctgggctaaacccaagagcaaccaggctgaggctccctgggtagacttgcttgctgcagccttgctatttagggccaaggctgagccctaaggaaagctccttagggaattagactcctaagggagtctgagatttccaaaatctgtttgggggtaactgaacacttgggaagaagcctgggaatggtgatgcttgagaggctctctaagctgacatgaactcctccctctggggctggccttttagcctaatacatgccaatgagacttgcaccctctccctggtctgtaaattttttagtttttggagacagggtcttgctctgtcaccaggctgggtgcagtggtgcgatcttggctcactgcaacctccgcctcctgggttcaagcgattctccgcctcagcctcccaagtagctggcattacaggcacctgtcaccatgcctggctaattttgtatttttagtagagatggggtttcgccatgttggccaggctggtctcgaactcctgactcaagtgatccacctgccttggcctcccaaagcactgggattacaggcgtgaaccaccggctgggcctggcctgtaatttttatcccaactcagttataatgtatcattcaatgttgttatcaggggtcaggaaaccaggcccatagaccaaatgtagcctgctacctgttttagcaagcgcccatgccaagaatagtgtttacctctttaaatagttagggggaaaaaaatcaaagaagaataatagtttgtgacgtgaaaattatatagcagtcagatttcagtgtccataaattttattggaacacagccacccccattcatctgtgcattggctatggctgtccataaataagttttattggaacacagccacccccattcatctgtgcattggctgtggctgctttcaactatgaagacagagtggagtcactgcagcctgcaaagcctagaatatttactatctggcctttacagaaaaagtttgccgactcccgctgtagagacgcctgggtaaattaaagatggtatcgtgtatacacttaaagagtaaaagatgagctgggcgcagtggcttacacctgtatcccaccactttgggaggccaaggcagacagatcacttgaagccaggagttcaagaccacctggccaacatggcaaaaccccgtctctactaaaaatgcaaaaattagccggacatggggctcacacctgtaatcccagctactctgggagctgaggcatgactggcttgaacctggaggtgggggttgcagtgggccgagatcacgccactgccctccagcctgggcaacagagtagaccctatctcaaaaaaaaaaaaagaaaaaagaaaaaagaaatgcgaagtctacagtgagaaggaagaagtgaagaacacatccgctttgggagtagccagtgatgtgggaaactgcttgccactcccagagggcagtatcttgtggctgcagggtttgctgtgttttctggaaacgactttgctcttgtgctctgtccttcccatccctctcaacttggggtcctgaattttgcccaggacttacaccagaggatcgataagttccgtttcaccccacctttggaggacagctcttccactatggcttcaactccaactacctgaagaaagtcatctcctactggcggaatgatttgactggaagaagcaggtggagattctcaacagataccctcacttcaagactaagatgaaggtatgtttgcaaaacgccagccagagagggatgtatgtcatgagaacagccttctccacaatgtgacttacagtcagataaagttggagagattcagaacccaattataggtcctgagatgtacttatacgttgtaaccttactaaatgcaaaaatattgcagtcacaacaatctgtccatctttagagctaggcaggaacacatacatgcaatttaaaaaccaaagaaatcaccatccagtccaatgatgtggcaatctttgagaggaaggatggagatgagatttagaccaggccaagtggggtggctcagaactgtaatcccagcactttgggaggctgaggtgggagatcacgaggtcaagagttcaagcagcctggccaagatggtgaaatcccatctctactgaaatacaaaaaatagccaggtgtgttggcaggcagctgtaatcccagctactctggagctgaagcagagaattgcttgaagccaggaggcggaggttgcagtgagccaagatcgcgcactgcactccagcctgggctccatctcaaagaaagaaaagactctgctctcagttctttggatctatactcagaagtggacttgttggatcatacggtaattctgcgtttaattttctaggaaccgccatactgcgttccgcagcagctgcaccattttactttcccacccaacaatcctcagaatcccgattctccaaatccttgccaatatttttttcctttctttttttcggtatggtcatcctaatgggtatgaaatggtatcacattgtggttttgagttgcattttcctatgattactgatgttgagcattttttatgcggtacttattggattctttgtaatttctcgaagaaatgtctgttcatgtcttttgtccattttttgggtgttttattagggtttaggattctctatatattctgaataaaatctcttatatttgcaaatgttttctcccactctgtggttgccatacaattaatctttttcagagacaaggtcttgctgtgttgctcaggctggaggcagcggctattcacaggcgtgatcatggctcaccacagcctcgaactcctgggctcaacaatcctctcgcctcagacctcctgaatagctggtactataggcgagcaccactgtgccagcttgttaattttttatattgaagaaattgtacatgttaggaatcttatttttaatgtttaagataatttggccttttcaaggaacagtgaagattttaatttgttaaaattctaggattacttaaagtgtatgaaagacatgttggtcagtcagataaactaaagttcctaaaaaaggaaattgaaattatagtgttaactgggtgtggtggcatgcacctgtagtcccagctatcaggaggctgaggcaggaggattgcttgagcccaggaattcaaggctgcagtgagctaaaggacaccactgcactgggtgacagatcaagaccccatctcttaaaaaaagagagagagctgggcacggtggcgcacgcctgtaatcccagcactttgggaggctgaggcaggtggacacgaggtcaggaggttgagaccatcgtagctaacacggtgaaatcctgtctctaataaaatacaaaaaattagccaggtgtggtggcgggtgcctgtagtcccagctactcgggaggtgaggcaggagaatggcgtgaacccaggagatggagcttgtggtgagctgagatcacacactgcactccagcctgggcgacagaatgagactctgtctttaaaaaaaaaaaaaaaaaaaggctgggcgccgtggctcacgcctgtaatcccagcactttgggaggtcaaggcgggcaatcacaaggtcaggagatcgagaccatcctggtctaacttggtgaaaccccgtctctacaaaaatacaaaaaattagccgggcgtggtggcaggcgcctgtggtcccagctacttgggggctgaggcagaagaatagcgtgaacccggaaggcggagcttgcagtgagcccagattggccactgcactccagcctgggtgacagggcaagactctgtctcaaaaaaaaaaaaaagaaaaaaaaaaaagccgggtgcggtggctcacacctgtaatcctagcactgtgggaggccgggcgggtggatcccaaggtcaagagatcgagaccatcctggccaacatggtgaaacccctctctactaaaaatacaaaaattagctgggcatggtggcacgtgcctgtagttccagctctcgggaggctgaggcaaaagaattgcttgaaccagggaggcggaggttgcagtgagccagatcgcgccactgcactccagcctggcaacagagcaagactccatctcaaaaaaaaaggagaaaggaaggatggacggaaacctcgacttggaggtgccagggcagcaaacatccttttctgatgcaagcaggccaggcctgtgggagaatgagccagagaaaagctaagtcaaatccagtggtgtgtgtcctggaactagagcccatcctggagctcagccaagaacactaaaaaaaaaaaaaaaaaaaaatctggaatgattttttggatcaaatttggacttctcttgagtttgctgtattctttacagtaatttgatatcttctattatgagcctaacaagaggatccagccacttaatcccagccaaactgctgtatgcaattaccataggttcctgtttggattccggcacgaaattgcctggcttccttgagtttgacttggatccctgtgttgtcccagctctcagtgtccatccagcagaaactaacagggcgcctgctgtacccaggcattctgctggggtggggacgcatagagaggacagggtccctccttcacagctcataggctcttcaggggcattccagcacatagtggcggtgttctgaaggaggaggctctgggagcttcatgagccccaaatcttcctttgaatgtgagggaaggcttcctggaggaggtggcatctaagctgaaatggtgggactttgccaggtgtgtggggaaggtggtccaagaaaggggaacagcatgttcaaggcccagaggcaggaggcagtaaagggccctttccatcctggcagctgccagccttacccactggaccctttcagggttcttcatgagactgggttttttttagagacagggtctcacctgtcagccaggctggagtgcagtggtgtgatcacagttcattgcagcctcaatttcctagctcaagcgatcctcccacctcagcctctcaagtagctgggaccacaggtatgcaccacacactaggcttttttttttttttttttttttcttgagacggagtctcgctctgtcaccaggctggagtgcagtgacgcaatctcgactcactgcaagctccgcctcccaggttcacgcattctcctgcctcagcctcccgagtagctgggactacaggcgcccgccaccatgcccactaattttttgtatttttagtagagacggggtttcaccgtgttagccaggatgatcttgtcgcctgacctcgtgatccacctgcctcagcctcccaaagtgctgggattacaggtatggccacggcacccggcctttgttttttctttcctttttttttttttttacatttttagtaagacaaggtctcaccatgtcacccaggctgatcgcaaactcctgggctcaagcaattctccaccttggcttcccaaagtatcaggattataggtgtgagccaccacacccagctgacatgggcatttatggtacaaaacctccctcaggtacaacggctccaaaagagccagtttccgcattgaattcatcgtggacttacccatgtgtggttctggcaccctgcccggggctggagcctgttcttggccttggtcctttagaataggagtaaatttggcaacataggaggacaccaggatacattgttaagttaaaaaaaaagagattctaaaatagaatgtatgtatggttcatttttgttaaaagttatgttctctaagtctttttaaaaagtttgaactgtcacagccagaagggtctaaagagacatgacagctcagtggtgtgtgagtcctggatgggatcctggacagaaaatggatatcaggggaaaaactgaggaaatctggctcatattttgttgtgtgtaataccagcattatccaggttttaaaaaggagaaaatcctggccgggtgtggtggctcacccagtaatcccaacactttgagaggccaaggtgggaggatggcttgagcccagtagtttagaccagcctgggcaacatagcgagaccccttctctacaaaaaaaaataacaaaaatagctagacatggtgttgcccacctgtagtcccagctacttgagaggctgaggtgggaggatacttgagcctgggaggttgaggctgcagtgagccgtgattgtgccactgcacttcagccgggcaacacagtgagacctcatctctaaaagaagaagaaaaaaaaaggaaatcctgcaagtgtgacaacatgaataaactctgaggaaataatgctaagtgaagtaagccagggacagacaaataccgcatgattccacctatagaaggaatctgaaatagtcaaactcagcagaagagagaggagaagggtggttgtcaggggctggggaataggggaaacggcattgctgatcgtgctgtgtaaagtttgagtcctgccagccgaatacatcctagagatgggctgtacagcaagcgccgtcagtgttggacacttacaatctgttaaaagggtaggacccatattaagtgtctcgccatataataaaaagtgtaaacactaaggaaatcaatggactttatagttaataaatctcagtctggttcgttaattgtaataaatgtaccatgctaacataaaatattaataaggaggaaacccggtgggtgtgaggtatatgggagttttctggactctttgcagtttttcgcaatctaaaactgttccaaaataaagtttagacagacaacaccatgttttctttagaggtgggattacatgtgagtcttccccctttggcttatctgtgttttctaagttttctacataaacatgtattatttgtataatatattaacgacagaacagaacattagctagaccatgtgactgcaccagccctggtggcagagagttccaagcatggcagccgccctcactgtgaagccgtaaggccccaggtgctgtccagggcactggcctgggaaggggctgccttcttttgtatgcagaggccccaagtcagtccagaggagacaagaatccattcacctgcccttggcttgatgatgttttcagcattgcacttaaaaaaaaatcttccactttattttattttaatttttgagatggagtcttgctctgttgcccaggctggagtgtggtggtgtgatctcggctcgtgcaacctctgcttcccaggttcaagcgattctcttgcctcagcctcccgagtagctgaattgcaggcgcctgtcagcatgcccgggtaatttttttgtatttttagtagagacgggtttcaccatgttggccaggctggtcttgagctcctgaccttaggtgatccacccgcctcgccttccaaagtgctgggattacaggcgtgagccaccacaccaggcccaaaaatcctccctttaaagaaaatatcatttggtaatcagaaaaaggtgacattttgtcaatgtgtatgaaaaaattatgcatttaatacctgttcattgtagaaaaattggaaagtacataaaactcaagagaaattaaaagcactggaatctactgctcaggagaactgctttttacattcttggatttatcctcccagacttttaaaattcaccaatacatggtataagtacagtataagcataatgactttttataaaaactgggtcacacaatggatatgacttgatcatttgcttttacccccagcaatatcttctgatcagttttctatgttaaataaatatacatctaccttgtcagttagatgactgtactggactccagtatactgtcaaactatacttgattaatcctgtattctggatacgtggggctttctccctaccctccagattttaaattattgaacaagtatttaggaggcctgctgtgagccaggagctgtcctgagccctggaaacccagcagtggctgtacgacctggcccagctgtcagggggcacctctaaggaaaccgggaggcaataatcgtagctccttgcagggaggttgtgaaggctgagtgaggacatctgtgcacctggagcacagtgtggtgtgaaaccagtgtcagcccttattactgtcaataccatgaagggggggcgggggcacaagggtggcaggactcaatatctaggctctggggggtgccagagcctgaccgtgcagggcttctctctccctccaccctgactgtgctctgtccccccagggctggacatccacttcaccacgtgaagcccccccagctgcccgcaggccataccccgaagcccttgctgatggtgccggctggcccggctctttctacgagttttataagatcatcccactcctgactgaccccagaaccatggcctgagcgatgagcacgtttttgaagtcatctgcccttccatccctggcttggcttctcagaggcatcctccaagaagggtacggggctgctagaggttccataactgcccgtcctcgccaagggtgggcccggtgttcccaccaggctctccttccggcggggtgagagggagttggcccgaggaagctgggaaaggaggggcctgagaggccggccccagacacacgccctccggggctggagatgccacccctatatttgggctccaggattccttcttgccttgtgagcttttctgacctccacctgggggtaggcgggcctgagaaatttcatagaacacagagggcccaaggagcaatctgcctgtgactccgtgactccatgcctttccccatcactccagggttcaactcggtggccaccgccaggatcttttacaagctgatgctgcggctgggttccaggaattctacattcaaggaggggactgggggtccctgatctgcactaatatggccagctggtgcccaggtgaggtcactgttggggtggtgtgtgtgtgtgtgtgtgtgtgtggtgtgtgtgtcctctaagaagtggacctgtgtgcagggtgggccaaggaccccccagggagaggagggagtgtgacctgtcactcagcagtgcctgaggcacgttgacttggatcctctgtctgtaacccagggttgcggctctgggtcaggttcccaggcagagaaggcctgtgatggaggggaaggtcaggcattagacctctctgctggaccaagctctgggacagccctgagagaactccccagaaactgtatttttcccccaacctcccttctccaactcccatggcctcccagtggggccagtgctgaaagaggctggctctgtgctcgctcctcagccctgaggcctttcctccgccatctctcctctctccctgtccttgacaccagcccagcctcaccccggccctctctctgccttcagccacgtgaaaggcctgcacttgaacatggctttggttttaagcacttctctaccctgaccctcctcctgggacagcgtttcgggaggtttcttggcctcactagagggatgtggagctgctgtaccccgtcaaggagaaggtattctacagcctgatgaggagagcggctacatgcacatccagtgcaccaagcctgacaccgtaggtgagtgtgctcagggtcctcgcccactgccggctccactggggcagggagacacccgcggggtaacctcaccccccaccccaatgctgcccacagaaggaagcctcttgtaaggacctcccagctctttagtctttaaactgcattttcccatagaatcaagaggatggaccctcagcagattcccaggcaatttagcaactctgtttagccgactcagtattcatagtggctttcacccctgatctccacccctgagtctatatcctacactgagaagcagagggatggagggggtgaggtaggaggatcctgggagtgggcagctctggggctgcaggggagaggggagagggtgccctggggcctggggaagaggttcccaggcagtgagggagggcccagcaaccatgtctgccaccagggtctgttaaaggacaatactttttcaaaaaggtaaatttataaaggaaccagtaaaattttaaaagaaacaattcaaagacaaataagaacactgaaattaatttgctaacagacacaaacttgtcaacatccacagagtaatatcaattaaatctccatgggacaaaattcatttgccctatgaacaagagtcattcgcattaccctcagttctttacaattcacagaactgtaaaaagctcaatgacaaggaaagatgggacccctgtagcatcacgtcagtccggaaggtctgcaggtaactccctagatcttgtccagaagacacccaggaattgtcttgcccatctcaaagtcttcatagttttcatggcaaacccatgcccacacacacgaggcagctcataatcataaaatggcactttataaaagtcagcatttttctctgattataaaatacatgttgtcaaaaacttaaaaatgcaaaaagtacaaaacattaaagacaatctcatataacctcttctccctcccacatcccctctccttcaaaagaacttgtgaacattttggtgagaattttcacaagtgagtacgtccatatcaccaacatggccccaacactccagatgcccctcggggttctctccaggtaccacgctctgacttctgactgagatggttttgattgtgcctgtttaagtcctataatagaatcacagagtatatacccttgagtctggcttcttttgctcaatattatgtttggagattcatttatgccattgtcccagctttatttatttattttttctcaagacccagtcggctctgttgcccagggtagagtgcagtggtgtgatctcagctcactgcaacctccgcccccaggttcaagcaattctcctgcctcagcctcccaagtagctgggattacaggcacctccaccatgcctggctaatgttttgtatttttagtagagacggggttttaccatgttggcaggctggtctcgaactcctgacctcaggtgatccacccgcctcggcctcccaaagtgctggattacaggtgtgagccaccgcacccagcctgtcccactgtcccagcctttttttttttttttttgagacagagtcttgctctgttgcccaggctagagtgcagtggtacgatctcgctcactgcaacctccacctcccgggttcaagcaatttgcctgcctcagcctcccaagtactgggattacaggcatgcaccaccatgccctgctaatttttttgtatttttaatagagaggggtttcaccatgtcagccaggatagtctcgaactccttaccgcaggtgatccaccttctcaccctcccaaagtgctgggattacaggcatgagccaatgcccccagcctgttccagcatttttaatgactgtacagtattttggcttatgagtatatcaatatttgtaactgatccctattttagacttttttaggtggcttctcatttttcatgaatcagagcacatagactgaaaaccccgcctttttaaaaacagcacttctcattgggaccccaccaaatgcagaggcgaggcccttcagtttgaaggaagctgagcaggcagtgtgccaggccctgggagacagtggaaggtatcgtccctgtttatcagatgaggatgccgaggcagagttaaggaagcgaggcagtgagcacccaggagttaaggcaggcctgtgctcgaacgtggcttcctgcacacagcccgccctctgcggccagtgccacacatcacacctgaagctccagctctctggtccccaggctgagtctctcccttgctccccgctccccgccaggctctgctctgaatgactctcctgtggtctggctgcctatattctagagaagttttccacctggaccaatacggaattccgatactggaggatggaggcctggaaaggtgaggccctggtttgcccctgcagtcatgaccctggcccagcagccaacctcctcaccctcttcatccccttgtctggttgctctgcatggggcatcagcaaattctattgttggctttcttacaaatcctcaccctgtgaccaacgtagctgcttttttgggtgaggtggcctggtgggttgttcccagcctcacagtgcatggtcaagactggatgcaggctcacctgcttgtgctccttttgctgaacaggcccctctggggattaggggcccacagggcagcaggcaccacattattgtcaagagcacctgggcttttcctcctgatccctggagagcctggcatcagggtcacgtgactgcgtgttccaggagggtggtcgcagaagacaggaggctgttaatctctcagagccttagaggctgtatcctctacatgcctgactccagctctgtggcctgactcaggcttcaccaaggtcagctctgacccaccctttccaggcccatccctttattccttcagtgacacacaggaccagacagtgctggggatgggaaagaagtaaaatgagactgaatcctgccttgggggtagggactctgtcttggccatgctgtagcccatcacctagaacaatgccgggtgaacagtgggagagcccagtacatagatgttgaagaatgcgcaaaggactgtgagagtccagtggaaggaggattctttgtctaagcggcagaaggggaaatgaccaggagaatgtatctgatttgggccttggaggataagtaggagtttgtggatggaggagagaaacttaggcaaagagaaaagcaataaaaatgcaaggaaagggtgttggaaagggtggcttgtccagaggctgaagcaggtacactggggccagatcaaaagcaactcattcctgcaggcaggtcctcacctcctccaagagcctcagcagggccttcgtctggatctgtttcccctgccctacattcagcaggacacaggggttgatggagcttctgcaagccaccttggcagggggtctggcctgctccttgcacacggatacctggagcaagatgtgagccccaccagactatcccactaggccactcctgcagctctggccccgggttacagggagaccaaatccctgagcaggaggtagacaggatcagatctgtgttctagaaagaacaggaaacactagggtggaaatggtggtcgtggtcgttttcaagctgcgggcagagccgaaaggggatggaagcacttggccaacttgcagaaatccagttcacagaggtgatgtgtatactggactagttttcattgaccagttttcattttgccaccaaaatcacattgaaaaggctgttcctttatctctgtccctgctccctgctgctgttgctagagattcagggtttgagtgaggaggtagggttgggagggcgtgctctggggaaagtggaaggtggggtgggggctgtggagttgcatcctggacccaagctggctaggtttggattctccacttaataagtaaaatggagaaatagtacctatgtcccataggctgttgagaggaaaacatgaattaaaagaaggtaagggcttagaacatgctgcctggtatgtggtcaccacagtagctggtgccctgagcagtttccggtgcaggggttgaggggagggaggagaggtcagtggcaggagagaggggacaggtgttagaggcaaggtgggtggggggaggaccttggggtgataagagacacttcaactaaatcatgcgctccagtctagtgccctgggcgcagcctgcctgtgacacgaggataccacacacttgcatgaggtctgaggagggaagccgcatgggcagggcctggcatttgtaggactttcggctgccctttgtcacacaactgcatgtggcactgagagtggggctttgtgttctgcgtcccaggaagttctccctggacgacctgctgaccaacgtcatgctctactggacaacaggaccatcatctcctcccagcgcttctacaaggagaacctgggacagggctggatgacccaaagcatgagcggtgagcctggctgagccgagaacaggggcctctgaggctggaggcaggggacggccagtcttgggctccacgaagggcacttggtggtgggataagtatagccttgctgcaggtgccccaggggcccttggatgggaacactaaaggtcgaggtgtttggagaaagcctcatggagggaccaggtgcctggctcccgggcggccctcagtaccgctccccagtctggatgctggtctggagtggcactgatggttctgggatttccaagtctcacatggaaacctcaaaggtggggatttagaggctgtcccatgcccctgcctgggtggccctcccagaaaaagaaggccctcagtgaggggagagcggttgagaccctggatttgtccttttctttatggtccttgtgggtgggccagctgatctcacccccaggcgctttaaccccctgctgtgcaggcggaggggcgcagggccacagcctcacccctccgtcggctctttcacttccaggatgaagtctatgtgcccactggcttctctgccttcccttttgagctattgcacacgcctgaaaatgggtgaggttcaagtacccaaagctcatctcctattcctacatggttcgtgggggccatttgcggcctttgaggagccggagctgctcgcccaggacatccgcaagttcctgtcggtctggagcggcaatgacccacccctctccccccgcctgccacctccccccacaagtgcccccaggcttttcttggggaagataccccttttctgaggaatgagtttgcctccgtcccctcccatgctgggagcccacgctcaccccctcacccctccaagctcactccccaacccccactccgtgtggtaagcaacatggctttgatgataaacgactttactctaaaagcggctggactcagtgacatgagcgtgcgctgaccccacatggggccccctgtgcaagcagagctggcggcccctccttgctggcagaggcacgggaggcctgctggggatgaggccactggccaggctatgctgcaccagaccaatggcaccgcccccacccctcccagcgcaggggcagcttgagcagaggcagcactggccaccactgcgggggcaagtcagcgtcaagagagtccctgaggagaaggcccagataagcccaggccccccaggccagcggacaggcacaggcagggcctaagaggtgccaaggccccaggccagttgtgctaggagcctggacctgctcttccacaccccatcccgcccctactgcacaggcttgtgccttggtgccccctggaggcagcagggaggagcttctcaggcagaagtcttaagttgcatcccattccccagaatccccaggagggagaaagggatgggctgcccctccttcctgccagagccacagctcaagggcagtgggatggcccgcacccagcccaggtaccccttcctctgtgccgaccatgctgtcctttggctccgaggagccctgagcactgcccacccccacaccttggagggagcagacggagggggtgagtactgacagagcctgcctggaggtgcagactcatgcactcagccctgaagaggtgagagaggctgatcttaactgtggtccaatgggcatattatgagtggtccttgtccctgcctgctatgggtaaccctgacccagctagcgtccctgacaacatgatacaaaaacacagaactctagcggatacagagatgtgtgcacagctggcaggagcactggccacctcccaacctgttccccaagcttactcctggatgtagcctggagggactgctgggctggggagggactggccatggacagggagctggatgccagcgggacctcagacctggactgcagcatctctttggttatcgttgtgtgtgtgctcagaagggaggaggccttccccttgttacatctctctctccatatatctcccggactcatcagtttggggggcgaaaagtccaccacatggtcttggcgacaaacactggggatgtcaccccagctgcagagctggaagcttgtgccggaggggaaactgggtggcaagggaggggcgaggcctgcctgtgctctcctcaccactgctgggaccagaaaagatggcacctgatagctcagctgggcagtcccaacgcattcccactcagccaagggcctgagcccaggccattctggttgtgtcttttcagagcagtgagacctaaaacagatgggaagaatcatgaacttgggagtcaggccgcttcacctgtcttctcaccccacaggctcccctgagctggcccagccagcagctcacccagcctcaggcctcctggggggcagcagccacactgccgtggcgctctgcgccaagcactgtccagggatagtcccgctgatgttgtggatggcacataggtctgctgctgctgctgctgcggagacagtgctgtcctctccgaggccaagccgtcagaatccgaggcacgtagggctgtcagcaaatggatttgtgcttggcctggacaggcagagcttccacactgcatccctcccctcctgcccttctcccaacaggacacagacagtggcataaaggacatatgaagaaacaccgacatccatttaggacattaagaccgaaaatatgcacctgcagaatttcctagcagccagggcaaaagagaaagcacagttatacagttctcagatcacagaaggaagcacaagagagcagttctcagaggaaactaaacttcctagccctgatcctaggaggatttctcactttgtagaagaaacaagtctacctatataggggggcttaaacgctgccctgggacccctgggatgctcaacatatctgtgtgagtctcattttgagtccatttcctcccaatcccaggctccagccactgaccccaggcacagagccctgccatactctcctgagaccctggctgtgagggcttgacatcatccacctgtcctgcatgttccctgctggccagcatagccacaggtgtgtcgctgggtaatgagtccttctgaggccctcccttgttggaacttgtccaaggacagacaccgataagagagcctgacacctgggaggcagccacagaaagaaccctgcagatgaggtcggctctgtcctggccacggctgtcaggaaggctgggactacagctctggaaccctggggctctgctttcccttcccagccccaccctaggagcagaccctggaggctgtgtgcagagagaactaggaaggcaaggagccctgtgtctctctacatggggtcttcctctgaagcaggtgcaatgttcatttcttgaattcaaagggaagtctgctgacaccctcttggagcctagtggaggacctcgcacaggcaggtgcatcgctgatgacaacctttgtcaaaccctagcgccttaccatgtgccttcactaaagccccaaactcaccagcattaaatatgcagagaaggaaagagagcagggaactgaaaccaagggggatggccataatcgagacaagactctatctcctcaacagtttcaaatatgcaggttaaaatacccaggggaccaggattccttctctgccattaattcacaaacttgcctgccatgtgatcttagcagagatgatcaaagatttgccggggcccatctggttgggactgttacaaccaaagcaaaaaaagggcgacaagctcagaggctgaggggcacagcttactgtgaacggtgggggcatgtggcctctgcctcacttcctttgtcacttgcaggctcttctgtctgcagataacagcaaaacttgcgatgataaacaaaactgatctctgtgaacgaacaccctccaaacacacagactttaacacccggaataatagtaccagctggcaccaagctccccagcagcccgagagaggaggggtgggggagtgcagggatgaggggaggaagggaagctacacatggcacccaaccaccacgcctttcccatggagaagcagaatctggagaaggctgctgctgtgttgatacagacagggtgggcggggttgacagcgagcccgtcccaccatctgttcctcccagggcttgaccggcagtggggtcgggggcctttactttgtagttcagagggctgaggtgcttgaagcatcaaagcaggtgtgagccaggcagaccaggatggtgagcagcagcaccaggaaggtgaacaagtggcgggggccttcatacctggtgatagagggtggctagccttggggtgggcagggagggccaccacctaccctcaccctgctgaggaaggggccgcacctggtgtggaaactgccgtgacttctccctcaggcagaaaataaaggcaaggcctaaccccccacccccacccctcactccagcagcaaggatggtgtcttcacagccaggaacacacagagggacccactgaatactggcatcatccctggtcagatttcaggcactggggtgccaagtcaatggcaattcttagcctccttgctggtccgttccctccagtctccagtgccctgggctagagaggatggacctcccacacccccagtctgaccggggcagacgtgtctttcccccaggagtgtcagtttttctcctccacgtccccacctcttccatgccaggaggtacaaggagctgggcccaaccacagcctcaaagggcaaatctggatcagcttccccatttcctctggttcagtccctgcacactgataaaggcactatcttctctccagggatgtatgggacaattgaccaggccttcacagggttacacctgcactcgggctagcttaggagccaggctgtcaacaccacacccaaccacccctcaccctgggtatcatgttttgattggacacctaaccagtcctcactctgggcacacattctgactagacatgtaaccaaccctcattctgggtaccacgttctgatgggacactaaccagccctcactctgggcaccacattctgactggatgccatgctgatgctgtgaaacaatgagggatctgactggctggtggggatgcagggctgggaggccaagggctggccccggtcagaagggctgctcacccaggcgcaggaaggaaaagaagtagagccagaagaggcaaggatgggggctgccaaggcctggttcacagcggcaaagtggatccccttctccagcttgctgggaggtagacgaagtagaggttgtgccggtccaccatgtgcttgagcaggatgtaatgaggcctgcaggggatggggctgtgagctggagacctcgcagggccacacagacaccctgtcctcttcctctccggggcggctattttggcaaggagccagggctggggctgctgcctactgcctgaacacaaaatgaggcatcctgcacctctggctactagttttttttcacttctctctcctacccacttcctcacttatctgtgaccccaaggtgtaggggatcggtcaggtggtgggagaaaatttaagataaagttataggaaatagacacaaaccttcttggaaagcgagaggtttgcatagcttcagtaaagggtttggctgaaggcagctgaattctcttaaagcttagggtgcagatacataggaatgtgggggagtttacctaaatagcttgtttactcagtggtcctaagaccaacctttgatcatccactggtgcatgattgctcgctattcaggggtcggcaatgttaattaccctctagtggtgtttactcgagacctttgtcatttagtctgtctaaataaatgcgaacttcgcctggcattgaggactacactgcagactcaggctgcagaccccttagccgcactgacaggcaaaatatctgtcagtgtatgtctgtctgtctgttttttgagacagagtctctgttgcccaggctggagtgcagtggtgcgatctcggctcactgcagctccgcctcctgggttcatgccattcttctgcctcagcctctcaagtagctgggactagggcgcctgacaccatgcccggctaattttttatatttttagtagagatagggtttcacatgttaaccaggatggtctcgatctcctgacctcgtgatccgcccacctttgcctcccaagtgctgggattacaggcgagagccaccgcacccggcagtgtatgtctttcatccgtcgtgggtcagggtctgtgggacagaccctgcaccaagggagtcacagtgtctgtgatcctgccccacagaacactaacattccagaatcatcttggaaagaggctgtttcacagttggatcctggcctcaattcctccccagcccttcccatgctgagcccctgtatgtcagtgctccccacccctggccttctcccacccggctgatccctgccctcatcacagtcaacagagaatgggcccaagggtcttaccccaggggtggcacaggagcacacaggggaccaacagaaagtggtgctgccttttctattatgccaggttcttttgtttttttattttttattttttttgagtggagtctcgctcattggtcaggctggagtgcactggtgcaatcttggctcactgcaactctgcctcctgagttcaagtgattctcctacctcagcctcccgagtagctgggattacagcgcctgccaccatgcccagttaatttttgtatttttagtagggacagggtttcatcatttggccaggttgttcttgaacttttgacctcaggtgatgcactgcctaggcctcccaaatgctgggattacaggcataagccatcgtgcccagccccaggttcttttttaaaaaataattttgttttgaaagtgtaaatactgtagatttttaaaactacacaagaaagtatacaggaaaactaaaacaacttttccccctaaaactcagctatcactgccagcagtctcttgggtttttgtttccttctagagcctttcattaatctgccagttgcagatgttttatttcagtgccaggaccttggtctttaaacagtcctgagttcaaaggctggttctcctgcttactaacacatacgaagttattttgtgtgaagggggaatagaaacaggaactgccttgtaggatgagtgagaaatgtggtaatccacgtggaggcaggcatctgccagagtgaaagcagcacgaggctttgattgtgactctggcactgtcttacttgctgctaaagaaatcaaccatgaacgaatagtcagtgggcagagaacctcagaccagaaatactaagagaggtcctagctgagggcagtgggaggaattcatttaaaaatga
